United States Patent 9,328,346 (POLYCOMB-ASSOCIATED NON-CODING RNAS) - sequence listing, part 9

SEQ ID NO: 1191 - RNA, 103284 nt, Mus musculus
cagcggcggcggcggcgcuggugcgggcgaguucggcgggugcaggucccggccugcgccugcggagggcucaggcagagggucgaagcgagcggcgcucgcgacagacugcgcuccgcgauggugggcgucccuggagcggccgccuuccaacguaaguggggcgggaaggcggacggcugagggguguguguugaggggccugcugcuccauaggcgggaggcuuugcagaggccccccggcgggaggccugggcagggaaacugaggccgggauuggggcacuggauccaaggucaugcggcuccccggccuuccggggcccucggggcuaucccggcgcuuccuguggggcucgcggcuccgggugcugagcaggacuguguggagcggccuuggagcucaggccuggcgggcgcccuauggacuguccgcgagagaaguauuguuuuguuuucgcggcaucggggcugaaaguccggucccgggaaacacgccggaauuggagcgacgagugguagauguuggaggaugccgggcugauauuccggagggcccuguugaauguaggcucuggggucggacugcuuuggguucauguccuggcucccucgcgaguaggcugugaccuuggcgcuccaaaagucucaguugcucgaucugaaaaauggguugugaggaacguacucugaaugcucuguaguaggguuuagugaauccaguaaaauccccugaacacacaguugcacaucauacucaagugugaaaacucacuaucguaaucacaguuuguuauguguguuccucggaaaaguccgaaguuggcgucugguuguguuuuguuaguuuguuuaauauugucuuugacuaguccuacuaugugacucaguuguguuuuuauucuuaccuccauuucgcuaucccauuuacagacguucuuccuagaauuguaagauccuuggaggagggauggcaucguuuaauaagaacaauaaaaauuuaauugucauuaaaauagcaguaauagccaacauuacuugagcaccaggcaauuugcauucgauucauuuaauauuuauuaaaucaucuaaauacaaauuaucacucuaaguccagagacuauggcaacaaacuugacagacuagauucugaauuugaguuuaagagagggacucgugcuuuguggauauuucuuugucuaugccaggugacagucuaaaaacagguauuugaggcacguuggaggcugaguuugaggucagccugaucuauacaggccagccaggguuacauuguggcacccugccccaaacaaaacaaaauaacaaaaacaacaacaaaacccuaaaaauaaaacaaaaaaaugaauaaaagcuaacaucagguguugcaggauguccguugugcaaggauaaaaugaggccucuugagagcuuuuagccccuccccucuuugcucuucaguucagcaguuauagcggaggauucauacagccuuuuucuugggcucucauuccaaauugaauggaaaaagauacaaacuagauuuucccaccaaugccuucuguaguuaagugugcuguugcugcucucaauggucuucugaagggagacaaguaacccuuagguuugaugguaucauauauaagaaaaguggaagagaggcgcucgccuuuaaucccagcacucuggaggcagaggcaggcggauuucugaguuccaggccagccugguuuacacagugagcuccaggacagccagggcuauacagagaaacccugucucaaaaaaccaaaaaacaacaacaacaacgaaacaaacagaagaaaaguggaagaaacuuuuacccgaauuuaaauucauuuacuuaaagcaguauuggggauugcacucagggccuugugcuuuauguaccaugcugaucuguauccccagcccuuuuuauuuucagacaaaguugcccaggcaacuuguaauucugucucagcuucucaguagcuaaaaauacaggccugugucacuagguccagaugaacuaacacauuuuuauuuccaugucuuuuauguuuucaguuaaauauauucccaaaaaguugaguauggugaaagcuuguguaauuccagcacucaggaggcugaggcaggagaauaugaguuugaggccagccuaaguuauguagugagacugucuggaaaaaacaaaagccaagaaguaggacuuugugguuuguuauguaacuaaguuucuuugcaaaaguuaguauauagugguuuaauaugcugaaggccuauaggugcuagguagguacuuuuucuuuuucuuuccucugugcagccuuagcuguccuggccacucuguagaccuuaaacucagauugaccugccucugccucugccucugccucccaguguuaguuuuaaaggugugugccaucaccuaggcagguacuuauaacugaaaacuacaaaguucuccuuaaaaaacucaaaaagucucucugggccuccauuuuuggggguggggggaagacauggguucacuguguagcccuggcuguccuggaacucacuguguagaccaggcugaccuagaacucacagagaucugcuuaccucugccuaauuagaacuaguuccaggacagccugggcuacacaaagaaaccuugucucaaacaaacaacccccccccgcccccccccaaaccaaaccaaaucacagaaaagauaggauuuuacucuguccucaucuugggcaggccagucccaccaccuccuuguugggcuccucagagcuagggugauaaaggcaugugucauuuucagugauuucagaagcuuaccuacacucuuucuuuuuuuuuuuuuuuuucuucgagacaggguuucucuguaauagccuuggcuguccuggaacucgacauguagacuagucuggccuugaacuugucuugauccucuagcuucugucuccugaguucugggauuacaagcaugcaaucuguguagcauguuucucuguguagcucuggcaguccuggaacucagagaucugcugucucugcuuccagagugcuggaauuaaagaccuucaacaauacccuggcucauuugcaaucucauucugauuagugugaccuguaaaauguuuuaacagugcuugucacacuguucagguaauguuagucgcugaagauagaaaggugacgcuggagcucacauuucauggggguacugcauagauaaauggggaguggaaguuaaagugcuuaauugggggggauuuauuuuauuuuuauggcagaagugggauauauggguuuaauagaguggcaguaaguuuugucuggguugugccugggaagugcugcauugcaagaaaguucuagaguucaacaggcucagcucacucguagguauuccuucauuuguccacuuaccuaagagugcaaacuugcagaccaagauccuugagcaagguaacuguggcauucguaaaguggcaaaagguuuaugcauuagugacccucaaaaggagccuauaauauguuagguaauacagauauuuuuacaguaggcugguccugugcacucauuacuauaaauagcuguaagaauuguucucuuaaggaacuucuccuuauguggcacauagcuauuaggaugaugaagagaaaugaacaccuaagugccuucuguuugcuucucuugcuccacuccuguuucucauccuauucucugguugacuuaguuacuugaacuguaucuguggacuucuuuccccucugaaaugaucaaauuauuucccugcuccuuuuuauuuggauugcuccuagcugacuggguuauccuaaacuccuccuuuaguguagccugugcugauuuccaccccagauccuccagucuuccuacagcucuagugcuaagauuaagagcaugagcccccaugccuguacaggauugcuauaaauuaccuuagagaugaacuggggaaaaggcaauauuaguuuaauagcacacaccuguaaccuagcauuuggcagguugagucaggagacuuauuacaaguuccaagacagccugggcaguaucaaaaaaacaaaaaaagguggguauuaaauaguaacucuuagcuggacuugguggcacaugccucaaaucccagcucuugauaggcagaggcagguggaucucuugaguuugaggccagaacagccaggacuacacagagaaacccuaucugaaaaauaaaaaaauaagauuugacucuugcugggcauugugguaacaugcuuguaaucuuacuuuuugggaggcuaagguaggugauuaugaagcugacugggcugaauagugagacuuucuuaagaugggagaaagcaagcaagcaaacaaaaggacuuugagucucccuucuguuuugcauuguuauaaucaaaugcagaaaucaaagaaaauucggagugaccaauguaaaauucugaauuuauagcucuggaguuggcagacuuuuaaauuaaauuaguugauggcaccaacuauguaaucuaaccucuccagcagcucaaugaaauguuacuaccuggcaucacacacauuccuugauacacacaaaacuuugaccuuuucucuuuuacaaauguuugccucauucuuuuguuaauuuugaucaucauguagcgguccugccugcuuuuaauuuuucaaaaccacaugagagcaaauauucacauaacacagauuuauucauuuaggucucauauccuuagaguaacaauaaacacacccucauuuuccuggaauucacaacacuccugaccacugucacccccuaucccauaaaagcuaauaggccccugcuauuuuuuuuucuuuuucuuucuuuuuuuuuucuuuuuuuaaaaaaagauuuauuuauguugugucuaggaauacauuguugcuaucuucaaacacaccagaagggggcaucagaucccauuacagaugguugugagccucaaugugguugcugggaauugaacucaggaccucuggaagaccagccagugcuuuuaaccgcugagccaucucuccagccccccugcucuuuuucuuuuucuuuuuucuuuuucuuuuccuuuucucuuuucuuuucuuuucuuuucucuucucuucuuuucuuuucuuuucuuuucuuuccuuccuuccuggauuuauuuauuauuauaucuaaauacacuguagcugaccuuagacacaccagaagaggcaucagaucucauuauggaugguugugagccaccaugugguugcugggauuugaacucaggaccuuuggaacagcagucaguucucguaaccccugagccccuagugcuauuuuucuauacuauaaaaacgugacaagguuuuuuuuuuuuuuuuuuuuuuuggagacaggguuucucuguguagcccuggcuguccuggaacucucucuguagaccaggcuggccuugaacucagaaaucugccugccucugccucugccucccaagugcugggauuuacugagcugcaucuuguuucccucuuuauuuuuuacuguuuuaaaaagguuugaugaggggcuggacaucuuaguaguuguuucucuugcagaggaccuagguuugguucccagcagccaacuuggcaguuaauuucagggagucuuguccaucuuuuucuagcuuugguagacaccgcacaugugaugcacaaauauacauggcaaacagaauacccauauauguaauuaagcgcccccuccgaguacuauuggauauucauccaaacccaguccucauguaacaguaaaaagccaggcauggugguaaauaccuguuacaccagcacaaggaggugagacaggcagauuuuggggucuugcucaucaguuuggccaaaacuuaagcucuagguccaguagagagaccccugucucaaaaaaugaggugauuggaagaagaaaccaagcauugaucugguuuucucacauucauguacagguaguugagcacauaaaccauacacacaugcacacaaagauacuuuggaaagagaaaagaagauggggauguuacuugacagaauacuuaaagaauuuuuuuuaaaucacgugacaguugaguaaaaaucugaaggaguuagcuaagcuggcuaugugcacaucuuggagaugagcaguauaacgaagaaaauaucaaauaucagggccaugaggugggaacaugccuuguaguuucacagagaaggcauaaaguuaguuuggcugaaguacagguuagugguagaacuggggcauuggauaugguccuaauaaauaauaaaggguguuagcaagaauauuagcuuuucugaaggagauaggaaaccauugcaggcagggaucuugaggagcaacaucuuucugucagugcuuaacuuaccaagcucuaaccuuaacuguacauauaaauaaacacacacauacuuacucauuguggugcuaggggccaaacuuagggcuuuagagccagaucuucacuuucuuuccuuuuuuuuuuuuuuaaagauuuauuuauuuaauguauaugaguacacuguagcuguacagaugguucagaugguugugagccaucauaugguugcugggaauugaacucagaaccccugcucgcucugacccaaagauuuauuuguuauauauguaaguaaacugcagcugucaucagacacaucagaagaaggugucagaucucaucacagaugguugugagccaccauguggccgcugggacccgaucuuaggacccugggaagagcagucagugcucccaacugcugagccaucucgccaaccccacauuauucacguucuuauuuuaggugauugguuaguuagagccagaguuuuauucuggaguacaccaucugauauagcagcuuuucuccuuuagucuuucaagugcugguauaggagacagcaacugggcccugcuuaucuuaguuuuuugguuuuuuuguuuguuuuauguguaugguguguuuagucuguguguaugucuaccuguguguguguagggugcagaagcuggugucugaucuuuuaggacuggaauuacagauaguugaguugugaacuaccauuugggugcuggaaaccaaccucggucuucugagagaacagccaguacucuugauagcugagcugucucuccgccauuuguucuuguuucuuucuacagugcuggaaggucuuaguuuguuagguaaguauucuaugacugaacuauaaccccagaaccaucuucuuuugagacaggaccuuccuguguaucccaagcuagccuggaaacuggcugugucaacuaggcuggcuucuaaguucaaugagcuucccacuucuuucuccuagguauuaggguuacaacuguguaccacccucucaggcuuuauuuuaguuuuugagacaagcucucacucugaucugagcuggucuccuguuuguagacucaguuauucucagauucccaaauacugguauuguggguauacacuaaugugcauagcuucugauuguauuuguauuacuguuuguauuucuuugaguuuuuuuuucccccaagacaagguuuuuccauguagcucugguuguccuagaacuugcuuuguaaaaaacaggcuggcuucaaauucauggagaucugacuguuucugccuccugagugcugggauuaaauguguguaccacugugcccagguuuuuuuuguuuguuuuguuuuuuguuuuguuuaguuuuuugaggcaggguuucucuguauagcccuggcuguccuggaacucacuuuguagaccaggcuggccuccaacucagaaaucugccugccucugccucccuagugcugggauuaaaggcgugugccaccacgcccauuuuuuuuuuuuaaagaucuauucauuuaguguauaugaguacacuauagcuguacuagaugguugugagccaucaugugguugcugggaauugacuucagaaccucugcuugcucuagccccuguuggcuccagcccaaagauauauauauccagaacuacuggaccaucucuccagcauacccagguuguuuuuguuuguuuuuuuuuuuuuaacuaauuagaaaacuauaaaaauuguacaugcuauuugggugacauguuuugauaugguuuacacugaaagagaucauuuuauuucuggagcaaacauuuuguuaauugaagguggaaccugagauacaaaauaagaaguugcugauuuaguuagagaagguuucugguuuggaccaugucuuuauuaggguuuccauugcuguaaagagacaugaccaaggcaucucuuaugaaggacauuuaauuggggcuagcuuacugguucugagguucaguucuuuaucaucauuuccugaaaaauggcagcauccuggcaggcauggcauuggaggagcaggagcugagaguucuacaucuuguucugacaauuaggagaagacuuuuuuccaggcaguuaggaggagggucucaaagcccaugcccauacccauagugacacauuuacuccaacagggccacucccuaggccaagcauauucaaaccaccacagaccagaauauuuauuaacaguggauguagaaacaguugcauucacaucuaucuaucuuuuuugggggggaggggggugacugggaauauuuugaagguagaguuaggugucaugcuucccucugcccauuuuauuuauuguuguguauauuaugauguaaaggcuccugagacacagugugcuuauggaggacagagaaugauggggaaagcuguuucuguccuaugauucgaguccaggggauccacucagggccucagguuuggcaguaagaaagugccuuuacaggugaacugucuuguugggcuacucuucugcuuuuuugggggguggggguggggguuugagacaggguuucucuguguagcccuggauguccuggaacucagaaauccgccugccucugccucccaagugcugggauuaaaggcguacgccaccaccacccugcucuucugcucuuuuaauuuuaaauaauggaggugucaacuauguugaaagcuuauuuuucuuacauuuaaaaagcuuacuuuucuuacauuuaaaaauuggacuuuuuuguuauaugcauuuugccugggauuuaaggugugagccauuauuuaaagauagguucuucuagcccaggcuggcuuugaacucccuauuaucugaagauggucuugaacuccucaaccuucugcuuuagugcaagcuuuauaagagugugccagaugcugccacacccagcuuaaaguugccaauauuugauugugaacugggacagggacacaggggaagucaaggcaauguuaggauuauugauuaagguuacuauuuaauucuuacggaauacuugaguaggcguggguaggauuacauuucacuacugauuuccuuaaagugaagauagcguucguuucagagaaagcugcaaaugcucuauaauaaacuaagauaguuaugugguugacugcuucaugaauuuaccaaacaacauuuccauaguucauuuuggaguuacuugcaucuuguugaauuaccuguuaccugugguuuucauuagcaguagaaaaaguaaacaaugaacccaugaaguucuguaaguagccacaacucuucuggaaguguaagucagucccuuucugccauuugacacaggaagaaaagugucaggaagggaagucuucccaggggcuggaaagauggcucaacaguuaagugcuugcugcucuuccagaggauggaaguuugguucuuaguaccuaucuuugagguugacagccaccuuuaacuauagcuccaauacuuuguucuguccuccaggggcacuuguauacacaugccauauacucucucacacaaaacacaaaugaaacacaaacauaaacaugaaaaaaguaaaacaacccgugccaguuuuauguuaucgcugaucaccaguaauuaauugaacuuuggcuaaauauuugauauuacagaacauauaacaucuucaguguuuuuucuaacauggucaauaauuugauuuuguaauuguuaaugcugagagugaugcuucauguaauauacaaguacaaaauaccaaaaguguguuuaggccauugcagaaauugugucuuaggccagcacuugggaggaagaggcaggcagaucucuugaguucuagccuagccuggucuacaggacagcaaagauggcacagauaaauucugucuagaaggaggaaagaaaaaagagagagagacuuauuuuaauuugugagugugucuguuucuccaguguguauacauagaguugucagugcuggauccuguggaacuggaguaauuaggcaguuaugagccacccaaaauugugcagggaccugagcucugguccuggaagagaagcaguagggcucuuuuauuuuuuuauuuuauucuuuaacaauuuuuauuuggaauuaggaaaguggaauaagucugugcaagguguagagaucugugaaguggauuucauaucacacccucuuuuuuucuuuuuuaauauguacugcuucacuaauuuguaugucccaggaucaugcuaauuuucucugaauuguuccccuuuuaguaauaugcugcugaagugagcgcucucacauccugucuaacacaggcuuguuguuggaacauuagcucuagauuuucauagcugccuuccucucucugacagguuuuccuuucuagguucaaucuuguuaaagaaugucuuuucacagccuucuugcccucuauaaccauauagaugcauccugccacugucagagcggucauuaaauaguucuuguucuuugcagcauccaacaccucaaacuaaauagcuccaggauuuuuucuucuuucuuuuugaagauuuuugacaaagucaguguccucuugaugucuugggucuguguaauggcacuuuuguguuuguaaguguggauuggagcuuugggacuuuucuguggcuugguguaaaauucuuuuugguuuuuugagacaggguuucucuguguagcucuggcuguccuggaacucacuuuguagaccaggcuggccucgaacucagaaauccgccugccucugccucccaagugcugggauuaaaggcguacaccaccacgcccggcugguguaaaauucuugaucgucuucaaaucaguguuucugguaagccuuaagagacaaagaagcauuucuuuuuuguuuguuuguuauuuguuuuguuuuguuuuuuguuuguuuugaauuguuuuguuuugagacaggguuucucuguguagcccuggcuguccuggaacucacucuguagaccaggcuggccucgaucgaacucagaaaucugccugccucugccucccaagagcugggauuuaaggcgugcaccaccacggauugcgacuggcgaagcauuucuuuauaaccuagaacaacuuccugccacuaggugcaggccucugguucccuguggcuaccugcuccgcagauagcagcacccuacaauaaacugcugagugugccuuuugggaccugcccuccgaauuugauuuugaaguuuuggguguugcacauucagaaaucuacauugccaccucacauucaguuuugugacuuuauauggguuugugacaguuuaauuaauacacuggugacuguggcauaaaaccauaugucaucucaugcguuuuuaauuugcacaagaaaaaagucacuggcuggguauggaggggccuagauuuaaucucagaacucuaaucccagaauuacagcacuuggcaggcagaggcagguggguuucuuugaauuuaaggucagcccagucuucauaaugaaaucacaggaaggcugcauggugagguucugucucaaaaauaaauaaauaaauaaauaaauaaauaaauaaauaaauaaauaaaucacugauuuaauuuuagugguaauguacauaauuaaaaauaaaaagauguguuuuuucuuuagguaugugugugagucuguugguaugugcaugugagugaccugucugacaugggugcugggaaccaaacuuguccucuggaagagcaguaguucaguaguugagccauuucuccagccucuaaauuugccaguauugaugaaucuuuuaaaucuuuuuuaaguggguguguauaccacauguggagguuagagaacaacucugaguucucuccuaccaugugaguccaggggauugaaucuagguuaucaggcuugaugacaagcaucucuaccugcugagucaucuugcugguucuaugccuguccuuuguuuugugcuuuugagacaggguuucucuguggagccauggcuguccuggaacucacucuuuagaccaggcuggccuugaacucaucugcuuccugagaccugagauuaaagguguucaccaccacuacccagccuaugucuuacuuuucuuacuuaccuaccuuccuuccuuccuuccuuccuuccuuccuuccuuccuuccuuccuuccuuccucccccccuuucuuuuucucuuucauucauucauauuuauuuauuuauuuauuuguuuuuuucaaggcaggguuucucuguuuaguucuggaacuugcuuuguagaccaggcuagucuugcacucaaagaucuuuuugucucugccuccaagagugcugauacuaaacaugugcaccaucaccaucaaugucuggauucuucucuucucuucucuucucuucucuucucuucucuucucuucucuucucuucucucuuucuuucuuucuuucuuucuuucuaaauagagggccccuguguuggcagggucagaaguacgaagggucagcaccacucacuagugaguucugugguucucauacugccacugccuccacagcccucuuuuuuuuuuuuuuuaauuauuucaucuacacuguagcugucuucagacacaccagaagagggcaucagccuccauuacagauggugugagucaccaugugguugcugggaauugaacucaggaccucuggaagagcaguuaguguguucuuaaccacugaaccaccucuucagcccucauuuauuuauuuuuaagcaacaagguccauccggcuugcuuuacuuauuuauuuaaucaaucauucauucauucauucauucauucauucauucauucauucauuuauuuaaaaacaaugucugucuguauugcccugacuagcgcugauggcugcuauguagaccagguugaccauccaaaguuaauauagguaaauaaauaaaacucagggaucuauguuccuagcaucucccccccuuggauaucuuuauuguugcacuuugagauuauaguauuuguguuugagagguacaaagcuuuauuuuagugaugauuuuggucuuuguguagaaaaugaaaugcaaauacugauuuggacuuggugucuucacagcuguucuggcugcauggaauggauguacugaaccagguguuguacuugagcugugccaucugugggagcaggugggcaggcaggucucugucaucaggaaagcacagcuggggagacuuagaagaacuaauugcuugcucucccagcucuuucuaccugaaugcaguuuuaccuccacagauguauugauuaggauaugguuagcacacuaacagcaaaaaacgaacagaaauaaaaagguguauuauguguugaggcauugucugaugucuguugccuuggagcuaguauuguccugucucauucucucaaaaucuuggauugcagaguuauguuaucacauccugcuuuuaguaccuuuagauugauucugagaaagguaacuuagggguucauucauuuauuuauuuguauuaacuuuguauguguauauucauauaugugcuaaugucuuuggagaccagaggcagagcuguucacuuggauuugugagaauucccucccucauagacugggcuggcgaucaucagaucccagggaucugcauguccccaucuucugaaugcacacuagcuuuuuuguuuguuuguuuuuuguuuuguuuuuugagacaggguuucucuguauagcccuggcuguccuggaacucacuuuguagaccaggcuggccucgaacucagaaaucugccagccucugccuccagagagcugggauuaaaggcgugcgccaccacgcccggcucacacuagccuuuuauggugguguuaaaaaagaucaaaauggggcuggugaaguggcucgguggguuagagcacccgacugcucuuccgaagguccagaguucaaaucccagcaaccacaugguggcucacaaccauccuuaccgagaucugacucccucuucuggagugucugaagacagcuacaauguaauuacauauaguaaauaaguaaaucuuuuaaaaaaaaaagaucaaaaugguucuuauuuuauguugcaaauucuuuaucaauuaagccaucucuucagaaccguauuuauuuuuuuaaaaagggggauguuguggaggugugcuucuguguuugaggguucagaagauagagaauaucagguaucuugcuuguaucauguucuuuuucuuagucccuugagacauggucucucacuaaaucagagugaggcuggugacuggcaggccucagugguccuuccgucuuuguccucaacagcauggccacacccuguuuuguuuugauuuagggucugacuauguaguccugacaguccuagaacuugauaagcagacuaggcuggcuuccaucuugaagagauccaccugcuucugccucauagaagcuaggauuaaaggcggguguugcuggcacauauaugucuuuaaucccagcagucaggccagccuggucugcagagggaguuccaggacuacacagagagacccugucucagaaaacaaaacaaacucuaggaugaaaggccuguaacaucaugcccugcuuuuucucauuuuuaugcccucugaaucuuagguuacacugccaugagcaccaggggacuauaucuuucaguuguuuguauucuaacaguaaccuagcaaauaucucauaggagauuaaacuagucuugguugugucaguaacuuggucucaguguagaaauauguaaaguaacagcucaguaaaauuuugggauauuucuuuuuuucaguucuggggaucaaaucuagggcuuugucugucauuauucucccuugguuuguugggauuggaucuggucucacuguguagcucuagccagccugcuauuagccaugccgcuuaggcugccuuuuuuuuuuuuuuuuuuaauuuauauaauuuaugugcauggauguuuugguuguaugucaucaugugccugccugguguccuuagaguucagaagagaucccuugaauugggguuacagguaguugugagccaauaugugggugcuauuaagggaaccuggguccucuacuaugcuuuaacugcugagacuagauacguaguguuucauuauguggugacuggaggcccagagcugcugggaccaaguagucuuuguuuguuuguuuguuuuuugagacaggguuucucuguguagcccuggcuggccuggaacucagaaaucugccugccucugccuuccaaguggcugggauuagagguguguuccaccacugccuggcccgaguagucuuuucuguuucaugcucuuagaucugagccaccaugccuuuugucuuuuuuugggggggggguaaagauuuauuuauuuauuuuauguauaugaguacacuguagcuguacaaaugguugugagccuucaugugguugucaggaauugaacuuuaggaccucugcucgcugcugucuguccagcucacuccggucaacucaaacucacucagucccugcucgcuccaacccaaagguugguuuauuucuuucuuuuuuucuuucuuucuuuuuuuuuuuuuuaagauuuauuuauuauauguaaguacacuguagcugucuuucagacacuccagaugaguuacggaugguugcgagccaccaugugguugcugggauuugaacuccggaccugcucuuaccugcugagccaucucaccagcccauuuauugguuuuucgagacaggguuucucuguuuagcccuggcuguccuggaacucacucuguagaccaggcuggccucgaacucagaaauccgccugccucugccucccgagugcugggauuaaaggugugugccaccauaaccagcagguuuauguauuaucauaccuaaguacacuguagcugucuucagaugagccagaagagggcucaucugggugugagccaccaugugguugcugggauuugaacucaggaucucuggaagagcagucagugcucuuaccugcugagcuaucuggccaguccccgcuuuuugccuucuaaaaaguguuuauuuacucauuuauuuguuuauuuauuuauuacagguauggguauuuugcuuugcaugugugugucugugcaccacaugagugcaaugcccauaggggacagaagagggcauuggauccucuggaacuggagaugcagccgguguggguccuaggaagugucccuaacugcugaaaugcuauccagcuucuggaaucucuuguugguuuuagggaggaucuugaauucccuguccucuuugcugagucuccugugugcuggggugacaggugugcaauaggauaucuggcuuuauuauucauuauauuucccuccucucugucaauacuuuucauucuugccucaaaguuaugcccaucuuucugucucaguuuuccaaguauugggauuacagagguguaauccacaccugacuuaauguuguuuuuuccccauuggaaaugggcuuacauaauuguaguaguaaaugaauagucaaggacaagguaaaggacaaacagaaucacuuugcuuaucaugccacuuguuuguuugccuguuuauuuauuggucuuuccagacaggacuucuauguguagccuugccugucuuggaacucacucuagaucaggcuggguuugaacucacagaaauccaccugccucuuucucccuagcucuggaauuagagucaugcaugcaugccaauucaaaguuuaucaugccuaugcuugacccaguuguuagaaacauuauaccgggcagugguggcgcacgccuuuuaucccagcacuugggaggcagaggcaggcggauuucugaguucaaggccagccuggucuacagagugaguuccaggacagccaggacuacacagagacacccugucucgaaaaacaaacaaacaaacaaauuaaaaaaaaaaaaaaagaaagaaacaccauaaaaauuucuaugggccuuccaggaaaguaaagaauuuuguuuuauuuuguuuuguguuguuugacagggauucucuguauaguccuagaauucagaccugccugccucuccuaaguacuaaaagcacgaggcaccaugccugggugaaaguuguuguuguuaugugguugguuuggcuugguuugguuuuucacauuuaauaagaacaaaagguuugggguauagcucagucauugagcacuugauuaucuugggugcugacaccuugguucaguccuuagaacugcuucaaaaaagauaaaucaagaacagagguuuaaggacugauagggugcaauguucuaugaacacuuguuuggaaggaaaguaugauuuagcagucaaagauaagggaugaugggaaaugugugcaggcugauuggggccacaguugcagguuauagguaagcguuuuuuaaacaauggcaaguguugucauucaaaccagaaaacaucugagacuauuaacaguagaucuuuuucacuuuguauuugaggauuuugaaaagauuuuuauuuauuuauuuuuggacuauugccccauuauauaaauaacaucuugcagaucuacauuugaaacugcuucaauauuccuucugggccuuccuaaauaaugucuggaguuacauuggacuugguguguuccuguggggaacaaaagcacaugaucacugaagccuguagcauaaaugagaggcuugugcggguggugugaaaggcgcucucccagccucacaugccugggugggcaagcuaaacuaauaguucccagcaguucugaaucagacacuguggagccaagagucuagcauuuggaauuccacugccugugcuaagggccugucuuuuauccuccaaaccaccauuuguuaaauggcacuggaccuguugacaagaggggggagacuggcaaagaucaaguuaaaaggcaaaaaaaaguucaaagguaggaaaauaagaaggguuaguuaugucuucaccuccccuucccccaccccgucucugucucugucugucucucuaucucucucuguagcuguagcccuggcuggcuauuauagacccaggcuggccuggaacucagugauguccagcuugccucccgggguucaauggugugaguuacuacaccauguuuuuccuccucuucacuuauuuacuuauuuguuuaauuuuaguaauuuguuacaaagaaacuucauaucugaaagcuggguuugauugugcacucuuuaaucccagcacuugggaggcagaggcagguagaucuccuugaguucuaggcugguuuggucuacauagugaguuccagaacucuagagcuguguagagagacccugucuuccuuccuuccuuccuuccuuccuuccuuccuuccuuccucuuauuucugucucuuucuuuuuuuuuuuccuuuuuuuuuuugugggggugggggagagcugugaaucaaaucuaugagcaugcuauggaaaauucugaacacaaaaaauagaacaauguacugaaugcccgugaaccuauccgauagcugcagugaguggcaauucaugaagagaaacccgaacuuucagccuuggguuuggucuccauguugggucauguuaaauuugucaucagagcaccguguuuaggcuuuguaauaagugauaugucacuuaaacuuuccuuuggccaggggugggaagugggccugagagaggguaucucuguguacccuuggcuaccaaaaaacaaaaacaaaccccaauaaaaaacaucauuucaaagcauguuugaaccaaguuugauuuucagugagaggcuucacgaggcugugucugcaucauauguuuuaggugaaaugauccagagcagccuucacauuagcuucuauaacagcuggcaggagguggagagugugggcgggcacugugaguaguauaguguacguugaugagauagugacugagcuagcuguuacugcccugucuugugcugucccuuuuucaaggagcaguugcuuucgguuuucagaccuacuguuuucucugucuacagaugaugugcauuuggcuugguucccugucuuuucagauccagcuguuucaaauuacaugggauccucagggacggacacucuuccuuagcaagcagugcugcuuacugguguucucuucugaagccuuuuuuccuuugcacacacuuuuguauauucuuugucuuaaagaaaaacaggagacguaugguauggccaggaauguaguagguagguuggucgaaugccugcucaccaugcacaaagcucaggauuugaucuccaacaccagcuaaacugaaugagguauugagugccugcagucagauuggaggacacccuagaggccaggucucaaaaaaacuugaaaucgacuuauaauaaauaaauaauauauuuaaagugcauagugggucuggagaggugccucagugguuaaaagucucacuguguuaucuguaguuggcuuggaguuagcuauguugcuuuauuugcacccccagcccccauuauuuguauuguuguauguguauggguaucuugccuguaugcaugucugucugugcaccacaugcaguauccauggaagccagaacaggguguugcagauagcuaugaucuuucaugugggugauuggacuugaacccagaucuuuuggaagagcagccagugcucucaaucaccucucaauccuguguuuuggacuucucaagguugcucuuuaacucacuauuuagcugguugaccuugauuuacuuauuugcuugcaccuccugagcccuagaauuuacauacaggugucugucuugccacucucccagcuccuuacuccagccuuuguuuuggagucuuacugagcuacucaccuuggccuugagcuugggauccuucugucucacccaggucucuuucagaagacuuugauagauaacuauuugcuuucugaugugaggaguuugaccauuuccccucccuuucagggagggugcuguucuuguaaauuaauugcuugcuuacuuuuuuuuuaaaaagauuuauuuauuauuauaucuaaguacacuguagcugucuucagacacaccagaagggccucagaucuuauuaaggaugguugugagccaccaugugguuccugggauuugaacucaugaccuuuggaagaacucagugcucuuacccacugagcuaucucuccagcccagcuugcuugcuuuuaauggggaauaguauuuaaaaucuauacucuuugugauagaacuacguagaccaggcuggcccuaaacuuaggauggucuuccugcuucagccuuuugucuguggcugggaauacaggcauaguuugagaaaaccaucuuuuuccuuuguaaauaaauacauauauuauacauuuauuauauuauucacucuccauggguuauauaauuccaaguugucuuugcaggugguaguagcuuggugcaugcuaucaagauuucuuacugggggcuggagaggaugguucagugguuaagaguacuuguugcucuuucagaggauccagguucaauucucagccuccaugugguggcucagaacuauauguaaacuccaguucacaaaacacgacccgcuucugaucucuauaggcaccagguaugaaugugguucacacacuuacacgcaggcgaagcgcucauaaacauuaaaaaaaaauugcuuuuuuuuuuuuuuuuuuugguuuuuucaagacaugguuucucuguauagcccuggcuguccuggaacucacucuguagaccaggcuggccucaaacucagaaauccaccugccucugccucccaagugcugggauuaaaggcgugugccacuaccacuaccaugcccagccauuccuuuuuuuuuuuuuuuuuugguuagaaaucuugauuccuuaucaagugguccuccuauuagagaugcuuggauguuuuuaugacuuggugguuagcauccuccagaguggguaauuugggauuacuccuugcuuccuucuuucuuccuucucucucuccugaauuguuuugcuaggaucaguaaauauuugugggcaucacuguguugcccauucugaguuugaacucauagguuaacaaaguguuccugcuacagucucccaaguagcugggaauaaaggugugugccccugugucacacuugagaagcgucuugaugacuuuucuuacuucauaguauuguauagguaccacaaaaugacucuggauaugaauacagacaugaugcugucacuagucacauguuauauuuuuguuucuuuacuuaguuguaacacugagauaauaaugucucccaauaggccguccuauagacgguuugcgacaaguaaggaaauaaagguaguccuugauacucaggacuuacaauaaaaauuacuacugcaucaauuaauauugaugcuaguugccucugggggaucuucuguuuuuguaaaacauugccagucagaaaauaccaaguuuauacauuuuaucuaucuaaaguauaguagaagcuaaaggaaggcauauuuguuugauuauguauguggagauccuaauuuuuaaacauauuuauuuauuuauuuauuuauuuaauagcuaugaauauacuguagcugucuucagacacaccagaagagggcaucagaucucauuacagaugguugugagccaccaugugguugcugggaauugaucucaggaccucuggaaaagcagucagugcucuuaaccaaccacugagccaucuccagccugacaucuucauuuuuaauguuuguucauguaaauguuaauauaagcuauguguucguguaguaugaucugggaagaaggcaagccccuccuucauuuuauauuuuuauucuaaaauauucacaggaaauugaaagaguguauagagaagcucaaggcccuucacccaguuuacuccacagugaaaucuuuauuggguuuuuaauuuguuuguuuguuuguuuguuuuuuugguuuuucgagacagaguuucucuguguagcccuggcuguccuggaacucacucuguagaccaggcuggccucgaauucagaaauuugccugccucugccucccaagugcugggauuaaaaucgugcgccaccacgccccaugaaaucuuuauaauaacugguauauuucaguuuucagauaacuguuuucauggcccagaaauugauuaaacauuaucuguauaagcuguugggaagugucaaggauuaaaccuugauguuguguaguucugucauuucucuggauucucaaaauaauuaucucaaauuuuacuguaaucuucauuguugaaacuuagacuaacaguucugaauuuaauaaugggaaccuuacauucauauuuacuugauuuuaaagcaauuuuugcauugucuucuuaucuuugauuuacagccgcaccagaaccguuguugccugcauugucuuaauuuaaucaugggccaguuuaguagagcaccaagucuggaucugggaggcagcuugugugaaucauuuacauauauuucugcuuauguucccaaaacuaauuugcagcuuuuuauuuuugacccaauuauacauucagaauauguuuauaauuuauuuuaugaaggcuuuugucucauauaggauuuaaaacuagccaaaagagcagaaguuauuaaacaauagcagaaacuacacaguauguagggcuuuaaauggugauuguucaacguuugaaugucccucaaaaugugagucuguguguacauuuauuccacuagugauuugaauagauggguuuuacacaauauuuuagcuguuauugucagucauaaacaaauuacauguauuuaacaaguuaaugucagauuggccaggagccacuaggagguguguaccuagugacaucagcuggcaaagcgcccgcccugguaaccggaguguggaaggguaguggagagagaggaaaagggagggagggagggagggagagagggagagggagagagagagggagagagagacugagagacugagagacugagagacugagacugacuguaucuggggauucuggcaaggugaagagcuggucuguuuggcaggaccuucccaucugggauccaucuguguuucccuggaaugggacaggcagcucuagucagugagaaaucgcagaugugagagagcugacacauguccagcuaaugaaaggaggaggaaggcugucugcgauugggcuuugaagauuagggggagaaaagaggcuuuuuaauaucuauuucaaguagauuugguauuuuacgagucuggauuuuauaauuuggacauucaggguaaguguacauuuuaauauaguuuuggggauaauaaaguguacaauucugccuuuccaaagcuuucugcuuaucucaaauuauguuuauugauauuuuaucagaguuuagucuugguuucauuuugaugauucauuuaauuuucugucucuauuucauuuuucacuugccaccuuuguauuuuuuuaauagaaagcuuaguuaaaaucagauguaguucaugaauucuauaguuagaaaaguagucccacaauuacuucuuuaaaacuaguccauauuaaauaauuccugaauauucugagggaauuuuuuuccuuaaguguguauaauaccaguguuaaagagaugacuucugcagggcucauuuucauuguuagauuuuacuuuaaaguaaucagauuacaacuaaaagaaauuguagcaaagcuagugucaucucagcauuuuauagcuuguuauguuuugcucguaugcuauuuucuguguccaaaauagcaugaagucugacuugaauugugaguuggacacauaccucuaccccuacuuggaguuuuuguccguuuauggugcccauuggccaaauucuauaguguuucuuauuuuugaaaggcuuccaaaucagccaucuauauauagguagaaccugagcuuagugcguaacuguauagacguuauuuccuaguucucucaucgugggaaaaucugcuguucugaaucuauuugguuuguuuuguuaccccuacuccuguuuuucuuacuuucucgacugguucuuacuguguaucuauguacaccagacuggccuccaauucacagagaaccacccuccucugucuccucccuaaaggcaugugccaucacagccagcugacuccugauuuguguugauauugggaaaauuugucuaguaccuuuccagcacauagaaggcauacugaucaguuucaaaagguuuuagagauuuauuuuucuguugugguaagugucuaaacccuuucuccuuucccuucuaccuugagccaaaaauuaucuggucuaacucacauuuucaagauguuauuauucuugcugcacccacuuuauauauuuauaguuuauauuuaaaauuuguuucauguauguguguuuuaccuguauggcucuuuguaccacaugacugccugaugccuacagaggcuagaaaagaucucuuggaacuggaauuacagaugguugucagcuguaaugugggugcugggaauugaaccuaggcccuauggaagaacaaccaguguugcuaacugcugagccaguucuccagaccuccgauccuuuguaucuaucuaaugugcuguaugucaucuuugcuaaaccuuuccaugacuaaaguuuggaaagcauucuggagccaggcaugguggcgcacgccuuuaaucccagcacuccggaggcagaggcaggcggauuucugaguucgaggccagccuggucuacagagugaguuccaggacagccaggguuauacagagaaacccugucucgaaaaaaaaggaaagcauucugaauauacagugaaaauggauucucucugaccauaccagaacagagcuuugaaaaguaaauuuacaggagggaaguauugauucuauuacuuuuaauugcaccaauuauuuaaaaaaaauguuuuauguuuauuugucuauuucuguggguuuuuuccuacuguguggguuccaggauucaaagucagucauauuagguguggcugcaagggccuuuacugagccaucucacuggucagucaguacuguaaauuguaccugacuccccaaagauucuaugaaauggcaaaugggagcuucaaaaaaauaacuuuaauaucuuuaagaguaauuucuauucgguguguguuuccgcugcauguuugugcucuauaugagagccuggaguccaugguugucaagcugagggcaucagauccccuggauugcaguuacggauacuguguauccuucugugggugcuggggccucugggagagcauccagugcucuuaacuccugagccaucccccuuguccccagaaguuuacacuuuguaaaguucuguaaccuuauaucaccuaguguuguaagaaaacaguguaaugcauuucuugguuuuuuguuuguuuauuaaagacugggucuuacgcacuuaguauccccagcuggcuagaauuugcuuuguaaaccugucuuggccucuugccuccugaguccugggauagcaggcaugugccugacugcaguguaguauauuguuccgauucuuucaguuuaucucccuuuccaucagguagggaaacuuuuaaaauggaucuuuuuagaaguguuuuuuuuuuuuuuuuuuaauauguuaaacugacugaacuuuguagaacagaguuggggacuuuugauagguacaguggacagcacuuaaggaccuuucagauuauuugagaggcuguaguguuauguugaacuuacaugguugucuuucagugagcaauauugcacccuuaggaacucuguuccuggggaugaguagggagaaaagaauguaaugcugaaaguauaguguagguuguacucugagagagcuuaaaaggaguuuuuauuauugcuauaugucuauucuagcaauacuguuuuuauauucuagggcuugggauugcuuccagaccuuguggaugcaaaaaaaaccaaaaccaaccaaccaaccaaacaacaacaacaacaacaaaguguguucuaucaguggcuaagucccuaguuuucauaaauacuguggcccagauuugacauagagcuaacucuguuuauaacccaggcuagucuugaacuaacagaacuaacaguaaugguccagucuuagccucccaaaugcuggaauaagagguauacguuaccacaccuggcuuaugugauaauucauuggcuguaaauaaaaguguuuaacagucuuggugaggugagaugaggcccugaguucagucuuuaguugugggugggggacccagcuaggacccagcaguuagaagacaaaaccaggggugaggaguggcacuuaccauuaaucccaacacuccaggaagcagggacaggaguuaguucaaacccagcuugguguaccuaucaguuucaggacacuucaggacuacaaaaagaggcacuuauuccaaacaaauaacaacaaaaacccaacaaauauuuuaccaccaagaaauuuuaucuaucuaucuaucuaucuauuuauuuauuuugguuuuuugagacaggguuucucuguauagcccuggcuguccuggaacucacuuuguagaccaggcuggcuucuaacucagaaauccgccugccucugccucccgagugcugggaucaaaggcgugcgcaaccacgcccagcuuuuccuuaauauuuugugauaggguuuaacugagguguccaagcuggccaugaugucacagcuauugggauuucagcuguguuccacagccaguguugagaucugggaggcacaggggaagcugcugagacuggggcucccugccaguguuugaaugccugccccguccaggcaguugcugaugauuuugaaucucucuccacuucccgaaugcugugguuguaggugugagucaucacgccagcuuggaauguaugauaucguaugcacuuauauauaaucgcaagccaaguuuucaucaguugagccaucucuccagcccagacuuuuuaaaggguggaauauagagauaaguuuuagaaguuauuacuaacagagagaacgagaucuuuuggagagaagguagcauuugauuaggaagccuuguguuuuguuggggggggggggcagggacagauagaaauguacuaguuucaauccccagcuccucccuggcucauacugcaguuccuuaaguuaaauuuugucaagugcauccuuacacugaguuaaguucugccacaguuuagauggagaugggggucucaugaccuaggcuggucuugaacgaacgcacuaugucgcugaggcuggcuuuuaacuucugaucuuccugccucuacuuccaggugcugggauuccaagcaugugccucuaugcucucuaguauuaaggugcacgugagugcaggugcccaaggaagcuagaggcuuuggauccccugcagccacuuggaucugagcacaguuguuugcuuaugaggcauuuaccaguguacuuacuuucaugauuucucuucuugaacauguggguuauauauucuagcaaguuccaguuuagaagguccugauauguggagaguaugugcauugauucccuccaacuucagaucaauaaauaaaggaucaggaguggcuuacaggaagaaaaaaaauggcuuguuagauagucugacuggcugugauagacuuccuagaugguuaacuuuuuuuuguuaaagauuuaauuuauuauguauaugaauacacuguagcugucuucagacacaccagaagagggcaucagaucauauuacagaugguugugagccaccaugugguugaugggaacugaaaucagaaccuauggaaaugcagccacuucucuuaacuacugagccauuucuccagcccauagaugguuaacuuuuaaaaaacuaugugguuagcuaggccugguagugccuaaaaauaggccuauaauacuucagacuaauuuugugaguuuuuuucucucucaaaauaaguaaaaaagcaucuauggauacuguauagugaaaauggcugcauuagguucuaguuucaagccuuagggccaccaagaaaacaacaguguguuuaguacccagcaaccauaaagcacacacccucaaauuauguauugacagauuuaugcugggagauugaaaaugcauaugggauuacuuuucuaagcaaucacugguggaaaucuuguuaucuuuccaucuugagcagcuuguuuagagauaccuagcagagaaggguacaguucuguguagaaaauggacucaugauaccuguugucacgucucauagcuggaacuaaaauguaaguggaauauguguuuugcuuuguuuuguuuuguucauuggaaacagguucuuauguagcccaagcuggucucaaacucuguguagcuaaggaugauaacuuugaucuucugagccucuugcuucaccucccaagcgcugggcuugcaagcauguagcacggugccuagcuuuagaacguguauuuuaacuugauuguauuaagaaagauggaaggaagaaaaugaaaauaucauguguaggcuuuaacauuagguuagguuguguaacuacgaacaucgauuauccucuaagccucuguuucuucagcuguaaaauuacaguaaaaugagcuuuaagcauuaauacuugcuacaugaauacuuaauaaacauuaucuuccuguguaauauuucuuuugcccucccuacguugauaacucacaguaaugaaaagcuaauuacaauaugcauguuuuuuaauauguccccuuuuaggcugauggaaccagcucugcuuccuuaacuaauucuuagucacaagagagagaguuucaagaagagaauguauuagucuuaaaaacucaaaccuguugcugaauggcaagcugucuagggaccuugccuuacuuugcuggucuagcugugggggaugggccacuuugagggugacagauguguccucugcucccagcaccaggugcagccauuguuuuagcuggucucuucaucccuccugucuguuacucugcucuuuguggcccauuguuucuguaggaaauuagcauuaaauccaucugaaacccccaugucccucaacugcaggugacuguuccuggccccagcugccacccuugcgcuugauuacuuccauauggggcugugcaaagaaguaguagucauuuauugauugccaccacaagcccccaccucaaacauaauaaccugaaaucuauuaggccuccaguaggcuguagcucaauuggcauuacacugugaugaacguuuuacaagcaaaauaauuaugucuuuuuucuucucccuuagccucuuuccgaaugucagauggagaaaacccugaguuaucauaguguuguaauuugaaugucuggagcuagaugcuucucaguaguggagcucuaagaauuuggauggacuugucuggaaaauuuuagucacuauuuuaaauauuucguaccacacccauaguguucaagcaaaccauggccugauaaguccuuaggauagagaugggaagggacacaaauuugcauuaccugcuuuauuaaauuauuuggaguguucaguauguugaaaaaggagccuaguuuaaaaggcugguugaggaaaacuauaugcagaaaguguugguuaaugcacucugguuguaguuugccucaaaccacauaaaauguuucauggccuagacuucuuuauuguuaaauguguguauuucauuuuggguguuguuauaaauugauuguaguaguauggugacacaugccugagaacccaguuuuuaaaaggcaaaaagaucucaacuuugaggccaccccccacaguaaguaagcucaagucuagccuaccagucaaaaccuuaccucaaaacauaaaaaggugaauuggauuuaaaaucccaaauccauuuuaaggacaguuuuaaguugccuugguuuccuaugguuauguugacugguacauuauuucuuugccaccuguaaaaugagccaguucaagccaaauuagauuauauuaaagacagguuuauugggaagcugcucucaguucacuagccccaaggacugaggccaggaaagucgccauggggaaggagggauggggaggaagagagaaauagaaagggugcuuagacagagagaggagaccagaacgucugggucauauagggcggagccucugggcugaaaaguucaagguuggggugugacagguagggacugagggauacugggagagacuagguggcuuugguauguaaaauaugaaccucagucccuugucccagggucugaaaccaaacauugacuuugucaaaguuaaaaccacaccagugaagaguauccuaagacgggcagugguggcgcaugccuuuaaucccagcacuugggagguagaggcaggaagauuucugcguuugaggccagccuggucuacaaagugaguuccaggacagccagggcuacacagagaaacccugucucgaaaaacaaacaacaaaacaaaacaaacaaacaaaaaguauccuaauauacuguacagugucacaacccugggagucagccaauucgcugacuugacuggugaguguuuaauuuugcagcucagguuuuauuauaaaaucuuuaguuuauaacaucauaaaucagauuauuuaauaugucuaauauuuaaagugauaguuuuauuacuuccaaguuagcauaugggaauauggaauauagggccauuucuguugagaauauaucuuuuuacuuuucuuuucuauuucugaguuuaaagaaguuuaagguuugaaaaacacugaccagaacuuuaucuggcaacuccugugaaggcaagccuccagguaaaguggcgugauugcauuuagauuagguuaguguuaguguuugaauuagaguguucagagagcuuugaaaucugcuucaucauuuuucgguuuuguuuguuuguuguuuuuugagacaggaucuuacuauguagcucugucugucacuguguggcccaagcuugccuuuacugcacagauuguccugccucugccuggaaugcugggguuaaaaguacagaugaccauucacaugcagugucaucuuuuugagcagaaagaugagaagauggaaagagauaaguuugauuaguguuuguugcugugaagagacacacgaccaaggcaauucuuacaaaagaaaacauuuaauuggcccuugcuuacaguuucaggggacuuuuccauugucaccauguuugggagcauggugccagaacuuuacaauccaaaggcagagagaugcugggucugguguggacuuuugaaaccuuaaagcccaccccaguggcaaacuuccucuaacaaggccacaccuccuaauccuccucaagcagugcugcucccuguacucccuggugaccaagcauucaaaucuauggccuguggaggccauuucccccccccccccuuggaaguuuuucucuguguagcccuggcuguccuggaacucacucuguagaccaggcuggccucaaacgcagaaaucugccugccucugccuaccgagugcugggauuaaaggcgugcaccgucaugcccggcuguggaggccauucuuacucaagccagugcaucagggaaaaagaaaguagcauuugggacugguucuuaugcucauagagugggguacauucauuugcaguuuggaacaaguuggaauaguuuuaaguucaguauuacugguguagcuaguuugaaaaaugaaguaagagguuuuguuuuuuaaauugcauauaaguuuugcuugcauguaugccuguguaccacuuguguaccuggugcccucagagaccagaagagggugguagguuucuggaacuugaguuauagaugguuguuagcuauuaugugcaugcugggacugaaacccaggcccucacgcaggucagcuugugcuuuuagaccuugagacaucgcuccagucccucacuuuccuuuucucaacuugucugucuaaaacaacuaaguguaaccaugccuguaauuauuucaguguguaguuguuaagagcuacagacuuugcuuauauaaccacagcuaucaaaagauugauacugcaccauuaaacuaaaagaucuuacucccaaauuuacacaaagaaagaaaucuggggauucuuguaggauugggacaaaacaaaccuguuuuauguggcuggucacccuacuaaaaaugguauacuacacuugagaagagauaggcaggcagacagacagagagcaugaaagagugguaucaguagcucuaguacuugggaaacaaagguuggucugcuuuacaaugaguuuuaagaauuuugagagcuggacaguugagauccugucuccagagaagaggggguagaaggggcuacuuacugaugaguaacauaccugucagucacaaauguauuaugcugcucuugcagaggaccuggguucaaaucccaguaaccacaugguggcucacaacuuuuuguaauuccuguuccuggggaucuggcaugcaugcaugccagauaugguagcauaaaccuuuagacuauucuaaauuacauuauagaaaucagaagaaagacuguuccagggaagaguuuaaaggaugggaaaaaguuugguaugcucaaagaaaaggaaaaagcccaguauaauuauaauguuguggugaagaaaugagauugucucugccaccaccaccaccuagcaucuaaaaucuuuacaauuucauauucuauguaauuuggggggaggggcaccugugcugugauuaacauguggaggucagagaagaguuuucagaaguucucuuccaccagguagcuucuagagguugaacccagauugucagguguuguggcaagaaccuuaacccagccucuccaguucuuuuuuuuuuuuuuuuuuuuuuuuaaagauuuauuuauuuauuauauguaaguacacuguagcugucuucagacacuccagaagagggcaucggaucucauuacgggugguugugagccaccaugugguugcugggauuugaacuucugaccuucggaagagcagucgggugcucuuacccacugagccaucucaccagccccgccucuccaguucugaucaauuguuucaaauauauaauuuauuuuuauuuuauguucauuuuaauguuuugccucagugugacuaugugugucagaacccccaaaacugguguuauagacaggugugagcugccuuaugggcauugggaauugaacuuggauccucuggaagagcagcugguacuuugaauugcugauccaucuuuccagcucuuuauaauuucuuuucuuuuuuuuucuuuuugguuuuucgagacaggguuucucuguauagcccuggcuguccuggaacucacucuguagacuaggcuggccucgaacucagaaauccuccugccucugccucccaagugcugggaucaaaggcgugcaccaccacgccuggcuauaauuucuuuuuaaaagaguuucucuuuaaggcauucgugaaaggucauccauccuucccucucaaguccagaagacaacucuaucuaucuaucuaucuaucuaucuaucuaucuaucuaucuaucuaucuaucuaucuaaucuaucuaucuaaucuaucuauugaaugugaguacacuguagcuaucuucagauacaccagaagaaggcaucagaucucauuacagaugguugugagccaccaugugguugcugggaauugaacacaggaccucuggaagagcagucagugcucuuaaccacugagccaucucuccagcccuauaauuuuuuaaagauuaauuaauuaauuaauuuuuagauuuauuuauuauauguaaguacacuguagcugucuucagacauuccagaagagggagucagaucucauuacagaugguugugagccaccaugugguugcugggauuugaacucuggaccuucagaagaacagucaggugcucuuacccacugagccaucucaccagcccagauuaauuuauuuauguauuuuauguaugcacaccagaaaagggcauuagaucuuguggaacugcauuuggagacaguugugagccauuaugugguugcugggaauugaacucaguaaccccuggaagucaacccuuaacuauugagccauccaucucucuagccccagaucaauuuuuuaauuuuuauuuuacuucacuuuuucccgggucacacuauauaucccggcuggccugggauucacagagaucuacugccucugcuuccugagaucuggguuagagccaccacuaccccuggcccaugauuuaaagugugguggguaaaucauuuugagcuuucaaaaugaaguuagacaaauaaacuuggaugcuguacauauuuuauuagacaauugggauggcaaaaauauuucuggcaaccucauuuucauuuuuaucuguaggacaaaaaaguaaacuuuuuuucuccccagcagaccauaugguguuugcacagacuuaugugacguagcugcauuauuuuucuuucagaauaaaaugcuuuaccugaugccaaugcucugagacauuuauuuucuagucaucaguaugugcagcaauuauucuagucauucuauuuuuuucuuugcuucccucacaccuccuuagggugucauguauauuuuaggcuagccuaaaacuuucucaagcuuagggcaaccuugaacuucugaucuuccucuuuguaccuuuugagcacuaggauugugguuaugaaccaccacaucacauaauuuuauggguuccuaagggucuaaccuaggacuucauguauuuuagggcuagcacucuaccagauaagccauuaccaaaguucuuaacuguuuuugagauagucucacucuaugccccugcaugacuuggaccuuacuauauauauauauauguguguguguguguguguguguguguguguguguguguguguguguguaccaggcuggccuugaacucaagaaguucaccuuccucaagaugagaccucuauccccggugauccagauuugauccauacuacuuaagcugcugcugggauuuuuuuuuuuuuuuuuuuuuuuuuuuuuuugauacaggguuucucuguauagccuuggcugugcuggagcuugcucuguagaccaggcuggcuuuagcuuugaacucacagagauccacuugucucugccuccugaguguugggaucaaagaugugaccagcuaccuaaacuucucgagugcuggauuauaaguguaggacaucauucauauauguauuguauuuaaagaauacauuucagaacugaggagauagcucagauaggugacaguuaagugcaaggaugaaguuuacauccccaacaccagugucaaaauugguaugguggcacauagcuguaacacugcaauugggcuguuuuggggagacgggugcauuccuggagcucagccagucauucuagcuagauugaugggcuucagguucaauaagagacccaagcucaaaaaauuaagauagagggacugcuggcaagaugacucagaggguaagagcgcugacugcccuucagaagguccagaguucaaaucccagcaaccacaugguggcuuaaugagaucagauguccucuucuggagcgucugaggacagcuacaguguacuuauuuauaguaauaaauaaaucuuuuuaaaaaauagugcucucuuucucucucucucucucuucccccccucccuuccccucucucucacccuuucucuuucugccgccaccuuccccccuucucucuccccuucucucuuaacauguggaaacaaaaaauaaaauaaaauaaaaauugcuauagagagcaaauaaggaugauacuggaugccaucuaucuuuucuccacacacuuacaucaguacacaugcucaacauugaucgugcauauauacuuguauauauaccaugcaguaaaagacauggacauuucucaaugguguuucuuugcaucauccuuauaguagauaucagaaagaaauaaguucugguuuccugucucagucugaauaaauaacaccugaguaaauucaguuauuagucuauuucccauguuacuugucaucugcuggaguuaugccucaguagaaacaguacagaaacuucuauauuauacuugcuuagaauuaggaaaguguuuuaggauuaaaacuguauauuaauauuagauacuccacuaggagcuguaguuacuaaaauauaaagcucaaacaauuuagagaaauaggcagagaaagaaguaauuugugggaaaauucaauuugagacauuucauugguuguuaagaugugcuggaagaguguaaguguggauagauuuaacugaagauggaacuagaacaugaaagagaucccaagacaaggaaggcuaggcauaguaugcacaacuuuuuuauauggcaaagguuuauuuuguaauaauuuuucuuuuuagauuuuauauguauggguauuuugcccacuucuuaugucuguacaaugugugaguuccugguguccacagaggucaaaagaggguguuggauccuuuaggauugaaauuacagauaagucaccaugugguacugagaacuaaacuuggauucucugcaagagcagcaaguauuccuaaucaaugagccaucuccuaagcucccagggauuucauuauaauguaauaguagguauugguacuuacauguuuacucucauggcauagguggcuauuugcucugccaaagugcccaucuaccuuccauuuauguuguuuggauucagucccugcuauauuauagccucacauuuacauugugcuuuuaaucuugaaaagcuuuuuacccuccuaaaggccccucggggaaggaaguaaaagccaggugucauauuuuuaucaaagagaaaacugggacaccaucgugguaucuaucacuucaauucuuaaguaagguuguuuuuuauagcuugacugcagagagugcuuuccaauaggaagaaccuccuucggguauuuuguauaucccugaaugcuaccugaggcugccuuacucaagugucuggcaaggcaggcucuaugguugcugaucauggagcuaacagccugacaucuguaaguugcagcuguacccuuuuguuccagucuauauuucugccugcauuuuugaagaaucacagaaucuggaagaauguaaguuuaccauuccaaacuuggaaguuugcucugugugugggaguauucuguacugaaugcugauccugaaaucccauagugggcacuguccucucaguucauuuauugccaucuucaguucaucaucccuaugccaguuuuaguuuaaugccaaaauaagauugagcuaucauaagauaaauugagugggugcuaagugugucacuaaagugucugccaaagacaguuuucucugauuuuguucuucuauuccuuagccuguuuuggcaaacauaacaaccugguuauaugucagggcauaugagcaggguuguuuauugaacuccucucuuccccacuugagaugggcucucaauaauuaacccaugcuggauccucgccuccuacucauggugacuuuuuuuuuuuuuuccacauucucccaagugccaugauuaaaggugugaaccauuauuucaggcugugugguuuauuuaugcuuaagggcuaagauugugccugauguaccucugguugcuugguaaccacugucuauucacacccaacucuaggcccccuccuguuucuuccugauugcugggauuacaggcauguaccacugugcuagguuuauggaccccuagauauugaacccaagacauugugaauuaagcaaguacucuaccaacugagucauauuccacgacuccuauuuaguuuguuugcuuguuuuuuccuugguuguccuggacuuugaacuguaggccagccuggccucagacucacagagaucagccuuccucugccuacagaguacugggguuaaaggugugugccaccacugccuggcaaguuuguuacuauaauuuaaagcacaucuguugcuacuucuuaagcaaaccuauuaauuugcuaaagugagaagcuuuuuucauuaucagugaggacauagcuggacuuuuaaaaauauagcuucaaucuacuucuagcuuucuuuucuuuucucuucuuuucucuucuuuucuuuucuuucuuccuuucuuccuuucuuccuuucuuccuuccuuccuuucuuucuuucuuucuuucuuucuuucuuucuuucuuucuuucuuucuuucuuucuuucuuuuuuuuguuuuuucgagacaggguuucucuguauaguccuggcuguccuagaacucacuuuguagaccaggcuggucucaaacucagaaauccgccugccucugccucccuagugcugagauuuaaggucgugcgccaccacgcccggcuacaagauacuuuguuuucacaaugggucacaacauaagcaucuggcccauuuugccaauguacaugcuacacaugcuugaucagcagcuauggggcacucuuuaguaucaugucugaaaagugaauaaaaauccauauaaaacaaacauuccaaguuuccaugggaacacaguaaaugugaccccccaucuccuaaccuuccauacagcauuggugccaacccuacucuuacaaagacauuccaaacuaacaguaacuaaguuaaaugguccccccacaugccuuaacacaagcuaaacuugcaguaaagugcuacaagaauggcaucuacacauugauccuagcagaagcacaggcugcaggaugacgguccaucccgcucuccugggcacaagacacgggcagcgugccaucaucuugcuccuccaccuccggcgggaagccauggcucuggaucugcuucaugaguugccacuuuggcugugacauuacauaguagauguuugaccucuggaacccauugaacguagaagcagcauggucugcauuagcuauagacagcauuuacucucauguuugucacuuugagcugugaucaguaucuuuucuccuaaauuuguagucagaauguacaaaccucauugagucuuauaauugucuccuuuuuuguuuuauuuuugagacaggaucucacuauacuccuggcuguuuuggagcuugcuauguagaucaggcugacguaguacuaagagaucugccuuccucagccucccaaaugcauguuaaaggcauguacuucucaauuuagauuucuuuuguuaaaauucuaaacuuaaguacaacaaaauuauuacauguguguguauccugaguauaauuuaacaucccugucccuugguguuuguugguuuguugguuuguuuguuuguuuguuuguuuuaugagacaagguuucucuguguagcccuggcuguccuagaacucacucuguagaccaggcuggccuccagcucacagagaucuaccugccucugccuccucagugcugggguuaaagaaaauauauuuucuaggacaauuuauguaucuuuuuauugacuuucuauuuuuccuucuauaccuugagauaagcuguuuccagguauuuauugaaagaaaccauugccaucagugucaguuucuuagcuuuuguuuuuucuuuuuuucuuuuuuguuuuucaagacaggguuucucuguacagucuugacuguccuggaacucacucuguagaccaggcuggccuuaaacucaagagaucagccugccuuugccucccaaaugcugagauuaaaggugcgugccaccacugcccggccaguggcaguuucuuaaagaacuuguguauucauugguauugucccccacacccagcuuguuuagucuucguauugcaagcuuuuagaguugcuauagugugcagugucccauagacugguaugacaacucccugcuuguaauaccucgagcugucauccaaagaggccaaaaacauggcacuauagugcuuuuccagaugucauucccucuguuuggaugacuuggagcuuaagaaggguguuugcacuugaauagcagaagaaaacuguuccuuuggcauaaggcccacccuggcagcauucuacauuggcucuugauuagaagugaaugcuagucagucaggaugucugauuaucagacccagccuuuaagaugaaauaggguacaaaagcuaaagggcgacuuaaauaucucugagaucuaaaagaagccccugucacagcugcaguucagagcccgagagcuuuaaguauuaaucaaaaagugucuacauauagaaacugcucuuagaaaggaggcagagggaugugugguggaaaccuuuuuaaaaaauuuuuuuuuauuuauuauguauuuuccucaauuacauuuccauugcuaucccaaaagucccccauacccucccuagaaaccuuuuuuuuaacugcuuuuuagaaauauagcaauaaaauacauauaucauauauccaaauauggauuacugguucuuuuuuguuguuauauuuuaaagauuuaguuuauguguguauuuugccugcauguauguuacugcacgaaguauguagugccaguagagucuagaagaggguauugaaugcccuggagcugagguuacagauuauugugagcugucauguggguauuggaaccaaauccaggugagccaucccuccagccacuuuuuuuuuuuuuuccuucgagacaggguuuccucuguguaaccuuggcugggauuaaaggcaugugccacaccacccagcuaaagaaguaaaaacuuuuuguggggauggggaagagacagggucuuacuacauagcucuggcuguccugaaccaggccagucuggaacucacaacagaggcccaccugccucucugcuuccugagugcucggauuaaagacuggcuuuguugguuuucuuucuuuuguuuuuuuuuuaagucaauuaauuuuuacuuuuaauguacauugguguuuugccugcauauaugucccucauaacaagaguuacagacaguuacgagcugccauaugggugcugagaauugaaccucagucuuuggaaagagcagccagugcucuuaacagcggaaccauuucuccagcccuuucuuucuuccuuucuuucuuucuuucuuucuuucuuucuuucuuucuuucuuucuuuuuuaaauauuuauuuauuacauguaauuacacuguagcugucuucagacacuccagaagagggcaucagauuucguuacagaugguugugagccaccaugugguugcugggauuugaacucaggaccuuuggaagagccgucggcgcucuuaacugcugagccaucucaccagccccuccagccccuucuuaauuguaucuuuugaaaauagaaaaucacuuuuagauaggcuuggaaacauauacuuauagcccaaguggagacaugaggacugagcuuagguaggucauggugaguacaagccugcugcaauuugcuuuacaccccaaaagaaaguaaagauuuauuuucauguuuuguuuauccacuuaaaauuuuugguuguggguuuuaaaauuacuuuuuuuaagauagcauuuucauguaugaguuuuugccugcauguguguauauauguauacaaccacaugccugauacccacauaggucaagaagguauuuaauuuccuggaacugaaguuaccauugguugugagccaccaugugguguugggaaucaaacaccagucuccuauaagagcaauaagugcucuaaucuauugaaccaucucuugagccuuuaaaaaucauaauauuauuauuacuguguggcuugcauguaugacuguggguacauguguagaugugagagggaaacugucugggaacugcaagguuucccuguugugccaucuacgugguccugguuugaaugcuaugugacaugaauauuuugcguauuaugaguucaugaaaauaaucucuugggcuuuuugugugguuguuguaguaguuguuuauuguuaaaacaaacuuauuuuguagcccuaggcuagccuugaaccugucauuuuccugccucagccuccuuaauacaagaauuauaggcauggacuaccauaccuagcuuucuugcuuuauuuuccuuuuucuuuuuuucuuuuuuuuaaucuuuuugguuuuucgagacaggguuucucuguguagcccuggcuguccuggcacucacuuuguagaccaggcuggccuagaacucacaaauccgccugccucugccucccaagugcuaggaucaaaggcgugcgccaccaugccgggcuucuugcuuuauuuucaaaaagcuuuuguuguucuggauguuaaccagggaucuaucaugagucauuuuguuuauauuuauggaguguguauucuucacaguaauauaaauaucuuggucuauaucacucccucccuaaaauauagagauguuuuugaauuuaaaauuuuuucuuuuuauaaaacuggggguaauauauuucuagauaguuguagugaaaagguugcaaaucaugaaauuuucuuguuuguuuuaaaccaggucuguuuaagaggucaguuauggugguguagcauccuagugucugaggcaguacuguugugagcuugaggccagcacaggcuuuaugaaacucuuaaaauaagauuaaaaagaggguuuaggaaaagaucugcuaaauugcccaagguugugguuauagcauuuaucugguaggccuuagauucaccuaaaaaagagggaaagaagcagggcaguggggaugccuuuagugccagcacugagucuacagagcuccaggacaguuggggcuacacagagaaacccuuucuugaacgccccccuaccucccacccccaaaaaggagagaaugagggaaaaaaaaaucaaugaauuggcuuugcauguaauacguuuaauguucuuguaacuggauuugacacugggaacaccauaguggagagggcaauuccuguucugcucucagcgcucaggcguuuaugacuugaggaacagaggcucgcccuucacaaacaagaaugcaucaugguggauuuagggaccugugauguaaagucuuuaguauucuucauuauguaguugauugggaaugcucaacauuuuguagagcucuguuugauaaggauuuauuuauagggcuuuuuuuuuugauuguugguauuauuguuauuugaugaaaauauuugcuaaagccauggcuguagcaugaauauuggaaugauuauguaucuguacauguagauggcuuucuucauuggcuaccuauucuuuuuccuuuuucuuuuucuuuuugauuuuauuuuauuuuugagacaagguuucauuguguaagucuuggaugucccagaacucaauuucuauaguccaggaugugacugaacucaagagaugugccuaccacugccuccuccuguaagcuaggaucaaggguauauaccauuaugccagccuaaccuaucuuuuaaggauugcccacuuuaaaaguuguuuucuuugcagggccaggugguugacuuucccagagcuugggagcagaggcagagagcucuuuaugaauuugaggccauucaggauuauacagugaggacagaccccagcccccacacauaauuuucccuccaggcaguagccaguaauccuagguacuuaggaaacugaggcaggaggauuguaauuucuaggugaguuuagacagucuaacaguaccuggauaaaauaaaauguuuggaggauguuagcuuugugguaaugcuugcuccacaggcuggggggggggggggggagguccuguauucaaucuuuagcaucaaaauaaauuuaaaauaauuuuuuugcauugauguuuuauacucaugauugguauuucaaaacagauagauagauagauaaauucuuuauguuguuuuguuuugcuuuaaucugaaggaaccagagguguuaaccuauguuuuaaaacucacauuugguagugguauaaacagcugucacacugcauaauugucacaucauuaugagaguugcuguugcucauuaaucuguagguuuaagucagggaaaaauuaguucuuguaagacuuuauguugggaaggccaucugcuccuuauucccaaauccaaaaggaaguuagcuauagcauuugaaaguccauuaauuaagauauguauaggaaaaugggcuuuccuacaagugcugacucuguaugaagguacuauguugaaguauaagauauguagacauucucuucauguaauggaaaagaaucuuaguuuucaaggguagucgaaaccuaaaacaguauuagaaugauaaaacgcccaucuguggucagaccuagggaguuugaagccagccucagcuauggauuaaaaccaugucaugagaauaagaaaguaaacaggccagacaucugcacuuugauaacacuuggauucacugagauaagucuucccuuuuguuauaccuauacaacuuuaguauaacucauggcauaaagauuggaaguugggacaggauuucauuggguguccuaggcuaguuuugaacuccuggcagcuguuuugugucagcuuccugaguguuggggcccagcucaucauaaacuccuugagauugggauuguaucuuuguguuuauauucuuaguacuuaguacauugcuuaggucaugcuagccuuccagugaccuuuguauuaggaguaacaaugguacuuuaauaaaacuugucuuauaauuucucuauauuccuuauucuaucauagcauauccuguauuaaggaauacuuaacuaucauuucuauggagaaguaugucuagaaugugcuuuguuuguuuugguuuugguuuuuucgagacaggguuucucuguauaguccuggcuguccuggaacucacucuguagaccaggcuggccucgaacucagaaacccacugccucugccucccgagugcugggauuaaaggcaugugccaccaugcccagcuuagaaugugcauuuucauaaacauaauauacuauuauuuucauuaaguuauauguuacuaucuagauucuuuauucuagaacauaauuaaucuacuagucugagaaaucugcuauuuuuaauuuagucgucaguaugggguuguuuuaccuacaugguaguuggucauucuucaggacuguauccuguaucccaaucuauaaccuuauuuagcuuucuuuuuuguuuugugcuugacucuguugccuuaagcucauagaucuacuggccucugcuuccugagcgcugagaggucugagccaccacaccugacccuuuucaucuaaguuuuaauucuauuuauggagacagagcuaacuuaucagccagcaaugugaacacaguacgugaugagauuuuucugucuuuuuaugcuuguuugagacaaaguuucuuuguauagaccaggcugaccuuggacucagagauccacaucacaugccucugccuccugagugcuaggauuaaaggugugugccaccauucccagcuaaguuuuucucucuaaaugaaucauauuuaguaaauauuuuuaaauaauuuuuccaaaaagauaauuacauguauuugggaaugaaauuauuuguugaacuuaaauaaccacaguuggaaauuuaugagaugaauuucuaagucaguuuaguuuguauuuaggugauagucuguuucuacuagcaauaucacaaccauuugucagguuuauucuuuugcaauguauuuuguuagcuuauacauucauucuuagcacuuuuacugaucuuugaaagaauaacucucaaaguucuguaaauccccucugcacucccuccuguaugaauugcagugcuugccauuguauaucauuugcuuuauaguuuuccauccucuuuucaugcccucauuuuuguugauugguuuaaguaacccuucuuuccuucugacuuaggguuugauugcugugaagagaccaugaccacugcaacucuuauaaaggaaaacauuuauuuaacuggggcuggcugacaauucagaggcuucaucuauuauggucaugguggaaaauucgguggcuugcaggaagacauggugcuggagaaggagcugaaaguuuuugaucucuaggcaucaggagacugccacacuaggccuggcuugagcauaugaguccucaaagccuuccuccauggugacacaauuccuccaacaaggauguacacccacuccaacaaggccacacacuucuuaauaguccuuuucccuaugggccaagcuuuuaaacacaaguuuaugugggccauuccuauucagaucaccacaacuuuccuguuucuuguuuuguuuugcuuuuuguuuuaaaacuaagaacucaagccuuccagguugguaucaagcucacuauucagcugaggauuucugagucucgcuccugccuugcuaguguucacaaggccugguuuaugcacuuugacaagugagcuauacaccuagcccuuuaaguaacauuuuaagauuagaaaauuuuuuucuccugcccuaucugguaaacucauuuaguagaggaccagaaaugguaacagcaguaggauggaugcagugaugagaaugauuuacaaaguggcuugcaguuuagaacaguauuggcuucacuuucugauaacaaaacagauuagauuuaggggugauuuaauugagcucuuuauggaggugaugagcuguuauuugugugugcucggauuuguuuugcauuuggccaaaaauuuacacucuccaaauucaaaaugagauuuuuaguagguuaaauguuaaguuugaggcuaaaguaccccuucuuacaugagcauagaguacacauuuuggcuguaagcaucuaaggauggaccuguuuugguuuguuaauuaauaauuguuaauuaauaaucuagacuuaucugcaaauagauucucaaagagagaguaucuaaauuagauuggcccgugggcaugucugugggggcuuguaucuugauuacaucgaugugagaagacccagucgaaugugaggaguaccauuuccuagguuugggacuuuauuaaguaggguggagaaagugagcuaagcauuaagcauggaugcaguaauuucucuuuguucuuggcagcuccauacaggauccuguccuggaauuaggaggucaaguaaacucuuucuccuuuaaaguugccuuuguuaggauguuucaucacagcaacaguaaaaagacaagcuggucaaauuuaaucccuucuauuaaagagacuccaggucaagacugaggucuuaugcuuaugacuugagccuugauuugccuucccuguuguguuacuguuucaaauauugugucccaguguuuccucaauccugacuaccuguugaaacuuuacauguguccacuugggaguccugguuuagcccaaaacaaaauagaaagauagaaaaguggaaccaggaaagcuagagaaaugacuuagcaguuaggaauacuuguucuugaaauggagcuggguucaauuuccagcacauccccaugacagcucacacuguaacuccaguucuagagggaucugauacccauuuuucugacuucccaguauaccaggcauaaacaugaaagaaacauauaugcaaaguaaaucuaaaaagaaaaauaguuuaauuaaaagggauuuaauuaaauuaaauuggaggaggugagggcuggggggcuggaaggaggacaugagagugaucagagcauauuauauacacauaugaaauuauuaaaagacucaaggauuuuuggacuuaaaaauggaagucaauguaacuagaguaauacuagccauauaugaaaaaaaaugcuugguagcacaguggaugucuaauuguugagaaggaaaucaaguuuaacuaaaauguaaauaaaaaucuguuauaagcuaugacccagauucaaggaagugaguguucaccuauuguuuaugccagccauaucauuaguucuauuuccacgaucguucucuugcugugaccacauguauuuuaauaaguaauuguaauuauaauguacauacaauuuuuuguagagaauggcccuccaccuggcucuguauuguauguauuccccaauugcugauauuuuuuuguaauuauuuucagugucuucacaguuugcauugacaugcugcucuaccauuuaauugaccacuccucuguggaauaaauugcauuuucccuugaguuauuuucuuaaggacaaauaauuaaggagugaggucacacaaucaaagagaauauuuuucuggcaaagaaauauuuuuaacccuacuaauuuaauauuaguacuuugaaauauguuuauuuuugcucuuucuucugacuacuaaugguaucaaaugagaguguagauaaucuguaaaaaauguuagccaggcagugguggcacacgccuuuaaucccaguacuugggaggcagagucagacagaucucugaguucaaggccagccuggucuacagagauuuccaggacagccagggcuugaaaaaacaaagcaaaacaaaacaaaacaaaaaaaucuuaauagcccaaacuggaaaugggugacuauuuucuuccaaguuuauuguguuuuggcagagcuguggggacuggcagaggaaaugugggggggauugguagcugucuugacucaccagaagagggcgucagaucucaauauggaugguugugagccacuaugugguuucugggauuugaacucaggaccuuuggaagagcagucaaugcucuuacccgcacaugacaguggucauggcucucugagugucuucccuguuuuggcauuuauaacuguuaauccuaacuugcaggauuucccuccucaagcaaaugaggacuagauuucuuuuuuuccuuuuuauuuuuuuaaaagacuuauuuauuuauuuauuuauuuauuuauuuauuuauuuauuuauuuauuuauuuauuauauguaaguacacuguagcugucuucagacacuccagaagagggugccagaucucguuguggaugguugugagccaucaugugguugcuggaauuugaacucaggaccuucaaaagagcacucagugcucuuaagcgcugagccaucuccccagcccuaaggacuagauuucuugacuggaucuuuuguaacuaacauuguuucauucaaauaguuuaaaauguuuugagcuggucauggagcaguguguuaagaugccacuaugucuacagguucuaucccugggucccaaacaguagaaagaacguacucccauaaauuguccucugaccuccacauguguccuguguguugagauuuagguguguacucucauacugguuuauuguuaacaauuucuagagaccagauugagccaaauacauaaagcuucauuuaauuuuuuguuuggcuguuucggccugacuugcuaagagcuuauaagcauguaggcaggucaucgacgguuccaggguuuauaucaccaccugucuuggcuagcaguugcccaguuccacuuguuauuuaauuggcaggcuaucuuuaccuuagugcaccaugcucuaugucagaaguuccguaccagauacuguuacaguuagcguauugccagaagcuucucauggcagucuuagucuucggucucuccacuccugaaccccaaguucucuguuguuugugugugugugcuuuuucccacucuaaaccagaaacuguauccuuuugggggccauaggagcauaauuuuucaaauauuaagggacauacaacaagguggaacccuagcgguggcuggcaagcucugucagaguuugacaaauauguauaaaaagaaaauauuuguguaguaugaccuggaauguggugaugugagguaaagcuuuucuuagagccaaggauacagcucagagugccucgcaugcccaagcugauuuuaaaccaaaugaaaauacaaaagaaucagaugaucaaauugacuagaauuggguggaggucagauauaugucauaagccacauaacuuauuuauggugucuuccuccuucccuccccacuuuuuuguucacucucuaccaccuuuguacauccaaggagaccaaaaagagaguauuagaucccccuugaagcuggauuuauuggcaguugugagcugccuaagguggaugcuaugaacugagcccuaucagagugacaaaugcucuuaaccacuaagccauucugcagcccacaguuuuuggagggacaaggucucauguagccagacugguuuagaauuaauuauuuuaguuugaaauccuguaucucaucaggcauggucuugcacaccuuuaauccuagcacucuggaggggggaaaaaagccaagccacuaugcuuauaguuaacaugauagacuauuugaaagagaaagacaguacuaagaacauaugccuuuguuuauugguuguuuguugguuuuuauuuuuugcuuuguuagguuuuuuuugagaccauguucuucuguguagcccuggcuguccuggaaaucauucuguagaccagacugccuugaucucacagagaucugccuccugggugcuugggauugaaggcaugcacuaccacagcccaguaccuguuuaacuuuuuaaguugggaucucauaguauugcuaugguuugccugauacaggcugacuuugaacuuaagagcuccacuacagagugcuagcauuaauuaaagacagccaccaccacuccuuaacuuacuuucacuuaaugggauaaaaaaauaaauaaaaaccugaauguaauggcucucaucuguaaucacaguacuccugagguugauacaagauacugcugugagauuaagguuuagccugagcuacauaguggguuccaggcuagaaugggcugugggaugaaacgguauuuaaaagaaaauauaaaacaaaaaagcaaaucuacaaacauggucuggagagauggcucaguugucauggaggaccuguauucaauucuuaacaccuauguaaaagcuaggcuugagucuguaaucccauuguggagaccugagcucauuggcacuccagccuagccaaauuguccaacuccagauucagggaaggacuuugucaccaaaacugugaugaagagugauggaagaaaacaucugauguggaccucucuggccuccacaaauacacauguacaucuucacagacaaacauaaacauguauauacacacacuuaacucuccucauacacaaagaauagaauuggggggaggagaauguguggucagugaggugguucuguggguacaaguauucguccccucccaagccugauagucuuaguuugaccccucauccuuacguggugucagagagaacgaacccccugcacauucauguauaugugugugcacacacuaaaauaaauguuuuagauuucuuaaggguuggagagagauggaucaguaguugauagcacuuggguucaauucccagcacccacauggcagguuaacaacuuccuuuaacuccaguuucagggaaucuauuacucuauucuggcacauacauucaggcaaaaugucugucugucuguuugucugucuacauaucuaucuaugaaugauaaaaaucacuugaaaaaaauuguaaccagaagcaugaagagugcugacagaugcuaugaguucaaggccaaacugucuuauguugcaaguuccaggccagccaaggcuacuuggggaaaacugucucagagaaucuaaguaaauaauuaaagaaggaguagaggaugcagagucccacagccaaacauuaggcagagagagagccaggguuggaggugucucucuggucccuacacucagaguuuagggaaccugguggaugagcgggaggaggaaccgugggagccagaggugucaggacacuaagagcaaggcuacagaauuaacaaagcagggcuuggagggggguuugucacagagacaggaccugcacuggucugugcuagguccugggcguguuuuagggggacuccagacaguggauguugggggugucuuugacucuucugucugccuuugggacuucuucccuccuacuggauugcccuugccaggcuuaaugugagggguuggugccuaguccuccugugucuugugcuguguuugguugauguugcuuuuuucugggguagggguggagcauuguggugcugauguggaucuggaggaguggggagaugaggaaacugggaggaauggagggaggggaugacacuggucacacuguauuguguaagagaagauuaaauaaaaaauuuuaaaaagcuacagaugguaccaggcuuacugguuaagagcacauacugcuuuuucagagucccugaauuuggauccauccuccauauucucccucccucucuccccuguggaucaauucucagguacuuaaguauuacacaagcauucuaccacugaaauaagcgccccccccccccccaucuugcuguacacuugccccagcuggucuagaacucuagaucuuucaccacagcuuuuugagggcuagauuauagggcaugcucccuugcccaauguaucuuaaaugauguacuguucagugcuguuaaguuuagucaucaucaucauccaucuucagaaacugucuuuuuuuuuuuuuuuuuuugguuuuucgagacaggguuucucaguauagcccuggcuguccuggaacucacuuuguagaccaggcuggccucgaacucagagauccaccugccucugccucccgagugcugggauuaaaggcgugcgccaccacgcccggcagaaacugucuuuuaaauugaaauucuauauacauuaaaugguaacuccuggcaccuaccauucucucaggaaaccuuaugaguagacccacagcauuugccuuuuugugucuggcuuauuucacauagcacaccauuacacuuuucuuuucucuucuucuuuuuacaguuccacgugggagguuuauugugagggaagaaggcaaagguagugacaaagaugaaggggaagggagggagaucagaagggucugccuuuuuuccuuuucuuuucuuuucuuuucuuuucuuuucuuuucuuuucuuuucuuuucuuuucuuuccuuuccuuuucuuuccuuuucuuuccuuuucuuuucuuucuuucuuuuuuuuuuaaagauuuauuuauuuauuauauguaaguacacuguagcugucuucagacacuccagaagggggugccagaucucauuacggaugguugugagucaccaugugguugcugggaauugaauucaggaccuucagaagagcagucaaugcucuuaaccucugagccaucucuccagccccccauuauacuuuucuaacaugucaaaauuuccuucaaggcugauuauuacugcauuguagguauagacuucauuuuccccaggggguguguaguguuugguugguguuuuugagauggugcuauguagcccaggcugaccuugaaugugguauguaacugaggcuggcuuagaaugcuugauucucuuacuucuaccuugaaaacacuaggauuacuguucugcaccauuccuugucucugcuucuuugguuuagcuauugugaauaaugcuguuaaugggaaugacuauagaaauauaaauaucuuuucaugagcuugccuuuucaguuuucucuccuccccacuugccuauccucuuccacaaaggggcucuagauugcuccaacaauuccagaccaaacuuuagaaacuguuuaaaagacccuggagaguacucuaaccccagcauuuuagagacugaugguggaagauugcuacaaguuccagaucagccugggcuacauaguauaaguucaagccuagcuuaggauacauagagaaacaucaggucucccaucaguaaaccaaggcaaaacguuuauauuuuguuguaagaacccgaagaauucauuagaagaguuuaaauucugguggguaggggagugagggggaggguaugggggacuuuugggauagcauuggaaauguaaaagaagaaaauaccuaauuaaaaaauaauaauaauaaaaaaagaagaguuuaaauucauuucugagaggacucguuuuaggguuuaaaucagcuagauuggaagugacaugucugaagcaggguuagggccuaguugugauugcccauggcugugguaucacuaguggaugagggauaugugauaccuuguaaaauagucugcaguuggacuggcagcauuuacucugauacuugugucuuccaguugugucagaacuggagcuagagagaccugaguuuccaucauaggagagccauuaauuagugguaugaaaaguugacaguguucuguguuagacacauaaacaaauaagcaaaugaagugaggaggauuguauuugaauaaaaagacuagaguuaacuuauuuucugacacucuugggcuuuuggauucugacugugcuaauaaauguuuggccagaacauuaauucuacauaauguuaaacaguugagauuaguaaauuuagacuguggcaaagguagccucccugaaaagguucaggguauuuguuauuucucuugaugugaaaaauaauaccuuaguggagauuggaaacagauggugugcaguuggaguagacucuguuacuccaaauaaacauuugcuggaacuggguuacagcaauccauauuucacucuuccauauuuacauuaucaggucagcuguguugcugcugcuuuuacuugcauucagguuaucaacagguuuugauguuggcaggcugauuacaucauaucuuuaaauauuaaaaugauuaacacuggaagaaacccuguaguuaucuacccuccauacucaguggcguaaugauuauuaaugcauucuaacgggagagcuaucuaagaauagcuguguguggauaaccuagcagcacuuucucaccucuuacuggauuguaacgccuccuuucuggaauggcuugucucaggugcuaguguagcuaaccaguuaguauuagaaucagguuucaggcacagauucaagaucaguguugucuuccacacuugcuuccccaggagccuugcuugcuguggaagggugacuucaaaccuugaguccuuagcccuccuaguaguguuacagguugccccauuauguccaggagacucugucccucucaucuuagcugcaaacaaaccuuuuuacuuauuauuuuguuuucuuuuucuuucuuuuuuguuuuguuuuguuuugagacaggauuuuucuguguaauaguccuggauguccuggaccugcuuuguagaccaggcuagcuucaaaacucacaaagauuuggcugucccugucucucuguauuucucuggcuguccuagaauugaggacauuaggcccuccucccucaaggcaaggucuugcuguauacuguggaggcuggccuugagcucagagaucugccugcugaaacuaggcauauacaaccaguuccaagccugagacguacuuuuaaauugaggaagaaaugaaaauuuuauggguuuggucuuauguagucuagauuauuacucauacucauuguaguugaggccuuugaacuucugauucucuuacuuccaaguccuggguuaaggguuuaugugaguaccuucuucaugcacguuagaugaggugucuaccaacugagauauaucccaaguccuaaaugaacucuuaaucuggccuaaaaauauuauagcuauugugcuuguaggagaagauuuguguguagucuuuuauguucuuaaucuuuggugaaaggguauauuuauucuuuccuuguucuugugcuuuuuuuuuuuuuuuaaaaagauucauuuauuuugccgggugugauggcgcaugccuuuaauuccagcacucaggaggcagaggcagguggauuucugaguuugaggccagccuggucuacaaagugagcuccaggaccgccagggcuauacagagaaacccugccuugaaaaaaaacaaaaaacaaacaaacaaaagauucauuuauuuuaugaaugucugcauguauagcugaaaauuaguagagggcaucagauccuauuauaguggugagccaccauguggcugauggaaauugaacucaggaucucuggaagaguagccagagcucuuaaacacugagccaucucuccagcucccuccuguguuuuuuguuucuuuguuuuuuguuuuguuuuauuuuguuuuaagauuuauauguacacuuguagcuguacagauggcugugagccaucaugugguugcugggaauugucaagaucucugcuugcucuggccccacuauuuauuuauuauuauauguaaguacacuguagcuaucuuuagacagaccagaagagggcgacagaucucauuacagaugguugugagccaccaugugauugcugggauuuggacucaggaccucuggaagagcagucaguguuccuacccgcugagccaucucuccagccuucuuguguucuuuuaaaugccuuggcacaagucagauagaauuugaaacaaagucucauuguagaucaugaugucuuuguaucuuaacauagccgaagauggucuugaacucauuccuguuccuccuguuuacuuaacaagugcugggcauauaggacuugucgccacaccugaagaaagauuucaguggguaagagugcuugcugcacaagcaugagaacuugcugagaucuuagcaccagugggaaaaacuggguguggccacccucaccuguauaguguguauauugggaauugaacucgggaacucugggagaauaacaggugacuguguaacagcuagaggcgugggugaauagagacaggaagauuaggaagauucacugugguugcugaccacaaaucugguuccagguuuagagacaccuugucccaaaggaauaaaauaaaggaguuuagaugccucccuggcgaccccaugugaacuuacacaaguuuaaaagguguuuuuucguuuguuuguuuguuuguuuguuugggagggugucuuguuuuggggauaugaccagaguggaaacaaugucuauagaaaaccaaauguuuguuacuauaacuuaggcaauuuaaauucaaacagggauuuuuuuuuuaaacaaaacaaaacagucaacucagucaaaaacccacuacuuccuauuuaauagcuguuuuguuuuuaagauuuauuuauuuuauauauauuuacacuguagcugucuuuagacacaccagaagagggcaucagaucccaucacagauaguugugagccaccauaugguuugugggaauuuaucuucagaccucuaaaagagcagucuccugaccucugagccaucucugcgccccucaauagcuuuuuuuuaaaggcacaguaacauuuaaauaugguuaagacucaguugcacaaguuacuugguuggaaggcuaauuaagccucuaacuugcucaaauagaauuacaaaaaggcaaaauuggaauauucauagagauucaguccacuggaaucaccagcacugggcagcuguuaaauuuagacuugaaguaauuaaggaauucugacauccuuagauggucuucuguuauccuuucuucccagagauuuguggaugugugggcugacacugccaccagcaaucacagccuugaucaucuccacaaauagcaaguugcaaguaauaagggguaauacacuuuaccuuuaagucuuuugaugcaguuccugccagcucaaguaccucuauggugagaugcucuguccaggauggcugagaugucaguggcugguuguccuagauuuuagggaaccugcugggugucggggggaagagggggcaccgccuuucucgggucauuuccagccuuacugccaaccauuuggaacugugcugaagcucagacaauugaguaagagacaaggucaggcagaagcucaguagauccaagagcccgcucuuccaucauaacacaguucaaacccaguaaauaaaauguaaaagguacuuuagagcuguaaagauuauuuagcagauaaaagcugcugcauccaggccuuguagcuugaguucaaucccuguaacccacccgguagaaagagaaaauggauucucccaaguuguccuuugacuccacacucacaaaauuauagguauuaguguguugagagagagugucacuuguguauuccuggcuggccugguauucacaguaaccugacugcuucuaaaauaugauuuuugucuguuuuuggagacaggguuucucuguacagcccuggcuguccuggaacucacucuguagaccacgcuggccucaaacucagaaauccgccugcuucugucucucaugugcugggauuaaaggggacuaaaggugugcaccaccauugcccugacuuuuuaaagaauuuuuguuguuguuguuguuuaugaaugucuuaggguuuuacugcugugaacagacaccaugaccaaggcaagucuuauaaaggacgacauuuaauugaggcuugcuuacagguucagagguucaguucauuauuauuaaggugggaacauggcagugucugggcaggcaugguguccucucaggaagagcugagaguucuuucuguuggagugggugugucacuguaggugugggcuuuaggacccucauccagcugccuggaagucaguguucugcuagcagccuucagaugaagauacagaaagaccacacuggcuuugaacuuaggcugucucugccucccaaauucugcuauuaaaaggcgagcaccaccacaccuggcccuuuuccuuuacuuaaaaaaacuuuuuuuuuuccuaucuauguuuugccagcauguuuauuuguacaucuugaaugugcccggggugugaggaagauaaaagaggguaugguaucaaauccccugaaagguuauagagaauugugagccacuguguggguccugggaaucaaacuuaggaccucugaaauaacagcaagcauucuuaaacugcugagccaucuccccagcuuucacauuuguuuuuucuucuuuccuuguaaauuccuugucuuaaaggagcuuugguuuagaucagugcuuuucaaccuuccuaaugcugcgauccuuucaguuucucauuuguggugacccccaaccauacaauuauuucauugcuauuuuaugacuaauuuuguuaagaaucauaacauaaauauuugaugugcaggguguuugcuaagcaacccucaaaggguugagaaucgcugguuuagauuggagacaugacuuuucagaauuagguacuggaaauggcagcaaagaaauguaaagccagauuuuucaugggacagauauggacagauuguagaauguacagagcgaugagaucugguguuggggucugggaaucacugaucucacacagaucucagucagacaggguuuuuugaauguacacgccaagacugauugaucaaucagggaaguaguccaggcucgggaacugaacugccugccacuuugagucaagauccuaccagcuuuuaaggcugaaacccaguuaucacagucagaauguaaggagggggcuuccgugggagccuguucuuguugcaccuuuacccugucuucacuguuugggacauucagcuguagcaggggacuugccuuacccgacauuggcgcuuucaccugccaagcauaguguaaguuacucugugcaugucuccuucugucagguaggaugucaguucccagggaggucuuaggaacguaaaacuuuacuucaccccuacucaaaauggaaguuuuaaucuaaaugacuucuuauauuuaaaaauauauuuuuuaaauuauauauuuuuuccauucuuucauagagucaauuuucucauuauuauguugggucucuuccaguuugaagcugaaguauuuuauuuccaaacuucuuauucaccuaccaacugggaacauauauuugguuuagaggcaauauaaaaacuuaauguccugccagguggagugacuaauacuuuuaauccaaguauucaggaggaucucugugaguucaaggacagccagggcuacauaauaagacccugucuagaaaaaaaaaaccaaccaaccaaccaauaaacaaacaaacaaacaaaaccccucucauugucccauacuaaauacauaauuuauuucuccaaauuuacucuugcuaguguucuuucccuucgucagcauuuccuccuuggugugcauuuccuaucuaucaccucaucgugaccagguacaucuccaguguucuaaucagaaguaucuuuuuaaacaccccccuucccauuuuauuucuauuguuaaugcguucucgggcauugcuguucuuuuuuucuuucuuuuauaguuuucuugucuuuuuguuuuuuguuuuguuguuguuguuaagacaaggucuuccuguguauuuauuuauuuauuuaucuauuuuuuaagagcauuuuguguauagguguuuuuugccugcauguauugauguguaugccuggugcccacagaguucagaaaaugguugucagaucaccuggaaguggaagugcaguucuggaugguugucaaccaucauguggugcuggaaccaaacacagguccucuacugacaggacaagugauguccucuuaacugcugagccaacuuucucgaccccauuuaucuuacuuguguaugcauuuugucugucuguauguuuauguaucacauuugugccugaugcugguagaggccugaagcauuguauccccuggaacuggaguuagagaccaccaugugggugcugagaauucaaacccagguccucuggaagagcagcuguguucuuaaucucugaucucucucucuccagcccugucucugauuuucauagcuuuccuuucaaaagguuuuuguugucauucauugacuuguguugaaaauaagauguagaaaggugaaauuguuagcuaaacuuuguguagaucaugaguagcaggaggagccaaaucagccuucuccuuuugcagaccaucauuacuguuuaaaguaggaauaauaguacuggugcuggaugguggagugaaggaaucgagaaguagguaacgcgcgugaccuguaaacuguucuugaggcuggauuuuauccacuagcuaaguucucagaagaugaagcaugcaguuggaguugggcugacccacuguuguuauucugccaagugcugaauguuaaaacacaucuaucugacugcugagccuacucgagccuggagcacccuugcuguaaagacagguggucugagaaagauccccuccagguugaugcacacugcacauagcauaacagugugagacaacugccgguuccuuccucccauccccuccagaaagcugggccccagauggaagaccuggaaacacgucaacuguucucugaagggcacugagaaaacacgggcaggaagaagaagccaguguaacagcucauuaggccacuaaucagauaggacgaccaucaucucaugaagaaagcaaccaggcuagggacagcaagagugggaaauuuuaaccucaugguuuucagaauacuguagguuuuguuagggggauuguaauguagcggguagggcuuggcuuccuugauacuuucuguuuaucugucccauuccaaaauuagcuacuggaaacuagaacauaaaacaguauuuagggacaucuuuccuaucagaaaaugugguaaauaugcuaagauauaccuugugguuuauaugaacaugcuagaauauacuaucuuaauaacugauccuacaagaaaacuuugauuuuuaccuucucauuuaaaccuuuucuguagucuuuugcacuugaaauugaagacaacugcuacugcaguauuuaaguuuaaaaauauaagacaagacaaaccccaggaaauuagugaaagguauauaguuaacuuuaaaggugagccuauuaaucaaguauuaauagguucucucggaugagaaauaauuuauuuauuuauuaaaagucaggguuuugccucauuuaauccaaaaugucuuaaagcuagagucuggcuuuuagcuccugauccuucuguuuuuaccuccccaguccugggauuacaggccgugugacaacauuugagauucuguuuugguuuugguuuucauaauuuuggggauuuuucuuauguguuuauuuguuuuugccuccauauaugagaggccagaggaggcugagagauugccuggaacaggaguuagauagagaagguugugagcuaguaacugaaccucuguccucuguaagagcagccuagugcucucaaccucugagccauccaucucuccagcccccauuuaacauuuuuuuuucaugugccuuggcauuuugguugcauuuauaucugugagagcaucagauccccuggaacugaaguuauuuuauagacaguuaugaggugccaugugggcacugggcauugaacccagacucucaggaagagcugucaguguucuuaacugcugagucaucuuuccaauugugcuugucucccucucccccccccccccccccaaaaaaaaaaaagguucuuucccaggucugcaagguggcuuagcuagucaggugguuacugccaagccugauagccugacuuuguuaucuuggaccuacaugguaggagagaucuggcucuagaaaguuaucuucugaucuccaaacacauagcaugguaccccccucacacgcacacacaaacacacuaaaaaaguaaaaaugcgauuagauuuuuaaaaaacagguuuuuuccuauuccccaaauaagguagcacccacagagcuagauguuaggacaugaacccuuggaagcuucaucuuaauuucugaguccucugggggaaauagguucauuuucaauugucauugauauuuauuauuauuuuguagagagcuuugaccucccuuucuuuuauucuuuacaguugguugugagaaaagggugccagcaaugccuggaucgccuguggaagugaagauacagucaagauccucaccucccaucaugccaccccucccaccaauaaauccuggaggaccgaggccaguguccuuuacuccuacagcaugugagacuucuuaauuaacuugaacuuauaacucaagucguauuuugaucugagugauagguuuacauuaaaccuucaauauauacaccauucaccaugacuacacacacauacacacacauugagguauagcaaugcauuccuguaauccaguucucagaggaucaagaauucuagggcagucgggcagugguggcacacaccuuuaauccuagcacuugggaagcagaggcaguuggauuucugaguucgaggccagccuggacuacagagugaauuccaggauagccagggcuauacagagaaacccugacucaaaaaaaaaaaaaaaauucuagggcaaccccuuggaauggcucauaccuuuauucuuggagugugggaggcagaagaaacaaguggcuuacagugaguaaaaauguagccggggaaugguagcacaugccuuuaauaccaggauucaggaggcagaaguagguggaugucugaauuugugagcagccuguucuacagacuaguucuaggacagccaagguuacacaaagaaaccuugucucaaaacaacaacaaccgugaaaaugugaugauacaguuuuauuuaaaaggcugugaaaagcucaucuauaccguucuugugaggcacuucaaagaggguagcucugaucaggagggaucuuuaaguagaaguaaagaaaugaaagaugauuguagcuacguuucuaggugggugagguuaaguguggagcucuccuuuccaguaguucuaguucuuuuugaauggaagaagaaaauuguucucccuuuuuucccucagcccauuaguuuuauaucaauucaguaccauuuuccugagaaccaaucuacccuuugcuagggaauaaacaaagcaaaagaaugaaagaauaugggguugauagcucacuugguaaagaugcuugcugccaagacugacaaccugaguuuguuccccaggacccaugcuauagaaggauagagagcuccgcagacuccacauucacucuggcauaugcacacacuugaaugcacccauacacuaaauacauguauugauaguuuacaaaaacuuaguacugcauauguauaugcuaaagugauauuuaucaagcagucgcuaaagugauauuuaucaagcagucucuccugauguguugauauauacuuguaaauaaauguucaagggagaagggaaguuagaagauagagauagaaaggucucuaguucaaggccugucucagaaagcaaaaaccaagcaagaaaaagaccauuaaggaagacuuaaggccuugccaguauacuaaaagaaguacauuuggggagguaaagugguaguuuuguauaugcaaauuucuggaauucgcucuguagaccaggcuguccuugaacucauagagaucuaucugccucugccuuggagcgucugggaauacaccuggcucagguuuauuaaaucucuuagaauguaccuuuaaguaaagcaucacuauugaauagugaugcuuuacuuaaaggugaugcuuuacuuaaagguacauucuaagagacaugccauggcugucaagagacagccguggcauguaagauaaagaagaguuugcugguucagauuugaauaccguccuggcagaaggaacagagauggagaaguaacugucauuauuuuaggagaaaggaaguaugacugaguucaugcuggucuucauacuuguaaauggcaguuuuauuagcuaauuaaaaguuaaaggauuagccuucuaaaacacagcugaagucuuuuccgugcuuuguugcuugcaugcuugguuucuguuugguuuugguuuguagucuuauguagcucacugcucuugaacucuguaaagccgagcaugaccuuagugucuuagugucucuuaguguuucugucuccaauuucuaaguucuggugacaucuuaggaaugugcccccaguccccgguuuuguuuuguuguuuuucuaagauaggucucacucuguagcucaguuugucucucaaguuggaauccucauaacucugccuccugagugcuguuaaaaaaguccaacagcacccauggugucuguagcuaaauauuccuucugugccuaugaauuuucuuuguuuuuuuuuuuuuuuuuugcucacuauagccaggucuccuugaacccaauguccuccuuuacccaagugcugggauuauguucgacauuacuauagcugccuuuuuccuguucuuuguaguaccuuacaaugauuguguguggauguugugucugcuuguuuguucuguaaauaauguuuucauuuguucuuugagaauuuccuauaauguauuuugaucgcauucaacccccuccccccaauuccuucagaucuuccccuaacuguucuacuucguccucucugucugucuguuuugucuucacccuuuccucuuuuuccccuuuccucuaguuuauguugccugacuaccucuggguaugagaucuaccccagaguaaguuauaacuacacugaggaaaacagacuuuacuuaucccagcaaggaucaaaugucaauagcuacucaugaaagaggguggggcauggcaugggaugauacuggacugguugggauggacagacuucaugcucaccucuccuauccucuucuaugcugaaauuuuaucuggcuugaacuugugcauacauugacaaucagucucuguaaguuaauaugugcaucugacuuauuauaaaugaaaaacacuguuuccuugaagacaacaaccaacucuggaccuuauagucuuucucauagacugccuacaccaugaagggaggaauguaacagagauaucgucuuuaggguuuagcauucugaagccucuuacucugcucaugcuggccgguuguggauuucuguguuaguugccauccacugcaggaaacuucugaugagaguugagcaaugcauuuauuuaugcaucacuuagagauucaaggugucagcaaauaacauaguagguuuucccugagugcucaugaccuccuuagccaaaggugcuuagccuuguugaugcagugucagauacagguucugucuuguggagcaaggccuuacgucuacaagaacugguugaucacccugucacacugaugccggugagcaggggucauuacucagagcuggggucagggcugauaauuugguguuuucucuagcagcaaacacaacaaacagcaaacaucccuuuagcauuuugaacauuagccaguagagcuaaggacaaacgagaguucucugugucuguugacuccuguauugguaucuccagcaguagggucuuacagaaaguucuggaggguaacgaauagcauuggcaauagccuuuaaagguuggaguugagaccccauugucaaaccucuuaaaaagaguuucuuugguagugucagcugcguaguugggguauuguuucccccauuaaaagaguaucaccauuucaacucuguuuuuuuuccuacauguauauauuuuaggaagcuucuacaaugguaaguuuucugucugaccuuuucaaagggccuuuaaaguuagcuauccuucccauguuccuuccucuauccugccuuccccaccuuauuuuuauuucuuuuuguuuguuuguuugcuuguuugcuugcuuuugaaaugucacuauguuacuaagucuagccuuguauuccugggcauacacauuuuuuuucccauucuggcccucugacuagccauaacuacaauagaagcacauauaucacaauacuuauguuuuaacauuuguacaauauucugucaccauuuuuuccugacaguuugucuugacacacagcaaacucauugaggguggaaauaaguuuuucacacugacaugcuuuacaugcgugaaugaaagagaacauaaaggugaggaggucagcaaauucucuucaguucugcacucacugacuccucucauucuggcuuucuuuuaguaagcaauggcaucaaccauuccccuccuacccugaauggugccccaucgccaccacagagauucagcaaugggccugccuccuccacaucgucagcacuaacgaaucaacagcugccggcuacuuguggugcucggcagcucagcaaguugaaacgcuuccucaccacucugcagcaguuuggcaaugauaucucaccugagaucggcgagaagguucggacucucguucuagccuuggugguaaguacagcuucaccuccaccagcugccuaagaagugguauuucugcuuauuccccaaccauguagauaaugucuuacaaauuguguaaaacuguugaauuauagauuucguagcagcauuuguuugucagaaaaaucuuuagugugucuuacuauccagggugcugauauaauuccaggaggcagcuuuggauuugucuuaaacagcugacguccagucaagucaauagaaggcuguuuguguggcagcacagcuagcuagugggugcauuauuuggaaaccaguuuuaauuuucaaaacaugauuuguaaaaguagacguuucauuaaauaaauaguaucuaaguaguuguguuguuuagcuccuuaugcauaguuucuuuaguuuucauucuguacugaucuuagugagccugcucauaaaggauuaacucuucuauauugccaucagggugagacugaauaucucaguuuauaagggaagugcuacuaguucucagaauuuucaaaugaaauacuguaaaauucacuuuugauaacagcaugcuguguuuuuucaugcauguuggcuucuauuuaugaugaaagaugaauuauuguacuaguuauuuuuuguuguuuuguuuuuguuuguuuguuuguuugggacaggguuucucuguguaguccuggcuguccuggaacucacucuguagaccaggcuggucucaaacucagaaauccgccugccucugccucccaagugcugggauuaaaggcgugcgccaccacgcccggcuuguacuaguucuuaaaguuguauuucuucucaaaauacaauuuaggucgaggccagccugaucuacaaagugaguuccaagacagccagggcuacacagagaaacccugucucgaaaaacaaaacaaacaaacaaacaaaaaauacaauuuaggaaaaucccugagguccccaguguccuggagggcaggagauggaacauaguugguagaguccuuaucuaguaauggguacagucccaguacuuuggaucuuuaggcacaaagaucaggaguuuaaggucaugcugaguuacauaguuucaugucaauugaaacaaggcuguguaucagaucuuaucuccaaccaaaaacaaaacagggucucauguagggcaacuugccuugaaccagauguagucuaggaccuugaacucuugauucucccgacucuaccucuuuagcacuagaauuucaggcaugagcugccauuauuuuguuguacugguuuauaauaccaacauuuauacacuuugaccuuugacaaacaugaauuguuuacauuuggggauaauuugucaggggucccuaagacugccccguguuuauagauugguuaucuucucuauauaugacauauaauggugcuaaccaacauuuauucuagagcuaaaauaaaauuagacaggaagaucauaaaaaagaucuacaugggcagagcaugugcugacuucuuuaacuaaaguucuccucauuccaugauuacacagaacauauucuccucugagcaaagaaacuagauaauaugcugcagcuggggaagccugaggagcacuccagacuuguacugugacuaggccuucuuaaccacccacccacccacccaccucaagcuccucguauguggaauccaguguuuuggcauaaugagaaacagugagccacuucugucacuuagagaaagugugagguuguauguguguauuauuuccucuguuuguuuauuuagaaaaaaaaacccuacuuauuagucaaaauauaaacuaacauuauugaauugagacuaacaaccuuuuuuccuuuaguuuauucuuguuguguguccaugaguguuuugcuuguauacacguaugcauaucgugugugaagugucagaggaggccagaaggcauguauuggaucccuugacuggaauuacagaucauuguaagcuguaaugguaccacauggucaccugaaagaauggccaaugcucauaauguugagccaucuccauaagcaagauuuauuuauuuuuuacaaaggaaaaaaagauuuauuuauuuuuauguuauauaugggcauuucaccugcguguaugucugugccucauaaguguguggugcccaaaaagccagaggagaguauugcagccuaggaucuccuuuguucguguuuaguugauuuuucucaucccagagcucuuccagcucucacugcucuggugcugugucuguggagcuuaguggguaugagaacccauuuuaucacuguuuuuguacuuugaaguuuuagucauacacuuuauacacaaauuacucuacagucuuuuuaauaaauugaaacaguaagugaaaaguagaaaauacaauggugaugccuuccccuuagugauguaucaaaagcauuauucauugccccaauuagugacaacgugaacagagucuauaaacaagccaaggcauuguaaacugguuguugaugaugggcagguucuagugcuaauccagggccuaagugaucaccaccuaauuuguuucggagggaacaaggccagaaaucucuaaugaaucugggaauuuauagaaaaguagaauaggcuauuuuaaaccugguuuagcaguacuguaaugcagcuucucccaacccuaguuaaguagcagcaaugcauuuaaaaccauuaacaauguauauauugcacuagguaagugaacauucugcuuccagauacuugcauugcauuuccaagcauauaacucucaggcagaagccugaguacacaggcaggggcaagcugcuuggacuuuguaacccaacaugcucugagcucaguucccuugcauuacaguuacuugguuugugauuucaaggcuugguagccuuguguguggcugccagccaugcugccgccugccucuugcuggcauuuacauccucucuagcuaucagcuucagcuauguugcagccucugucccuggcaguauguacugcagggucaugccuguggcuugagugcuugccugcuccuggagugaagccuucugugagaaucugcauaguauggacgugcaaucucaggcucacgaugacugucuucauccagaaucaagcaucucuggcuucucauucagagaaaaguuacccaaaaguaacaaggaagguagcuccacuuaagagcgccuugagcugcuugcuauaaaacucagccaugcagugggacagcaaagcacacucagcacacuggagugcugagucauuuagcacacgugcugaagugccaccuucuggcugcagcaccugucucagcagcauuuucuacagcggcugcagugaugcuuucugcugauaaagucaaacguggugucacacugcauacaucuuggacauuccuugucaagaacucacugcuccuccaagcugaauaggcuuucgagggugcagugugcaguccacugggcgagugcacaaacuuggcauugcuacuugcugcagccacagcuugagcagcccuuacacugccacacagggcagccuacuuuauaaguuuauagagcacuacauucccacgugugccacuucugucacaacuaucaccacugccauucaucuucagaacuacuuucaucuacuugguuuuuucaagauuaugucuccuguagcccaggcuaaauucacuguguagcuaaaaaugauuuuugucuacucauguuucagucucuaccuccccaggguuaggauuauaaucauguggcaccauguucaguuucuguuguacuggggaucacauuuaggccuucauguaugccagacaagcacugcaccaauagagcugccccucagccccuucacgguucgacagugaugugauggaugugcaagagcuuuguaaaggacagggugucuugugucaucuguauguacaguguuuguuuauccguguguccuguaugaagggugguagauuguugcuucugcccugucaguuagggaaaaguuuuauaucauuguagacguuuuccaguucacagucucauaucaacugacagucugcuuuucaugcaagccugcauuuccuuuucccuuuucuauuuuuauuauauuuuaaucuuuauuauaguauauguguagguauggcuguguuauagggguucuaauguccucuucuggcccccacagguaccaaacacucacauguuacauguacauacaugcaggcaaaacauacacauuaaacaaaaauauaaauuuuuuaaaaaauaaaaauuauguuaaaauuuuuuaaauguuugcagagguaucaccuuaagaaguuaauuuaaaagcuggguccaggggaaaugcgugucacacggcuuggcggcaguacuuucacucacugagccaucuugcugccagcccaagaccuucuguauacugagccuugaccaguauauagguagugguauagaucuauagguacugugaauuagugaguuucauaagauguuaacaguggaggagauuagagaaacggcucauuauguaacccuucuaauuuuaaauuuuucaaauaaaaaauuauauaaaauguaauaaaaauagaaaaggggaaagaaaagguaagccuguaugaauugauugugugaguacuuugucuuguguaggucuguguaccacauguagccugggacccucagaggcccaaaggaguguauuaguuuauaauuuuucucaaaaaaauuaaaaguauacauaaaguaaauauagcagcuagugagcuguugaggcagccuguguuucagagagguccugucaccacccagcaaguauggggccuagcucuguccuuaccuauccucauacuuuaucuccuaagauagucccuuaagacuaaaucuucuaauguuuaccuuucaaauuuucucucucucaagcauuucuuagccuuuaaaaaagauuauuaaagucgggcagugguggcacacgccuuuaaucccagcacuugggaggcagaggcaggucgauuucugaguuugaggccagccuggucuacagagugaguuccaggacagccagggcuauacagagaaacccugacucgaaaaccauuguacacagggucagauguaauaguaguacaugacucuaaucccugcacucuagcagacacaccaugaagaucucuaaaguucacgccagguaaagcuacauagugagaugcugcauuaaaacaaauguuuaaaaauguaugcacuugugccauuguauuugcaugaaagucagaaguggaauucaggcuuuggcaguaauaagcaccuuuacccacugaaucaucucgcucacuauuaaaauacgagaaacuuaguggucuuauuuccuccuggacugugcagucuuuagaggagggaaaaaacaacuaagcaaaaacuaaacaguuauauucuuggugauuuaacaguugacugaagucagucugguacgacagcucauucuucuugagaugcagucugcccuguuuuggccacacaggcagccuugagucucucucuuccucuggcaugagucacuuagucucugcuagagauuuguauuaucacuuugucuauccacagggaaaguucaggucauuccuuuggccuuuccguacacuuaaucuuccuauuuuuuuugcugugugugcccaguuuuggauguugacuauuauuuaucuuugcagaacucaacaguaacaauugaagaauuccauugcaagcuccaggaggccacaaacuuuccucuucguccauuugugauuccauuucucaagguaauucugagaggcauuuguuguaguaugucaucagcauuuccucaaggucugcugauccuugcuguuugaucuuagcaaagacaacuuguuggcauuuuucauaaauuuguuuuauuuguagcugauaggugaacaguauguaaguuggccucauuugaaaugggaaugauuucuguuuccagaacucuaguuagcauccaggagcaacuacaggaagaaagaaccaagaaagaggacagaguaugcgaguuugugggcauagagggaaugccacuacaucauguagauguggucugaagaugaagaguguguguuaucugaaaggagacccuuuacaaagacgcagugguuguguuacucaaaccccagauacuacagucuaucgaugucaucuugaauuguuuucccuggaacauacuuuuguucacaucauucuaaauuaucacgccuucugucuuaguuagguuguuauugcugugaagagacaccaugaucauggcagcucucauaaggaaaauauuuaauuaggaaugguuuauaguucaaagguuuagucuguuaaaugucauggccugcuggcagacucaguguuguagaaggagcugagaguugcacaucuugauccucagaaagcagaugacuaugucacuugcaugacuugagcauauaugagaccucaaagccuuccuccauaauaacauaauuuccuccaguaaggccacaccuaacccaaggccacaccuccuaauaaugccacucuaugggccaaccauucaaacacaugagucuaugggggcucuuucuuccuuccuuccuuccuuccuuccuuccuuccuuccuuccuuccuuccuuccuuccuuccuuccuuccuuucuggguuuuuuguuuuguuuuguuuuuuuuguuuguuuguuuguuuguuuguuuguuuguuuguuuguuuuucaagacaggguuucucuguguagcccuggcugcccuggaaccaacuuuguagaccaggcuggccucauacucagaaauccacugccucugccuccuaagugcugggauuaaaggcguaagccaccacugccaggccagggcccauuucuauugaaagucccacacucauucucauaaguguuuuuauuuuuaagaaccuucaugcucacagauaagguguaaaaugguacaauaagcuuccuuuauggcucccaaaccaauuucccaaaaaggagcauuucacaaucauuuccuauuuuucuucggauauauauuuuuuuaaaaguuguagaugugacacacuuaaauuaccaaaugaaaaauuucauuuuucaugauaguagggaucuaaucuugggcuucaggcaugccaagcccauguucucucagguagccauguccagagcucuuaaaucaagauguuaacacucagucaacacuuguuguaggauguacagacuuauuuauuuuuacuaguguccuacuaauguucuuuacagcaaaguuaagcuuuuguauguguguguguggucuaauaaauugauggauuccucagucauacaaaacaugcuaaagggaguugggaaugaaaaccuuucuuuccauagucauucaagaacacaaaaugaagaaaauuccaaaaucuucaaccuguggcuuucucgauaauaggguacaaauucaguuggcugauggcuaagagggauggacuagagagagaaaaugggugcuuaaaggauuuugaagaaacuagcaacugugcuugccugucugucuguguuucucuucauuucccuauuaaccaggacucugccacauaguaucaccuaauuacagcagaggauagaaaaccuagacagaaaacuagggaaaagggcugguuacacaguuuccaccagagaugcuaucugagggaagauucuuuuccucucagcuacuggccuuuucucacacaacugagguauaugggaaagcccacuguggaauuaccuuccugaugcaucccaugguuuauucucugugcccugugcucuugcuuuuucguguguguguguguguguguguguguguguguguguguguguguguguguauuucuauuauauugucuggaaagggguugaagaacaaugauaaggaggguaaaaaaaagagcauggcccugagucaugacauaaaaagaggacaaguacaggauucuugucugcccaguaagccaauugcuguucuugauggccuugcaacauuagagcuuuugaauguaguauuugguaccauuaaagcuucugccaugucaggaauggaaagagaugcaauucuuaaagauucuuuguacaguguagugcugauuggccuggaacucucucuguagaccaggcugguguugaacucagagaugcuccagccugugcaucuccauugcugggauuaaaggugugugccaccaugccucugccuuccaaauaaaaaaccaaguuuuuuuguugaaugugaggaucauggucugggucuguauuuacaugacuccacauugcauauaguauuaaucuggaacaauuucucuacuuuuacugaguguuucaucuuuguauaauuuuauuuuucaucgugucuaugaguuuuugugcuuguggaauccagagaaggguguugaauccccuggaacuggcuuuacagcugcugguuuugagccaucuacugugagugcuggguucuuuaagugugggucaacuuuccagcaccaagagcuuaauaguuuagaggguacugaugauuguaaagaagcuuagcuugcuuuguucaagaaauuccucuucuugacgcuuaaguuauuugauacauuuuagugaaugauuguggauagguuaguauaugguguugcaugccuguaaucuaagaaucagaggcaguagaacugcccaggucuauguagcaaauuccuggcuagcugauggcuacauagcaagaucaucuaaaaagccaaagacaauguauauauauaaauaauuaucaccccuuccccccucccccccaaaaaaaaggaauuacaguaaguuauaucaccacauacaugcugucauaggacauaguaaugauugguuccaucaaugauaauaccuuuucuuuuuucuuucucuuuuuugggggggagcaauuuaguaaagcugguugccugcuauguuuuuuucccuauaaaguuaauauuuucuuagauuaaaugauuauuuucccauauagcuuguuggcacacaacugcaguucuaguaccugggaugcugaggcaagaggaucagcuucccaaaugcuagaacuacaggugugagguaucuugccuaguugguuaguaguacuuagaaccauuuaggacuguaacauaguaggccaguccaaucaggaagguauucuggcacgagguuuacaagccuauagguuccuuacaguguggaaaccgugauggcugaaagcacuguaugaccuuugucagcucugcagcaccgaugcugcuuggacccugacuaauuuuucuuuacgucuaaaucuauagacaguuauucacugagaauguauaaucaagagaucauuauuaaucauaaaaucauuaaguuaggcaguaguggccuuugaucccagaagaggcagguggaucuccaaagaguuuugacacagagaaacccugucuugaaaagccaaaauaggaaaaaaaaauaugaaauuugugaugauagaauauaguuagcagcggggcgugguggccgcaugccuuugaugccagcacuugggaggcagaggcaggcagauuucugaguucaagggcagccuggucuacagagugaguuccaggacagccagggcuacacaaaaaaacccugucucaaaaaaaauaaaaaauaaaaaaauuaaaagaaauguuucauauuguuuaauucuccuuucuuaacuauguuuuuuggaaaacaacaugaaugagguagguuguuuauacuguuucaaauuuugucaauuuauuucugcuuuuaaaaaauccacuaauaauggugucuauuaaaugaacccucagugagggguggcugccugcauguguuagcaccuuguacuugcuuauuugccccuugagguaaagaucuuuauuauagguucucauucaauuaucuuuaaauuuaggggaaaaaauuuuuaauguauauaaaaagaaaucuggaaaagaauuagaauucugaaguuuaaaaguguguguguguggggggggggagauagucuuaaucuaccaaaauuuuucuuaauaugagaaugaaaagacagcagaauacaauuuuucuuuuccagauuacuuuauucccaguacuccucuucaaaaccccauuucuaaaguaauccugguuucugagauuccaagacuccuccagagaccccuaagagagagcugaaugccacuaucauagaagggcugugauuagaggagagaaaccaggacuuguaguucuccuuuuuagacauuaguaauucucuaacugggcagucuucaagaaaauguguaauuuggaugcuggagauauaguuugguaauagagcauugggcccuaguacuauuucccagacugaaaacuuucuuacugaaaauguuuuacggcuggagggacaagacagccuagugaugagugcuugcuguucuuauagugauguggcuugaaaccucuuauaacuccagcugcagggcaucugcacucacauccccaaacacacacacacaauuacaaauaaaagacaucuuuuaaaaaaaggaaaaauguaugcuuuaaaauuauguucaauaaaccuuuauugugcucuguaugaggccacaaaaguaaacuaagggacagucccuuuaagaagauugaagucagccagucaugguggugcucgccuuuuaaucccagcacuugggaggcagaggcaggcggaucacugaguucgagggaagccugguccacagagugaguuccaggaaagccagggcuacacagagaaacccugucuugaaaagcaaaaauagaagauugauugauaucuugcugggggggaagaaacagaccaaucagcaacucaaaaaaaugccccuuuacugcuuggaugucacuuuacucgugaguguuagagggagaaagcagagggcuuuuggucuaugcgagcacauugagaccuuaaucucuguagcuagggcucagaagaaaacugccucuuuauuuucaaggccaaccugccccugcugcagcgagaacugcugcacugugcccgggcugccaagcagaccccgucccaguaccuggcccagcaugagcaccuucugcucaacaccaguaucgcaucuccugcugacucuucugaacugcucauggagguucauggaaauggaaagaggcccaguccggaaaggugagcagggaagaggucuguuuuguuuuucuggagccacucugcuuuaaaaggaagaggguuugguuguugggugguagacaaugucuuagacuuuccaagauuaguuuuccuuugucccaacaacucuucaguugacacauuccuuuugaggaccucugcccuggaguuuacgcagguucacugucccagaaguggaagaagagcagucauuagucagucauccuuuacucuuguuguucucuaccuuaagauagagcuggcgcugcagguugaagacuuagcucccaggauuguccucucgcuuaagcuaacuacaagugucagguucugugaauacuguccugucaaacaacugugcccccucugcuuuuuucucauaggcuguuucugaaugaucuacaaauugggcuucuuuugguggaagugggguucacgacaggguuucuguguagcccuggcuguccuggaacuuacuuuguagaccaggcuguccucaaacucacagagauccaccugccuuugucuccugagugcugggauuaaaggcauagcaccacugcugggcuaaauugagcuccucaguauuguuuaauuguucauugucucagagaacucaggaacauuagcuggcuaaugauuaaggauguguucgucggauacugaugaacaguaggcaaaggcaaggcacagaguggcacuggguauguggagugggccuguccucuccugguaguugcaccaccaucuccaaagagacgccacacauacauacucagcucuucagacauucuugucuaucuugucugcuucauuccuuaagugugauugaaaauggcuaacucaugaucgacuuaaccuucaaucaccuccccucccuagggguggauaguguaauucugccuugguccuucccauaaccagccccaauccugaaucuaccuaguaguugccagccuacaguuggcuucuuagacuuagcacuuggaagacucuaaggacuuuaugacuagcaugucaggaaguaggauaaaguggcugccacaauaguauaugaguuguugaggaagcgguauugaacagcagaaggcuuauuacaguugaagcuguguuacuaagacccauaaugagucauagaggcagccuuucuucccaggaaaucaccuccauagucagaaauuugaccuucugcauuccuaaacuuucucaguucuugucccauucaguuucucuuuuccugugucacgguuauaugguucugccugccuacuuaggggugaauuuggccugucuucaugcuggaauaaagaagcauuuacgaauugugucuagccugaagacaguuugguuccugccucuagguauaggaacacacaccagaagaggcacaaaagucagaugucuaguuuggcugacagcuggaagaagggcugaagggcugggaguauaacaauaugaagcaugugcuuaguauaugggcugcagcacccaaaauaaccauucuugcuuuggaaucuucagaaaaauagcagucuuccugcuuuggaaagugaauagaacaaaacauagugugcucuagaggguuccagguuucauagcaucuaaaggggggugagacucugggaagaaacagcuauucugagacucguagggauguuaacaugaacacuucuugacaggcuccuauaagcacuucaguuucuucuacaggagggacgagaauaauuuugaaagagauacaguuccuccugaaccgccugccaagagaguguguacuaucagcccugcuccucggcacagucccgcccucacuguuccccuuaugaauccugggggccaguuccauccuacuccaccaccucuucagcacuauacacuagaagacauugcaacuucucaccuguaucgggaaccaaacaagaugcuagaacaccgagaaguucgugagaggcaccacaaucuuaguaagugaucucagccccaugguaaugccuucaucuggagggaguucacagacugcuuuccugcucagugauaaagccaaauaauagcggcauugccuuuuuucuguugauacgaugauguuauguagcuggacauaguggcacauacuucugauuccaauacuguaaaggcugaggcacaaugaucggccuacagucaucuucaucugccuaaggaguuuguggguugccuaugcuauaaauaacgauuaaugaaagggcugggcaugguagcacacuuauuagcagccaggaggguuaccccaaguuggaggcaaguuugcucuacaggaaucccaggucugacgcagcuuauuuggcucuaccuguguaaucuaauggaaauuucuuaggcucuugagccugagaguaauaaguucugaaaagaauucugaaaugggggcuggcaagaugacucaguggguaaagggcacugacugcucuuccaaagguccggaguucaaaucccagcaaccacaugguggcucacaaccaccccuaaugagaucuaaugcccucuucuggugcaucugaagucagcuacaguguacuuauguauaauaauaauaaauaaaucuuuuuuuaaaaaaaagaauucugaaaugaaugaagauaucguuaccaucucugcucuuuugcuagguuugaaaugccugaagcaugggacuguguaacuauuaaauuuagaaauaaacacuucauuuuaaaacagaaaaacaccuacagauuccuaauuugagaucaauuuuggaaagagcuuuuugucccauucucuucuggagucuguuuagcaucuaucuggcaaaagaaaaaaaacacaaguggcuaccauuuuguaggguuuccuuuaccuuccauuuuuuagugacaccuuguggagaacacagugauucuuucccauucugacuuaggcuaacuaaggcaccaaccucaguagggccucgggcagcaugcagcucuuagugcgugcaaaggccaugagagauuugucuccaugcauuuacugagucucagcuauaccucauuauuugauucagucuuuccagaaagucugacagucacuaauuucuucauacagagaagaucaaagcaaccguggccagugucacacagcuaguaaguugucuugacaagaugcagcuccuaagcugcuggcuggaaguugaauuuggcuguauugggaacagaugaugauccauaccuuccuugguauccaguucuuauucucccaugccucuuucuucagcuguuaaaaaaccagacuuggggaugggggugcacagcaagauggcucagugaauaaagacacuugccauuuaagccugggaccugaguuugauuccuaaagagaaugcacuccagauaguuguucucuaaccuccaugugucaucaugaugcacauaaagauacaacaacaguaauauuaaaugauuuuaagaauuaugcuggucaccuauagcaugacuaaauaaaaugaacauaauccccuauuugggaaucuuauaaaauagaagguuuccauaugacuuuccaaacauauuuaguauuagucugccaagcccuuccccuauucuacccucccgaauucccuuucuaucauuuccccuuuacuucauaucagcuauguucgacuauccaccauccuggcuaguuuucugccaaccucacacaagguagagucauuuuggaaggggaacucucaacugagacaaugccuccaccagacagacuggccugugggcacuugcuugauuuuugacuugggagaacuguuuaucaugggcagcaccaccccuggacuuccauggccucugcaucagauccuuaaaaaaaaaaaaaaaaauuaugcugucauuuacuucuucauauauaguuuuuguucguuagaagaauggugaaagcuagguauaucuguuuuguuagauuuuucuuguauuucuaauucauuuaggaaaagcuauauuuacauguggaaguguaccuugaaaaagacugcugguuaccuuccaugauaacuccgccagucugaucaaagauuuguuuuuccuagacccauuuagaaaugucuacccuauuuauacugguucucauucaucaaaccaucacuugcuucucucccccccccccccauugcaucaauaaguccacugcccauuauucuccuaaaaugaaaucuauggauacuaugggauaucuuagauccauaauuuuagggucaguagucuauguaacacauaaaaaagaauuuacaauaaaaaguacuaguacuuaggcauagcuauucuagaagguagcaaugaaaauuagaagguuuugaguaacacaguuguagggcaaacucuaguucuccuaccucuacuuugcacguaguaaaauuauaaaugugugcuacaauguaguuuuagucaauguuauauuacuaugaagagauaucgugaucacagcaacucuuauaaaagaaagcaucuaauugggacuugcuuauaguuucagaccuuuaguccauuaucagcauggcagcaagcaggcagacauggugcuggaaaaggucuuuauauagauccaaaggcaccaggaagaaagccacugaccuuggcucaggcuuuugauaccucauagccuaccuccagugacauacuuccucuuacaaggcuacaccuccuaauucuuucaaauaguguugcucucugaugacuaaagaguucaaauaugugugccuguggugcccauucuuauucaagccaugacaacaucaaacucaacagacuguuucugcuauuuuaucuucuagaauguuggcuaugaaaugcucugugagcaguggagagggugagacuccugacuacuuagaagcuuuguuggcuuccugcuuaugagcugccuucuuuuuuccuauauaaucuguugcaucuugugauugcuuuucuuuugugauauucgucauuauaagugaauuauuaagacuuuaggagacaucuccacaaguacugggaauagaauacccaaacuauauauauuuccuguuucuauuuaguagauaccaaacuauauauauuuccagucccuagaguuauuugaucugaguacuagcucuuuauugguuaguauucauugguuguaaaugugaucucuuguuucuaauaaauaggucucaauggaggcuaucaagaugaguugguagaccaccguuugacagaaagggagugggcugaugaauggaaacaccuugaccauguaagaaccccagccuguuuaauuuucccaaguccuuucuacuuuuaaaucuuuaugguuuaugucacauuuucuguuuguuuguuuugguaguuuguggcuuugguguguaucugugugugcugcuugcuugcauccaugcucauugcugcacauaccuugacaugaauguaaagaugaagaagacagauauuagggcuggagagauggcucagagguuaagagcacugacugcucuuccagagguccugaguuuaauucccagcaaucacaugguggcucacaacugucuauaacaggauccaauacccacuucuggugugucugaagacagcaacauguacucacauauauaaaauaaaucuuucccaaaaaaaggaggaggaggaagaggacagauauuuggucaugugacuuggcaggaagccaagauuacacacugaaucacccccuuccccccuuuuauuuuuuuacuuuucuauucaggcaugcaccacugcauccagcuccuaauuacucuuuaguuuuucaagacaggcuuuuucuguguagcuuuggaagaucuuaauucuuaaacacuaccaguaguucuugggugcuugaaguggacauuuauuuauucauuuauuuagcccuggcuguccuggaacucacucuguagaccaggcuggccucgaacucagaaauccaccugccucugccucccaagugcugggauuaaaggcaugcacccaccauugcccggcuuacuuuacuuauuuuagccuugauuucucucucuucccccccaccccaccccccaaaaaaaaauuagguuccguggacaaaggcagucaaguuagagaaaagagcuugaucccuaagacccacaugguggagggaaagaaccaauucucacaaguuguccucugacuuccacucuugggccauggguuguaugcaagcugacacacaaaaaccacacacauacuaaaauaagauaaucuuucucuuuaaaaaaaaaaaaagacaggcauuauuuguaaaguauguaaaguguuuaauaucagaggauauagcccauggagaguuagaguauaugcuuauguucuuuuucccaucagaauagagcaucccuuauccuugauuuuaaguagugacuacuuuaaacuuguauauuguggcguuuuguucuugagugacugcugacccuggcccuuaucuuagaugucgucaucauccucugacccuaguucuuaccucaggcaguuucugugggggcguggggcacagacaggccaaaaaaucgagucagauccauugaacauaaagauauaagcaguuguauaaaaacauuuggcuuuaucuaacauuaucagguacuaagacgugguuagaaguuccuuuacucauggagccaucuuaacugacuuuguggauguggaugugguaguaugguugugccacaaugaguaugaaggccauaaaacuuccuccauccuguggauuccaaagggcagcaugcacucaguaccuacugagacaucuugcuggcccacauagaggcuuguuuguuugugucuggguaugugugggguuuuuucagacaagguuucucuaugaaacagcccuggcuguccuaaaaccuccuuuguagaccaggcuggccucgaauucauggagauugccugccucugucucccaggugcuuuguauaagguauguaccacccaccacccagcuacccauaaacuuaagucacuucuagauuauaguaccuaaugauuuuuuaaaaagucuuagguuaaagaaaucacucacggguuuagguggcucaaauuacuggcuacuuuucuaucaguccugaguucaguucccaacaaccacaugguggcucacaaccaucuauaaugggaucuaaugccuucuucuggcauuuugguauacguuuagguguacaugcagauagagcacucauauacacaaaauacauaauccuuuuuuaaaaagucuuggcugggaguggugguguaugccauuaauccuagcacucuaggagcagaggcagguggaucucuaugaguuuggggccagccuggucuauagagugaguuccaggacagcugauacuucacaaagaaacccugucuccaaaaaaacccaaaaggguguguaguuaauugggcauaaguuauaggcaaaugccauacauuuuagguaagggaauuggaacccuugugacuuuuaguguccccggaaccaauaccuauauggauaggaaaacauaguggucuguauaaguaacaaagucuaagaggcagcucagugguuaagaguacuggcuccucuuguagaagaccuggguuuguuucucaccauccacaugguagcucacaacuaucaguaacucugcuuccaggggauucuaucccuucugaccucuaagggcaccaggcacacacauauuaacgcauauauuuauuuaugcacacaaaacacucauaaaaauaaagaaaucuaauuuaauaaacaagguauaauaaugacuuuuaaauguaaacuuuauuccuacgguuguaaaaucugugagcucuguuuucccuccuuccaauuguuacccauccuugauuuuaauguuccuuauuaaauuucucaucucaccucugcuuccccaucucucuguuucaggcacugaauugcauuauggaaaugguagagaaaacuaggcgcuccauggcaguucugaggcgcugucaggaaucugaccgugaagaacucaacuauuggaaacggcgguuuaaugaaaauacagaguugaggaaaacugggacugaguuggucucuaggcagcacagcccugggaguacagauucucucagcaacgguaaauauagagggggaacauagaacauagaaacaacagcagcuucgauucuaccuaaacugaguuuuaugucuuuguucuguggcauuuauuugguuugguuugguuuuugagacucuuacuauggaguuuaagcuggacucgagccuccugcuucagucucccaagugcuggaauaaaggauauggaccaccuugcccaacuacacuuauuuaguggaugugggugugugauguuuguggagagaauauuuccucccaccagcuccuuuauguuuacuuuaaaaacaauugggguguauguauguguguauguaggucagaggacaacuuacaggauucaguauucacucaguguguauuccuguucuuaccuguuggcgaucacuaugcuucccauaauuccuuccauaagguuugcugacacugcucacaggcucagggaagcaagcuuauguguuuaaaaaggauacacaugaagagaugcaaaacacacggucugggacacaggacuucucuagacuugccacacugaagaauuguacauuucugcuaaccagcuuucuggauccuccaucuuauggcuguguccuugcaguugaauuauaauggacuggauggggaaacaaaggauggccugagugcauuggugguuuuggcugugcugcagaauuccuucuuuaggggaugaggcaggacccucucucuauuaucacagaggcauacaucaagcagguuugauacuguuggacuugguuuuguuguucauuuucuggguugguuuucaagauguuucucacucuguagcgcugacacaaacuugccucagccugccacugcugagugagauuacagcccacagcuaauccugugauuuuuguuauguccaaucccagucuagaaagcuuugguagggggugcacacaggccagagcuuuuguacccugccuugaggaggagaaauuuaggcuccaauggagaagauuaguagccagaaaaauaggugacaucugaacuuuggugacuggauguauccuaacgaugacacuugcccuccugagcaguggccuggcuucagaccagcaguacaaaagaucaguaagagagaaagaagagaguacuauguaugucacaucacuccuagcuacuuggaugguuguguucaccauauuccuucuugaagguauuuacuccacuuugcuuucuuuucccaguuacccuccacuaccuagagacugucuucaaaagacuagcuuagacaaagcuagguuauucauauugaagcaucagagaugagcggguacauccaggaagccagagauaucccacccaaaauguuccaucacuuuccccagaagcugaaaaaaugcccuauccgaaaggcacagcugaaugacaggccaucugugaucacacucuuuuuccacccacccacuuaaaguucccaaauguucaucaaggagagugaauuucuuauuucagugcuagcauuuuccaugcaagacagcuguuagucucaaaaggacuggaagaaaauuuagaggaaaugccagcauuaauaauguguauccuauccuaaauagcuaaaggcugccacucuuuccucauugacaggcauggcucuuaagccaaccgucaguuguucuauuuuaugugagaugaucuaggacaggaagaaacaaacaacuuacauacugacacagacacaaaacuuugauuaaaaacuucaaaaccggggcuggagacaugacucagcggguaagagcacuggcugcucuuccaaaggucccgaguucaauucccagcaaccacaugguggcucacaaccaucuguaaugagaucugaugccuucuccugauguaucuaaaggcagcuacaguguacuuauguauaauaauaaauaaaucuuuuaaaaaaaacuucaaaaccaguggaggcuaauuaucagguaacccuuacaaaucugaacccuugcaaagauucccugcagcaacauagagacccuuccuugccugaaguucaacauuacaguuacauauacucauccaugaguguacguguguccagcugagguagagugcagccugacaggacucaacugccccgcacaaaccacccuuaacuugagggucuagcugggaugacgauuuugucuaaugugccugcgacaguucuucuuuguuucuaugaccugucguaauaguaaccagcaccuccuuuucacaaugaugacaauuuauaugauaaauucuaauuacuguagauguagugcuucauggaucccaguggcuuguauuaaaauuuugagauuaccaacaugucugauuuaaauugugucauuugucugggauguagcuucguugacauaguguuuacuuaagauacacugagcccugggcuuaaucucuagcuccaaauaaacuggauauggucuuagugcacaccugggauuccagcauuuguuagguagagaguuucagaaguuggauauuagccugggcuuaggaaggggaggaaaagaagggaaaacuugaguggguaggcgcugaagagauggcucagugccaggcauuggaggugcacgccucuaaucccaguacccagcaagcaaagauaggcagaucucugugaguuggagaacagccugguguacauaguuaacuuccaggagagccagggcuguuacacagagaaaaagaaaagaaaagaaagaagagauggcucagcaguugagaacacuaacugcucuugccagagggcaggaauccugggcaggacuuugaguggcucacaaucacuuacaauguacagccucacgaaaucucaccuaggcaggcuuuugcacucuugcagacucacagucacaugaugaaaaucaaauauaaguuguuuaaugaaaggggaaaaaaaaagacuuugcugacaugguagugcacacaauuuuaaucccugcacuugagaggcagaggacagucuagucuacauggagaguucuaggaaauucagggaaacuuagaccuugccucaaaauauuuuuuguuagguuuuguuauuuaaaauauuauauaugugcaugcuuauaugccugccuuauguguguggguaccugugccauaauguacuuacgguggucagagaaacacuuugggaguugguuuuuugcuucuccuuuauuugggcuccauuuaucuuacuuaguucaucaaguuugcauggcaagcagucacccauugagccaucugucacuuuuuuuuguguaugugacagggucucacuauauaguccugguugcuauguagaccagacacuauuuuuuaaguguuguuguuuguuuuguuucuuagacaggucuuaacuguguagccuggcuugucuggaacuacuuauauagaccaagcugccuucaaacucaaauugaucugccagucucugccuccuucaugaggaauuaaaagcaugcacuaccacgcccaguuaacugcuguuuuauaaguaauuguacuauguaacugucgugcaaaagcacuuugaagcugaggcaggaugaauuuuaguuugaagccccucugaauugugacauacugaaacuuuauccccagccucuaaaaaggcccagaucauaguauuuggaaagauaauauuauagacaugcuuucuccuucccaguuaucuuggacuuuucuuguaggcgcaugaaccaguccauuaguguugucucacaaaauuuucuaaguucauauuuaaagaaaguucccgggcuggcgagauggcuuagugguuaagagcacccgacugcucuucugaagguccagaguucaaaucccagcaaccacaugguggcucacaaccaucuguaaugagaucugacgcccucuucuggagugucugaagauagcuacaauguacuuacauauaauaaauaaaucuuaaaaaaaaaaaaaaaaaaaaaaagaaaguucccgggcuggcaagauggcucaguggguaagagcacugacuacucuuccaaagguccuaauuucaaaucccagcaaccacauaguggcucacaaccacccauaaugagaucugauucccucuucuggagugucugaugucagcuacaguguacuuauguauaauaauaaauaaauagaaagaaagaaaagaaggaaggaaggaaggaaagaaacaaacaaacaaacaaaggaagaaagauuaauuucguccaguuguuguugauguuuucagccugagcuuguugucacagcccuguacucccagaggaugagcucaaggcuuaccugagcugcagaauucaaggacaguguaaauaacacucugucuaaaguaacaggaguggccuagccaagauaacacugaagccaugucuaugauagcccauguuuuuguggcccacugguagagcacuuauuuaucgugaacaagggcccagguuugaucccuaacaccauaaaaauguuaaugcuuguauauacuuagauacaaaguuuaguauauuguuucauaauuugaagcuagcucuuauucuaaauauguuuuacaccaagcaagcauacuuaucugcuucuaggcaguaaaagaaguuugauucaaacuucuugugucuuaauugaaaaucuugucuuggggccagggauuauuguuagaguauugccuagcaaaaccgagaacuuggguuuugaauacugauuaaagcagcuucugacaccuuucucguuuaucucucuuguguagauucucagcgggaauuuaccaguagaccagcaacaggauaugugccuguggaguuuuggaagaaaacagguguguguaucugucugucugucugucugucucucugcugguaggcugucuguacuuacuaguuaaugcaagcugggaaccuauauacuagggaaaauguuguagccugacuuucaguuguccacaguguccuccuuauggaauugcuggcuucuccugcucacugauuguacaucucuucuccucuggcugauuguacaucuccuggccagaacugcauguccgauccuugcaggaucagaguuugauccugaguuuggaauaguucccuccaggucuuuucacacccuucuaccgucuuccauugaaacacacaguaccuagcucuuucuucauuuugacagaaguugguuuccuggcuaguaucauaguauguucacccugccacuacauuugcuuaguuauguuuugggguuuuuuuguuuugguugguugguuuuuuuguuuuguuuuguuuuguuuuuugagacagggcuucucuuuauagcccuggcuguccuggaacucacucuguagaucaaacuggacucgaacacagaaauucgccugccucuuuugugcugggauuaaaggcgugugccaccacugcucggguuuugguuuguuuguuuguuaagcuuuguuguguuuggauaccacaguguagagaacagagggcaucugcagugucagcucuugaucucuaccuuuuuaagcaugucucuuguuugcugcuuugaacaccaggcuaguuggccaggaugcuuauaacuaauucuguuuucacuuucugucucuuuuggaauacugggaugauuagauguauacuucauauccagcuuuauguggguucuuucuucuuguuucuccuuugagcaugacuacuaacaaauugcugccagcuucccuaagugaccaacaaccagccacacugccucucuaggcucuagcauugauauacccucugaaaagcucuagaauuucaaaugucacacagucacagaaacuaucuguagcuggcaaaagcacacaucuccuagagaaugaggcagaucauagucaggugcuucagauaguccaaagcagcccaauaucuccauuaaaaugggauuaaaaugaaaacauauucuuauaauauuucuuuguuuuuaaagaacccaaaauuccaaaauuguagugacaaauacacagcucuguuuuuguuuuguuuuuagcuaauuuauccuuaagcuauggaucaagaauguaccuugggggaagggggcacucaaaggguugugcagauagaagucaggaguccuugaccucugggugggaucuguacuauagggaguuauaacacagccuaggacaauuuaaugcugcucugaggcugugcuguauauguauauguauauguaauauguauaugaaauagcaaagcuguuagggauccccuuggggucuagguuguguuuccucauggacuuaaaggagauguuuuagauucacauucucuuggcuaaagcccuugucauuuggagugucuucaacgaagcaagguggguuagugagggaggggggucugaacuaagcaguccguguugcaccugggugccucccagcccuccccucccugcuuucagugccauucauugcauaaagcugccuucguuguccuuuuccacaacacccagacuacccuaacuccucagcuccugaguaccccuuuuauacauucagagccucuucucucaacugagccacacccacuuuuccaggugcuuucuuucuuguuguaugcaauucuagaaguucacauuuccuuuaggaaaucaaauauugaaagcaccuuuugauccucuugcucuuguacaguuaacaaccuuuguccuugaaacucuagucucuuugacauaaggcaucuaagccauugggguacuugaucccauucagaaggauggguggugucuacuuaucuaugucuugccagcuuuucacacagaaucaaucuacccucauguuuauaccuaacaguugcaugacuaggugagccuguuguaggaauaaugugaguguaugcuucacauucacccuugcacaucuuguuuuacuauuuuuccuuagcaguacuguuguuagcuagcugagugcguugacacauaccuauaaauaaucucacuucuuggaagcagaaguaggauugugacaaauuugagacuaaccuaggcuauauagugagaaccuaucaaacccuaccuccucuacccccacuuuccacucccacaucccuuaaugcugugagauggaagugaaaagauuucucugccaguugauuuuacuguugcuuucuuccagaagaagccgugaauaaggugaaaauucaggccaugucagagguacagaaggcuguagcugaggcagagcaaaaagccuuugaagugauugcaacggagagagcucgaauggagcagaccauagcggaugucaaacggcaggcugcagaagaugcuuuccuggucaucaaugagcaagaagaguccacagaggucagagcuacacugggcuauaggcugggcuggguggcuaaagggaagcaagcccgcugcuugccacugaaaugcuggguagaaagaguccacuccugaauuagauggugggauuuuuagccauuaccaagagacuuuuuucuuacuugacgauaauacuaaaauaauaaacuauucuuuuguauucauaacagucuaccacacacacacacacuauuuuagcuuccaugaagugaaaugugucccauugugugauaaugacuagcaguccuagagcagauucaguacauacagaugaagauacccagcuauagagauguaguaggcucacugugugcagguggauggacaccuggcugugcaugcaugcuucuucugguccucacaguaaucucauuagguaaauguugguucuaaauuacaaacugggcaggcagauaagguagacucccaauaccuuacccagggcccaggaugcuuugauagaauaaaaacaaauacgaaaaauuagaccagauaugauaauuauaccacuuaggagauuaagacagaauuuagaguucauuugugccugguacacguaggagaaggcagguaggucauaaagaugaaaaaaggauguaagggcagaaacaaugugacaguaccaguuacauccugccacccucccuggucacaguacagaugauuacauuuagggccuuggguguauuuggcaagugugaucccagccuuuuguuguuuuuauuuugagacuaaguugauaaagcugccucuagaggagcuggaacugcagggaacgugcauuaagcccuagcacuaauauauuugaauucaacaaaaaauuuccaaguuguuguguuauuuauuuaagacagggucuuuguguaucccugacuguucuggaacuugcuauguagauuaggcuggccuccagcguagaacuuucugcuucccaaguacugagauugaucaaagauguacaccacaacuccuggcuuguaacuucuuuuuuuuuuuuuuuuuuuuuuuuuuuuaaacauuuauuuauuuuucuguuugggggaagaauucuggccuugccuauggcucugguucauucuuuacugaguuauccccugaaaucuuuucuuuuuuuuuuuuuuuaaagauuuauuuauuuauuauuauauguaaguacacuguagcugucuucagacacuccauaagagggagucagaucucauuacagaugguugugagccaccaugugguugcugggauuugaacucaggaccuuuggaagagcagucagugcucuuaacugcugagccaucucuccagcccggcuuguaacuuuuuugagacaguguuuauauauauugcccauucaggcccaguacugugaauccagguuggucuggaaacuaaaggcaauccugcuucagucucagagugcagauauugcagauaugcaccacuaugcuaaccaccuuauuuuaggcauuuuuuuuuuuuaggcuuagaacauaaggacuaagacuguaggaacuauaauuuuaagcagcaaacuaaguacccugcguugagaugccugccagcauggauucuggcaaauuugcauaucaaagggaagaccagacagccuaagcuuuuguugaguuugcauuggagcagaaaugcugauucucuaauuucaucagaaauaauccuccuggaugacuugcaguuucuccaucucaugauaagcugugugguguggaagaagcgugccacuuccacccugacuuuacacuggcuuugcaucauuaaagacucaguuuucugugcagaagcuucagcugccguggucuguuggccugcuagcuuuaggaagguaaucugaguuuacagagugauacuguugaggugauaaggccuuugcugugauguguaagcuacggcagcuucuguacuugcaguauagcccuagauccgcgcugcucccuugccugcaauggaggggcgagaguauccuaucaccuugucucucccacaaggcauguucuaucuccaucuccaaguuuucuggcaaacacaauaaacuagcaauugacaaugaagaggaaagaggucuaguugggacccgaggcuguugacaagcugcagauaauugugauacaggucauaacuaggagccucuccuuaacaaaggaaauuuagccgggcagugguggcgcaugccuuuaaucccagcacucggaaggcagaggcagguggauuucugaguucgaggccagccuggucuacagagugaguucagggacagccagggcuacacagcgaaacccugucucaaaaaacaaaacaaaacaaaaaacaaacaaaaaaaccaaaggaaauuuagaaucacaguucugaccucagaagguucauaaccuuugcacacuaaauacagaaaaauacugaccuaagucuauagcucaaaguugaggaaugcuaauuuugaagugugacuaaacaauagacauuuugguuuuuuguuuuaugauggcucaccacacugcccagacucgucucaaauuaaauuuuagccuccauuuuagccucccaaguagcugggcuaguugcuuuguuguugauaguuuuacuauacuagaacauuaaaaagagcuuuuaccagucaguccugugaguguucagguguagaucauucacauaucacugguauccgugcuaaggcugcacagggcuagcuagcauuuuuuuuuauguugucuuuguucccagucacuuguauauuuaaaugacuguaugcugcuuucauggcugcuccuugagcccacaggaaaccuuucuuggcucuucuauacugugauagaauuacuguucauaauuagccguuucugcuaagccucaggaucgucuaccccacucuuaagauguaacaaguaguaagaaaaugcccagaguccacuucagggacuccaggguugaguggccuugagaacagacuauaguguccccucagcccaucugcuguaugauacgacagugagggacauagacacagaggacagaggaggcagcagcauagccaucucccuccucauccauccugguucccuggaagggaacuuuuuggagaaaaaaaaaucuuaguuuuccuauauucuuuuaaaagucuuaguuuaaaagaucagauauugucaauaaaaacacugaagaugguuccuccauugggauguagaaaauguuuguuuguucaagcucauauguggauauaugaucuucagaagguaguugugagaccugggcccaggugacacaugcccaugacccuggcauuugggagggagagcaggaggaucaagaguuaaagggcauccucagagacuuacccacaggucuguagcgccacaguccuugcuguaccaugcagaugacaagugacaguggcgagccugcccaucaagaugucagcagccacuaacugacgccugugucuugcagaacugcuggaacuguggccgaaaagccagugagacgugcaguggcugcaacauugcucgcuacugcggcuccuucugccagcauaaggacugggagcggcaccaccgccucuguggccagagucuacauggccacaguccccacagccagagcaggccacugcucccuggagggcggggcucagccaggucugcugacugcagugugcccagcccagcccuggacaagaccucagcuaccaccucacgguccucaacaccugccucugugacagccauugaugccaacgggcucuaagcuacagacuccaccuguccugaugaccccuccacaugggagcaugcuugcaccagugagcuggcuauuagaacaaguagcuguugggucgucagcaagaagugaaguuggcaggaagcauccaagaggcacuccacagcuucucugggauuugccacguguccuuggaagaacuaauguaucauucucugcacacaggaaguagcuugagcugccuccuccauggcuuuccugagguuccucuuccagcuaaagcuggcauaaccagccccuucucaguguauacaccagcucccuccgacuccuugcauuagcauauugucaauagugucccacacuguccacaguagaggccugaagacugguagcaggcuuaggaggaggcccuuccuuccccugucuucaaacaguuccuugagccccauauccacccucgagugacacugauuggccuaaaagagacuuggauagcacaaaagcaguacucaggacucucuccugagcugcucagagcuguuaagaugcucagaaaugcaagaaagaagucacuguuucaguaaaaucucuaguaaugauaaaaaauuaaauuagucuucccaagcaucauggaucauuuuggacaagauuuucuaacuuggcugucuucguuaguuuggaacccaccucuuaacuccaguguuuuucuugauuuugcuuguguaaaaaauaaucuccaucgcauggaucggucugagagaggauggagccauugugcuagucuuuucucuaagcauguuggccaaacuaaaauauuccguggaucaccuuggaaaugcagagccucugccacugcuugacuguuuaaaacagucgccuuguuguauguguccuucucucugggacugcaugucuggauccuuggggaugucuugugaguagguucuguuuggcaccuaagcagugcuccuaacccugaugggauuauucgcaccugguuuugacaccaccucauagguuuauuaucagguggacauuugaggcauccuuuuucugugcuccguguuuauagucucccucacagcucagaguuugugaagaaugggaaccguuuuugaagagccugaccuguuuuuuuuuuuuuuuuuuuuuuuucccaucuucaggaacuuuuccaauuaucugauucuccaaauagaauuuggagacaucgaucuggucauuauuggaccuauugaucaggccaaguacugcucacaucuuuuccuugccaucuaaaguuuauuaguugucagcaccuugcaucggccacucaguauacuccagaaucguuuugcccugugcagucaauugggauaagucauugccuuugauccuguuggcuuuuggaagcuguggucacuuuuuguacaaugaacaagucugaagaacaagucugaauacuaacacuugccccauaaaaguauggauuuagugucuuugcacacaguuaaggcugauuuaaaaauacugaguuccuaucucauuggaacaaggguucucagacuuagaaaguagaccuuuaaaaucauguuauuuuagcauagaauacccaagacccacuguuugccagacagcuuaguacagccuggccucccuggucccaucccaucagucuaguggggacaacuuugacuuacuagauagaguuaguaccagacagcacuuguccauacucagacacaaaacuucgggcagaucaggagcuucugugaacaugagaaugucuccuggugugcccuggucaguuacucaguaguaaaauggaugaacacccuuuaaguguuaaauuuuuuugccacagaacuacuccagauaguuggaauaaagagcuagaaccaauacauuacuacuuaccugguuggagaucaguuuguacagcaaacuggguuacaaaaucuagccuaccuuugugggcugugugauuggccuguccgauucugaguuucuauagugcuguuggggacugcuuugcuucuguguccuacccagguuugucuacacacucggacaguacuuuacacuauauaguucaguucucagacuugucucuaucuugccucuggucagcaucacucucgggguuuuguuuuugguuugguuugguuugguuugguuugguuugguuugguuuuucgagacaggguuucuccguguagcccuggcuguccuggaacucacucuguagaccggacuggccuugaacucagaaauccgccugccucugccucccaagugcugagauuaaaggcaugcacuaccauggcccggcuucagcaucacucuuacgugacaucuguuuaggacuuuucagauuuaaggaguuccuuucugcaguucuccaacuccucccuaggcaggagcagcagcaguaggagcuggagcuacaagugauuccuggcucaccgcuuuguuucuaagucugcuuauaugagccaccaggcugggagugaacauagagcuucaggcugcucacaagucuggccucugcaguaacuauuugaggaagaaaaguagucagggcuuggucauucuguaccaagugagggauaaaauuucaggaaguaaauaacaaaaguagccaaacugggaguucugcacaccaguccucgcuccagcaaaugaagacuuguugaagcuagcuugggacauggcuuauuugguagcauggacuucauucccaguguggcauacaccagccaugguggcacauaccuguaauccucuaacacuuaggagguagaagcaggaggaccagaaguuuaagguuauccauagcugcauagcaagccugaguuacaggagacuuaucccacagagacucauugaagggcccugcagcuucagauuggcucaugcagggagguggaggugagggcgcaggcugugaguggcuuucuccuaaggugcuaaguuaugugcagccaugggucuccauggaauaaccugucuggccccccgaggucuauccaggcauuggcugucagucuucuguaauguagacuccuuuacccauuugauccccagggagugcuucaaaucuugaugucagcuuuaccgucauuucuugucaccuucucagagagagugaagacauuuuuuucugagugguucuggaaacuaucucagcaggugugugaggccucaacacaacugcaaguguguguuagugguucucccuagagcauaaggagugagcagauggccuucguucugaaaacugcagacaggauuguggguugaauaaaccuuuacaaauaggacacgucuuggaggcuuacuucagaacuggacuggaaccaagguuuccaggcuccuggcucaggagacuaagccaguguacuuugaugaauguuagcuauuugcagagaacugggugguggcauguuugaaccaaaugugagaaaagccagaaggaacugaacuggccauuguggaccagauggccagcuguggaagauccuugauccagcagcugcuuagcagacccuggccacucaaguauauuccuuuaaagccaaaaugcugacuaccugcuucugccucauguugacacccauuuccaaagaugauggagccagugugagccaggaggaagcugagaugguggcugauaauuuacucuaccaucuccuuccacagcccaagagguggcacuucccgcucagacaccgucuuaucaggccuccagcugcccaguguaaacugucaaugcuuauaccaaaaagggcaugugcagcuggugucugccagggacagcccagucccugccuugugguucccaggaagaagcugcaacaauucagugaaugauuaaagggcuguuugauaauaaggccuucguuccacuccuguggcuuuccaaguuccuaaugaggcuacaaaggcuccauccauacagaaaaccaauaauguaaauaaaagccaauccugcaagcaugguuugcagaggcgggugaugaaugugaagccacccgcaggaugcauuugagucugguuuuucugugcuuugucauuugacucaguaggaacuuuuguuacuuaacucugugcauaacuuauuuaauguacuguauaaaugaaccaaaacuguuaaauauguauuuaguuuguucuacuuaaaguaguuaauaaaaaugcuauauuccuuuucugacucaagcuggaccagaccuggggaagguagcacagugguggaguacaaaugccauaugacuagcugcagccucugguauugucgagcaccacacguggacacucacucuucccucccccacccccaggucuuuggugaaggggcaguggggcucuaagcauccuugcuaugaccaaaagaucauggcaugagggguagggacaagaagggcuggaaugcuugcuguagaaccccaccaugaugcuaguugcagccaucuucugugucaaggugaccaugcuguggcagcagugacagcaauaacagagauauccuugguuucucacacuccuccccacugagugaucuuuuaguaauaacauucagccacagaauggacaugaauauuuuucccaaguaacuguuauuuccuuac

SEQ ID NO: 1192 - RNA, 14508 nt, Mus musculus
cagccugggcggccugguaaccgcaacccgcagccuugcaagccuccgagccauggcgugcgccgggcugcuuacugugugccugcucgggccaccugcgccccagcagccgcgacacucugcgccugccgcgggacacgcgcuuuuccaggacgugaguggggcaccggcgggcgggcaucaggcucccuaggucucagucuuccaugucccugucucucccuccacaucuguugguccugcuucggucccucuccuagacuaucugugacccugcuguugugauccuccugccuuuuugucuuccugccauugcauuucuugugcugucugugccgcuccgugucucuccuugucucucagcaguacugccccucacccuaauuguguccacuggggcuggggacugccaacacucagucacagcagccugcuccauggcagccccggcugggcugauaggacaggggagccuaccuagaccuugaaggagcucuguccugccccggaagccucaggccugaucaaggguggcagagucuuacaguugguaagggacuccucucaugggcagcagguggccuugagcccccuuuuguagauguagagcauccuacccugucucagaucgcugugcaaucuuccugugcuaccuuaccuagcuagaggcaaaacuccaagugcaggagcccuagcucugagcgccucucuuucccccuucuacuaugugcucagcaaguccuggcucucuucugccccuauucuagaagucccugccaguguaagaggcuguugugcccccuccccaaugcccuagugacucagcaccuugaccaugguccuucaagccugaggaggcauguuucaggucaggaggcacccugggguaugaauggaguaucuucauucaagcuuagcucuccugccccacucccauccaaauuaccccagcccggcugcguugagcugcugugugaucccaauccaguagcagcccuuucucugagucagccuaaggguuauauugguugauuagccuagugacccugagggaguuggguggaagaguuuagcauucaggacccugggcucuaugaguucugucuaggcuuugaacuugucuguuucaucauugccucuacaaauaaaaucuacgggccguugccacccuccuuguuccuuacacaaauguguacacacagaugcccacagucuucaugaugaauuggccuuauaagaggucccagcccugaaaggguuaaacucuaagcugcucccucacauacuagugggaaaaccagaacacccaaaauaagcaggcacaagggaaagagccuguucagugaggguagguggagaauaguguguggacuugggagaauacccauaaagucagggugggggagggguggggagggaaacauucagaucugauauggcuuccaaggcuucucaggaagauucuuagcccaucuguccaaccuuccucaagcugggaacaugccaaaggcugcuacaucagagccaacucgggcuugacuccagcugugggaggugaagguacagagagcuggccaggagcacccacccaccgugaagccagcccuacagcaggagggagucagcacuagggcuugcugugagagcuuccugugcuaccuugcuggagacuccugcaggacuucccugagcagggugaaggcgaugcaggggggcuggcugccaagcuggagccccacuggcuugggaggggcaccccuaucucccuggcuccccucacagugcccacuuauuucccuuuguccccuagguuuuccgaagagcagacaaaaauggugagugguuucuucccuuugggucccacaguguguguguguguguguguguggguguguguguguguguguguguguugggggggcagaaugugagagucagggacuugggagguauaguggggcgggggcaggguagaagagcuagggacuuggagguacagcuugaagucucgagagcucaaaaugggggaucaagcaagcaacccuuccuggaguguacagaauagggagugggaagugugguuugaucugaggcuggaggugggggcuuauguuaagacauuacucuagcucagugaugguaguguuguaagauguccuuacaacagcuuucuaggugggaauucuucauuccauuucacgguaaaggaguggagguucagagaagugagucaguugugggccugggauccagacuugugugggacaucaccccaggcucccugaaugaggggcagggcacucaucuggccuucacuuuuccuuucccugggccugcaggcucuuguuucagccucuuuguguccccagcgcuugcccuuucaugggucucuucacauuggugcagaccauuaacuuaacaaacaugcucaugcuggaugauaguggugcauaccuuuaaacccagcacucgggaggcagaggcaguggauuucugaguuugaggccagccuggucuacagagugaguucuagaacauccagggcuacacagagaaacccugucuugggggggggggggcgagaaagaaacccaacacccucccccaaaagauaccugcucccaauaccuucugcuauagaggcucagacccuccccaucuugcauaucauuuagacaguaaaucccauugccauuuuauccuuccacucucugccucugcuuacaugcccccaugaggggagcucacucucgucccagccagucugcagcuuuguagagucuggcugguggguaggcuuugcaugcuucucugugacuuccuagaaagguccuggggucagaacauggaggucucuucuacccuggggcaagacuaguuucuggggccagggacuguacccguaaguccuaagcuguguucugauguguuccaggcuguucucuuacauuuccauuuggcagacauugaaucccuaccaaauguauccuguacaaggugggcccuguuucuuucagcauauacuuuuuggaggacucuuguccuuuuguucaaaacagucugggccuccgcuggagucagaacccuaggcuaucuggcugagugauugugaauguugcuggccucugaggagccuggauagggggacaggauguagcuaggacuuaaggauagcaacaccacgccugucucuccccagaugaugguaagcucucguuugaagaauuccagaauuacuuugcugaugggguucucagcucugcggagcugcgggaacuguucagcggcaucgaugaucaucucacugagugaguucaauagaagggccggcuugcuguggcagagcccggccagcucaucccaacccacuguguccccugcugucagguucuugcuggaggacaggggguggggaaagacaacaggcccagugccaacuuugucaacccacccacaccuucuccagcuccagucuuguugcuauacugauuccagcugggaccucagaauaaccagacuugagucaccaaccaugcucagcccuucuauucccaagcagaggauguuugaggacagcuggguucugccugccucugccuguggaugcagaugcaggaguccauacucucuugcuucccacaugcccacaucugguucacguguaugcuccuucccugcuucuucacuuggggacacacaccaugaacauguacagcuaccccuguccucuccuuuuccuuccuuucccuucccgucccaucuccuuaguguaaauccuagacuaggucagcauucaagguuucaaggacuuagacugacccucugaagggccugugaccccuccccagcagccaugcuaugugaggcucaguaggagcuggcuugcuguggcacaaccaggcaucugucugguucuccaggcccaggugcuaagagucucaaagauguuuucucuuucccccacagcaauuuagagacagagaaacuguguggugaguagucuugugucccagccccugggcggguggguguggugagggaugcuuuauggggcuggccucuugggaugggaaggcuggagcagcugaggaauucugggcuggagagaugguuuaggcuagugccccuggaccucuucugccugcagacuacuucuccacacaccugggugucuaccggcccgugcuggcugcgcuggagucucugaaccgugcggugcucacugccauggacacuacaaagcuggugaguacagggaggggucguggggagccugaagugucagagcccagugaggcuguggaaacgaggguuggguucaaguucuggcacuccuauuuaccaacugugccauuuccuccagagccauagucuucucuucaguagccaggguggcucacaccugaacucucagccuucaggagacagaggcaggagauuugcugcuagugucaggccagucuggcuagagagaggagacccuguugggggaggaggaggcggaggcagacauguuuuguucuuugcucuguccccugugcccaaaacaaugcaggcaacauaguagguuuugcuggccuauuauaauugcugggggcugucaaaccaggguccaauagguacaggcugggacauagaugaguuuauacguguccacagguacagggagacaaugaggcagggccuaaccucaggacaugugagacgguagguaugucuaugccuaguuuguuagccugugcuauaaccuguguagacaaauggugacagccagagcuccagacccugaaagugaccaaaaaacaaaaacaaaagcaaccuuccuuuuauguguuaagaaccaucuuugccaagccgggcgugguggcgcacgcuuuuaaucucagcucuugggaggcagaggcaggcgaauuucugaguucgaggccagccuggucuacaaaaugaguuccaggacagccagggcuauacagagaaacccugucucaaaaaacaaaacaaaacaaaacaaacaaacaaacaaacaaacaaacaaagaaccaucuuugccaagaauagguaguuuauacuuuuucuccucuggguauuucuggauauucuggaacuugcucuguagaccaggcuggccucaaacacagagauccaugggccucugccuccugagugcuaggauuuuuacgcuaccacuaccugaagacagcuuaagccugagacugggcaauagagugagauccugucucaaaaaacagaaaaagaucuccuuuuagggggugacaggccuggaguguuaccugaaugaacuuguuuugguacugaggauagaacccaaggccuuaccugccagguacugcacuauacuccugcccucugaccucacuuucugcagaaaaaggaaaaaugagacgucaggggucaccugagcacacagcauaggacaggacuucuaguucccucauguaagaguuuuuucaaguauuguucuuuaaguuuggcccugcugaacuggcauucucuaaacugguuuggguauucaauugaaagcaaaaaggaggcucaggguuagcucagagagggaaaagggcagcccauucacauacgagaacccugccagcugugaacacggcaaucuguuuaucugguucuccgugcuaggacagagguacagccucuguuccugaaguccccccugguggcaccauccauucucguucaauauaaaacucaaucgaauacaucucgcaccagcaaagggccguguuccugguacauggcccgagucauccagcggcacugaaaggaguucaaggaugccaucauggauccuccaguccacacagcugugucccgcccgggaugagccaccagacagggcugcagggccggguacccaugccuccggcacugugccuccagcuccagguucaugcgcuccacaaagccagggaaaaggguggaaccuccagcuagcaccaccguauuggccagccguguccgcaguguuguggguaucuuuugcagugcuuggaaggccagcgugggcaguccuggcucaggguggccuaggagacuuggcuggaagauggguucagggcagcggaagcgcucgcugccgaggcgcacguagcagccauugcccaggcaaaaacaggcccucugguggcgggcagggucacagauaucacccuggaaaucuagcgacacauagcagcagcgcuucuugagcuguguaacggucuugcgggacaggcccugcagcugaagaucugggcaugcugccacuagcaaaucucgaaaguagcgcgacaggguacugccugccacauucagacggaagguggccuugugccaugagugacccgcguagauggguguggcguggcacacgcccgcgcccgccuccacagccagcccacugaaagcuccuauggagcagagugccagcagcgcuguguuggccauguggcacgcaggcacuguuagggccucgaacagcagcucagccaccuucucucggcccuuggguggugcugauggugagucgcucaccagcacaggccacugcucgggguggaccugcaggccucccaccauuaggcgcucccacagucccuccagugcgucccaguccaccacuacuccaugcuugauagggugcgcacgggccacgccgccugccagcucgcaaccuggugcuccuggcagcacaggccggucccaacugggcaucagacuugagcucuucagcacaaugcgcggcuucaucuccccagcgaagccugccuuggugaaaccugagccuugguccacuaccacagcaacgugguccaaugaaggcagccugugggcgcggcgaguccggugcaccgaagacgccaccuucagggcucaaugugccccgaagcccuaugggccuucagggcggauaacuggcccucuuaguucucagcuccgccuuuggcuauaaggcuccaccucuuaagaguagggauuccuuuuuuguggcacuaccucaaaaguagugucacuauuagucaagacuugauucuuccuuagagucccagagucccagccuuccuaggcagcucucuucacacgucacuuagcuuggcuagaguuaccuggauguagaggugggaaggaacuuagauugggcucauuaugaccucagccuugcaggcacccccuccuccacccccuugcgugggcuaauggcagcagccauuugggagcccauguuaaggaucugucuguuuggaguauuuaugugcucuggcuagauguccagcacuuuaacucucgguucuaaagagaaacuucagauguacagguacuuucccugugugacagccgcauggggucuggucugaccccuucagcuuugaagcucacauagcaacccuaagcaaguccaagucucuuccgugguguuucuaacuccuaaagacagcaaugagcccugccuccuggauagaccauguugguugcaaauagaagacucagaugcaccuaagcuaaaauaaggaucuuauuacagagauccuggauauuuucuggaucauaggggcaaaaauaggucuuaggaacaggaucugcccauauagguauaacugggaaggucucuuaaaguucccaauuacaguuguaggggagaugauggagccagcuugagccaagcaugcaugugcugauaacauuugacagggcaauuagcucucgaguagggagacacauacuguguaugguucacacauuuuccagcacaauuccagccuguggauaguaacacaagugcagccuuaauugcauagcuuaugguucuagugagcugaggcauucugccaucucuagccccaggugaaacauucucaguguguaagacuuuuuuuuuuuucucgagacaggguuucucuguguagcccuggcucuccuggaacugacuuuguagaccagacuggccucaaacucagaaauccgccugccucugccucccaagugcugggauuaaaggcgugagccaccaccgcccagcucaauuuuuguuuuaagcaaucugugguacugaauucaaguuacuccuaccccauccucuugagugcugguauugucacaggaaugguggcuuuagggucuggucuggagcugggugugggauccaagaaagccagcaguggcuucuguucagagcaugcugcuucucucgggaauaagagugacaucagaggccacuggugcuaugucaguauggaggagcagagggagagcacugauggcaguggggaucggcagcugggugugcauacacuaauuguagccuuggccuuuggaggggcagcagagagacugaggauuauauacuagcaggggaaacuaauuugccauacacagauuagugguuuggaagaagauuuuggcuacaaaugguagaggauagaacugguaccucuggaggaaagugcuuugauuaagggacccuaaaguuugggggaccugagugcuugggagcugacaggcuguagggugagagacuagagguucaagccccuuuucuugagugugugccaaaagcagacucugagguuccagcuucaccaugacugacauccugguaugauguuuguaagccugaaacccuuccucuuccgaagagggauuuuugaacguuggggacucuuggagaccucaaaccuuugccugaaacaaguucuuccuagcguugcucaaguccaccuucagucuacggauuuggcaugagcugaccuuugugcuacgaaaaguaaaaggcagcccuagcuccaggucguguuggugacuguucuaacuccuacucgcucggggccucaguuuugaccaggugaccgacagcaggcacagaaguggcagacacaggguuugcuaugugcucuuuauugagcagaguccuggcgcuaggggucgugccaggcacucagggccgcgggcgagggcagcggcgccgcuugcgcggcugcuccucgcgggggucgccuucaccacaggcaucgcguugggucagcacgugcgcauacagcggcugccagcacugcgggaccuuggccccgccccccggccugccucccacucgacgccccuccuccugcagccgugcguccagcugcagcagcagcaccaggauccuuuucaucucccgagcgcgcgcgccuucgcgccuguccacgccgucgccagccccacguagcauaggcgccaccgcugggaagcacguuggggcgccgagcggguccucaguuggccgcaccggccucacaaaugggcccgccgcugccucggccagcugcugccgcuuguccagcgggaaaagcagcacgaucuuggucugggggugggcgggugugaagggaagaacaugcccucguggggccugaggcuucuuccgugcccgacccaaccuccggagccccacugugccccguacccugagacccugccuccccacaggaacccauugaccacugcauacuuucccagccuugaugcggggguucucacccacacgggcagggucaggagccucucgccacugaaagaaagggaaaguggcguguugcgaggccaugggcuggagagaggguguaaagguauuucaggucuguggucccagagacacuauaccugaucccugguugagagagcacucuuccuccucccccccuccccccagccauugcuucuagaaucccuauacuacuacuaccuauaugggcuccagagauccuguucucucuagagagucucuaaccccucaugcuccuggcacccagcgucccuucuagccucuccauacucacacuuggcuucuuccucuugagauggcugaagaacugcuugugacgggcuuuguccaugucagguggccuguccuuguuggccugauugggugcuuugguccucuugugggaacugcuguuucccaugauaggacuggucacaggacuggucacuagaggccacugcccaugcugccucggcccugcccucuaaccaggggccccaguuuggccccgcccaucaggguaacuguauugugagcucacaagugaccucaccacaccaaaacucugcuccuccccuguaacucccaggggaaucuggccacugcuccacugucuaugaccucuucuggucuuagcuucccagcugcaaaacagggcuagugcuuuaacaaagcaauacuuauaaggugcuuaagggugaguagagggggacuucuauggcuuugauuugaauccuggccugccacuaauuagcugcuuaacuuuggcucagauucaaccucucaaggccccagauacaaaauggagucaauuaugguuacugaaaauuguuaagaugguuaaaaacaauucuugggaugagucugguaugaggaaguugguucugccaagcagguuugguugcaaacaguagaaaaucgaucuuauaccuccaaaggaaaacuaccaaaaagaugucauggaaacagaacccacagacuuagagcaggacucgggcacuacucuaucccauuuguuauaagcaugguccagaagcuaccaucuuaguuuaaccaaggcagaucauacaucaaaaaugaaacccauuaaggccaguuuuacacaugguacaaaaugaugugugauaugaccccguacuggcugacauuugcuuguucuuucauuauuccacucaacaauccauuuaacagacauuuacugcauuuuguuggaagcuacauauauauauauaggucucuauuagaggccucacuagcuguugcagaagcgagcaugagccuuuuuuuuuuuuuuuuuuuuuuuuuugucuuuucgagacaggguuucucuguguagcccuggcaguccuggaacucacuuuguagaccaggcuggccucgaacucagaaauccaccugccucugccucccgagugcugggauuaaaggcgugcgccaccacguccggcucagccuuaacuuugaagaggaauugagauccaggagaacccagugucccaggaggguaugauccugugaaccagccucauaugcaaggaugaacaaaguccaucugcacugggaaaaggggccuuagaagcugggcagagugguucccaucuuuaauucauucuagcacuggggaggcauauacaggaggaucccaagucaaggcaagucugggcuagaaauuaagacccugucuggagacaaagaugggaagugagugguaacuagcuugugcuggccugcaugcucuguccacuuccauugcugcucucaugagcaagguaagcucccuguuaucuugcccugcacauaggaguaugaacaggccuccaagguggaccaguuugucacacgauuucugcugcgggagacugucaaucagcuacaagcccugcagaccucccuggagggagcaucagacacccuggaggcgcaggcccauggccagcgguaugugagggugcugcugggcugcggguaugugggugucuguuguuccugaguuccaaacuccucaguaucccguuccauccagccuuccagaggccacauucuuggggucaugaucugcugagagaaggggucagugguuugggggcugggcuucaaagacccaggagaccugucuuacccuaccuaagucugguccugugcugaaaucccaguccuugacccuaugggucuggggacacuggacuaaccuucuacuuuccuuccagguuggaugaagaaacuaucaaagcgcagaguaggcccuguggcagccggagggcaggacgcagagcccuaaggagcaucaguuggucaccauccuggucuccuggauccucugauacagguuugccuauggcaggguaggaucuggcugcacagggccaggaaagacguggcaucuccuauucucucagggcuuugcucugccaauguucccaguucacccugagcggccucccuucagggguccuggcugauguccuccuggucccucugccagggcggaguucagaggcugagcagcaguggcggcuacaggucaaccgccuccaggagcucauagaccagcuugagugcaaggugagaggcuggguggccagugcauguucacgcccaugcauacuagaggcucggucuguguucugugucucuugcaggcaccccggcuggaacccacacaugaggaggaccucaccaagggguuugacucggugagcuugggaaaaaguacucaagcucugucuacccagaucugguaggcaggugcuaggcuuuggaucuugcucuauggcuaccuuagguuuucuguucucucauuuguaccugugaaagucaggccuaagguaggaauggaagcuggaaggcacagugggagaugguacagcagagggggagggucagucaguagcuuggaggauggagucagaagcugggagguuguggggacuugaucccacagggggcagaucuggaccacauuaggaagacuggauuauacucugagcuuggcuuguccccugacuagcugcuuucuugccagcacauccuuguggcgcagaggcaagugcagguggcagaggaugcccugcaggauuuucaucgugcuuugugcugcuacaugaacuucacaggggcccaaagccauugucugcagugagucucuggagagccagugggaugggugagugggugggaacagagagggugggcacccugggcagauaggcagugguggucacagcugugguccagccuggcuaccucuuugguucugcagugugucugcccagaagaugcuagacaaugcugcuuucacccuguaugaguucuggcaggaugaagccuccuggagaaggugaguggugguuggucuaacaucugacauugaugggguucuggaggacaucggaccagguucaaguccugcucuccuaaucacuggcugugugacuucaaauaacuaaccuaacacaucugggucccagaugagaugauguguaaggaauaaaugcaagcuagguauugagugcaugccaguuauaucaacccugaaggcagaggcucagaacacaaggccaauaugggucuuucaaauucaacaaagcucugucuccaaaaacaaaaacaaaacuaauauccaaaaaaccaaccaaccaaaaaccaaaauaacaaacaaaacaaaacaaucauacacguuggccaugguugcgccagccuacgaucccagcccuugaggcagaggcaggaggaucaaugauucaaggcuagucugagcuagacccuauaacaagacccugucuaacacaaacccuccaaacucaauacaauacugauguauagugugcccccugggcuaggggccuucauuuaguccuggcaguagccgagugauggagguaccuuguucccaguuaggcuacaagcaguacugaaggguuggugccuugaguccaggagcuggacuagugugaaugacuuagagcccugaucuuagagcagaugacucagccucugucuguuccaucaccucccaggcaccagcagucacccugcagcaaggccuuccagcgcacccucaucgaucaccugcaggccccggacacucucaccacuguguucuucccaggugcgcauaccccugugcuccacacagcucugggauccaggaggggagccccccuuaucuccugacuccucaaccucucauccacagccuccugguggauuaugaauaauaacugagucaguucugcuuaaacuggagacugcagcccugccuaucauucuggagcccucugcacugguugacucuacacuaaaaucauggaaccugccuguuaccaggcuaaaggccuggucaucugguagagggucucucagcccagggaucaggagcuaggccguuugcuugcuuuauuuauuuuacuguuuguagcuuccaagcaccugggcuucugccugauucaggaaacccggauucuggucccccuucccucucuaccuugcugugugacccaggcagaucccucaccucucuggcugccuaggagaguccugcuuucugcuugcugcuuugggguuaaguuucuguucuuccucaaccaguggcagaaccaggacugaugcucagggacuccccucuccccccucaaacccuggaaccuugacccuugaggcuaggccaacucagucuauaguguagagacccauggggucagcccuaaaauuucuaccaucagugguuguaccagagaccucuggaagauccugggucgguuugcaugucauuugccuaucauuugcaugucuuaucccacccauucucaggguacuaagggaagccccaagaagaccuugcagaguagcaauaauuugggccuagaguugccugcugcccccacccccuccaucaagagaucucugaaccccagccugggccuugagcacagaggcaauaaagcugguagucaccugugguggucucucucucuccccug

SEQ ID NO: 1193 - RNA, 2968 nt, Mus musculus
cuuagggcucugcguccugcccuccggcugccacagggccuacucugcgcuuugauaguuucuucauccaaccuggaaggaaaguagaagguuaguccaguguccccagacccauagggucaaggacugggauuucagcacaggaccagacuuagguaggguaagacaggucuccugggucuuugaagcccagcccccaaaccacugaccccuucucucagcagaucaugaccccaagaauguggccucuggaaggcuggauggaacgggauacugaggaguuuggaacucaggaacaacagacacccacauacccgcagcccagcagcacccucacauaccgcuggccaugggccugcgccuccagggugucugaugcucccuccagggaggucugcagggcuuguagcugauugacagucucccgcagcagaaaucgugugacaaacugguccaccuuggaggccuguucauacuccuaugugcagggcaagauaacagggagcuuaccuugcucaugagagcagcaauggaaguggacagagcaugcaggccagcacaagcuaguuaccacucacuucccaucuuugucuccagacagggucuuaauuucuagcccagacuugccuugacuugggauccuccuguauaugccuccccagugcuagaaugaauuaaagaugggaaccacucugcccagcuucuaaggccccuuuucccagugcagauggacuuuguucauccuugcauaugaggcugguucacaggaucauacccuccugggacacuggguucuccuggaucucaauuccucuucaaaguuaaggcugagccggacgugguggcgcacgccuuuaaucccagcacucgggaggcagaggcagguggauuucugaguucgaggccagccuggucuacaaagugaguuccaggacugccagggcuacacagagaaacccugucucgaaaagacaaaaaaaaaaaaaaaaaaaaaaaaaaggcucaugcucgcuucugcaacagcuagugaggccucuaauagagaccuauauauauauauguagcuuccaacaaaaugcaguaaaugucuguuaaauggauuguugaguggaauaaugaaagaacaagcaaaugucagccaguacggggucauaucacacaucauuuuguaccauguguaaaacuggccuuaauggguuucauuuuugauguaugaucugccuugguuaaacuaagaugguagcuucuggaccaugcuuauaacaaaugggauagaguagugcccgaguccugcucuaagucuguggguucuguuuccaugacaucuuuuugguaguuuuccuuuggagguauaagaucgauuuucuacuguuugcaaccaaaccugcuuggcagaaccaacuuccucauaccagacucaucccaagaauuguuuuuaaccaucuuaacaauuuucaguaaccauaauugacuccauuuuguaucuggggccuugagagguugaaucugagccaaaguuaagcagcuaauuaguggcaggccaggauucaaaucaaagccauagaagucccccucuacucacccuuaagcaccuuauaaguauugcuuuguuaaagcacuagcccuguuuugcagcugggaagcuaagaccagaagaggucauagacaguggagcaguggccagauuccccugggaguuacaggggaggagcagaguuuugguguggugaggucacuugugagcucacaauacaguuacccugaugggcggggccaaacuggggccccugguuagagggcagggccgaggcagcaugggcaguggccucuagugaccaguccugugaccaguccuaucaugggaaacagcaguucccacaagaggaccaaagcacccaaucaggccaacaaggacaggccaccugacauggacaaagcccgucacaagcaguucuucagccaucucaagaggaagaagccaagugugaguauggagaggcuagaagggacgcugggugccaggagcaugagggguuagagacucucuagagagaacaggaucucuggagcccauauagguaguaguaguauagggauucuagaagcaauggcuggggggagggggggaggaggaagagugcucucucaaccagggaucagguauagugucucugggaccacagaccugaaauaccuuuacacccucucuccagcccauggccucgcaacacgccacuuucccuuucuuucaguggcgagaggcuccugacccugcccgugugggugagaacccccgcaucaaggcugggaaaguaugcaguggucaauggguuccuguggggaggcagggucucaggguacggggcacaguggggcuccggagguugggucgggcacggaagaagccucaggccccacgagggcauguucuucccuucacacccgcccacccccagaccaagaucgugcugcuuuucccgcuggacaagcggcagcagcuggccgaggcagcggcgggcccauuugugaggccggugcggccaacugaggacccgcucggcgccccaacgugcuucccagcgguggcgccuaugcuacguggggcuggcgacggcguggacaggcgcgaaggcgcgcgcgcucgggagaugaaaaggauccuggugcugcugcugcagcuggacgcacggcugcaggaggaggggcgucgagugggaggcaggccggggggcggggccaaggucccgcagugcuggcagccgcuguaugcgcacgugcugacccaacgcgaugccuguggugaaggcgacccccgcgaggagcagccgcgcaagcggcgccgcugcccucgcccgcggcccugagugccuggcacgaccccuagcgccaggacucugcucaauaaagagcacauagcaaacccugugucugccacuucugugccugcugucggucaccuggucaaaac

SEQ ID NO: 1194 - RNA, 32277 nt, Mus musculus
cuuucuuucuuuuucagcuuaacaggagcauuggccaccagcagaagggcaucacugucucaggccucaagccaggcacccaucucuggaugccagucuauagcggguaccagaggaaagcuggcagcaguaacucucuccccaugcauccuagccagugagugcuacauccuuugcaaguggaguuacuggccuacccuuaccccaugcauucuuccugucugcacugccugggccaaggggcagaaacacucugcucuucuuccccaggacauucccaggcuugggguuuuucuauagguuugaaaguaaaggggggagggugggaagggugggaggaaccugacaauaaagagauuggauccaaauaugcucugagguggaaugguuugcuuguuuauuuuguuuacauguguguacaugguauuaggugguagacaugugugugccacacuaucuguagaggucaaaggacagcucuguggagacaguuugcucuuuucaccuuuagaugggcuuuggagauugucaggcuugcacaggaaacacuuuacccacugagucuucucacugucuguauuucuaugauaaaacacuaugaccaaaagcaacuugggaagaacaggauaacuuuaucuucuacuuccaggaagcagucuauuacuaaggaaagucaggguaggaaccuggaggcaagaacugaugaugaaggccauggaggagugcugcuuaaagguuugcuccauggcuugcucagccugcuuucuuauaguugcccacauugggauggauccucccacaucaaucaucagucaggaaaaugcagcacaggccaaucugguacagguauccuggcuccugcccaccagaaagcugcuauauugaacacuuuuauucuccacuaacuucucuucuccagggaacacuuucuuguccaauacugaaccauuagcaccaguauuccuuugcuaaaaugaguaaaguuaagcuugauggcuauaaucccagcacugagagagagagaagcagaagggucaguuaguucauaacuggucaggacuacaugagaccuuguuucaacaacaaccuauaaauguaccugucauuuuuagaucuuuaaugcaacucuagaaucuaaauugcuugcagcaagaaauagcuuuauuuauuccaaaaugguaauguaacaggguuuuuuuguuuguuuguuuuguuuuguuuuuuuaagcugcucaaguagcauggaacuguaaucccagaacugguuagguagaggcaggagaacccaaaguucaaggucaucuugguuauauaacaaguuugaggcuagccuacauuauaagagacucuguuucaauaaacacagacaaacaguaaauaagguuaaaauaagguaacugugcaggugcugagcuggcgccaagcagucauaggccaucugucacccagcaguuggccacagccucaucuuuguacagcuucuuagucugguuuuggcucaaaggauucaagaauucuccacuuucucuguugccuuagaaugaugaacuuuguauuagaauuuguccucucuucagcuucuuggagcuguuuuaugucacuuccuaacaagguaggcuugucuuuuguuguugcuagcuauccuaauaggcuuuauuuuucauucugucuagacccccuuuucuauaaaauacaaauaucccuauagagucgaaaaggcuuuuccccuuuugguaaaugugggccauuuguucuacucuaucacugcaauuuugggcaugcuggcaauuaacacaucuuaaguuuacagucccguuacgaucaugugucugucgcaugagcuaaagaaagacaagguucuguagaugacuguagacauuuaacuugagaggguacagugcagaaggcuggcuaccaggagaacguauaccaagaauuuggaauauguuccuuauccaggguccccauagaccagaccaucugaauuaagcagaccaaaaagccacaaauagcccagaaaguguuaacuaacuugcauucuccuuauucaguuagauagaugugccauccaggaucccaggaauguggauuagguugaggguguaggacagcauccaccuagcaaguacaaaaacucaaggucugaucaucuacacccaaccugggaggcaguguuaaauuagagaccagcaguaauacuauuuugaacaagugaguuaccaauguuaaaguuucauacagguuuugaugacagaugagacaucaaacacuccagaccaaggcaaacaucagaauuuaccugagauauuuuaagaucauagccccucugggcauuaagagcuuuuauucacuguuauagccaaaagcccuuuaagccaggaauucuaugaauauccuucauggaaaccccagaguuguuuuuucgagacaggguuucucuguauagcccuggcuguccuggaacucacuuuguagaccaggcuggucucgaacucagaaauccuccugccucugccuccugagugcugggauuaaaggcgugcgccaccacaccuggcuuguuauuucuaauuuuaaacuauuaagaaaggaacagauuuuuacuaagcauuuauacaauuuuguuauaguuccaugaaaauaagaacacauacauauuuccaaaaaccuuaaaaauuuucuuuaaauaugaacaacuugcaaaauguaauauuuuagcugcaaaacccaguaagauuuaaauuuuauguguaugaguguuuugcuugcauuaauaucuacaacacuucugcuccuagugccugcagagggugccggauccccugaaaguggaggagcuacagaugguuuugagcuacuacgugggugcugggaaccaauccuggguucucuagaauagcuaagucauuauuccauccccauuucugaagcaauuuguaacuagacaaccuugagaguauccaaauacucuuaguuuguuccauugacuauuugagacaauuuaagucuuugggggugggggcuuuaaaaggugauuugucuaugggguucaagagaucucugcuuaucuugaacauuugccuaguugucucacuagcuucaagcuugggagauuguacacagaucuuauguuaccaauuuuaucuauuauuucccauuugaacaaaucaaacuuaaauucucaggacugccauaggucuuuuucagccauucauggcugacaaguauguuaaaugaguccaguuacaugaguggcaacagaaauagucucaucagcaugggacuguaggacaguacuuccauuuugcugaccuuguuuguuacuguuuugggaaauggccucuugguuuagcuguuguccuggucauuucaguacauguuucugcacuaguugucugcucuuuaggaacugaaucuauacagcagaacuucuucugccuaguuuuugacuacaagguaugauagaaaauuugauucugggugugggacaguauucaggccugaguuuucagauuugucaaggccugucucagccuccugagugcugagauuacagacaugugccuccacacaugccucacuuuuguuuauacucagcuuuugcacugaguucuauagaauguguguacugagaaaggguaggauagagauuucauggcuauucugcuaaauucuucacaggcacugcuuauuugcuuaucagagaugcacauccuguuaauauauacugggaacugacaauugccuaagaucaugucacuugagagucauaauguaaaucuacuugaagccuacaugacugaaaauccugauuuuuuuuuuuuagucucuugggccuuccucugcauucccaguguucuuugcuuaacucccuuuaaugccugucucucuacauucgucuccacuccuaauuuuuuccaugguaauaugagcuaccauuaaucccgccuuagguuucaggcauguuccacucacauuccaacaaaaggguagcugugaaccccauguaacugaguugcaugaaauauagaaugucauguuuuaaaauaaacuuauaauucuguuguaccauauuuacauucuuuggguaugccuaggcacucuuucacauuagauuaaaaagguuuucauguuuuuauguguaugaguguuuuguuuuaccugucugucuuuauguauguauaccauauacaugcaauccuuaaagacaaaagagagcaugggaauggaauguugcaaacagaucagucucuuucauacuuuguuucccugucccccacuuuguugauccagguuggcuacaaagucuuaaugcuacugacucugccucccaaaugcuggggguuuacaacugugcccuacuacacccagcuuugcucuuuagaaaucaccuaaauggucaccauuaugaaguugaaaauugugauugaagucagcaagcagcacauacugaagagugaaaguaccauggcaucccgaguggucccaccaagaaaauaauuguacagaacacaacacacaaaagcaauggagcacuaguuacacaggaggcacugauccuugcuuuauucacgcaguuauagccaacauuggggaucaugggcagagguacaaaaaaaaaagaaaaagaaaaaagaaauugcagucauaaacaguucuauucacauggcagugagcggugauggcaggucaaccaguauaucaguauauauauggcccaucucuugaccuaccugcuugagagaagguuccuucugccauuucacagccaaguuacuuggcucauuuggccuauacuugaaaauucagaggucacagugauuaaaaacaacauagucaagacagcagggcuaacugacuguucuugagccauuuagcaaaguuaacagucugguggcagaaaaguugagcaccguuuauguccuuauccuggugggugcaaguaaggcagauuacagcacagacccacaagauugacccuccuguggcccaauaaagaccacacaugaagcaguaucucuugguuucuaggucacguucaaguuaguuuaguacagaaaagcauuucagaggacgaaguuuuacugaccuagagcacagguuggagaagcuuccuaagugcuaagaagucuguacuauaugcuuccucaaagaggaccaacuagccuaacacaauuccaaggaggaggaaucuagcaccuggcacuuucagcuguugucacgugagagaaugaggaauuggcuaggaagaaguagcaguaauccucacaaaaggaaauuaaacccuccaaaucauuuucuagacauuaaaaacaggucgcugccccauuccuuauguuccaaccacucuuucaagggaagaccuaucuauucuagccauguagcuucaagagacacuaaaaggaaaaauggcugcccagcuccaguaucugccaguuuugaggacaaagaaaacuugccacagcccaggaaucaaguuuguuguuuuguuuuuaaccaaauuuaacgaacacuuuauuguagaaaagaaaacugaaggacagaucgacuucaaagaauuacuguuauaauaacuuuaauuuaucuugcauuuuacagaagucuaugaacgauuuuaaaaaguaccuccuuacccccaucacguuucucugacaguuguuaaaguaggcaacgaguaugucaacagcuugaauaucgguaucuugcaagguauuucagaacaaucacuugccaaacaacuuggcaguuuuucuaucuuguuuuuaacucaaugguacauccacucugaugguaaccuguccagccaaaucuccaacacauuuuggaaaaaucaauggugauuagcaaauuaguuagcuuuggcacggagcugugcucgcuugccugugacagccuggaagccaguuuugauacuggcaacagagcaucgagaaugacaaguuucacauuguaagaaauagagucggguguccuucuguaggauuguguccggugaccggcaugugugacaagugacauauuccucugcaagaaaagcaacacagcauuaucugcuagacacaguuuaucccauccagauagggaacccuagcuaagcauaccuacucuagggguaagaaaauuaaaaacuaagcugucuuguauaaugccacuggcaguaaaaacagguugaaaggacuucagaugcccaaguaaaaaggaaguuugccagaugccuauuguuagauccacuuaugaaugauccacuuuugccuuaugugagagcaggaaagauaugccaauuuuuaaacggggcugauaggccaagccauauuaauaagaggcauguuucucugacuuggucuuuaguaccagaaucagccagcacagguugcaugaacucagcuuucugccuccugcucguuauuuccuauuuuauuuuuuuaaaaagcaaaacaacaacaaaacagggucucuguguaggccuggcugcgcgagaccucacuauguagacucaagagauccaccugcuucugguucuuaagcgcugggacuaaagguauaugccaccauguccugccccauuucccaucuuuuuaagacuuacuuccucacauccauuaaaaauggcuucccucaaaagccuacagccuaaaaagaacauuuuaaaaugcaauuaaauuauauacuuacugauauaucuucucaagacauuuucuauuuguuucuguuggaaucuuccuuugauuacaaguugguuauuaccaucuauagaaccacuaugaaagaaaacaaaaauguccccauuauuuuugcuugcuuucccaagccaaauuccagcaccuucaugcuuaagaacuuaaaauacacucaguagcauaggauaauuucuaggguugauauuuuauauuaucugguuucugaaauuuuaugucuuuuuuuuuucucuuuagacaggaauuuaugugucccaggcuggcccugaacuaauccuccugccucacucagccuuucagguacuaacauuacagguauacacaccucuguacuuggccacacaccccccccaauuuuuuuuuagaguuuaucuucugcaaacauuuuauucuuaauuauguguauauguguaugucugcguagggguaugugcaugugagugcugguuccuguacaagccagagguauugcaucuccuggaacuagaauuauauuauagguggagguaagccacccaacaugagagucagaaaccuaacuuaggaccuuugcauuaucuguucuuaacugcggagucaucucuccauccucucaaauuaauuuuuucuuuuugagauaggguuucuuuauguagucuggcuggucucucuguagaccaggcuggccucaaacccaggagacccaccuacccugccuuaugaguuuagguuaaaggugugcaccacuacugcugggauccucaauagucucuuuaaugauuuacucauauuucuuaacauuuaaucugacuucagcuaucucugguaacaacuggauugauuuguaggugacuuuauguccaaaacggauuccuugaguuugauugcuuguucaaccaacaaagaaaaacuuauacugaaugcacagcugcaaaucugaaggagguauaaacauaaaaaggcuguauguuauuuuuaaaauucugaaaccaagcauggugguacucccagcauguaagaagcagaaacaggaaggaccaccauggguuuaagucaagccugggguacacauugagacccugucugaaaacaucaauauauauaaucuaagccacauacaguggugugaaccaguuaaucauaguuaucagguagcuuaggcaagagggucaauauaaaugccugaggcaugagugcccaggaguucaggaccagccugugcaacauagacccuaucacaaaguaaauuaaaaaucaaaguacuagggcuggagagauggcucagugguuaagagcacugauugcuugcucuuccagagguccugaguucaauucccagcaaccacuugguggcucacaaccaucugggaucugaugcccucuucuagugugucugaagacagcuacaguguacucauauaaauaaaaauaaauaaauuaaaaaaaaucaaaguacuacacaguuugguucaguaacauaugauaugauuauacuaaaauugugaguuguauguuaagaaagcuguuacgaaaaaauauacaacugaaauccaauacuacaaguugucaacgauaaacugaauaacuggaagcagcuaacaaacacuugagaaagaugcuuguuagacacuacugcuuguuaacaaaucagaaaguaaaauauaauuaagucuagcagaguuaauuuacuauuuguuccuaucguaauauaaaucaaacuucuucaggaacagugauuuucuucgagggagaaaaaucauguaccauaaauuguaacccuugauacccuaauaccaauguagugcauuuuucacuaucaaaaagaagaaaacaaaacaaaaagaaaaaggaaucuucccaacaaaucggaaaaauuuaacccacugaccacaaaguucacuagucacauguuagaauauaucccaccucuacaaaaaguccagcuuauucugagaagcauaaaaacauggcuaccuuuccuuuccuuauuuauauuuaauauaaacaauaaguguaauaaauaaaagucacaacucuguuaacaccaucauccauguucaagcagauuacuuaauaucacagccaagaacaaaaugcaacuugagcuucaggacaguaggaaaagcacagaccacagaacauuguaauuaucuauguacugcagcugagacacagagcauucugaucuaaagguccaguaaagaggcaggcagacuugaguuugcagucuauacuguuaugugaccuacaaagucuuaccaaaccaguuggcuguuaaacaaccaaagaaauguuauuuucugcuucacagaacuguaugaaauggcaucuacaccaaacagaacuuggcaugugccuugcacuaucaggcaaucaauguuauaugccauugaugcaacccaaaucuacauuauuuaaagagacacugguaaaaaagacaaucuguuuggcucccugacaauaauuaacuaguucaguaucucuaauagcugagcuccacagauggagagugcuaguuaaucucagacccuaguuauauuuacuuuugguuuuaagacugggucucucuguagccuuugcuauccuggaauucauuuugaagaccagacuggccuugaacucagauaucugacugugcaucuguacugggauuaaagcuauaccaccacugucugucucagacccugguuuuaaauggucucuccuuuggcacucaucaccuuuuaagcuuugcuucaucaauagacuaccaguuauagaggaaaagcugacccgacaagaauugaguuccuguuauuuauuuccuauaaaaggacccaagaauuccaaauagugacuaaacauagcaguaccugcagugcucauuuccaacacuaaaggccugcucagauggaucacugccagcuccauucuccaucccugaggcaccaaacucuccccuuucccaucugaccucaaaaguuccccagggacucaugaugcuccccccaccccccaauauguucaaauuacacaaauuguucuuuugaaguguugaauacuaaguacuuuuuacaguuucuuaccuuguacccaauucugccaauaaaaaugcaaggagauguuuggguugacgauguaaucuaaagagaaagucaaauacuuaaaaaucuuucauggaaauccuaaaaaauaaacaaacaucccacacuguuugucauuucacgugauuacucacucaguacacagcucacacacagaaacaaggaucugugcagcccuggcuauuaucccaguacccaugaggcaggaugauuuuaaagccagccuaggguagugggugccuguuccaaaaacaaauaggcugaacagccugcucaguaguuaagaacacugguugcucuuccaguggaugaaccagguuugauucccagcacuuauaaggcaugaaauucaguuaucuguaauucugguucucucuucuggccuccucacuaccaggcauacguugugguacacagcaugcacacagaacacccauacacauuucaaaaaauuaaaaaucaccaaacgguauaugcuauuucacaugcuauuuguaaauacaccuagcaaguguaucaugccuaaaagcaugaaagcagaacaaaacacuaaaagcaaaacuagguuuugauuaucucuaccuacuuagauuuacauauaacuuuuaauuuucucuacugugucuuacuuuucuaauuuguaguaaacauacacuauugcugucaucagcaugaaaguaaaauauuuugaauaaugcugaacguaaugaaaaguagccuuuucacucuugacucugugguuaggaucuaucccauccucagcccauaaugugugugggcaccuugccugccugugcaucauccugccgcggagucgucucuccagcccccaggaucuacucaucaggcagcacuaacucacuuuucucaucuuuggauaaaaugagcucugagaacagacaaacauaaacugacuucccucaaucuaugaccuacauuugcacagaaauacuacaguaaagacauuuaacauuccuaauaccccacaagucuaucugguauuuauuggaaugaaggguucccacuagcgaacuuacaguuuacagauaucuguaaaauugacaaaagaaguuuucuugguuccuacucggacgaccuguggagguuucauaacaaauuuccucuucucuccagcaaccauaucuggauucuuuucucucaugauguugaacacucgguucagcaacuuuaaggaaaggguggcauuuaagcacauucuuaguaauaacaagaauauaaaguuucuauuugagauacucugcuuuaaugaagcagauuuacuuuuauuaaauguacacaugaauuucuguuauguucuaggaacuucuuuauuuauuuauuuuuuuucaagacaggguuucucuguguagcccuggcuguccucgaacucagaaaucugccugccucugccucccaagugcugggauuaaaggcgugugccaccaggcccggcuucuaggaacuucuugaagacagaaacuauuaaccaaaaucugggucuuuacagaugcucaguaagccccagccccagcucauucuacugauuuuuaugggaaaguacuacaugugacccugaccacaaauuugccacugucaccaaagccccacuaauucagagggcuccauaccuccuucugcugaauacuaucaugacagcuacacuuugaguagacugcaccaagagagaguaucacgaauugucaugcacuggcuucauggccuacuggacuccaccauucuauauuucagugucucuuccaaugcaggagauuuauacccugcuuuucucuguucuuaaaugaauaagagaaaaaaaauuuuuucuucuugucucaccuccucauauguguagucucuuucugagccugcccaagcaguuuggcuacugaaugaaaugccaucaucuuuuuugcugucuucaucuucuaaagcuacagauuaaaaaaagaaagaaagaaugagcagugggcuuugauccaacaaaagggguguuggggggggcgaugauagguguagagaacgauagcuucagauacugcucuucucuuucacagugauagcucaguagcaucaaguacaaagagacacagagaaguccuuguuccuuuauagacaggaauauuacaaccucacacaaagaccuuuaaugagacagccaugguaauaugugaaauguuucuugacaaaaagaagacaaaauaaagcaucaaguacuuaaagaagaguccaacuuuucaaaccccaagaaacuucugacucuauaaaaacccauuuguuuauguugaaaguuauuuuuaaaaaacccuauaguauauaaaacuauaaauacuaaaaguuguaaacauuuaaaacucauuuuccugucuggaucagaaugguuuuuauaaauaguauuuaucauacuuuaacucuuccccuaugaagacagaggaccuaaugcucacaauucagcugugguuggacaagcaauuacagaagauagaaaaacucaaaauggcugucaauuguuugccacuacaaucauucuuuaaagaacuguagagaaacagauucuaaggagaaagcccucuauaauaauaauccagagagaaaguuuccugugaaaugcagauguggaggguacagacaugagucucaugaauguaggucauccaaagauaugaggcaauuccuuaaugucagaaaauuaaggagccugacacgcccccagcccccaccaagagccauuaauuuccuguccaccaaggaaagacaauucugaaaaacuagaaaaaucaaagccugacaugacagggcugcucaaaacuuaaacuauuuaagagagauaaaggaacuccuauggacaaacuagagauucuaaagauaucaaaaaacaaauauuuuggcaaacuacuauaaauaauuaaaaaaaacaaaguuaaaauuacauguagaugaacugagaucaaaggguuaguggagacaggagcagauguaacuguauuaucauaagacuccuggaaccaaagggcaucggcauagcuccuaggaauuggggacauuaucucaguuaaaacaaagucuaaaauggauuaaaugcacaggaccagaaggccaaacagaaaauggcuaauacagccauaaaucuaugggaagagaucuauuuuaacaguaggaagcacagauuagcacccugcaacuuuagagacaggcuauaaaagagaagguccuaauaaaaaaggccuauaaaacguuuacaacuguucuuuagacuguccaggcuguccauuaugcacgacacagcagaggcugacucuauaugggggcgccauugcuaguacaucaccagcugcccuaccauguggcaaacugggaagaacaaugguuaugacaaaagaaaaguuacaggcacuagaacagcuaguccaagagcaacuggagggccaacauacagaagagucugccagcccuuggaauucuccuaauuugucauuaaagagaaaucuggaaaauggaggaugguaacagaucugagagcaaugaauaaaaucauugagccaaugggcucuuuacaucccugaaucccaucgcuuuccuuguuacuaccuaaggcacagccuauuguagugaccgacuuaagacugcuuuucuaaaaucccugggcaugagcaugauagagaaagauuugcuuucucaauaccuacuuauaauaacucuugaguuauuaaagauacacuggagggucuuaguacaaggaauguuacacaguccaacuuuauguccauauuuuguacaacagccauuacaaguaacucauaaacaguuuccucaauauacaauuuaucauuauauagaugacuggcuaacuaaaaugcagauacccuaggaaaaaauguuugauugaaguaaagaaaauuuugccuugcuggagauuacaaacuauuccugaaaagaauacaagaaggagauucuacuaauuaucuaagauguaagacugaucuacaaaaaaaucugaccacagaaaguacaaaucaggagagaccaauuaagaacuccuaaugauuuuuaaaaauuguugggagaaauuaaucgguuaaggcccacaauuggaucaacuacucaagagcuaaguaauuuauuucaaaccuuacaaaguaucaaggacuuaaauaguccaagaaaauuaucagcugaggcugaaagagaauugucucugguagaaaagaaauuccuucuacucauucccccacagggauauuuaggcagauagaagacuaaugcugaaaaugccucauuaugggugaaaaugaauauugacaaggagcuugcaguaauuuuuugggagagauuaacaacaaauagcccaaaagccagcaauuucaauuuuuaaaaagaaauaauuggauucuccuuugcauaauaaaagggacaccgauuucuggauccccuacauucuauccugaugcaaauaaaucagaaaagguggguuauaaaucaagaaauauaaauaaaauaauucaaaaucuguaugauuuaguuccaaaaaucaaagcuauaugccauccuuauuagauuuuccagacuuucucaauauaguuacugacucucauuaaucagaguucuuuuucauauagaaaccacugaacuuauucagaauaauucaaaauuaacuccauugauuauucaacuacaaguaaguagaaguagaaaucauccauucuauguaacacacaucagaucccauaugggucuacgaggcugucuggcacaagguaaugaugaagcucaucagcaauguaggcaaugugcuagaagcuucagaauuuccuaagaaaaagcacguuaacagcaaagguacccaaagaaaugaaauuuggcaaauggauguuucauuuuacagagguuggaaaacuaaaguguauauauaccaacauauauucaggauuuuaauaaguaacugcuuuuaguucugaaaaggcugauucuguaauuauauacuaauuagaaauuauggguauuguagacauaccuauacaaauuaagacugacaaugguccagcaaacgucucuaguaaaaugaagcaauauuuugccuauuacaauauaaagcauaguaaagguacacacacaaccccacaggacaagcaacuguaaaaaaaaaauccaacucucuaaaggagacacuuaauaaacauaaagagcaaacaaagauacccagagauggauuacauaauacucuauuaacuuucaauuuuuuaaauguuacuaagcaaaaaaacagcugcugagagacauuggauuauagaaaaaacugcugaaauaaaucaguucauuuguuuuaaggaugucuuaauucagaauggacgguaggaaauacguugccuuaagagauguuuguuucaacaggaaaagaaaagcuauggauuccaucaaaauuaauagaaauuagauuugaccagggagacccccugaaaaucuaggcuggaccccugaaggaagaaaccaagaaaccagauaacaggaaugcugauccccacuacaugggaacagcugagacuggcugagacaggaaagugucucugcaugaccaauaaaucuuguuggcuacaguguccucaagacuuauuauggcaucccuucaaacagccuggaugaaaacuuauauuaaacuuugaauauacagaucaaacacuaaguuugaugccuuuuuccuguucuaaacacagagcaaagaaucaucuuuagcugaauugugcccacagcacauuucaugcauguguuaaugcagaaauguauacuacuuuuaaaaacuuauguuugcagagcaaaaggacaaacaccaaagacaaguagucuaaauuaaguuaagcccugcauuuucccaccacacagauacuagaugacaaauuacaucuagcuuuccuaggacuuaacuaauaucccaauuuuccuaugggcccccaaaagaugcuguugccucuagacugcagaaagcaauuuuaagaggauacccaauuccccaaaacuugaguguaugguuuugguaauuugaugggugacagaugucugucaccacuuaagggggggguuaguuacaaguaguuaauggucuugaucagagaggaaaacaaaguagagguuagauucagggaucucuuucucucucuguccuauuuaauuuaggggaaaguggggggagaaagaauaaaaagaaaaagggauaaaagaaaauaaaacaguagguuauugaaucuuuuuaaacaaaagagucaaauauuuuacauugguaaggauuuugaauacuguuacaauuuuaagauuauuuuugcuacaaaauuguguauauauguuugaauucuuauauaaaguauuguaucuauacaacucauuuuaaaaugcaauauaaaguuccagugcuuaaaaacugcuauuaacagggauggagagauggcucaguaguugagagcacugacuguucuuccagagguccugaguucaauucccagaaaccucaugguggcucacaaccaucuguaaugggaucuaaugcccucuucuggugugucugaagacagcaacaguguacacauauaaaacaaaucauuuuuaaaaaguugcuauuaaaaauugcuuaggauaacuaggaaauccaaguuaauagucaacuaaacuuauggucauguuagauacuaguuaauuacauacagaaauguuuccuagguuaaacaguuaggaauagcuagaaacaagcaaugcuugccuauuuagauauacuauaaagagauggucuucaaaaaccucagagaucuauagaauauggauuuaaagauuuuuuuuuaauuaacauaaggcuuuuugugacaaugagacaucugcuccuggcagcauucuacuucaaagaugaugagcaucguuaaagagauggucuucaaaaaccucagagaucuauagaauauggauuuaaagauuuuuuuuuuuaauuaacauaaggcuuuuugugacaaugagacaucugcuccuggcagcauucuacuucaaagaugacgagcaucgaagaaucucuauaugggguuugcuucuaauguggcaagguagccacugggcaaaaauugcccuuaccgcaacugcugacaguauguugcccaaacuagacacaaacugacugcugaacuuugccaagacaagguaggcaguccuucauaauuucugcuucauaaaaaagucugucugauauucuaggccagaaggucaaagauaauauucaaaugacacagagaaaccuuggaugacuguccaggcagccagcaaccucugucaugucuacagcuuugggagcugcuugcucugcacuuccuguuuauucagguaauauuuguccuucucaggucucugaugggauuagagacuagaugguuauaguuucacaauuaagcuuaaguuguuuaggacuuaagaaaauguuuuuaaaaaucuagaaagauauuuuuagguugguaaugcaaguuauuguaaaaaauaauuuagguaaaggacuuuggacucaccaagauaggauagauagcagaauacauuucauuauuacaaaguagaaauaaaagacaugacaaauauuuuuuaaaaagcuccuuaaccuagccaaggagacucaaauuaaaggauauguaacuuaaaaucaaagugcugaauccccaacauuaccuucgucuuuuucuaguauuucaucuucuucugggaauuuaacauucuucuuuuucuuuuuuuuguugccaagcauaaugucaaggucauccucuggcucggcuggcucuugagcaucacucucaaucuuaacauccuaagacauugaaaacaagucucaauacugugguacuagaacuauuuuuaacgucauagacaaguaucauuuuugaauauuuuucacauauuuacauaucuaaaauuguagaugagaaaugucucggguaggccaaauuuccucagacucuguccaauauguaaauugugaauuccucaagauaaauuuuaggauuguuuaccuuucuucagcucuuccuuuuuauuacaguuuuaagauauuguuaucuguauccuaaacuagguacuaccugagucacuugagaaacucuaauauucuuaaaccuuuuaacugaccauauucagcaggaacaggauucaggaguacuuuaaguuucuccacuuaaauguucugaacagguaaaccuacagagcagaucuagcaagagcagaggccugaggcuggcauguagugggaagaacuggagagugacaaugaucaugggcuuuguuuucauaaggauguaaguguucugaauugaugaguuauagaacucugaauaugcuaaagccauuuacuuucaauggaugaaugaaaugguaagucaauuauaccuuaaacuuuguuucauuauugcauuugcaguauacuugcuuaugcugauaccgccccucaacuccucuccauccccuuuaaguuucuaaauagggucaauggaaggauuuuccuaccgacaccaaauacaugguuauuuuuugcacaauucuccaacucgcuaauacaaauuagguaccaucuuauucauuuguaauggaaugcuaacuuccuggaguaauuacucagauaucccauguuuaaauuaaaauuuugaccucauaguuuaagggcucucauuaaauguaggucacuaaugucgccuacacuuuugcuaaccuacaaauguaaagaccuuccgccuauauucaguaauuugcuaaaacucagcaaaauuauuauuaucaguuuuuuguaagauuaacugagaaacagccaaaugaaaacaaugcauaggacaagcuauggugaguaaggagcugaggaagagucaagaaaagccuaguauauaaacacacuacccuaucagcacuucugugagguuaccaaccuggaaacucuuggaacuccaucacuuacggguagcagaacucaguuuccacauuguccauuuucagagguagcaggggcaauuuaaaguucccaaucuuaguuaugccuugaucuuccuagugacuaaccacucauccuaagaaacuaucuggauaccagauuucuccagagcaaaacaugagucuuugaagacuuaagagguuuucaggaguuaaacauggggaaccagauguaaaaaccaaauuauuuuuauuauacuuauuacaucagcucacagcaaauuguaaagaaguugcugggcaccaguucaauaaaugauaccaugaaagagggaaaagacagaauuccuggggaaucagggucuugugaugacuggguggacaagacacagccugacuccaagguuacuugcuauaggcuugaauaugaaaaaggcacauuaaguccuaaagaggacucauaaacgccauaaaagaacaaaggcccugccuaaguuccuuggcuucuaguuucucaucagcuuauucugcucacuaacccaaccaaguacauuaccaacaugaucacaauuauuacauuaucugugugccuacauccuaaacaauugcugauaaugacuauaguaauuucacagaucuaagcagguaaauuuaaauagauggaauuagugaaacuaaaacauaagaucuuaaaucuagcuauguaguuuuggugccacauuaaagacguuaauauccaguguuagcuagaaucccagaagcagagaaaaaaguaaaacagcauuuaauagaaguagaacucaugcuaacuucucaggacaaaagcuacagggguuggggcggggggguggggggggaccaaaucagggacuagagagcuggcuagaaguuaggagcguuggcugcuuuuccagagguccugaguucaauucccagcaaccacaugguggcucacaacuaucuguaacgggaucugaugcccuuuucugacaugcagguguauauguuaaauauaauaccuuguuaaauagauuauugaauaaauuaccaacuacauuuaaaauauucuucacuuagguuugagcaaauuaacuaccaaagaaaaacuuuagcacauaguaaaaguuuccucaguaugugguuguuuaugcuuuuuucacuaugaauauauauuugugauuauacacaagacacacauacacacaaaacuacuauaugcucauuuuauaaauaugugugugggcuuugcuaagauugacuucugcauagggucucccugugcgugguacaugugugaguuaauauuacauuugccuauguuuguggguagaggccugagguugacuucuggauauuuuccucaauuacuucuccauguuauuuuuauugccuguuuggauuaacagugagugagucaggaaaucuaccuguuuccccugccuagugucaggguuacaggugcauacugccaggcaggcuuuuacaucauccuuaaagaccuaauugcccaccagacacuuuagccacugagugaucucccuggccccauguuuaaaugguagcucucaggcaaggaagaauagucuuucaucuacucugcucaccaauccacccuccuauucacccuccuaccaccuaucuacauuuuacucaaggaauuuucagauaucuguauuggaaauaaauccaaucagagcacucggccacagaacuggccagagaagucuaauuuuccuauagaguuacugucaucagcuaccaacuaccauacugagagaaguucuuugcugcuacugaaaguuuaacaagaagcuauaguaauauuuguaauauuuguuccucaagauuucucggucauagagacaucuuaacuaagaugcccuuagccaaacaauuuugguaugguuaaagacaauggacauuaucugacuccacuguaaugauauaauacaauauauaaaaccuaaauccuuccaacuauaucuuuuauaccauguagucaaauacauuccuaagaaaacuaccuuaauaguaguagcuaagugcuaaacaacaaaagcaaaacuaccaaaagaugagaugaggaggaaaacagcuaucgacauccuuaccagaaucccaauuuuacguucaauaagaaaacaauacuaccuuuauagcuucuucagcuucaucaaugucaaauaucuuuuuugucuuuuucuucuuuuucuuuugauuaaagaaguucaaaucaucuaagucaucagaagcaucuaaaaauagauuaaagguuuccaguuauuaacaauuaacaaaaggcaagcaccaaauugaguuaugccagcuccuuucucaaguacuucuaugguaguccuaccacaaccaucaguuaugguuuugaagaaacugacaagcuaacucaagcuuucuagaaggaucugguuaggagcccaggccaaaaaccaggaaacucauguaaugucagagagcauucccugacacaaucuuagacuauucaacucuaucuucacuuuguccacuucccugucccauccaaccuucuaucccucgauguacggcuccaggucgaccaauccagcggagcagcuaaggcuuccacaacaacugugaccgccacaacuauucaccuuucuuccuacugucuuccucaucagcguccacgucuuuuucuucaguugguucuggcuccacuucuuuugucucugagggcuggguuucuucugucugggcaucaccuucuucaucuaacauaaaaggcuucuucuucuucuuuuucuuuuugcucauaguaggaucaaaaaucaucuguuaauuuaaaaacaccaagugauaauuccuaaugaagcgcccauuccaaauauccuuuauucucaaaaagcauauuccuaaaagaacaggauacauuaaaaugccaaaagguggggcuggagacaucccacacuugcuccccgguacuugcuuauuugcaggcucccuuucacaggcaauacacacaguaaaaaaacaaaacagaauuuacagaaagcccaccuaacucccuuuacaucauuaaacacagggagaaccucacaaaagucuuuuaauuuguaagcuaucauaaacuacaauaacuucauuuuuauuuucaugaacaaauuuaggccugaacaaauccugaaauuuauuaaaaggacuuuagcaacaaccuauauugcaucccucauuuaugggugaggaccaacaaugucuaggcagaugauaaacguuuuauuuaagguugaguagaugcuaacaccagacaaucuaagacuugguuuuuaaauuuuucaucuguugaguguuuggagaaguuagagguaaauacaaaauaaagauauauugucugcauuauggaacuaucaaaacaguaagcaaaauauucuaaaaaaaauuaaaaauuuaugcugaaauucacaucaaccuuaacuuuuauggaacccuaucagcaacccuuacuguaagaaauuuuucuaaggaauccuucacuguuuuuugcuauguaaugugaaguguucacaagccacuuucaucuaaaucuauuguagaacaagugaaaaauuaauuucuaaccuguagacuguuuauacugaucccuuaaaauaauuugaacauauagggcauacuccugcuagugaagaaagcaaaaucuuuagucaaacagaacuggauucaaguccaaaguauuuuuuuuccuaucauguuuaagcuuaucauuuuguucauuguguagugaucgaaagcacauuggagcauaauuaccuugcguccaauccugacucuaacucauguggguuacccuaugcuucaucuguacaucuucaucuguacaauggagauaacugauaccaaccaugacaaaguuacugugagaaucaacuaucugauuguaguuauaacuaacaaugauccugucauugaagauuccucaacuaaggaguaacuugauuuuucagacauaacaaaacugguuuuuuuuaaaauucccaaauugauucuaauaacuaacuguaauuccuuuaugucuaucgaaagacugaaaccuuguaauaaaguaaauugucauagcagacaagucuguucaaggcauuauggaaauuuucauauagcaccaauaccaaaagcaaguccagugcugacuuacuacagggccugagguaaucccacauggaaagaaugcugcaaucuguuauaaagaggucaagaacacagcuauacuguaggaagaagacuuggcauaagggcaaacaaaauuccaggcauugaaacuuugauucugguagagcuuacaauccacucauuuuuuuuccagucuaaguuucccugauuuacuaguggcuuuuucugaguuugcuuuuguggcuggucuugaacuccuaagccaagugcuaggauuauagggacacacuauuacacccaucauaccuuaucaagacagaucaaagaagggggaaauccuaaaaugaucagaugauaguuuuaguuaccuuucaccccucaagaaaauucuaauuuaggucuauaguaaguagacugcaggcuaguaguaaacacucagaaaucuuaugccacauuguaauuauguuccuagaauacuuaacacauguuuaacauauuaauacuuauuuuuguucacacaucccuguaaaauaguugcauaaggaaaccagaaaaccuaagucagcacccaaagcagaacuccccaaaucacaagaucacacuugccagcuugagauacacauuaagacuuuggcuuaaaaaguuucauauugaggcuggagagacugcucaacaaucagagagcacuggcugcucuuucggaggauccagguucaguccccagcacccacaaagcaccucacaacuguuccaggaaauccgacacccuuacaaagacauauguguaggcaaaaugcaaauauacaauucacaugaaauaaaauaauuuuuaaaaaaaguuuccuaucaagccucaguugggggcgcacaccuuuaaucccagcaauuggaggcagaggcagguguaccucugaguuuaaggccagucucaucuacagaguuccaggacagccaggacuacacagagaaaccccgucucaaacaacaacaaaacauuuaauuuuuuuuuuuacuucaguuuuguugaugccuagcacacuaagaauaagccauccucagucuuaucuuuacugugugugguggacggugaggggggcaggcagggauguuguccucaaacuugauacugacauacuuuugaggagaaaauaucuuaacuugauggcaaauuuggaucagcugguuauggaguaacauuucucaaaacaauaaaacuuuaaggccgggcgugguggcgcacgccuuuaaucccaguacuugggaggcagaggcaggcggauuucugaguucgaagccagccuggucuacaaagugaguuccaggacagcuagggcuauacagagaaacccugucucgaaaaaccaaaaaaaaaaaaaaaaaaaaaaaaacuuuaaacuagucuaaacauuacuucuuccuacaccauacuuuaccacagaagcaauagacagaacaauauaacaauacacagguaguuauuuuuaaguuacgaaguuugguuacuacauguguuaucuauuaccucuuacuacccauaagcacuuuaccacagaacaccacagcuguauauagguaguuauuuuuaagucuggaacgugaguagaaauaaaggcuaaacacuuucugaacuuuucuaacacauaaugcaguagcaaagagcaaugucuaacgugucuuucaagcaagaaacaucuaucucuuccagaguuuagugaguuugcaagagccuccuagucauuuagaugaaggcauacugcacagagcugggauucuauuacuagcucaggcacuuggaauuuuauuagaggcacuguacaacucuaagcuccaauuggcucaucucuaaaauggacuuacaggaauuuauuuuacugaacccuggaaaccaacuuaaacuagaacuaguucccaugaaacaaaucucuaauuccuuaauguaguuaccuaaguccuccauaaacuaaccagcaucuacuucaaccaaacuagugaauacuucacuuucuaugcacuuucucccuucuugaccauaaacgccuugugaucaguuuucucauugguugagaaaauucugaucauuucuagagcccauucaaaagccaacucugcacagaaccuucaacuauuccucuuaccccuccccuaggccuguaagucaaguaagucacaaauucuucguaaaguacuuccuuggggcuaggauuaggcuucuaggcccaaugcuaagcaauaucuaagccaagaccacucuuuuuucuuuaaagucauuuaaugguaugugaacuaggauaaaucuggaaaaggcaaaacccaaaaagauuuaaaagaaaaaaaaaagacacaauaaaacgggggacggggcuugaaaaauucugagauccaaacccagucaguuucacagccggaccuuccugcucaccucgccuguaaaggaaacuuugggacucgggcccgaaaacuuuucucgaaagguggucacuuccugagacuuaaaauaucuucuccucuggcucuuuggguuccugucuuaagaaauaaggccucgagcgggaaacgggagcgagauauccgcccggaaaaggcagccuacaaaguuuuaaccucggugcuccaccggaaccgagaggggccucgcagggcacccugaccccucagccgugagagccgaggcggcuaugugugugaggaaaggaaugccggggcggccgggcaaacuaacucggcauucaaccccuuuccgagaggacggcucaacacgcucuccauuccgaaacgccgaucaccgugggagacaggccucgccgccgcccugaggagagccgagggagaccaagucugaggauccagaguccucgccggcuccacagcuccgggacgccuaggccgggcugcuccacauggcggccggcuacagcuaggccgcaggcccggcuucucacacagguguggguucggcuuccugccucaguccuuagcccuaacuccagcucagccucucaccucguccccggacauggcuguaguucgagcggguucggcagggaugaaaagucaaaccggucggcuucacggcccggagucagcguagcucccaccgauacuucucacagcaccgcacuaggcucuugcaucagcgaaagggagcgacaccccgcccuccucucaaacguuggaagugcgccugcgcagagcucgccaaagcgcaggcguacaguaaagccaaccuuacgugcuucucguggcgcgaguuauucggcgacuccccggcgccgggcauacugggacuuguaguuuggcuagaaaagaccggcgcuugugcgcuucgggaguuucgagggcgugcacgacuguuuuaaacaugucaggauguucggguucuugugcugcugguuaccuaagagguucgaaaagugcuguguugcuuguaaagugaauuuggggccauuuuucagguuuaacuuaguggaaacccuaauaugaacccguggagcugaguucacgcuuuccccuagaaucggucuaguauucgaggaaugcaccucaguagaagcguuucacuucgugagaaguuuaaccuucuagcuuuuuacuucagaagauucuucccugguuuuccauaguuagaccgaggaacgaagccguccucugaggagaaacagcccagcaagcuacagucugucaggaagcuucgaaauagucuuaacuagcucaauaaaggggcuauguugagaaauguguagaguagguaauuaacuuguugacgaacuucauaccauauaaguaaagacacuacaacguccuaggcgauauaaucaucugggacuauuaauuauguguccuuuuuugacuaaagcuuccuuauaugguacaugacuccuuguuuauggagucuuugcuagacaauucuggauguaucaucuauuuucccuggggagauacagcugccauuuaggaaggccucggaguaugcgcuuguaguuaaaaaacaaaacaacaaaaaaacaccuguguuuguaaccacagggaacugcaaagccccacuguuugaaagaaugcucagcuggggcgucaggugauccacucaggugacugaagggacugcucaaguaaguagaugcuaucaggagaugagaguaauuaucaaguuuuuaaugcuucuugcauaaaaagaaucaagugaggauuaaucuaugauuagugaaaaaaagcccucacguuagaagagauggggaaaguacuuagugauuuuuguaguuggcaaaauguucuucuugauugauuuuuguauucauaccugauuacugaguuugucuuuguuuuggucuacuggaauuacaaaauggucugucugagcugggugugguagcacuuaccauccuagcucuugagaaguagaggcaugaauaucagaauuucauaaccagccuggacuacauaagauuuuaucuuuuuaaauuaaucaauuaauugauuaauauacuuuacaucuugaccacaguuucuucuccucccagccccuaccccccauucacucauccucuauuucucuucagaaaggggaggccuuccauugauaucaaccugcccuggcaugacucguugcaguaagaccagaggcaucuuauccuauuaaggcugggugaggcagcccaccuagccucugggaaaggaucccagaggcaggcaacagagucagagaaaaccuugcuacgcucucuggucgagucaacuggacaagccgaaaggcuuaaaagucacucaugaggcaaaagaguuucaaggaagcucuccuccuggagucuaguguucucuacccauacauuaauuuuucauucccgaguuccauuaccgcacuagucuagaguuggauccacgugugcucucuuucaguauuuuccuauaagugcucugacauggcuaaagccuuccgccaguguuccaacaguccaagggcauccuugaccaagaucaaggguuuagaauucagcaagauuguaaaagcuaagucacucccuuacacaggaauuuaccaucacuuaaaaagaaggaaguuucagaccaaaggagaaaccagaauagauacuauagcagaguuacacccauacacacguauuuacaauggccuaaggagaagguagacuauacaagagacuaaaauaggaacuguggcaaggacgggaagcccuugacccuggcuucuaagauuaaugaauuuuagguggagcccuuguugaucccagcuguuaucaauauauucuauccugggugguuccgguuagaccuuuuguguuugcauuccucuguuuuauguaagauucuggucaccucaauuguaccuugcgaauaugucacccaacuuccuuauuguccucugcauaaaaagucugaugcucgaguuguaaaauuacauucagauuccacacaaacucuccugcgugugugucugucugucauucauccaagcuuugcccaccagcgucgagagaccccguuccacgcagacauagggacccagaaggucugcagcaaaaccuauuacuguuguucggagucccacaugaaaaccaaacuacacaacuauaacauauguguagagggacuaggucaguucuguggcaggcucccugguuagugguucagucucuguggccccuaggggcccaaguuaauugauucuguaggguuucuugugguguccuugacuauucugucuccuacaauccuuccucccccucuuccacaggauuccccaggcucugccuaagguuugccugugggucucugcaucuguuuccauaaguugcugaaugaggccucucugaugacaguuaugcuaaguuccugucuggggucccuggugcuggagugaccucuaggaaagcagccagaguugugggccagaauauggaucccgagaggauggggugagaucuugucuuaaacaacaacaacaacaaaauaaagaaacaaacaaaccaggcaguaguggcucucugaguuugaggccagcccaguauacauagugaguuccaagacagccagggcuacauagagaaaugcugucucagaaacaaaaacaaaaacaaaagauggcuuuagugucuucuuacugaucguuuugcuguacacuaaguauaaacuuauuguuguguuagaaucuuggcucacccuaaauauuaauuaaauuaaaacaauguucuaugaaaucacuuaguucgggcacacacuagaugaaaacaucagcacagcugcccacuacccgaggcuguucuccucaugcucuguaauccuuaguauguucucugcuuuaggccugaagacaacugaguuaacccacaaauauuuagaaauacuuccugcugcacaccugucccuaaucuaggcagagcacauccuugccuccaaggaacuuacaauuuagcaagagagauaguuuauuagccccauuguccagaugaagaaacugcuuguagagcauugaaaguguauccacaguuaaauacagacaacagaaaaagugaaccccugacaguuugauacugguggcuauucuuuuaccuugagaaucugaauugcugccaccaaaccacagucgucuguagcuacuagcaucuaugcauagcaggaucucuuaccagcaacacuauuggcaauuugaacaagacaacucuguuauagguugauguucccugcauggaggcuauucaguaccuggucaauauccaaagaugccaggagcauacucccuccagucaugauauuaccugaugucucagggggcggggggggggugcgagaggcgggaggggggcugggauaagcaucaccccugguggagaaccagugauagacacaucuuuucucuuccuagguuauugagauccaacaaauaucccuggcuaguccucaacuugcugaguggacagguuuugaagaggagagaaugaagcuguggauggaguuucagcaaagccuguucauucagaagauaaagacugaacaaaugggaaaauaauguagaaauaaaagggaaagugacagaaauggagaaagggaauucacgggaaaucaccuuuucauaauucagcucaugcuagcaaagauaguugacucuagugaacgcacuaagguugucaugcuuucuagucaauuuaacccaggcuagaaucaucugagagaagggaacgccaauugagaaaauuccaccauaagaauggguuguaggcaagccuggauggcauuuucuuaauuagugauugaugagggagggcccagcccacuguggcuggugcuagcccuggacuggugguccuagggucuauaagaaagcaggcugggggcuggugagauggcucagcggguaaaagcaccgacugcucuuccaaagguccugaguucaaaucccagcaaccacauggugguucacaacuaucuguaacgagaucugaugccuucuucuggagugucugaugacagcuacaguauacuuauauaugauaaacaaauaaaucuaaaaaaaagaaaaaagaaaaaaaagaaagcaggcugaacaaacuacaaggagcaagccaggaagcagcacuccuucaugaucucugcaucauccgccuccagguuccugcucugaguagcuguccugacauccuucaaugauggacuaacauggaaauguacacuguagcuguauagaugguugugagccuucaugugguuguugggaauuggacuuuaggaccucugauagaggucgagaugagugcgcagaggucaaaggaaacuuuuauuucuuaggaguggguaaaaauccuuucuucuaguccucuaucacaacccuuaccguaggcaguauguauugcacauaucuguacauggagacuaaguaaaauaagucuuuaaaaaaauaaaacuaugcccccgaaguguuguuuguuuguuauccaggcaagguuucucuguguaucccuggauguccuggcacucacucuguagaccagguuggccucaaacucagagauuugccugccuucugccuccuaagugcugagauuaaagccguccccaccaccaucugcccugacuuguuuugaauuuaguagaauugcacugcuguaaauaguuggcggagguaucaagggcuacuugauguuuuaguuucuuagaagauuucuaauaaaccacaaugagauucuacuuacacucauuaaaugguuacuaagaaaauaaaaccaaaaagacccauaaaccaaacaagugcucgcuaacaaagcuaugggaauccuuguguguuauuuguaggaagaugaaauacuguauccacuauagaaacaguaaggcuauuccuccaaaaaaaaauguuuaaauagaauuaccacaugauucagcaauucugauugugacuauguauccaagagaaccaaaagcaggaugguaaagaaauguuugucuaccuagguucauagcagcauuacugacagaggucgagaugaggaggcaaucuaccuguucaucaccaaacaagcaaaaaugugguaagggcauacaaugaacuaucacugggcuuuuaaaaggaagaggauuaugcuauaagcaacaacauggauaaaccuugaggauggucugcuaaacgaaacaaaccaguuauaaaaagacuggagggauggcucagcacggaaaaaccauagacugcccuugaagaacaucugagucugguucucagcccucaugucaggcggcucggcacugacagaauugaaguuauauuuuuugacacugauacaaaauuuuauauauugauacaaguuuaagguuuucauugguauaagucuuuuuagguugauacaaaauuuaagauuaauuuuauuacaacaugauauauguaugacucagcucuucuauagguauuaugccuaugcaacucaguuuaaaauacacaauuuagucccacuccuuuucauggcugcuauuuacaaacuguuuaaaauauuaaguagugcaaguuaauacucagagagucaaacugauggucauauuagauaccaguuuaguuaauuacaauaaaauacuuuuaagguuauucagggaguaaauagauaaaacuaaacaauguuugacaaugaagauauacuauaaauaguuggucuucaaaaaccucauguaauccgggugugguggcacaugccuuuaaucccagcacuccggaggcagaggcagguggauuucugaguucaaggccagccuggucuacaaugugaguuccaggacagccagagcuauacagaaaaacccugucucgaaaaaccaaaaaaacaaacaaacaaacaaaaaaaacaaaaacaaaaaaacaaaugccgcagaccuucugggucccugugucugcguggaauguggucucucgaagcaggugggcaaagcguggaugagcgacagacacacacacaggagaguuccuguggaaucugagugua

SEQ ID NO: 1195 - RNA, 15194 nt, Mus musculus
ccagcuuuuagccauccugugcacggggcuuguuuuuauuugcuuuccaggucaaauggguucaguaaauugaucacuugggcaaauaagagggaguucaauuucucauacuuuuuugugugauucacauuaugcgauccgugaagagauggcucaguggguaagaccguuugcacuuguagaagcuacacauggccaugcuugacuuuaaccccagcucuagggugagggaucugggaagagcagaaauggccucacucuaguccagugagggacccugucucaggaauauggaagaaagcgaugggacaucugguguccuccagaaucacagguacagugucugcacacacaugcacauaugucagccacauacaugcacauauuccagccacacacuuacauuuuaauagagccaaaauucuuuaggcaguagaaacuguauuuuauccaccuuccuuuguuaacauucuaaauagcauauaaacauuauaaaacaaauuaaucuguuugugaccugggcuugugacaggaaccaucaacuauacagaagugacaggccuuuuccucuuuguuuuuccagccccuuucagucugucacuuguccuuucuugguuaaucuauccuaacccuugugaaauagggaccaaaaaaaguaccaacucaguaucaugagguuuaagagacugcccaacaguaaaaaggcccagcucucgggggccuucaaacuccagggguuccugcucuuugguggagcucguucuuggguccuggacugagaaaccaauggaucugcaaaccaggcacacagaucuaaagaccaagugagggucucauugauaaggugcauggcuugugaccaucacuagcaacauccagccucaggacuuccaagacuucugagaucauguccccuguggaugccuaccagguaccucuccauucccccuccacaccuggaacaguaugagggauacagcagaggucaaagacagagugaccagccccagaggguguaaggggagggcugugugggagaagcacuguccaggcuacugcaaaguuggugacauuugcucuugggaacgagagauagggcccggaacaaggauggcagcuggaaggugaaggacagccccagcacucaguagcgguagugaucaggcuugaaggggccguugaugggcaugcccagguacugggccugcuucucagucagcuuggucagcuucacauucagcuugcccaggugggcuucagccaccgccucauccagcugcagaaacagaagagccaggaguuaauaucaugcucuaguacccucaccugcaucuagccaacacacuacucugacagggagcuggcaaguggcacuacccuugcuacccucguucucuccucauggccagcugcagugcuccccaucagaagagucaugcacacccaucagaucacucugggcaccaccaauuacaucuccucaccuccucuaaccaaagcacuaaccacaaugcuuccuggaaugaacaggacauauuuuauuaucaacagggacacucucuaccaaguccuaccucacaauggcaggacaaugacuacagcccagcccagacggagagagugcuuuuacguuccaaauccuuuguauguccacuguuccucagagcugcgcagacauccccaagaaagaggaaggauaaucccucuauuaacagaggaagagccuaaagaaacugauauuggguucaacuagaugcaaggugggccuaggcuggaguccacaucagaaauggaacggaggcuuccucugccugggcagucuccuugggaugcccgccuucucucucacagcaccggcaccggugugcuacagaaguggugaccuccugggcaguuagagcuggguuuccaaaaacucagaagagcacacagccucuaaaccuugauuuccucauuuguagggcacacauaacaaauacccaccuuuugaaccugcccuaaagaucagugacauucagacugcugguucaaggggguaauuuaguaaguggugguuacugucaucauuaaauaagguaccuaauaaaccugcagaaacguggcccguugucccggcuaaguacuagggaugcagcuaagggauauuuguguagcaguuuaaggaccugggcuccauguccagcaccacaaaaaugaacaacaaccaacccaagacugacauagaggcuugugccuuuaaucccaguuuccaggaggcagaagcagacagaccugagucaaggccagccaaguuccaggcuagucagggcuauaaugagauccugucuaaacaccaaacagacgaauaaaccaaauggggccuauucauuuuuuuuaacuacaauguguugcauauauuuuuaaauuauuucauaucaagaccucagcacaugacuucucuugagagagcucagaagcccuguccacuggagcugugugcuaggcuggugacagcugaguggcagagaccccucugccuggcauguauauucuccaacuuuucaguucccacucagccugcuuuaccaacuuccugccaauccguguaaacaugggagaggcucgccaucacuaaggagagaacucuugccuucacuuuacagaugaggaacggagacacagcuccaaaccuggugagucacacuccacagccaauuccacugugugugcuccagggagcaccaaggacucuggaugacaacuaagaaggcagacagacauaucuuuauaaacucuagcaagccugcacagggagcccaggagccagcccauaagucuuggcuuacaguaaagcuaagagcuuaccuucuuaggcaggaagugaaccccaacaggguauuuaucuggguggguccacagcucaaucugugccaucaccugguuugugaaggaguugcucaucacgaagcuggggugucccauggcacaacccagguugaccagacggccuucagccagcaagaugaugcggcgcccauucuuuagccaguagcgguccaccugcaagggcccagggcaacgguaagguggugggcacugcccgugccuuuguucaccucccaugcuucacgagauggccuggaaugcccccaaccaccgcccuucagagccagcacacacagcuaagagucgccaaugcccuaacaagucuguugugagaacuuaaugaacucagaccuauaaagcacuuggcauucuguaggacucggaagguaacagcuagugguauuauuacuguaacuauacucuguaccuaguccuuugcacguacaugacuaucauuuaguacuucaucuuccccuauugagacugaaguuuauaaggcugagucaucuguucagagcugcacacucacaaguggcugcaauuugagccuggacaguuugaggccagaucucaugcucucaguugccauuaaaaaguugaaugcaagauggggagauggcucaguagguaaagcugcuugcuugcugccuaaguucaauccucaagagccacauaguagagaaucaacucaguuguccucuuaucuccacaagcaaguaugcaugugcuuacauacauaagcacacauguauauauauguacauguauauagaagguugaaggcagggcuggggauauaguucacuugauaucagagggcuugucuagcuuauggaagcacuggguuuaauauccagcucuacaaggcagaaaagagcuuaacuuaaagcaauucucaagggcucagugguuaagaauacuaucugcucuuucagagguccugaguucaauucccagcaaccacaugaugaugccaucuucuggcuuguggguauacaugcagaguguguguuuauguguacauacauacacacguacauauuacauaaauaaaucuuuuuaaaaaguuuucaaggaacauuacucuuauaaucagacauuacucuuauagaaauaaaauaaauuaaccaacaauaaauaaaaccuaaauaaaaaguuguauauaccuaaaaggacucucugcagcagagcugucccuucucucaguacagaccuacuuugcguaggcagaaaugcaaugccccuuuccgguccucccccacccuggcccugcugccaguucagcccacaugccugcccuuuggcugcccgcaagccugcccagcuaugagcacccccagagucuugucucuuuggcugccacuguuugcaaucuucacgcacaagcacaagugggcuuucugaaacagcaaggucaccaugugacacaacugcugacaccuuugggggcuucagcagccucagccucaguucugauuccucaaacccagcucuaccaaggcacacaccgcucucuaggcugcaacagcgucuguggugggcaaccgacaagcccacuccuccuccucagcccugcccugccagcacggagcgaggcuggggcuucucaccuggggcuugauguucacuuucuccaccgcguucucauugagccacuucacaucaaucuccacaucgaaguguccaauguuacagacaauggcgucauccuucaucugcucaaagugccugugagggagcccagaccgugagaccagagaccaagagcagucccaagccguguccucuuugcucccuaggccucccgccuggcaccuaccggccaaggaugauauccacacagccugugguggugacaaagauguugcccuccuuacaggcuucguccauagugguuaccucauagccugcaggcguuaagcauguguuaucaaacauggccucccucuccucaagccccacagccacccugacccuaucauacccuccauggcagcuugcagugcauugauggggucgaucucggugaugaugacucgggccccaaaaccccucagggccugggcacagcccuugcccacaucaccauagccugccaccaccgccaccuugcccgcaaucaucacaucuguggcccguuugaugccaucuaugagggacucccggcagccauagagguugucaaacuugcucugaaaggagagggagcaaggggacaacgggggcaggcaaugccuugaaaccaggcgucccagacugcgcugagaccaccugccugcuugggcugacucccuaagaauuuccacuagaaaacgccccaacacgucccucauccucaucagcucccagacuaucucagacuuuaucucugcugguccagaagccguucuagagagucaaugccuaggacagguugcugggucaaagacucuguuuaacguuauagcuccugauaaucaaagccaugauaccugaagcagcugugaccuacuggguaguucucccuucaaggcgcuuaccacccucagacuaaguaagagcuucaugucccaagccauacccugcguggacaccuuucuucagagauucacuccuaagcucacugagcaccaacagccagagaggacacuaccccagggcucaccuuggugacagaaucguugacauugauggcaggcaccuucaguaucccauuggacaucaucuuguagagguuguggaccccagucguggucuccucagagauaccucggaugccugaaugagagaaagagcgucauagaacacauuucuaccaaaagcccucuugacuccuugcugucccccccucccuuguugccaucucuguaccugacuguaagguucacccagucacccagggaggugucaucugaugcacucuauccacaguccuaccaggcuaaugacucaaccuccccacaccuccucaccaauguccuagugccugacaucauuuucacccagauguccuaucagauccuacaauauucucaagagaaggcuuccuucauuuacuagucagucaugccaagguuuuauagggucaaucuuuuccuaccccauggccuuugucucuccauccucuccucccugucacacagucaacaacucuguuucucugcagccauuccuagcugcccuacauugacuguggcuuaugaacucagccagcccugcccccacccucaguuagccuggcuucacaucacaaguuagaaggccauugccugcaggaaccuccugucugccaguccuauggaucugggaguucagccaggcccacugccucaugucuaugaaggagcaagauaccuucaggcuaccagugcccaccccaccugcgcaccugacagaagcuguggguauuugguguggaugagguuaguaaggucaccaccaucauccagaaucauguugagggguccguccuugaagugcagcgucugcucaaugcaccacagguacuccucaucugucucgcccuuccaggcaaacacugcaggggaagcggcacaugagaagcaggcagggaggcgcuagagaacucuaccaacaaagccaauaccaucuccuuccuagcucccaucccuagguauguccagccccuguacccacacaauggugggaacugcgcagcuugaagcuagagagaucuaagcucaaacccuggcuggcucugaacuuuccggcuagaccuugaaaaauucacuuuaccaguuuccucuucuauaaauggggcuugcaauagcauaagucaagugagacagaggucucauacaacgcuagauguaggugucuagaaauaauuauuuccuuuuguaucuccuccugccuggguucaauggaguaagauacuggcucacacagaacaggacuucaccaaaagggacauuguaaucacuggguuccaucaggcaggacccuggacuugcuccucacugaaaggucugaagggccuggcagucucugugauggguaguuucaggugauggcuagccacagugccccagcagaagcgacuauaggugaagcaucugcugugccagguucuguaacccauccccauguucccuugugcaaaccccaaggaggcgcugccaucaccacucacagaaaccucccagagggucuaggaugugcaugacucugcccagcacucuaaagcagcaccugaaacaggguacuggcaggugggugcgccucacagcgagugccacuacacagcugugcggaucccaggcaucaccuguuugcacaggacaccagcccaucagccagcugccucccuccccacacugaagaagauaaugcuguagaaagugaagccuguucugaccgagggcugccaagccuagccaaggugggagagcugcugacaggccauucagcccuaugaggcuauagagcaccuucccucugcccucuaccuauagcucaucaggauucccaccaccaucaccaaaucuuuaaguguuuugucugcaagcaugucaugucuuugacugguugccugaggaagccagaagaggauauuaggucuccuaggucuggaguuacagauaguugugagcugcuacaugggugcaaggaaucaaacccagauccucuggacuaacagccaguauucuuaacugcugaaagaucucuccagcccccuaaugaagauuuuuguauuuuguuuaaucaccacugaaucuagcaagucccugcuugcaggccagaaagacacgcauauucugcagcaguuugagacaaagacuuuguucuugagccugccuuucucauaccccagacuacuggaccagccagggcaccucugagacucucguucugccuuacaccuaggcaguucuuuacgacccauaggguuccucuaagaacccucuaccucuacaccauguggcucccaaucauaagauacuucccuuggacacgacacagcucggugggucaguaucuuccaugggauugagacgagguagaagggcaaagcugcucuuggcagugagauccucuaggcuaagauccucucucuaccauauggaggcuuauuacuacaggauucaguagaagaaacacaaaaaaagcagagagccuuauccacucccgcauaccccagugaccccacucaccuggaaugccagccuuggcaauggcagccgcugcaugguccugaguagagaagauguugcagcuggaccaccgcaccuagaagggccggggaaaacaaggcuaggaagcacugauguuagggaccgggaaaggaaagcccuaaagccaacaguggggacucugugcaagugaguggcuacgaaacagcaccagagcuuuagaaaacaaaacaaaacaaaaaacaauaaaucacugacccaggcauagugguaugccuauaauccgaggacucaggaugcaguaucaagaagauuagaguucaagaccagcuugagcuauauggggaguuccuugccagccugaguuauacagugagauucugacucaacgcacacacacacacacacaccacuggacagauggcucagcaguuaagagcacuugcugcucuucuagaggacccagacuugauuccuaguaccuacaaugaagcuuacaaauaccuaaaacuccaaacuccaacuccuggggaucagaugcccucucuggacucugugggaaccaggcacuuaugugauacucuacugcgaugugaacaaggagagaggugauguggcaaagacuucaggacaaggaggacaggaaaccaagugugucuggacugugcacuugaucgccaaguggcuuauccaauacuuggacaucuaagaccgggggcucaggucaggcuuguacacguggcaaggcgucaccaccacacaggcaguauuuaaagcuaugagaucaggucaccagcaagcugaauguuaaaaauaaaaacacagcaaugguagcuggagagagucagugaagaguacucugcaggacccagaagagcuuauccaggauccagguucaguugccacccccgacgugguggcucacacuucaagccugcucaggcacuggaagcaaguguuacacaaauguacaugugggcgaaacaucuagacacauaaaacaagaacaaaucuaaagaaggucaguggggacggguaagagcauccaagccucuguacuuggaggcugaggcaggaagacagcuuacgccuaaccugaacucuagaggacacagugggacgcuguucccaaauacaagcccucaagaacucuuauuuuggcuguccuacucuagcagggccccuucuccuuaagaucuuauauacauaauacaggcucaaccaaucaaagcacucuaccuuucuagcagcacgacuguccagaaagcacuuggcccaaggaaggccaaugggaguguuuugggaugacuaaacggaguauuggggugggggucuucuaccagcacucucaggcaggagacgaaagacuauuugcccccaagagcagcagcaauagggaauggagagaaaaccaaggugaccagaaaaggcucugcaagcuaggucuccuaccaguacagucuucacucauggcugaggucagagaggggaagcaacuugaaggagucagagagcgugggccucaccucagcacccagggccacgagagucucaaugagaacagcagucuccacggucaugugcaggcagccagcaaugcgagcacccuucaguggcuuggaggcugaguacaucucccgcaugcgcaucaauccuggcaucucauucucagcuauauccagagccuuccguccccaggcggccaguccgauguccgcugcgggaacagaauggguaaguuacaugagcaaccuguucccauuaaccaugaagugccuucaccuuauaaggaccaauacaaguguaacccuacagccuucaggcugggcgaacugucacucacaacaaagagaagugcuccuuggaaaaucagcucuagaacuauggaucucacaaugucaccugucaaugugggacuggaugcucgcuugagagggggugguagggaggagaagaaggagagaggauggaggaagcugcaauggaccagaaccaaaugucugggagaaacugcaaguaaguuuauagggguccuauagcuggggaguaagaacaguaccagaucugaccagucugggcauaugguuuguaauuaauauauuuaaacuauguaucuguuauaggggcuuauuagggcuggaaguuccagcaacaaaccucuaggucacauucccagaaaagucaaauccagcagguguauuauuuuauaaaaggacaacagccucucuuuacguaugagcauguauauagaggcuaaaggucacugugaagugccuuucucagcuucucuugucuugcuuuuugagacaggaucucccucuguaccugaagcucacuguuuuggcuagguagacccuccugccucugccucauuagcacugagauuauaagugcuugcuuaugggugcugaggcucuaaacacggguucucacgcuuaugaagacaggcaaacuuaccaacugagccaccccuccaaggccaugauuuuuaucuuuagaggaaccuuaggucuucccaaucacccuaagaaacggagggugaaacagagaggaggcugcuauaguuuaauaauuuaacaaauacacaggccaagagugguagaacaugccuguaauuccaguacuugggagauggaggcaaggggaagagaauccuugacuucacagcaaguucaaggccaaccugggcuacaugaggcccugucucaaaauaauaauaauaauaauaauaauacaauagcaacaauaauacauuauucuguuuccuaaauugcauuaaauaaucucaaaggagcagugcuaggguauguccaagguccuaaguugaaccuccagcacuacaaacaguucccaaggucaacacuccaccccuacggaaggguucacucgaguuacacaaacacagcuccuucaacacacacacacacacacacacacacacacacacacacacacacacacacaccacuuccccaggacaucaacaaugacagcuccuucagaaaucugaacuucaaauaaccaccucuggccaugucccuucucccuauagauucccaacuccaaaccguugaauuuagucaauuucuaguguuccuuaucauucccccuucacgaucuccacuguccaucugaggcucucuaagacugagaccuggcuaggcaaagcucccacuuaaagcuagggugaguggcuucaugcccguaaccccagcacuagggaagcugaguuacaaagccugccaugauuuugaggucauucuaagcuucacagagaccuagucucaaaaacaaccaaccacaaaaccccacaaaguucccaccuaguuagagccagcccuccacuguaccuaagccacugaaccagguaggagaccgacagccacaggaagacaccuugcuuacuacgaauggggacccugagguaaacuggugcaucccagcaauccuacauuuucccaguagguuugcuucccuucuccucucccuaaacaucuuuccccauccauguucccuugauaacaugacgucacaaaucacuaaggguucagaaucauucacuucccauucacaaacuccaucuguggcuaacuagacauucuugucuguugcaaaagaugagcugucccugguuccccaccaugucucaccccuucagaucuuaccauugcauugaucaccuagguacccaggagcaggggccccacuaaggacucccucacuucugaaauguuuuccuuccuuggcauccgauucucucuugugcuuucccuccuaccuuccuggcugcuccucaucuggcaaacucuaggaacccucagggauccauaguagcucuuauccaaugcucggcauuuagccaaauggcugugaauaccuucccugugcagaugacgcccacguauuuaccgccagugcaaacuucucccaggaauuugagacucacaauccaacggcugacucagcaccucuagacuuauguccaauuauuaccaucaaguacgagcccuccagacuccuuggccuaacacccucaaucuucccauuuuaggaaaugaaaccaccauucaaccaaccacuccgaccaaaaccuuguaaaauuucucguucccauuuuuugccucugucccauuuuucuuuuugcuggguucuuuuauuuuugagacagggccuaucauauagcuucgguuguccugaaacucacuauguagaccaagcuagcugcaaacucaaaagauaacugccucccacugccuccugaggacugagguuaaaguugugggucaucauacccccaccuccaucagcaagguuuugacugagcaucucacgcucgucuaaagcacuaguucucaacugggccaacaaagcagcuucaugguccccuuuguucucacauagcaaguucuugguuauaguccagugggaaacuuuuuaaaaguuuaaaauccuaacccuuaccugggcuucaggccccacuccugucuaccaacuguuucuaucuccacuuuauucuccucacuaucugcucagacacacggaucucucccccaucgcaggaauuuaacacagccaguuaaccuggaagguucaugccaaguaccagguccaguauaugcuccaacacaucugaaaauugaggggcuuaacagauggcuuaauggugaagaggacuggcuguuccaggguuuaauuccuagcagcucauggagacucacgaccgucuacaacuccaguuccagagacccaacacuuucuucuggccccuguccacaucacaugcacguggugcauagaccuacacgcaggcaaaacacccagacacauauaacaaaaugagaaggaaaaaaaaaaaaccuaaaaaucgguggacugacucaaacagggguuuuaaaauaaaucaggacuuuacugucagugagguaggucaccuacagagguucaaaggugguguuauuugaugaccagauuucucuuuagaaaagauucuacuggccaacuguagcaacaugugccuauaaacagugcuguggaggcuaaaggaagauggaauucaagaccagcugaggcucaaaaagcaggaaaacaaaaugggagcaaggagaucacagaccugugaggagagaugagacuggggacugguagccauggagagaaaaguggcagaucuccucacauaaaacuaacacuauaccauacgggccuaucugucucagccgugugccugggucucaauaccuccagugaccagcaggcccuggcacagaggagucagaaaaugucuaccggccauaccagcugcaaaaaaaauaaauaagcaaaaauucaugaagagaugguacaggacaaggaaaaagaaaaagaaauaaugaaugaaauagaggggaaaaaggaaggagggggcuggaaagauggcuuggugguuaagagcucucuggcugcucuucuagagggccugaguucaagccccugcacccacaugguaacugacuacugcccauaacgccagacggaacuguggaacccuuucuaaacccacuucuucaaaauaaggagaaucaacuugaaccugagcccaaggaucauaggaaaugccaaacgaguaaggucuagcauacagcauacccuacuugaugggcaaaucaugccuccacccuuacacaggcaagaacccagccuuaucuucauccauacaaucuguggucccccccucccaaucuucauccauacaaucuguggucccccccccucccaaucccucccuacacaguaugucgagccuccauucuagcucuuccgccaagacaacacugacuuaaaccucucugggcuucagucuuagcaucuacccaguggagacaauaaacugcccugcuggcugauuaacuaucuuaauaagaauuugcaaagccacuucccuagguuccuguguaaugggauagcauucaucucccuuugaggacccuuuccaauuuaauagaguauugaaauuauuuuaaaagcuaaccagccugaauugcuuuguuuuucuguuuguuugguuuguaguuuuguuuugauagggucuccccaucuuguccagguuggucuggaauucacuguaugcccaggcugaccucugaaaugagcugaucgauuccuuggccucaguagugauagcagggcugggauuacaagcuugugucacuaggcacaguuugaauuggauuguguugaaauuccauuaggguuguuucaaguguauugccuuguauacagacagcaguggaagagaugagcuuagaggucaugauguccugaguccaaauucuaaccagcugcuuuccaguuacaagauucugggaaaaugcccuuuauaccucuggauauucauuguaaacauaaaaccguuccuuccauggagagcuacaauaauaagacggguuagucuagaauaaugcuauaaggcagugcccaucccacuguaaacgcucaaguuaagguguguuuacucagacagcuuucuauaaucgggacaaaacgaacaguaauuucuaaccacuccaaauuuucuagacauccacuagauaucccagagauugagcagaugggacccuaaguucccguugcaccgagacuagccguuuccaggccucuccucauuagcaccuagaacacugaugcucucuccggcccugcucaaggcccagaagacggugggcccuugcuaggggccacccaagccgccaaacgccagggccagggucugggccucuagggccgcuucccaauggccagucucuccgacaggagcacgcugcccgaccaaagaucacagcccgcgcugccgcucugggcgccuaccgcggggcacgccgggacuuguaguccgcggccguuucccacuccuggcucucggcggcguguggacuccaauccccgggcaccugcgcggccaggccagcgauucuaggggucccggggcgccccgaagccgccaccuaaacaagacgcaggucgguacugacaacaaacccaggacgggagccgagucgccacggaggacugaacccuugggacucaccgacuuuguagggcaguuuaucagacaugcuggcggcgcuuccgcuaggacugaugaacucagugaagggggccgggcggcgcggggcagggaucuacgccuggcgccggcgucuuuaaauaucuucuuauuug

SEQ ID NO: 1196 - RNA, 15194 nt, Mus musculus
caaauaagaagauauuuaaagacgccggcgccaggcguagaucccugccccgcgccgcccggcccccuucacugaguucaucaguccuagcggaagcgccgccagcaugucugauaaacugcccuacaaagucggugagucccaaggguucaguccuccguggcgacucggcucccguccuggguuuguugucaguaccgaccugcgucuuguuuagguggcggcuucggggcgccccgggaccccuagaaucgcuggccuggccgcgcaggugcccggggauuggaguccacacgccgccgagagccaggagugggaaacggccgcggacuacaagucccggcgugccccgcgguaggcgcccagagcggcagcgcgggcugugaucuuuggucgggcagcgugcuccugucggagagacuggccauugggaagcggcccuagaggcccagacccuggcccuggcguuuggcggcuuggguggccccuagcaagggcccaccgucuucugggccuugagcagggccggagagagcaucaguguucuaggugcuaaugaggagaggccuggaaacggcuagucucggugcaacgggaacuuagggucccaucugcucaaucucugggauaucuaguggaugucuagaaaauuuggagugguuagaaauuacuguucguuuugucccgauuauagaaagcugucugaguaaacacaccuuaacuugagcguuuacagugggaugggcacugccuuauagcauuauucuagacuaacccgucuuauuauuguagcucuccauggaaggaacgguuuuauguuuacaaugaauauccagagguauaaagggcauuuucccagaaucuuguaacuggaaagcagcugguuagaauuuggacucaggacaucaugaccucuaagcucaucucuuccacugcugucuguauacaaggcaauacacuugaaacaacccuaauggaauuucaacacaauccaauucaaacugugccuagugacacaagcuuguaaucccagcccugcuaucacuacugaggccaaggaaucgaucagcucauuucagaggucagccugggcauacagugaauuccagaccaaccuggacaagauggggagacccuaucaaaacaaaacuacaaaccaaacaaacagaaaaacaaagcaauucaggcugguuagcuuuuaaaauaauuucaauacucuauuaaauuggaaaggguccucaaagggagaugaaugcuaucccauuacacaggaaccuagggaaguggcuuugcaaauucuuauuaagauaguuaaucagccagcagggcaguuuauugucuccacuggguagaugcuaagacugaagcccagagagguuuaagucaguguugucuuggcggaagagcuagaauggaggcucgacauacuguguagggagggauugggagggggggggaccacagauuguauggaugaagauugggagggggggaccacagauuguauggaugaagauaaggcuggguucuugccuguguaaggguggaggcaugauuugcccaucaaguaggguaugcuguaugcuagaccuuacucguuuggcauuuccuaugauccuugggcucagguucaaguugauucuccuuauuuugaagaaguggguuuagaaaggguuccacaguuccgucuggcguuaugggcaguagucaguuaccaugugggugcaggggcuugaacucaggcccucuagaagagcagccagagagcucuuaaccaccaagccaucuuuccagcccccuccuuccuuuuuccccucuauuucauucauuauuucuuuuucuuuuuccuuguccuguaccaucucuucaugaauuuuugcuuauuuauuuuuuuugcagcugguauggccgguagacauuuucugacuccucugugccagggccugcuggucacuggagguauugagacccaggcacacggcugagacagauaggcccguaugguauaguguuaguuuuaugugaggagaucugccacuuuucucuccauggcuaccaguccccagucucaucucuccucacaggucugugaucuccuugcucccauuuuguuuuccugcuuuuugagccucagcuggucuugaauuccaucuuccuuuagccuccacagcacuguuuauaggcacauguugcuacaguuggccaguagaaucuuuucuaaagagaaaucuggucaucaaauaacaccaccuuugaaccucuguaggugaccuaccucacugacaguaaaguccugauuuauuuuaaaaccccuguuugagucaguccaccgauuuuuagguuuuuuuuuuuuccuucucauuuuguuauaugugucuggguguuuugccugcguguaggucuaugcaccacgugcaugugauguggacaggggccagaagaaaguguugggucucuggaacuggaguuguagacggucgugagucuccaugagcugcuaggaauuaaacccuggaacagccaguccucuucaccauuaagccaucuguuaagccccucaauuuucagauguguuggagcauauacuggaccugguacuuggcaugaaccuuccagguuaacuggcuguguuaaauuccugcgaugggggagagauccgugugucugagcagauagugaggagaauaaaguggagauagaaacaguugguagacaggaguggggccugaagcccagguaaggguuaggauuuuaaacuuuuaaaaaguuucccacuggacuauaaccaagaacuugcuaugugagaacaaaggggaccaugaagcugcuuuguuggcccaguugagaacuagugcuuuagacgagcgugagaugcucagucaaaaccuugcugauggagguggggguaugaugacccacaacuuuaaccucaguccucaggaggcagugggaggcaguuaucuuuugaguuugcagcuagcuuggucuacauagugaguuucaggacaaccgaagcuauaugauaggcccugucucaaaaauaaaagaacccagcaaaaagaaaaaugggacagaggcaaaaaaugggaacgagaaauuuuacaagguuuuggucggagugguugguugaauggugguuucauuuccuaaaaugggaagauugaggguguuaggccaaggagucuggagggcucguacuugaugguaauaauuggacauaagucuagaggugcugagucagccguuggauugugagucucaaauuccugggagaaguuugcacuggcgguaaauacgugggcgucaucugcacagggaagguauucacagccauuuggcuaaaugccgagcauuggauaagagcuacuauggaucccugaggguuccuagaguuugccagaugaggagcagccaggaagguaggagggaaagcacaagagagaaucggaugccaaggaaggaaaacauuucagaagugagggaguccuuaguggggccccugcuccuggguaccuaggugaucaaugcaaugguaagaucugaaggggugagacaugguggggaaccagggacagcucaucuuuugcaacagacaagaaugucuaguuagccacagauggaguuugugaaugggaagugaaugauucugaacccuuagugauuugugacgucauguuaucaagggaacauggauggggaaagauguuuagggagaggagaagggaagcaaaccuacugggaaaauguaggauugcugggaugcaccaguuuaccucaggguccccauucguaguaagcaaggugucuuccuguggcugucggucuccuaccugguucaguggcuuagguacaguggagggcuggcucuaacuaggugggaacuuugugggguuuugugguugguuguuuuugagacuaggucucugugaagcuuagaaugaccucaaaaucauggcaggcuuuguaacucagcuucccuagugcugggguuacgggcaugaagccacucacccuagcuuuaagugggagcuuugccuagccaggucucagucuuagagagccucagauggacaguggagaucgugaagggggaaugauaaggaacacuagaaauugacuaaauucaacgguuuggaguugggaaucuauagggagaagggacauggccagaggugguuauuugaaguucagauuucugaaggagcugucauuguugauguccuggggaagugguguguguguguguguguguguguguguguguguguguguguguguguguguugaaggagcuguguuuguguaacucgagugaacccuuccguagggguggaguguugaccuugggaacuguuuguagugcuggagguucaacuuaggaccuuggacauacccuagcacugcuccuuugagauuauuuaaugcaauuuaggaaacagaauaauguauuauuguugcuauuguauuauuauuauuauuauuauuauuuugagacagggccucauguagcccagguuggccuugaacuugcugugaagucaaggauucucuuccccuugccuccaucucccaaguacuggaauuacaggcauguucuaccacucuuggccuguguauuuguuaaauuauuaaacuauagcagccuccucucuguuucacccuccguuucuuagggugauugggaagaccuaagguuccucuaaagauaaaaaucauggccuuggagggguggcucaguugguaaguuugccugucuucauaagcgugagaacccguguuuagagccucagcacccauaagcaagcacuuauaaucucagugcuaaugaggcagaggcaggagggucuaccuagccaaaacagugagcuucagguacagagggagauccugucucaaaaagcaagacaagagaagcugagaaaggcacuucacagugaccuuuagccucuauauacaugcucauacguaaagagaggcuguuguccuuuuauaaaauaauacaccugcuggauuugacuuuucugggaaugugaccuagagguuuguugcuggaacuuccagcccuaauaagccccuauaacagauacauaguuuaaauauauuaauuacaaaccauaugcccagacuggucagaucugguacuguucuuacuccccagcuauaggaccccuauaaacuuacuugcaguuucucccagacauuugguucugguccauugcagcuuccuccauccucucuccuucuucuccucccuaccacccccucucaagcgagcauccagucccacauugacaggugacauugugagauccauaguucuagagcugauuuuccaaggagcacuucucuuuguugugagugacaguucgcccagccugaaggcuguaggguuacacuuguauugguccuuauaaggugaaggcacuucaugguuaaugggaacagguugcucauguaacuuacccauucuguucccgcagcggacaucggacuggccgccuggggacggaaggcucuggauauagcugagaaugagaugccaggauugaugcgcaugcgggagauguacucagccuccaagccacugaagggugcucgcauugcuggcugccugcacaugaccguggagacugcuguucucauugagacucucguggcccugggugcugaggugaggcccacgcucucugacuccuucaaguugcuuccccucucugaccucagccaugagugaagacuguacugguaggagaccuagcuugcagagccuuuucuggucaccuugguuuucucuccauucccuauugcugcugcucuugggggcaaauagucuuucgucuccugccugagagugcugguagaagacccccaccccaauacuccguuuagucaucccaaaacacucccauuggccuuccuugggccaagugcuuucuggacagucgugcugcuagaaagguagagugcuuugauugguugagccuguauuauguauauaagaucuuaaggagaaggggcccugcuagaguaggacagccaaaauaagaguucuugagggcuuguauuugggaacagcgucccacuguguccucuagaguucagguuaggcguaagcugucuuccugccucagccuccaaguacagaggcuuggaugcucuuacccguccccacugaccuucuuuagauuuguucuuguuuuaugugucuagauguuucgcccacauguacauuuguguaacacuugcuuccagugccugagcaggcuugaagugugagccaccacgucggggguggcaacugaaccuggauccuggauaagcucuucuggguccugcagaguacucuucacugacucucuccagcuaccauugcuguguuuuuauuuuuaacauucagcuugcuggugaccugaucucauagcuuuaaauacugccugugugguggugacgccuugccacguguacaagccugaccugagcccccggucuuagauguccaaguauuggauaagccacuuggcgaucaagugcacaguccagacacacuugguuuccuguccuccuuguccugaagucuuugccacaucaccucucuccuuguucacaucgcaguagaguaucacauaagugccugguucccacagaguccagagagggcaucugauccccaggaguuggaguuuggaguuuuagguauuuguaagcuucauuguagguacuaggaaucaagucuggguccucuagaagagcagcaagugcucuuaacugcugagccaucuguccaguggugugugugugugugugugcguugagucagaaucucacuguauaacucaggcuggcaaggaacuccccauauagcucaagcuggucuugaacucuaaucuucuugauacugcauccugaguccucggauuauaggcauaccacuaugccugggucagugauuuauuguuuuuuguuuuguuuuguuuucuaaagcucuggugcuguuucguagccacucacuugcacagaguccccacuguuggcuuuagggcuuuccuuucccggucccuaacaucagugcuuccuagccuuguuuuccccggcccuucuaggugcggugguccagcugcaacaucuucucuacucaggaccaugcagcggcugccauugccaaggcuggcauuccaggugaguggggucacugggguaugcgggaguggauaaggcucucugcuuuuuuuguguuucuucuacugaauccuguaguaauaagccuccauaugguagagagaggaucuuagccuagaggaucucacugccaagagcagcuuugcccuucuaccucgucucaaucccauggaagauacugacccaccgagcugugucguguccaagggaaguaucuuaugauugggagccacaugguguagagguagaggguucuuagaggaacccuaugggucguaaagaacugccuagguguaaggcagaacgagagucucagaggugcccuggcugguccaguagucugggguaugagaaaggcaggcucaagaacaaagucuuugucucaaacugcugcagaauaugcgugucuuucuggccugcaagcagggacuugcuagauucaguggugauuaaacaaaauacaaaaaucuucauuagggggcuggagagaucuuucagcaguuaagaauacuggcuguuaguccagaggaucuggguuugauuccuugcacccauguagcagcucacaacuaucuguaacuccagaccuaggagaccuaauauccucuucuggcuuccucaggcaaccagucaaagacaugacaugcuugcagacaaaacacuuaaagauuuggugaugguggugggaauccugaugagcuauagguagagggcagagggaaggugcucuauagccucauagggcugaauggccugucagcagcucucccaccuuggcuaggcuuggcagcccucggucagaacaggcuucacuuucuacagcauuaucuucuucaguguggggagggaggcagcuggcugaugggcugguguccugugcaaacaggugaugccugggauccgcacagcuguguaguggcacucgcugugaggcgcacccaccugccaguacccuguuucaggugcugcuuuagagugcugggcagagucaugcacauccuagacccucugggagguuucugugaguggugauggcagcgccuccuugggguuugcacaagggaacauggggauggguuacagaaccuggcacagcagaugcuucaccuauagucgcuucugcuggggcacuguggcuagccaucaccugaaacuacccaucacagagacugccaggcccuucagaccuuucagugaggagcaaguccaggguccugccugauggaacccagugauuacaaugucccuuuuggugaaguccuguucugugugagccaguaucuuacuccauugaacccaggcaggaggagauacaaaaggaaauaauuauuucuagacaccuacaucuagcguuguaugagaccucugucucacuugacuuaugcuauugcaagccccauuuauagaagaggaaacugguaaagugaauuuuucaaggucuagccggaaaguucagagccagccaggguuugagcuuagaucucucuagcuucaagcugcgcaguucccaccauuguguggguacaggggcuggacauaccuagggaugggagcuaggaaggagaugguauuggcuuuguugguagaguucucuagcgccucccugccugcuucucaugugccgcuuccccugcaguguuugccuggaagggcgagacagaugaggaguaccuguggugcauugagcagacgcugcacuucaaggacggaccccucaacaugauucuggaugaugguggugaccuuacuaaccucauccacaccaaauacccacagcuucugucaggugcgcagguggggugggcacugguagccugaagguaucuugcuccuucauagacaugaggcagugggccuggcugaacucccagauccauaggacuggcagacaggagguuccugcaggcaauggccuucuaacuugugaugugaagccaggcuaacugagggugggggcagggcuggcugaguucauaagccacagucaauguagggcagcuaggaauggcugcagagaaacagaguuguugacugugugacagggaggagaggauggagagacaaaggccaugggguaggaaaagauugacccuauaaaaccuuggcaugacugacuaguaaaugaaggaagccuucucuugagaauauuguaggaucugauaggacaucugggugaaaaugaugucaggcacuaggacauuggugaggagguguggggagguugagucauuagccugguaggacuguggauagagugcaucagaugacaccucccugggugacugggugaaccuuacagucagguacagagauggcaacaagggagggggggacagcaaggagucaagagggcuuuugguagaaauguguucuaugacgcucuuucucucauucaggcauccgagguaucucugaggagaccacgacugggguccacaaccucuacaagaugauguccaaugggauacugaaggugccugccaucaaugucaacgauucugucaccaaggugagcccugggguaguguccucucuggcuguuggugcucagugagcuuaggagugaaucucugaagaaagguguccacgcaggguauggcuugggacaugaagcucuuacuuagucugagggugguaagcgccuugaagggagaacuacccaguaggucacagcugcuucagguaucauggcuuugauuaucaggagcuauaacguuaaacagagucuuugacccagcaaccuguccuaggcauugacucucuagaacggcuucuggaccagcagagauaaagucugagauagucugggagcugaugaggaugagggacguguuggggcguuuucuaguggaaauucuuagggagucagcccaagcaggcagguggucucagcgcagucugggacgccugguuucaaggcauugccugcccccguuguccccuugcucccucuccuuucagagcaaguuugacaaccucuauggcugccgggagucccucauagauggcaucaaacgggccacagaugugaugauugcgggcaagguggcggugguggcaggcuauggugaugugggcaagggcugugcccaggcccugagggguuuuggggcccgagucaucaucaccgagaucgaccccaucaaugcacugcaagcugccauggaggguaugauagggucaggguggcuguggggcuugaggagagggaggccauguuugauaacacaugcuuaacgccugcaggcuaugagguaaccacuauggacgaagccuguaaggagggcaacaucuuugucaccaccacaggcuguguggauaucauccuuggccgguaggugccaggcgggaggccuagggagcaaagaggacacggcuugggacugcucuuggucucuggucucacggucugggcucccucacaggcacuuugagcagaugaaggaugacgccauugucuguaacauuggacacuucgauguggagauugaugugaaguggcucaaugagaacgcgguggagaaagugaacaucaagccccaggugagaagccccagccucgcuccgugcuggcagggcagggcugaggaggaggagugggcuugucgguugcccaccacagacgcuguugcagccuagagagcggugugugccuugguagagcuggguuugaggaaucagaacugaggcugaggcugcugaagcccccaaaggugucagcaguugugucacauggugaccuugcuguuucagaaagcccacuugugcuugugcgugaagauugcaaacaguggcagccaaagagacaagacucugggggugcucauagcugggcaggcuugcgggcagccaaagggcaggcaugugggcugaacuggcagcagggccagggugggggaggaccggaaaggggcauugcauuucugccuacgcaaaguaggucuguacugagagaagggacagcucugcugcagagaguccuuuuagguauauacaacuuuuuauuuagguuuuauuuauuguugguuaauuuauuuuauuucuauaagaguaaugucugauuauaagaguaauguuccuugaaaacuuuuuaaaaagauuuauuuauguaauauguacguguguauguauguacacauaaacacacacucugcauguauacccacaagccagaagauggcaucaucaugugguugcugggaauugaacucaggaccucugaaagagcagauaguauucuuaaccacugagcccuugagaauugcuuuaaguuaagcucuuuucugccuuguagagcuggauauuaaacccagugcuuccauaagcuagacaagcccucugauaucaagugaacuauauccccagcccugccuucaaccuucuauauacauguacauauauauacaugugugcuuauguauguaagcacaugcauacuugcuuguggagauaagaggacaacugaguugauucucuacuauguggcucuugaggauugaacuuaggcagcaagcaagcagcuuuaccuacugagccaucuccccaucuugcauucaacuuuuuaauggcaacugagagcaugagaucuggccucaaacuguccaggcucaaauugcagccacuugugagugugcagcucugaacagaugacucagccuuauaaacuucagucucaauaggggaagaugaaguacuaaaugauagucauguacgugcaaaggacuagguacagaguauaguuacaguaauaauaccacuagcuguuaccuuccgaguccuacagaaugccaagugcuuuauaggucugaguucauuaaguucucacaacagacuuguuagggcauuggcgacucuuagcugugugugcuggcucugaagggcggugguugggggcauuccaggccaucucgugaagcaugggaggugaacaaaggcacgggcagugcccaccaccuuaccguugcccugggcccuugcagguggaccgcuacuggcuaaagaaugggcgccgcaucaucuugcuggcugaaggccgucuggucaaccuggguugugccaugggacaccccagcuucgugaugagcaacuccuucacaaaccaggugauggcacagauugagcuguggacccacccagauaaauacccuguugggguucacuuccugccuaagaagguaagcucuuagcuuuacuguaagccaagacuuaugggcuggcuccugggcucccugugcaggcuugcuagaguuuauaaagauaugucugucugccuucuuaguugucauccagaguccuuggugcucccuggagcacacacaguggaauuggcuguggagugugacucaccagguuuggagcugugucuccguuccucaucuguaaagugaaggcaagaguucucuccuuagugauggcgagccucucccauguuuacacggauuggcaggaaguugguaaagcaggcugagugggaacugaaaaguuggagaauauacaugccaggcagaggggucucugccacucagcugucaccagccuagcacacagcuccaguggacagggcuucugagcucucucaagagaagucaugugcugaggucuugauaugaaauaauuuaaaaauauaugcaacacauuguaguuaaaaaaaaugaauaggccccauuugguuuauucgucuguuugguguuuagacaggaucucauuauagcccugacuagccuggaacuuggcuggccuugacucaggucugucugcuucugccuccuggaaacugggauuaaaggcacaagccucuaugucagucuuggguugguuguuguucauuuuuguggugcuggacauggagcccagguccuuaaacugcuacacaaauaucccuuagcugcaucccuaguacuuagccgggacaacgggccacguuucugcagguuuauuagguaccuuauuuaaugaugacaguaaccaccacuuacuaaauuacccccuugaaccagcagucugaaugucacugaucuuuagggcagguucaaaagguggguauuuguuaugugugcccuacaaaugaggaaaucaagguuuagaggcugugugcucuucugaguuuuuggaaacccagcucuaacugcccaggaggucaccacuucuguagcacaccggugccggugcugugagagagaaggcgggcaucccaaggagacugcccaggcagaggaagccuccguuccauuucugauguggacuccagccuaggcccaccuugcaucuaguugaacccaauaucaguuucuuuaggcucuuccucuguuaauagagggauuauccuuccucuuucuuggggaugucugcgcagcucugaggaacaguggacauacaaaggauuuggaacguaaaagcacucucuccgucugggcugggcuguagucauuguccugccauugugagguaggacuugguagagagugucccuguugauaauaaaauauguccuguucauuccaggaagcauugugguuagugcuuugguuagaggaggugaggagauguaauugguggugcccagagugaucugaugggugugcaugacucuucugauggggagcacugcagcuggccaugaggagagaacgaggguagcaaggguagugccacuugccagcucccugucagaguaguguguuggcuagaugcaggugaggguacuagagcaugauauuaacuccuggcucuucuguuucugcagcuggaugaggcgguggcugaagcccaccugggcaagcugaaugugaagcugaccaagcugacugagaagcaggcccaguaccugggcaugcccaucaacggccccuucaagccugaucacuaccgcuacugagugcuggggcuguccuucaccuuccagcugccauccuuguuccgggcccuaucucucguucccaagagcaaaugucaccaacuuugcaguagccuggacagugcuucucccacacagcccuccccuuacacccucuggggcuggucacucugucuuugaccucugcuguaucccucauacuguuccagguguggagggggaauggagagguaccugguaggcauccacaggggacaugaucucagaagucuuggaaguccugaggcuggauguugcuagugauggucacaagccaugcaccuuaucaaugagacccucacuuggucuuuagaucugugugccugguuugcagauccauugguuucucaguccaggacccaagaacgagcuccaccaaagagcaggaaccccuggaguuugaaggcccccgagagcugggccuuuuuacuguugggcagucucuuaaaccucaugauacugaguugguacuuuuuuuggucccuauuucacaaggguuaggauagauuaaccaagaaaggacaagugacagacugaaaggggcuggaaaaacaaagaggaaaaggccugucacuucuguauaguugaugguuccugucacaagcccaggucacaaacagauuaauuuguuuuauaauguuuauaugcuauuuagaauguuaacaaaggaagguggauaaaauacaguuucuacugccuaaagaauuuuggcucuauuaaaauguaaguguguggcuggaauaugugcauguauguggcugacauaugugcaugugugugcagacacuguaccugugauucuggaggacaccagaugucccaucgcuuucuuccauauuccugagacagggucccucacuggacuagagugaggccauuucugcucuucccagaucccucacccuagagcugggguuaaagucaagcauggccauguguagcuucuacaagugcaaacggucuuacccacugagccaucucuucacggaucgcauaaugugaaucacacaaaaaaguaugagaaauugaacucccucuuauuugcccaagugaucaauuuacugaacccauuugaccuggaaagcaaauaaaaacaagccccgugcacaggauggcuaaaagcugg

SEQ ID NO: 1197 - RNA, 9144 nt, Mus musculus
cuaccaaguggugagaugaaaggcagguacauguaaucucaguuucuccacauguaaaucaggacuaacaaucccugcccugucugucacucuuuccccccugaccuguuccgguagcaacguggacuaaauaagguauguaaacguucuaagccgagcugucuccaggucaauguuuauucagcuuagagcaauuucuuuccaaguccuacgcuggccagauuuccugucagccccaucaauucucuaacacucgcaggugcuccuuuguaaccgcggaaggggcaagguccgcucaagcccaccguaaaaaggagcggggaaaacaaaaaacauagaggagggagagcaggcaaguagggcaguguagagaagugggguaaaaggacaaggaggguaaaagggacuuacagauggagcgcggcgggggugggugggguggguguccugcaccuaagaugcaggagaagggaugugcggagcucuggggcaagugagggagcagggaugugugcggaaaaagcagcgaggugggauucuugaggaagaauuggggggucgcuuucagugugaggucuguggguaacugggggcagggaauucgggccgucaccuccacucagacagaggcuccgagagcagcucccgggcuacagccacccgcuggcaaaccgcggaggggcggggaaagagcauucggcgccugugauuggcugccgucccgacggccgcugacgcgagcgggcgggccccuuugugacgucacaaucagcuguugaagcguucggauuugugcccugagcccgggcgcagcggccgcagcagcuccgggcguccguucgggagccccgccgucucucggcccguccccgguaugcggcuccaguugugagcaccggcgacccggggacgcccggccgcacaacuaccucagcgcagcgguugcugcagcggccccaggugagucccgaccuccgggcugggggcuccgggcacccccaggacacgcccugcgccccccucucccguucuuugucugucuccgccggcggcagccggagcugcguucuuggcucccuauugguugcuccaagccgguaggccaugacguugcuuuauuugcauaugacauugagacgucaccaaggccagccccgccuuccaggcuugcaugggugcuuguccucuggugacccggugggcgcuaugucgugcccagccggccgaggguugaagagacgcugaaagacaagcgggauccgaagggacucggcgguuuccugggcuaaucuagggacuggggucaggccucucauuuguuuuuuccuugugaccugagagaggguaggacagcaaagcucgauuuaaguugagagggcgguaaguagauggagcuucagacuccagguccuggagacacuaccagaugguagcggauccccucugucuucaggcuccgcccccuaacauaauaacauccuucuaaucccugacaugugugcagagccugaguugaugucauuuucagccuacaaauauugagggucuuaagccccacuucacggaagaggaaacugagacucagagagacguaguuuacuggagaucucagccaauuagaaucacacucacuaagugguagauuccuuagcugaaguauaagcuacaugcuuacauacaucuacugaggacccuaucuuggguucagcaccaaccacaauuugaugggaugcuucagucuucaugauccuggacauuuucccaggaggucucugaaaauugggucucuuacaaggcccugaccuccucugccuucuuucuacuucaaaacccaauaaauggccgucucccagcuguuuugaccacagaaaggugagucacuaguugccugccuccaggugucuccagggcagauguuguugagagggaguugggaguucccucugugggccucccaucagagcugucagcugggagaaccagacccuucccuggcauuagugaugcagagcuuaugcuguuuccugaggcugcuuccagagugacagaaggaugucucuuacuuuccaaguaaguagaucuggaguccuucccagguugagggucgcucaagaauggccugggcuaggguuggcuuaggccuccagugcuauucuaggcacagccucuguaguauuaagggaaugguucuuccuggagcagagccaggaaucugagaaccaggaagccagcaggcuaggaaagaaaacccaggaggcucuccuaguggucaaaggaggggggcagucauagcuggcugguugcuaccaucucuccuggcugucacucacuucuguaugaucuccaccagggagcuucucacuugacaugucaacaguugaaaaggcucauugcagggacuggugcacagugugaacccugggaaaugcaugcaaaaguuugaugccagggaccagagaucuacagggaccagagaccagggccugugucugauuucccuguuuccuguguauuauauuuuuggauauuaccuguugagguuuuucugauuguauguauucugcauugccacaccaccacuaagcuauagcuuuauuggguagauucauguucccaauuugauaucaccaucccuaaaacaggagacuuguugucuugguccagggaaggaggcuuggguuugaaggcuuggaucuugguccaaagcuuguguuuauccucaagggaucccuggaucugacagcuuccuucuuccacugucuaucacugacauguggucucacuggacaggauucuuucucuuggcuagugaugcugaguuugaacaagagucuaggggaaaggggaguuagaguaguggggcagaccuguaggcacagguccuccucaucugaggguugcccaaucucaugguaagauuguagaacugagccgggcgugguggcacucgccuuuaaucccagcacucgggaggcagaggcaggcggauuucugaauucgaggccagccuggucuacaaagugaguuccaggacagccagggcuacacagagaaacccugucucgaaaaacccaaaaaaaaaaaaaaaaaaaaaaagauuguagaacuguagugauuacggaugcuauuagguucaaauacuaccugugucuuucacuagcugugagacuuuagguaguuaucuuauuucgcugggccuuuuaaaaaaauuaauuaauuaaauguaugugaguacacuguuguugucuucagccacaccagaagagagcauccgaucccaucacagcugguugugagccaccaugugguugcugggaauugaacucaggaccucuggaagaacagucggugcucuugacuacugaaccaucucuccagcucucugggcuuuguuuuauuuaucucucuaucagaaaaaauuuuuucucuuccucccacuccuuuucagucccuuugacaggaucuuauguagccaggaacuauuuuuuuuuuuuuuuuuuuuuuuuuuagguagggccccauguaguucagacuggccuuuaacucacuauguagccuaagcaggacuuggacucugaucccccugccucuaccuucuaagugcuaggauaauagacaggaggucuucaugucuuugaacucuuguccucuugccucuagccccuaaguccuaagauuccaggcuugcccuuucacacacugugaggauauaaggaaaaauggaccagguuucuuaguauaguguuguauguuacugacacaggaauauuaauuaugaugaugguaauaagaacaauuuuuuucccuuaauggaaaauuccuauuuacuccucaaagcccagguuggcuguuaucuuccucuagagacuuacccuggcaaagcuuggucauauauaucacuucuuccauauccccaaagcacccugucauaacaccaaguuuauuagcuuauugaauguuuacugugugcucaggcacuguucuaaacaugucauuaaguguuuccucauuuaagucuuauuacgauugucauuugacagaugagaaaacaaagacccagcaccuuucuaagugcauacaggaacacccacugaaugcagaaaagcacacacaccaagagcuucucugcuauuacugcucuggcagcuaggggcuauagccuugucuccagcuaccaacugaagggcugacuuuaguucgugcuucuacuaaugucuuucuaugcuucucagggcuuuaaacugccauagggcgcccccuugagguugcuucacccgcugaccauguuccagcgcuucaccagccuuuucuucaacaccccugcgccuccugaagacuccaacuguccgggggccuuugucucugaggaggaugaaguggauggcuggcucaucaucgaccuacagggugaggcuugagucaggauccagcacucuugauucccuagucuaugagcauaaugaggacaggagguguugcaauauagaggggaagagggcuauuuggauguuggagucccccuaggccuacuggaaaaauuaaaguagaagccgugagcccagaggugagguaacacagacccuucucuugaaagcucuggcuccugccauuuguuggggcacacaccugggacaccuagggcggugggcuaaggauccuggccuucaggugcucucugggcacgauggauagaggugcaggucugacuaacgaugcccuuucucuccccaucccaugugucuggcauauguguguguguguaugugugucccacccugcugcucccucuccucugcauggcuucccauucccacacccuauagacagcuauacagcuccucccgaccccggggccucgccugcuccugcaggccgcccuccacccgcgcccuccuugauggaugagagcugguuuguuaccccucccgccuguuuuacugcagaggggcccggccuugggccugcccgccuccagagcaauccgcuggaggaccuccucauugagcaucccagcauguccguuuaugucaccggcagcaccauagugcuggagucugggccaccuuccccucacccugaagcugccuugccugaucaggaccucagcgaugggugaguggguugaggguggagacuggaggcuagggucuaggagacuagcaggggcguguccuugggauaaagggcugaaggaaaagaggcguggucuuguggcuaagguggggcuugggagagcccuggcucagaggauugggagggaccagccugaucugccagacagaaucagaguaggacuuguauuggggggucaggguuuuuucccuguucugccuaguuaccugugccaggugcuuaaucacaacucuaauugugauuaaaggaagaauuuguaccccucaguggucugccccgcagaaauagggugugggaugccaacccugaucucuucccucucugacagaguuguacucuguuucugcagagagcuggcgccugcccuccgggaacccagggccuugcaccacgcagcugcuccuaugcccgcucgagcugugcugcuggagaaggcuggccaggugcggaggcugcagagagcccgacagcgggcugagcgccacacauugagugcuaaaguguugcaacggcagaaucgcgcccgggagagccguucgcgccggcccaagcaccagggcagcuuuauuuaccagccgugccagcgccaguucaacuacugagcgccccugcugcaccgcgaaucccucgccgacuccuggucccauccgccuccucugcagcagccagugugcugcucgaggguguugggggguccacccgccuccaucuggauacuacaaccucccuccuuccuaaguuuugagguggggugauggcccucuacuucccuguuuauagucuaacucaccuauuaaccucucucauccugggucauccucccuccuuucucagugucugauucuccacccucacacuccccacacccacucucccaugcuucuuuuuaggaccucuauucuugucucucgccccuucaccuuuucccucuuagcccacccgauuccuaagacccugacuuggcaccuucuccgcuucagcuccuacuuuccaagacuuacucuucuguuugggaucgcucccacucuuguucccuuuuuuucauuccuggcaauucccucccaauccugcaggugcaaccugccaggccugggccauuguccucauccuguagucagggaucaggcauggguuuugauuucaguuuucccccuuucucugcccugggggcugggcuccuuauugcugcuuaggccuagaaaguuuaaguauguggaagaggagagugaguuguaaguuagauaaggugaagggaauggagggaaacaggcagccuagugggggccgcagauggggacagguggguugagaaguagcagggagcagggcaucuugggagcugguauugugcuuggucagaguagcuaagcccuggucuuaggccugagccuggagucugcccccauuuccuuuuccuauaauccugccuuccaggguuccccccucccugaaauuuguccuucaggaguaaccccuacccaccccugucccugugagucuggaguccgaagggcuuguaccuugucaccuuaccuugucaugccaccccaggaguagaagcuggguaaggccccaucauccugaccaucucuguucauaugcccaaggugcuagaauuagcuuaggagagaugcaggccagaggauuuccaggcagggaaaaggaaacacaccccaaggcaagaaugaggaggcaugaugcuaaggaggacaacuaugagguaaagccauccccagacugacagcucugccuuuaucuugccucuggccuuauauuucauacuuuguucaauauggcuggauaauaaacacuccuggguagaggaggccaggagccucacugucccaauucccaaauuuuucuuacagagauucagggccuucaagagucuucuuaauguucucccacagggcucuuucugagugcccuauaaucccuccccccuuucuaauucaauaucuggaguaaggaauucuuggguagggcacagggaugggguugccagcuucuucuuucuugugguggggcucagacaccagcaacagccucuugggaugccccaaguuguuuccgguucuuucuagcuguccuuuuuaaagugugugcucuuccuuccuuaaaaccuuuagauguccuguuacacuaacacaggucuucccuucccuccaaccccagguuucaggucucagagccaagccaggguuggagaaaacugcauuccuacgaggguaaaaguagcugcccucuuugauccuuucuuacuaggcuucaugugggaugggagaggauguccccaggauggggacagaggaagcccugcuagggucuccuagcccaguaagccaaaugggaacuauaagcagaucaaaauuuuacacuagcuuauuagagcccuauuaguuccugucccaaguucuucaguuacaaccuaguaguauacuuacucuuccaacuguccuaaggucacuucccagccagcuuaggaucuucagcauuuuuaagagcugaagcucccucuugcccuucuugucuacuccucacugccaguuggggccuaggcuuaguccugggcaaauguccaugaucuugcugcuguaggaagcuugauagggcauuuggcucaaauuucagaaggccucgcuccugaccuaauuucucaaagcuccgguaguucuagaccccuccaauuucucaucugguugcaaggcuuauuuuucuuuuguacuuuccuauagaugcuauagcauuugaguguggcaauauuuuuguuguguauagaugucuaagaaccaacacuacucagucuccugcuagucugacuccugaagcaucagacccugucauacuguauugacuguguaugugccuuucaccuugagcaugcuucaggaauuuuuuuuuuucuuaaaccacagaacuugaauacacaagggaaccagaauucacaaaguccuaugcaacccuagacaggaggagguuagagagucugucuugauuugugguuucagagacccuagagaaauuuguaccaguuuguauuaaagucaguacuaccagcacuuugccaaaacuacggaugucagagggaccuguuucuagagugagucccaauuacaucaaagggcaaccugcgcuuucuccaauaagucugagugguucucuugagcuggugucacuuucuaaccuuugccagucuagccccagcagggcaccgugugugugagugugguuuggugcuguuuuggagugugccugccccccagccuggaacccucugaucaacuugcugggaccuauaacgucuuaggugcaacaaggacccuaccagagcuccuggguggcuuugugugaggggacugaacgcagacaaaccacagccugcuucuaauaccuucuuucccuaccaccuaguuccaaauggaaccaacaaguugagugcaucucuguuggguguuuuguguugagacuggcugaagugaagaaucuuugacugaccauguugugaugugucgacagacucaaggacacaaccaccucgaccuggucauguggcaugccuguguauguguguaacaggauucugaauguuagguuguaaugcuauuccuguaugggagaaaaaauaauauaaacaaauaaaaaucuauuuaaagcacauuaugcuuucugccucagcugagcuaaaguaugagaaacacuauaauuucaaguaucaucaaggcagaggauacuauuauuaggcuaaucuucguucuccuuugucauauaagaaagcaagaggacaaauaguucacuagaaaaggacaauauagggucugacucauaaauauuuuuagaagauccuuauaaggcacauauaugaagauaccuggauacagaaaugagaaagcacagcaaacacugguccacucuuuagucccaagcacugggcuaugacaagguccaagagcuaccuaguuaacuguagaacuguguuaagugcaucuccugauggagcagcacaagcauugc

SEQ ID NO: 1198 - RNA, 623 nt, Mus musculus
gcucagacaccagcaacagccucuugggaugccccaaguuguuuccgguucuuucuagcuguccuuuuuaaagugugugcucuuccuuccuuaaaaccuuuagauguccuguuacacuaacacaggucuucccuucccuccaaccccagguuucaggucucagagccaagccaggguuggagaaaacugcauuccuacgaggguaaaaguagcugcccucuuugauccuuucuuacuaggcuucaugugggaugggagaggauguccccaggauggggacagaggaagcccugcuagggucuccuagcccaguaagccaaaugggaacuauaagcagaucaaaauuuuacacuagcuuauuagagcccuauuaguuccugucccaaguucuucaguuacaaccuaguaguauacuuacucuuccaacuguccuaaggucacuucccagccagcuuaggaucuucagcauuuuuaagagcugaagcucccucuugcccuucuugucuacuccucacugccaguuggggccuaggcuuaguccugggcaaauguccaugaucuugcugcuguaggaagcuugauagggcauuuggcucaaauuucagaaggccucgcuccugacc

SEQ ID NO: 1199 - RNA, 825 nt, Mus musculus
auuugcuucuaaagauuuuaaaguugggggugggcuuucaggaagggccaaucuccuaugcugauacaucagggcaguuccagaaggaguugggguuuaaaagagaaaugugagcaaucugggggagggagggcacaggaaggagugugagaucaaaagagagguucaagaggggccugcaggugaaaaagcagucaggaugaaguagggguuggagauugaaaaggaaucuugggaugaaaugaagucagagucguaagucaaaaagaacacugcggguaugaagaguaaguagucuuaguggggucggaaaaguaguuugagaucagaagaggggaaucuuggcgaccacagagaaauuuggaguccaggaagugagugguccgaagaggaucugaaaucaaagagaaauuugcgcucaaaagucagucugugguucuagaagcauauggaaucugggcuggauucagacuggaaggaggaagggccagggauuguuugaggaucccagaguagcgucuucauccuggcaaccuuccacuguccucugggcucccauccuccugcaccugccugcaggcugcaaucaguagacuuuaagcaggcgggggcgagucauacuaggacacugcugacggugggggcgcccccucccggcuguccaggagcucagaccccgcccuccgcccucgcaccccccucuucacugccacuuccggcaggcgcugcgcugcuggggguuagggcgaggauggcggcugagaacgaggcuagccaggagagcgcccuaggcgccuacucaccaguggacuauaugagcaucac

SEQ ID NO: 1200 - RNA, 3874 nt, Mus musculus
ugguaugaaaaaaaaaaaccuucaugugacagacagggguggugguggugaacaucugagugacaaugacagacagggguggucaugugauggugacgucugagugacagacaaggagacaguugugcuaaaauuuagcaguaaaucauccaaggagaggagcgggaaggggcuacgauuucccgggauggcaaguccuucauucccucuuauuaucaaccaggucacuuuggacaaguuagaucaccucucaggcucagcugccauaucuacaaaacagaaaugaagccacuucaccucccacaaugugaggagacccagccaaagggccauuaacaucuggguccuccccaaaugucacccauaaucaccagauagaccauugcugauccaucuuagaagaaaggaagcuguauagagaguccugggccuuggugcuuuuguuuuuauuauaauuucauuuuuguuuguuuugguuuugagauaagaucuaacuaacucuggcuggccuggaacugguuauguaaaccaggcuggucuagaacucacugagauccuccugccucugccuuccaaaggcuggaauuaaagguacaagccagcacuuacucccugcguacuguaauucauuuaguaccagaaauagcuaccuuuaccucugguuaauacagugacuuuugucugucagucggggcagcugcuuccuaccuggucauuauagaagcaauaagaaaaagguaucagaccacaaacauuauucuggcaacagccagaucaccucccugccaacucugucccauucauacgagacaucuggagggcuguccuuccuagacuggagagaggcaccugcuuuaucuaaagaguuggaaggauuuuggucccuggguuaggccacugauuuacagucaguagaaauucuccuucauaaaucucucuucaauuugacauucccccuccccuuuuuucccuucacagcgauggcuuggagccucaccaacuuacagcuaacucuggaucaugucugucuguaccuaauauauagaauggcgucuugucucugcuaaaucuccagccucaagguuucuuccugaggccagcucuuaacagccugccccacacucuagagcccaccuuuuauuuacaccaaaccaauuaggaguuugcuaucuuaggcauaauucccuaggguuugaucagauacauucauuucaggaaaauuuuuaucagaaaggaacaucuuuuuuuaaaaucagguauauauaguggcuauuccugauugucaacuugacuauaucuggaaugaacuacaauccagaauuggaagguucaccugugauccuaaucuggagacugggagauacaaguuucugaccuggaucuuggcauggagaucuugaggccuagugacuaugaauuccagaagauuaagacagggagaccucugaguuuaaggucaucugggacaaagcaagucccagauccaggcacacacuuuuaaucugagccacaccuucugauggagaccuacauaaggacauuggaagaaggaagauuagcucuucuuugcccugcuugccuugugggacugagcuagauccuuggacugacauucacagcugcuguugaccauuguuggggaguuggacuacagacuguaagucaucuacaaauucccucacuauauagagacuacccauaaguucugugacuagagaacccugacuaauacaagauaacucagauuuugaaucaaccucucacagucuagggaaaacaaaguuaaauuacuguagguugccagaggaugaggggucuguauagagggaagaggauaaugaacuugcauauuuacaaacagccccaugggggcugaagacagggguggcuaagagaacuuuugcucuggguucccagaggaugcgacgcucucuucugccuuugaguguccccaucucacagcgugccacuagcucuaacucucugggaacuaagcuaacagguagcaucccgccguuguagccacaaccaaggcucucccuagaguaccgacguauuccuuaaagcccaggucacugcucauguaaugccccuucccggccgccguccaguuccauaaacacagggcuccuuccccaccccuccucuuuagccuugcggggcggucugcgcaggcgcacugggucguaccgaagccccgccccccgagcccggguaacggcgugcggaguuugagcuuggcgagcagcuggacaacgagcgaguaagucggggcuucgcgacggcggcuggcgagggucaaguuuccuugggaggagagcggugagggaggggucugagagcgauuagaacgcggcgagcgggcagaugacgcgguggcugggaacgcggcgagcaccgggaaacuuguguccagugaggggcuugugcugggcgugcugaaccuagauuuccagaucgccgguucccagcucggacacuguuagcgaggcuagagccagaguucuagggaaaauaaacaagccaccaucaaaaacugggagagaucaggaacaaacuuugucuagggauggggagcggacggggcccaucacggggacaagacaggacaagcgacuguguuguagcccgaggcccugagcccgcacucgccucgcccaggggauuaaaguccaacgggauuucugugugggcguuuuaaaguuuuucgugauucauucaccacuuacuuauuuaaccuucaaugaaguaucaaggcaaaugcuauuuuuaugauagagguacgaaccuggacagagaaauccggcgauggcuuccaaaacagaaucaagaguuggggguacagaggcuggggauguagcucagugggagaaccuuuaagccacgaggaaagcaggaaagcgaggaaagcaggaaagcgucaucauccaagaucugaaaguaagagagagaggcugguguguuuuagucacuuaagaugccuuuacuacucugaaagugcccaggaagaggaguggguuggcaguagaggcagacaugagggaauucaaagcgcugcauuuagucagcagaauccacaggacuggaagaaaugggcuguaagagaaaagugcacgugaggcugggaugucagggugagacucauuagaggaggaccgccccagggagcaggaggaguguucuagauugaaaaccaggaaagaacuugcuguguaaauacaaacuugagugucaccagccaaacaagucacagaacaguuaaaucuguagaaaggaaaacaaggggcccaguuagcauugucuaguuauuacuaguauaguguuuuuguucaugaauaugcauggacacccaaacacugguguguguguguguguguguguauguaugugugugugugagaugcagaugugcugucaguguuuguaugugagggugcccugagcaucaggugucuucccugaucagugcacuuccucucugcaccucugggauuauagccugcucacuaucugcccaggauuuaugugcauaauugggggucugagcucuuuaccugcuagcccccuccuucgcccucuaccuuauuuuuuuuguuuuuaaagacagggccuuacugaaccuggagcucacucgcauucacuaaccagcaagcugcaaauguccagcugucaugaucuccccagcacugcaaguucaaagcuagccuagccugagcgccaggccagccagggcuguaucuccaacagcauuugagcuaacaaguuucauuacuucuuuuccuggucaggaucuugcucugucacccaggcuggccuccaacucagcaauccuccacucucagccucccaagcacuggucucacaggcaggcaug

SEQ ID NO: 1201 - RNA, 24038 nt, Mus musculus
gcaauaaaagggguagcagugcuccgcucccuguccucaccguggugccaggugggugaucaaggcugagggugugugaucagguggaggguaggugaucagggcagagggugggugaucagggcagaggaugggugaucagggcugagggugggugaucagggugguggguagguuuggagcuggaaggaaggcaggagagugcccaugggugggcccaggacaucaguaccuauagcagaggaugcucuuaugucuggaggugugcaguugcaggcucacccaggacaucacccaagccuugugguuagaggaucauacuccagugugggucuagcuccccaucccugaguuuccugucuuugcugucuugcagagcccgcugccuaggacugcuuugaguugcugccccgguuuucagguccuccuuuugcaccucucgccaccaugauggauaugagugaacuuggagaaucagccugcuaccuccgccagggcuaccaggaaaugaugaaggugcacacugucccaugggaugguaagugagggacccagccuggagacacccauguauucagacuaggagugaagagggcagacauucugcuuaacaugacaggggcacuguggccugauaccugggucuuccccucaguuccugaguaccagaggcuaaagucacaggaaccaugugaggaugcuuguauggcuguuccucuauaaaaggagacaaugucaccuugcuccugaagucucugugaagacucaggcugaaaccugggacaucugacaugagacugaugagugcagguggccuccaugcccacaaaaccugugcugaacuuauuuuuaguguuguccauggagccaaagccacuguuaauuagggacaggaacaaagacuacuauuuaugccuugauuggcucauaguacaauaauaacauaggcacugcacgucuggggcugauggugugccgcgucagggcugauaauuuucuguguaucgucucaguaaccuggggaggugggaacuaaagaggagccagauucaguggcgugcaacagcuggaguuguacacagcacugugcucaaaauguacagugcuuagcuggacgugguggugaacaucuuuaauaucagcacucaggaggcagggguggguggaucucugugaacuggaggccagccugggcuacguaucgagaaccggucucagaagaaagaaaaggugucuccugcuuaaucugacauucugcuauugcuaucuuaacugcuuucuuugcaugcagaggauuuccuuccagcauuuuaaauuaaaauuaauuaauuaauugauuaguugaauaagggagccuggguugggucccuauuaugugaauaguuccgaccaaggaguguggcuagcgacugugagggcacggaacagaacuugcccuccacacgaguccacauuuuaucaccauaaaaacgugggcucuccgaagcucuagagugagccgaccagucaggaaugagcagaggacauaaggugcaucuccugaccggcuguguccacacuuucagugaaacagggaagguacaacccagcugagaguuaggagccucauacuaaaggggaugcccuaccugcaauuuccuaugaccuuugcauuugaggaaacaggcccagagagaacaaaagcuucccaggaggcagggagcugaacccaggugugggguguagacuguuauuccagucagcucauuugagaucuuuagggaccaucucugccuuggguuuggagagucugcacuggaaugucuauaaacuggcagaagggcucccagugaggacugggggguggaaggggguggggauuauugcuuuagcguagauaucccaugggacacuugguggcccucucaaagucugauugauugauuuuugcaacccagguaagaaacgggucugggugccugaugagcaggaugccuauguggaggcugaggucaagacugaagcuacuggaggcaaagucacuguggagaccaaagaccagaagguugagcuuccccuuccuugauauuagccccucugacccugggugcaucuccuggccagcuggauccacagagugaaugaagcggcguggggcaugggagugugugcggggaggagagagagggaaggucaguuggccccaucucuguuccuuaccaugugacacaucuccucggaaggugcugacagugcgugaaacggagaugcaacccaugaacccaccccguuucgacuuacuggaggacauggccaugaugacgcaccucaacgaggcugcagugcugcauaaccugcggcagcgcuaugcucgcuggaugaucuacgugagcccugggcagggacggcucaguggugggcggggccacuaauggggcgggucuaagggaagaaucgugacuaggaguggcuaggcuagaagagggcucugagacugaaggagcagaaccgaagaguggcaaaggagagggcuagagggacaaacuguaggugaaugaaggggcguccuagauagaugacuuggugaugucuagggucuuggaagcagagccagggccuuguguggagccuggcugcuggcaccucugaagggucagcagaggguuuugaggucggucagucgguuaugagccuucuugcagcucaggcuggaacagaagaaagggccgugcauggcauaucuggagguuucuagaauauugcaggggucauggugggucugggaaugggaccuuggacaucucucuugcugauccuaaaagcucugucugugaacucucucucuucagacauacucgggccucuucugugucaccauuaacccauacaaauggcucccggucuacacagcugcugugguggcugccuacaagggcaagcgucgcuccgaggccccaccucauauauaugcaguggcagauaaugccuacaacgacaugcuccgcaguaagcaccaccucccucaccaucucucucaccaccccucaggucaggguggcuuccgguuagcacccccuccccuucccuccccuucagcacuccccuccucugguaccacccuagcuauucugccuuuuuaguuuggaaauccuacuuggucucacucacuggacguuuggguaguggcaacugugucugcgccuuagaugauccaggcaguccaccuaugguuagucccucguccuggcuaacacauuuauuaucuccccuuccucuagaccgagagaaucaguccaugcugaucacgugaguggggcucugggcaucgaguggccagugcuggccauuugaugguggugguugggggaaucaaaguuaauucucaggguuggauccaaagugguuaggucagggucuuuaccuccuagagccaauguccacccugaccuccuuuauguggggaggaggggguagaaagcagauauucaaacaugggagugaccccaagcuccuugccaucucuccugagaucugggaaucuugacucuuugagguucuacauagguucucugccuuuccucucaccucaucucuguaucucagcccucauccuuccuuagccuucaugggaaagagacccauuccauauguauugaguucauguccagucaggccaauacaugcauggacacguggauaaacaugagcacucacaugcacaaguguagguuauuaagaacaagcccucugaagccagauaaagcuggauauaggcauucacauucccauuucuugcugugugccuuugggccccugaaccuugccaauacaaacagaacaaccuaaccugccacacaaaauuaccaacaguuaagucuguuuagaugugaaccuugcacagaacugagacagguucagcgcuuccgaggcccauuucuuuauccauaagauggugauagucuaccccuccccgccuccccaggucuucugauggagguggggugccuggauuggcacugggagcuaaguuagcacucaguucucagugguguguuggcauugucaucccacagagcggucuguaccugggaguuuggaucugaggauacugaguugggaagagaggugguggagagaggcucgagcucuggggggcugggaggauuagagagacagaugggcuuuggugacugauguuuguguuguccaagcggagagucgggggccgguaagacgguuaacaccaagcgggucauucaguacuuugccaucgucgcugcccugggagacgggccgggcaagaaggcaguaagacucgcccacucgggcaccaauccccacugcuuuccccugguuuuuuguuuuguugaugguggguuuuuuuuuuaauuuuuuccuuucuuuuuaaaauugcaaccccccagagccccaagcccugccugagccuccuaccuuggugggagucucuggccugagcaaggcucgaccagaaaacccauggccaccucugucacuguuagaccugagccagaccugcuacagcucucccuggaaccacacagacgggagccacaucacugcuccuggaugcuugugugugugacuuuucuguugugacugucauucuucuuaaagaguuuaccaaacagggugcuuuuaucuggaagugauuauuuucuugggccacauucaucaaggucucuguuaccuguucccaaugagaggagcagacugauccacagacguuaauuacccagagcugagggcacugggaauucuccacuguugcauggcccaugguuuugauuaagauuuuuuuugaaacuucuuaaacaauggagacauaguguuuuuuuuuguuuguuuguuuguuuucaaugugacuaugcuaucccuggcccaaaggccagcuguagagagcucuguggcuuuggcugaccccacacaucuacaccgacaugagcggacccaggcguccucugcucgacccacguuccugguccuguugagccuugcuuuauucuggggcaacuuuuuuucuuuuucuuuuccuuuuucuuuuccuuuucccuuuccuuuuucuuuuucuuucuuuuccuuuuccuuuuucuuuuuucuucuugcuguguuuucuuucuucuuuuuccauuuguuguuuguuuuguuuuguuuuuugucucuuguucccccccaccccagccuuuuccccauuuccucacucgauugucuugauuuuggauuuuguuuguuugggguuuugguugcagccauaguuuuuguuuuugcuguugacuuuuugagauucuuucuucccuuccuuucccaccauuucccaagcccuggaaggucuuugacgauacuguagacaaguaggguaacccugaaucaggaaaagaagacagagcccaaaucuggcaggaacacaccuggaagggcugggacaggggaguaccugcauaggagggggcuaugauccuggagucaggcuaugggggcagcucagcagaaggucacccacaggauuugggaacuuaaaagcugcacugacacccucccucuccuggagcucagagucggccaacccagccagaaagagucuugaccaaaagcagugacugugaguugcacagggagggaagaggccccucuuccacuucucagcaauguguugggugcuuucuuaagucucggaagggggagggggagggggagaauaaagcuaggaggggagaaaggaguguggacucuagguaauguccuugcucugacagagcucagcacacgcagcuggaagggcugucuuggguagcaguccacaugccgugcugaagacauaaguaugggacauaagacauaagaagacauaagaccgggaaaguaugaagggaccuccagggcgguugggggagggcuugaagucgcugcacuaucaaagaucagaucagggaggucuucccagaggaggaggagcuuuggugggcugggccgcuaaggagaaaaaacucuagugugccccuagugcagauguggacaaugaagagauuccugagaaggcagagacaggguugggcuuggaacacaggagacucuagugcugacccccugccucaaacccucaagauggugcuugcuuccccucccucucuagcaucuccuagcuaaucaguccaggagagcuagguguauagagugcuccaggagagaauguuacgauuaacauuacuaaauauguagguggugacuaacauacacugucccacugacuacccucccaaugcccccacccuuacucugaaagaccacacacccucugacacuuuccuucucccuccagcaauuucuggcgacaaagacagggguaaguauugggccagcugugggguagacaacacuuaugggguccuggggauguccccuucuccaugaucugcucuggcccucauucccgcugccaccagggcacccuugaggaucaaaucaucgaggcuaacccugccauggaggcuuuuggcaacgccaagacucugaggaacgacaacuccucccguuuugugagugggcgcagucgggaaguaugugguugggggucaggggaggagagucaguagcuggggggcccugguggaagggacccuugacaggacugaggguggcauggucccuccgcugcagggcaaguucauccgcauccacuuuggucccacugggaagcuggccucugcggacauugauagcugugagucugggagagggcaagagagguguggaaggagggacagaggcugaaccaaagaaauccauuggcuucucucugcucuggccauuucucuccaucacugaucaguucccaauugcgcccacuuuacccaucauacuggccccuggucucuacucuccugcucugucuauagucugaaggugaccauuuccugucccugcuuccaagccuccucugaggagcuagagagaggacuccugaguaaaguccuugcugugcuuuucaaggacgagaguucagauccucagaacccgcauaagugcugguggcccacugguaauuccagcccucggggagcaagaggcagggagucuuuuuuuuuuuuuuuuuuuuuuuugguuuuuucgagacaggguuucucuguguagcccuggcuguccuggagcucacuuuguagaccaggcuggccuugaacuuagaaaucugccugccucugccucgaggcagggaguccuaaagcaagcugcacaguaagagagcaucaucagugagcucuggguucaacagagagacuucugccucaauauauauggcugagagcaauggaggaagacaccagggacucccacagagacagacacaagucccacccagugacgcagauccugggaaggcacuuuccaguauaggccugccugugcacagucaugggcaccgccacacaugcccugccucuccuggcugccacuuuucuauccuuacaccauacuggggucuuugccccgggaaaguagagagaccacaggcuagcaccccuucucugcagaucuccuggagaagucgcgagugaucuuccagcugcccggugagcgugguuaccaugucuacuaccagauccucucagggaagaagccggagcugcagggugagggucaggaugggaggucagaucccaaagacacugccuggcucugggauggguguucacccucucugcagaggcguggggcaccuccacucuccugguaacacacagccuguuuguacccacccucuucuuccuacugcuucugauuaucacuaagcccucuuuugcuuuuuauuuauuuuuggaaaugguuguuacugagggggugucggccgcagaggugugugugcacgugcacaugugcgcauguuccuaugcuaggggaaacagguuccauuguccugcuaagacugcagcugccuauccugagacuagaacucccacccagcaacaagggaaccuggugguaaucuauauccacugucacauuugaaagcccuuugaaggcaaagcauggucuucccuugucccgguauccagcugaggaucugggguagaaagaugacugagcaguggucaaaugaugagggagucuuauggaccgagugagggccauucccccagagaacuguaaagaaagggacucaugcccagacaugcauauaaacuuuaaaaaugaaaaggggcggggcuuggugguaugcaacuuuagucuauguacccaagaagcagaagcagugugaagcuagccuggucuacauagucccagcccagccagggcuauguagagagaccugucuaaacaaaauaaaauaaauaugcuaauaaauaaaauaaaaauuugaaaagagcuaaguacaacucagugauagagaacacuuauccaggaggcacaaaauccugaguuccaucccaauuaugcacaagcacacaugcgcacacaugugcacacucauacauauacccuuacacacucacacacauacucucacacacucgcacauauacucucacacacucauacacucucacucacacugucucucccacacucacacaacuguaaaaaagaagcagccagcaggucaugccuguaauuccaggacucaggagcugagaucagaggauugugaauuacgaccagcgugggcuacacagaaccugucucaaaagaauaaauaaaaauaaaugaugaaauaaacuaaaagccuuguguagggauuacagagaccagaagcucagguuacagagaagcccuuauaggcucaagacucucucugagagaccccuguccucgggggcccccuggugggcaggagagggaaggcagccugaggcuuccuccugacuccuccugggccucccuguccauagacaugcugcuccuguccaugaaucccuacgacuaccacuucugcagccagggggucaccacuguggacaacauggaugacggcgaggaacuuaucgccacugauguacgaugcucugugggggaaacggggugggcgugggggugggagggggcaccaggcuggauucccauggguugggugugugugaguauaugcacugggucgagaccggggaauuaguaugaguggggugguccucggcgagacucucaaggacucauauuucucugagccugcuugguuccuucuacaucagcaugcaauggauauccugggcuucaguguggaugagaagugugccugcuauaagaucgugggugcucuccugcacuuuggcaacaugaaguucaaacagaagcagagagaggaacaggcugaggcagacggcacugagagugaggaccucuaaccccagucugaccuggccuuuacccuggaaacuuucccagacauucuccuugacccuugccaauaaucuuucaucucaguguucucuguuccugucugaauucuagacccuccuaaaggugacaaucuucaggccccgauuccucuuaaccuuccucuuuaaacccccaagaugugacaacagaccccugacccccaagugcccacguuguugcccuuauccaagccauguucccugccaggugcggacaaggcugccuacuugaugggugucagcagcggggaccuccucaaaggucuccugcauccccggguucgugugggaaaugaguauguuaccaagggccagaguguggagcaggugagaaggcgccaaaggcucgcucagggacagcugaggcgggaucccucucuugccgggucccacccgacccugccgcccuguauccacaggugguauuugccgugggggcccuggccaaggcuaccuacgaccgguuguuccgauggcugguuucucgaaucaaucagacccuggacacaaagcucccucgacaguucuuuaucgggguccuggacaucgcugguuuugagauuuuugaggugagaagagcucucaaccacggcagaggcugaugggugggugugggggaccacagcugugcuccccacgcccuccagucugcauccaucaggggccugcugauuggggcucugccacccauaguuuaacagcuucgagcagcugugcaucaacuucaccaacgagaagcugcagcaguucuucaaccagcacauguucgugcuggagcaggaggaguacaagcgggagggcaucgacugggucuucaucgacuucggccuugaccugcagccuuguaucgaccucaucgagaaggucagaccuaggguggggaccuugccggaaguugugcgugcgugcgugcaggccuggauaagcugccuaucaaugugugguugugauugauguggcuauuaaauaugcauugaagugaaucacuauucccguucaguugagaagugaaguuuggggcuggaaagauggcguaggaguuaagagcacuugcugcucuugaggaaggucuggucaguuccuagcacccacaacaggcaagccacagcugcauguaaccugaguuucaagguauucaauuuccucuggccuccaugggcacacaaacucaugccggcacauacauaugcauacaaauaaacaaacacuuauuuuaaaaaagaaacauagauuuaguaaaauauuggguucccuauuucuaaggaguguagauaccaaaaugcagauucaaaugucuuaaaggaaaaaaaaaaaaaaacuuaagccgagugagccauggauguuaguuaauagggcacagagaugccagccuguucuacacacauaggcggggaaggggauccgaagucaagccacaaacucuucucucccagaaaguggguuccuggguauacacacgugccugacuucuccuguacacggcuggcuuguggaccugaaacagcucccagagggaguuaggcuggagaacaaacguccaaggucccagccagcauggucuagccuggcccuucaaucuugcuuucuguucccagccucugggcauccuguccauccuggaggaggagugcauguuccccaaggcuucagacgcaagcuucagggccaagcucuaugacaaucauucugggaagucaccuaauuuccagcagccucgcccagacaagaaacgcaaguaccaggcucacuucgaggugguccacuacgcaggcgugguaggugcucgcuggagcccuguacucaaccacuguccucucucccuccucagggucgccaccugggucaauauuuuucuuuguagguuccuuauagcaucgugggcuggcuggagaaaaacaaggauccccucaaugagacggugguccccaucuuccaaaagucacagaauaggcucuuggccacccucuaugagaacuaugcagguucuugcuccagugaguacugagggaccauuccuggggguccacagagccacguucccuggcaugaucaauucucauugucucuccuagccgagccccccaagucuggggugaaagagaagcgcaagaaagcagcaucauuucagaccgugucucagcuucacaaggugagguccagacuggggucccagcggcccuggcuuucugcaggcugccccgcccccuaagacugccacgcccccuacaggcugccacgcccccuacaggcugccacgcccccugcaagcugccacgcccuccuugcucccugccgucccugugucuugggugggcagcuguuaagacuugcagugauguuuagcuccucugcaugugaacaucacagcaagucugugcugcugccugcccccaugcugccuggguagggcugggggaagggggagccaugggacggagcccugggggugggggggcggugaagacuuaggugguguuugggguggggcaggugucauaaggagcauuugggcuccucugcccaguccccucuggucccuaaccacugcggcaugcaauucugguucucugacccuccugugccucucccugcuccuccugugccucucucccugcucuccccauucccaggagaaccucaacaagcucaugaccaaccugcgggccacacagccccauuucguccgcuguaucguccccaacgagaacaagacuccaggugguguccccgggcuggccaggaugggggaacuggaggcaucuuaggcucucaccuuggaggguuugcucagucucuaaguaaggccuggguagggaccuaaaggcauggccgugcauuucuaaccaccucuuccacucccaccacauccaggggucauggauuccuucuugguguuacaccaacuacgcugcaacggggucuuggagggaauccggaucugccgccaaggguuccccaacagacugcuguaugcugacuucaggcagcggugggugcugacugcuucagccuccucccgcugcucuuagauuagguagagcuugagggggucggggagacauguuggagccugagggacauacagcaguucaggucuccugaggaggcgucucagucuggaacuggguuaaggaaagaggugacuagacuugagguaaauguggaaguggaggcugcuggcuuugccaguuacuuggguacaggauaagaaaggguuagccuguggugacucccaagucucaggccugagcuacuggguaguagauuuacugagcgauaaggcaggauguuuagacugggugcagaggggguuugaacaugcgcaguuagaaaugccucuggcagaugucuuaggagagaaggcagguuuucggguuggauuuauuauucuagaacucaggugagcauacgagagaggguauagauugaggauuaaacauggguuuguguggaccuugagagaugccugacagauagugggugugccagcaaugucaucggcuccuuucccacuucccuuggucgguucuguuuguuaaacuacacguguccuuaguuguuuccccuucuacaaguaaaggagcuaucaccugcccuuuauaguuuagcuaucuauacagaugcuguacaugugcgcacguguacacagagagcuuguagguuuguuuuuaugucacuaucagucccaucuccaaccaagggccugagucugcguuaucuuugucuguuguuuuaaagcaggguauugcuguguggcccaggcuaaccucaaacucucaauacucaugggcauugugucucauuccuauaauccuagcacuaaagagccugggcaggaggaucaucaagggugugugaagccaguuugggcuacauaguaaauucuagggcagccuacguuucuaacccaaaacccaaaacaaaguccugagauuuggcggauggcucacaacagggcaagccuugaggcgugaggaccuggguuugagucccagaacccacaugaaaugcugggcaggguggugcacauucauuaucccaggggaggagcugaggcuccaggccauccagugcagucuaacugucucaaaggagguagacugaguucgugaggauagccggcccccggaugcaugugugcuuagaccaaugcacauacauuuaaaacugaaccugugcugaagagcugguagugacuaagagcauuagcucucgcagaagacucaaauucaguuuuuagcacccacguggugacuuaaaaccauaugugugugacuccagcuccagggcuuuggcgcccucuucuggucccuacgaguacauacacguaggcaaaccacacacauagcauuaaacaacucuggacccuggugccugggccuccugaaugcugagagcaggcaugcgcccugucccuuuacuguucuuuccugucuguaaaaccgcaguagcccagugacccacaccuccugaugagucaguccccuggugaaggggccuguccugucucugguccuuccuuucacugcauggccaccgcccacccguccacacguguguaaacaaacaucccugacagcggacaugccagggacccuuguucccucugaauagcauucucagaugugucuucauuuuguaauauggugcagcacagcacugcuuuuuuuguuuguuuuauguuuuugccuuuaagaaaucacaaaagcaccacauguucuuuauaaaaaccacaucuacugacaaacucacuaaaaugcucuuaagccaccaagcccacguuugagacagggucaggccaguuuaccaagccggccucaaagaugguccugcuucugccucucaaaugcugggguuucagguauauccacacaccuggccccuccgcugaggucggugccgucucccccaguguggucacacucucccucgcugucuugugcagcauaugucccuuuggaaccucaccucugagaggucaagcagucacgauucucuugcugcugcuccuggcuuuccauggccuguacccuaucuguccauugcagccuccucuucaucuccuagguaccgaauccugaaccccagugccaucccagacgacaccuuuguggacagcagaaaggccacagagaagcugcugggcucccuggacaucgaccacacucaguaucaguuuggccacaccaagguuagggggucccggaguuagggcuuaaccugggugcacacggucacacuggacagagaucccacuuggcggcaccccuacccuuagguguucuucaaggcugggcuucuaggcauccuggaggagcugcgggaccagcgucuggcuaagguguugacacugcugcaggcucggagccggggccgccucaugcggcuggaguaccagcgcaugcuagggggaagguaacugcgggugagggauggaggauaagggugggaagggauggggauugggcguggacacugacccaaggcuugaaaggaucuccaaccugugccaugcugcugagguugcucccucuccauggcuggcuggggugagggucugggucgugucucgccuagccucggauuuuacaccuuaacauuggggagggggccagagagagguuacagaccuugccucggagguggauguggggcugcuccccaggcuccccggcucugaagggcugcuaggaagacuauggagauaggacacagcagcugaaggggcaaagccagcugccucacgcgagcugccugucccuagggaugcccuguucaccauacaguggaacauccgggccuuuaaugccgucaagaacugguccuggaugaagcucuucuucaagaugaagccacugcugcgcucagcacaggcggaggaggagcuggcggcacugcgggcagagcugcgggggcugcgaggggcccuggcuacggcugaggcuaagcggcaggagcuggaggagacucaagucagugucacucaggagaagaacgaccuggcccugcagcugcaggcagugagugggacagggacucagguggccaaugaaacccuggagccagacuauggccagggcagcccugcagcgcugcgggcacuucgaccuucuguguugucuuccuacuuaacgucugcccagccaucccugcaggccuuuauccauacgcccuaaagccaaaacugcaggggagccacaccuccccucucuuugauuucccugagacuauaacccugcucccaagacgaauaugaggcagauaacagagggcagaggucgaagucuggaaguccgcagcauuguuuuugauuuauuuauucuuauucuaugugcauuauuuuguccacaugcacaucugugugagggugucagauccccuggaacuggaauuacagacugugugagcugccaugugggugcugggaauugaacccggguccucuggaagagcagccagugcucuuaaccacugagcugucuccccagcuccuacccaguauaggcuuugaaugacacuuggaugccagccccaggcugaggcuggagaugaugguuagaaaacuccgcauccagcaugagggcuuaagcagcaggcagugaggaaacucugccuccuccugaaauggccuuuggugcugcccccuggugggcagcgcuggccuugcacccaaccauaccaccucucagaugguugcagcuccuuagcaagcaagugcaguggggcuuuucuccuagagcucugccuaggucuccuaggucacauauguuguggcuaauguuaauuuuucacagugccauuucugucucuguguccccugcaacaguccccagagcccagcagaguguaggugcgccagcuccucgucuaucgaguugaauugccagcaugugccucacuggaguugccuuugcauggucaaauggccuuucuuccccagggcuggcccuggccuccugccgaccgcucuuuaacugucuccccaccgcauccuuucaggagcaggacaaccucgcagaugcagaggagcgcugccacuugcugaucaaguccaaggugcagcuggaggcgaaggugaaggagcugagcgagcggcuggaggacgaggaggaagugaacgcggaccuggccgcccgcaggcgcaagcuggaggacgagugcacggagcucaagaaagacaucgaugaccuggagcugacgcuggccaaggccgagaaagagaaacaagccacagagaacaaggugugggaagggccugagcugggggccaguuuugguguuaggcaacugcaggguuccucccuaaaaccccgcucugcauggguaccugccauguagcccgagucaggccacagagccucuuaagaaccuccguuuucugguccgucaaguggggguaccagcacuuacauuauuagggugacuaaggauuuggauguaaguagccuuugcuaagcacauacuacaggaccuugcacacagaaggugcuuaguaaaggcuugcaaugaucaucgguccuggauugaaaagcuuguuggggggagggcagcuugcccgaacugagaauccuaucaccgagagccgugguugccagcguugugaguauugacuuuuacacagaagaggaaacgaggcuguuuagguucuuaugggugccaaauauaaggccgcggcuaggacacagcucucagaauaccuguugcuauuguaaauggcugccacccacuagucuuuuacucugagcuauguaugcuuggguaugaaccuuuacccagcucaaggaggaggucaaaccuguaggcaggaaugguggaggcucaguauagcggccugccugcauccuguagcuggaagggguggcugcucagaccagccuagggggagcacuguccucacagugaaaucgggccuugacacaggugaagaaccugacagaagagauggcggcacuggaugaagccgugguccgccugacuaaggagaagaaggcauugcaggaggcucaccagcaggcucugggugaccugcaggcugaggaggaccgugugagcgcacuggccaaggccaagauccgguuggaacagcaaguggaggaugugaguuggagucccuugggggacccucagggcggcgacaguuacacuggcuugcuggaagcugagcccuacucuaccccacagcuggagugcucccuggagcaagagaagaagcugcgcauggacacagaacgcgccaagcgcaaacuugaaggagacuugaagcugacgcaggagacggugacagacacaacacaagacaagcagcaguuggaggagaaguugaagaaguaggugugggguaggcagggucucugggccugaugggcccuccuucucagccccguugcuguggggaggauaccagggcggaggucacguccugcccucucuggaucagagcuauguacagcagaggcgcaggaucgaggcuccuuaggaccucacaggggcagacagguggauagcagguagggccagggcuggcucaccccgccaugcacucccaggaaggauucggagcugagucagcugaaccugcggguggaggaugagcagcucgugggggugcagcugcagaagaagaucaaggagcugcaggugggcauuguggccgugggggaugcccuggguggaccaggccugguucaggggcucauggagucgguaccaucuccuuaggcuagggccgaggagcuggaggaggagcuggaggcggagcgagcagcccgcgcccgcguggaaaagcagcgagccgaggcagcgcgggagcuggaggagcugagcgagaggcuggaggaggcuggcggagcuuccgcggggcagcgugaggguugccgcaagcgugaggcugaguugggccggcugcggcgggagcuggaggaggcaguucugaggcacgaggccacuguggcugcccugcgccgcaagcaggccgauagcgcugcagagcugagcgagcagguggacagccugcagcgcauccggcagaaacuggaaaaggagaagagcgagcugcgcauggagguggacgaucugggcgccagcguggaaacucuggcccguggcaaggucugccuccuucccgccucgaaaucaguuuugacucuacacugacccuauccccccccgaccccccuuccccaaugcucuggucacuucaugacaauacuccgccgcaaugaccuccugaccccuggauguuuaaccugaugucuaacccccagcuccgcagcaguccugaccucuaaccccgagugcucacuuucauuccuuggcuuggguugcucugguucccacccaaaccucagcccuuccaacaggagugugaccccagcucuugacuccugaauucagacuuagcaccugcccuaacacucuucuugucccaauuuuggacgcccccacccccaccccaaaauccugacaccuguucccagaucuaguuccuaauacugacucacugacccugggaugggucccgagacucccaauuugugcccacaguaggaacccagacccugaaccuggaacucgagucuggucucauaccuaguguucuaggucccagucccagucucuugccuggcagccccuggaucccccuuggaugcacaaacuugucucgaucucugacucuggguuccaggccagugcggaaaagcugugucggaccuaugaggaccagcugagcgaggccaaaaucaaaguggaggagcugcagcgacagcuggccgacgccagcacccagcgggggcgguuacaaacggagaauggugaggcccggguuucgcugagcuaugccagguagggguuaggugcugcgccucgaccgacugugggccugcuggccccuucgccugcaggggagcugggccgccugcuggaggagaaggaguccaugaucagccagcugagccgcgggaagaccucagcagcgcagagucuggaggaacuucggcggcagcuggaggaagaaagcaaggugggcaggaauuggcaaccguggggcggaggugggcgcuggggccauuagcuuggauugauggcgaggccacugcugucccugcaggccaagggugcgcuggcucaugcagugcaggcccugcggcacgacugcgaccuccuccgagagcagcacgaggaagagucugaggcucaggcugagcugcagcggcugcuguccaaagccaacgcggagguggcccaguggcggagcaaguaugaagcagaugccauccaaaggacggaggagcuggaggaggccaagugaguagcuggcaccuagaccacgauccaagggggacucuggccugugcccccuguguggugguggggauucuggcguccuuuccccaggcuccuuugguacauaagccacccugccuggucugcgguccaggaagaagcuggcccugcggcugcaagaggcagaagaaggcguagaggccgcaaaugccaaaugcuccucacuggagaaggccaagcugcggcugcagacagagucggaggaugugaccuuggagcuggagcgggccaccucggccgccgcagcccuggauaagaagcagcggcacuuggagcgggcgcuggaggagcggaggcggcaggaggaggagaugcagcgggaacucgaggcggcacagagggaggcucgaggucuggggacagagcucuuucgacugcgacauagccacgaggaagcgcuugaggcucuggagacacucaagcgggagaacaagaaucugcaggguagggccguuggcccagagcacugaaggcucgaucacccuggacuuggggugaaggaagggagcuggcucagagcagagguggggggcgaguccucagugcucuguucacccugcagaggagaucagugaccuuacagaccaggucagccucagcgggaagagcauccaggaacuggagaaggccaagaaggcgcuggaaggggagaagagugagcugcaagcugcacuggaggaggcugaggucagggcuggucacggguggguagacucugcuccauggcucccuagcuucguugcuccucaaauacgugccgaggccccucacugccacugcuugaucaacaucucuagggggcacuggaguuggaagagacaaagacucuacggauccaguuggaguugucccaggucaaggcagagguggaccggaagcuggcggagaaggacgaggaguguacuaaccugaggucucuggaaagcagucuuguggugcuuaugauggcacacaggacagacuagcugucccugccacaggacuagaguguucccauuccagaggugguccuccacaggaugcucaggguuaagaguucaguccacgcccuucuuggucuccagugaaugaacuuuuuuuuuuugcaagucaccagggaauuguaaacaggcaauucauuugcuccccaaguggguucccaagucuguggguccuugagcauggcacagguuaaugccugaccuacuccauuccugugggccaagccgguccuucauccaccuccuuacaggcgcaaccaccagcgggcuguggaaucccugcaggccucccuggaugcagagacaagggcccgcaaugaagcacugcgccucaagaagaagauggagggggaccucaacgaccuggagcuacagcugggccacgcaacccgccaggccauggaggcacaggcagccacgaggcugcugcaggcucaacucaaggaggaacaagcagggcgagaugaggagcagaggcuggcugccgagcuccgugagcagggucaagcccucgagcgcagggcugcacugcuggcggcugagcuggaagagcuucgggcugcccuggaacagggcgagcgcagccggaggcuggcugagcaggagcugcuggaggccaccgagcgccucaaccuacugcauucgcaggugggggaugcgccaaagauguuacaaggaugggguagggggcagagcccugcaggccagcugaggcucuacucucccccagaacacaggccuccugaaccagaaaaagaagcuggagguggacuuggcccagcugaguggggaaguggaggaggcugcgcaggagaggcgugaagcugaggagaaggccaaaaaggccaucacugaugugaggcugggccagggucuggggugggggaagggugaguguguagggagcucaaaggagccuccccuccacuaugcuauucccuccccauccaggcagccaugauggccgaggagcugaaaaaggaacaggacacgagcgcacaccuggaacggaugaagaagacccuggaacagaccgugcgggagcugcaggcacgccuugaggaagccgagcaggccgcacuucggggugggaagaagcaagugcagaagcuggaggccaaggugugcagccuucccagcccuccugccccacuggccgaggcucuggcugcugggcuagggggcgggcgacccuccuccugccccacuggcggagguucgggcugcugcugggcuagcgagcgggcgacccuccuccugccccacaggugcgggagcuggaggccgagcuggaugcagagcagaaaaagcaugccgaggcccucaagggggugcguaaacacgagcgccgggucaaggagcucguguaccagguggguguuggcucucaccccaggagacggcgccagagcuaacccuugucuaggcagaaccugagagcccuuugcuuguccagacugaagaggacaggaagaaccuggcucgcaugcaggaccugguggacaagcugcagagcaaggucaagagcuacaagcgucaguuugaggaggcggugagcacacugggggccagguaucugggacuguucgggacacuaguggcgagcugcuuucagcugcggaacuggcagccagggacgcaucugcagcaggcucaacuaacggguagcagccccacccucucaacucauggacuucuauggcuacagcaggggucacuuacaacuauagaauggacuuaaaaagugagugguuucuauccucagcccaggcacggugggcaggugacagaggcacuucuugaaggauggucuccacuuuuuucccuccuguguggguucuaguaaggggaggcuggugacaggaagaguggagggaggaccaggagaagucacuucuuucuggggaugggagcagguggccauuuuaguuaccaacgggaaacaaggcucugcauauggcuccaggagcagcaggccaguaccaaccuggcuaaguaccgcaaggcccagcacgagcuggaugaugccgaggaacgggcagacauggcagagacccaggccaacaagcugcgggcaagguccagggaugcccugggccccaaggugaggcagccucugugucgggggggcugaacuuagggaagcacaggugacgugguucagcuucuuuuucaucucuuagcacaaggagugacacccaggcucugaggagggauaccccaccccugcgauccuguugucucuuuccaucugccacuccacccucccugagccccugaaccccaaauaaacacccugucugcagcaguagccacuguccuuauuucuuggggcuagaggagcugggaacagaacaucauggacaaagucagguccacaucagucuuuaaaauaaaguucuuuaauagucuccauuuaaucgguuuauuugcuguuaauaaacuggcaacacaggaggagccaaggguaagcucucagccaggcucccgugucugggcucaggcaggcacaggcacuccaugccccaagggauggagagaaaaggcuccccccacuucuagggagccuccuggaugaacacaguggccaaugagcaaagaaccagaggagcuaaaggaagacaagggaggugaggaagggagagaugggcagaccccggggaaggcagcauucuccgauacccaccccugcccagggcucaggagccucucugccugcguccugaggccagggagguuuggcucacaggggucugcaucuuccucuccaucaggacugaugggagaagcucagacagaugguuucccguguuccccuucucuggcaggccagggcuccaggauugcgagggaaaggugggcauggugccauuguccuuacccuggggacagugaagaaacaggcuccccaugaccugggcccucagacccaggagacaagagcuucuaggauguuccuuccacugagccugcaccuggacacccgggguggacagagcacuggggaggcaagagggacagggaugggcagagugcgaggcggcacgugcacucuggcucucugcacucgccccugccuggcagcuucuugaagccuggcucaaggucacuccucagugaagucucugucuauguccauguagggcuccucaauguagcugacgagggcagagggcgacuggcggucuggguucaacaagauggacacugucuccuuccaguacgagaagcugauacaggagcucugagugaaagcgagaggguugggcugugcuuaguagaggacggggcucacacacgccaguguccucccacugucacucaggguggggcacucacauucuccaggcag

SEQ ID NO: 1202 - RNA, 58110 nt, Mus musculus
uguagagaguccuccgccgccccguagaaaucgacacggcuccgggaccgcuugcuuccuguuugucggacgaggagacauggcggcagcgcccgcagcggcuggagcuggggccagccgggggaggcgguuggcagcuaccgcggcggcguggggcggcuggggaggucgaccgcggccggguaacauccugcugcagcugcggcagggccagcucaccggccgaggccugguccgggcggugcagguacgaggccggcccggaggggcggggcggggcgggccaggcuggagcuggccaggggccggggaagaggccuuuccaggccgcugcggaccguccagaucccccuuggcuggccgcggcgcuguccugugugcgguccggacgcugucagccgcguugggacggagggcaguggccagcuuggaggccugcgggucugggccgaguggagucgagcugccugggguauugauggcgcgucuaagcccugggccgaguuucuagauccucauuucccugcgccacgucugcgugucuggaggaccuuggcgaguuggcuucaucuucuacuggucucguguuugccccuugugagcaggacgggguccucuucacugcagcgcccccccgcccccaaacgguucccaagcuuaugauaaaugucaucuucccagaggccucaacguuccuccuccuuuucuaaaguaggccccccgguuguuauucuaucagaucacccaauucguuuucugaugcucuauuuucuuugccuguaauugcauauuucuuuguugucugcccuuucacgccuguaucucacauuaggcugagcuccaacgggugcagaagacucuuuuacuagcguagggauacaugcuuugggggaagaacuuuaguucaaagcccuauucucuuucucccucgggcaaguuaccuuucagggccguuguuuacucauuuaauucacccuuuaaggcuauugucaaauucagaggagauagaugugucaaguguuaguguauuucaggugcauauaagggcugaaggguaaucaguuauuguucuguuuagugucuagcuuauuaaguguaaugauugauguccuauacauguggugguguagggugugugucuguguguugcgggggagggggguguauagggcacaaccuuagaauaaauagaugaggauaggugacuccucucacuuuuucuucuuucucccaggugaucccagaacuuacuuugaaaacauuagcuuaauuucaagauagcuuuguauauaguuuugaggacuacauaaggaaccaaacaguguugaugggagagggacgggcaggaauuaggugaguggaugagagaaugggugugagauuuuucuauacaccgcuacauauuuaaaguuaauuuugauccauuugaauauuacugaaagaacugaacagaucaaggugaaauggucgcaggugaaggggcggcugaauuucccuauagaaacuguagaugagcagucuuuucuucauugcauuccucugcauuugccuuaagaagaggugagaaauacuugcucuguccuugaagccagaauaccucacugagcgagugugucaggacaggcagagagaggaauggcuaaccuuuaaugaucacauaguuuuggaucagucaaugugcaugcaggcuguugacuuuuuuugaaagugaguuuacuuuugagacaggcucucccuguguagauuugacuggccuugaaacucauauagaugaggcuggccuugaacuuguggacguccuccuaccacugcccucuuagugcugggacuacaggugccuucuaccaaacccagaaaucuucaauagcuugagccauauguugaauucaucucucucucucucuuucucucuugcucucuuuugguuuuuugaggcaggauuuuucucuguagaccaggcuggucucgaacucauaaauccacgugccucugcuucccaagugcugggaucaaaggugugcgcuaccacugcgcggccuugaguuccaacuuuuaacacagauaaggaaacggagguuuagaaagguugggcgguaugauuccuaacaucccuccaggugaucacgaagaacagugaacccgagacguucuuuaacacgcugaaggaggcaauuuaggagaagaauuugcuuucaaagcugaaauguaggaaugcuagggaacuagauuaaaagguuacuaaaauauucuuggagccuguuuuggcugcucauugugguuaccauuauuauuacucugucaauccccaaaguuuguuuugauugcuuaccuucuuagccuauuauuauaaauaauaaugauaauaauaauaaauaauaauugcauauuucuuugguaguuuuauaaaggugugggagcuauuucagauguuggauuagagcgcccgucucccaaauaguagugauaaugaugcagggaccuucacaucuuauaguuaguucccuuucuuaguagaguucuucaggguuuuuccuugcucugcacucccucucccgauaugcagaauaaauuacuugcucacccauaucuccauaguacaguacgcauacugguuauggcauauggcagaguaggaaagugccaaguuuuaaaaaaacuuuagagggggcgguggaggggagaaaaucagauuuauuaagugcacugcaaggggcagcaggcugggcuguaacaagagcuccaccuaccuaaaauacccuuuaaauaaaaaauaugcauaacaguaaucauugcuucugcuugaaaugacagaucaguaguguuuacuagucucacauggaugcacaccagagcucuagaacuuucccagcuuauaaaccugaaugaaacucgauccaccgaguaacuccucaggccccuccccagcuacccacccuucugcucugucuugcugugagcuugaccaaaagcccugaagguuuaucugagucauaccauaugguagaauuuccuugggaaagacuggauuuugagguaagauggaccugaguugaauccuaguuccagccuguguuagccagugccccuaggcuaaaucagucucuucagaucccaguuuuauuauuucuaaagugguaguaaugacaucugucccguaagguuguuaggcgugucaggugaaacaguaggucuagaaagguuagccaguguaccaaauacuggcuauuugauaaauaguugcucuuagcuaauuaguaauuagacuggacuuuuugagagagugccuuaauuuucuuuguaucuucagagcgucagaccaugccaagcacuugauaggaaggauuuaggaaacuauuugaguuggaauauuguguccucagucugugucugucguagucacucuccaguagucccagcuuuaaaguguucuagagucaggucaccugugauuugaaaccuggcucugguacauucuugcuuuauugucuuuggaaaaguuauuuacuaucuguuucuuuaucuguaaaauagagaucaucacaggaccuaaccucuuaagauuaugaugaagaaaaaugaguuuuuauaagaaaaccuugaaaauaguagccgaaguauaaugagugugcagaaaggucgccuuuuauuauuuuaacaaauacucuauguucugauggcucuuaagucuuuauuuccauuucugagucuuucuuuugcucuacguggguagguauuucuaaucaccuguucugaauuuccauguaaaugacuaaugggcaacuccaguuuaauauguagagccuggugugguggcgcacaccuuuaauuccagcacucccgaggaagaggcaggcuaauuucugaguucaaggccagccuggucuacagagugaguuccaggacagccagggcuacacagagaaacccugucucaaaaaaccaaaaaagaaaaaaaaaauuaauguguagaaaaucagaaucuuggguuccucuuccaccagacccuauguucccucugucuuucccuuuucuauaaguaggaaaagaccguaagucacaggauuuagagugggcuaguccuacuuugguuuuuauuugccuugucuuccuauccuuucucugaccucugugaagguaauaaauaugccaagauacucuaacuuuuuuuuuuuuugagacaggguuucucuguguagcucuggcuguccuggaacuuacucuguagaccaggcuggccuugaacucagaaauccaccugccucugccucccgagugcugggacuaaaggcgugcgccaccacgcccggcgauacucuguaacuuauugaugccuucauauucauuuguacauuugauccugaaagcaaauugggucucauaaguccucugagugaagccccagcugcuuuccgugcugcagagucagaucugcuuccugucugacagggauacagauuucugcaaggccaguggaguugagggagggauagacugaguaaacuguggcacuaggacagugcaccuggacauuccgugcauggccgccauccccagguagccuguagccugggguugguagucuuggcuaugggaucccuuccgcuccccaggcgcuacuguugcaucuguuaugaucacuguagauuucccuggguuuucuuucuacuuguuucuuuagauccucuuuccccuccuucccaucccccuccauuucuguguguugcugggagucaaacuuggggccugguauacgcuaggcaaacacucucccauaaccccccuccccacuuuaauuuuuuuuuccuucuguagguacuguuuguuuuagucuuacucuaacuaggguuugaaaccuagugguuuaaguaaacuuuucuuuccugguaaaggcaauuugaaacugaggauaccuuggaaagcagguuuucuccauaugguaucugccagcugguaccuaccgcugauaacucucagcauuugggaagcagaggcaggaggacuguugacugcucaaaggccaaguuggucuacauagugaguucuaggccagccaggauuacauagagagauccugacucaaaagcuaucccccuucuccauagguaggggagagggaagagagagaagaagaaaggaagacagaagaccauccuggcugacucaagucccagaaauguauaaauucuguucauuucaguggguagcauuuguacccacaaacccuaagaugaaaccacacaaacaccauugcauaggauacaaauagucaaugguuaauauuuguuuuagacugcccuaacaauguauuuaaucuuuauuaauaauccuuugaaaugucuguuugccugcacuuugcuauuuuaagauauuagcugucuuagacuuagacuuaaacaaagaagauauacauuuguuuucacagaaaucugcuuuuauuuuaaagagaaaacaauaaagacagucaaugaaaauugugaaugucuggaaaugucacauugacuaaacaggcagacagagaagggaacccgauguaagagaugaucacuccuguaaacugucaaaccacaaguaccugaagagaaagccccagaugacaccugccaguaacucagcucugacgagccugagugguggcucuuucaucccagggcucugcuacuugcaaggaaaacaaaggggaaaugauuauuuuauuuauuauauuuugagacaggaucucuguguagcucagcugggccuagguagccucugacuaauggcgcacauccuacccggccugcaaagcacucggauuaauuauaggcacaagucaccaugcuugacguacuuuagauaaaugucuaguaagccaaugcuuagagcuccuucugaaauuggguguucggacguggcuggcucucugggacucaugaggcccuuccagacuacagccuugcccugcccaacucuucacccuacucaauucucccaaggccacaguguagcugcagcuaugcaggaggaagacccaagaagccagugagccaggcuuucuaacuaacuuguuucuuucugaagcuguuucuuccaauuugaugauaucuauuuuccuccucauguaaaagauuagcaucuauacgucauuugucucugccauucucccaguauaucaggucuggcuguugguaucaaguaguuccauucugcugcugauguaauuacuguuuauauagagccauguaugucuaacaguuacugccuuaauauaguuuuccuugauauuaaaaguaguuuuguuguuuuuaguugauguacaaaugcauacauaguaaaauuugcuuuucuuuuuuucauguuggagacuaaacccuggccucacgugugcugagcguguauuauauaccauugggaagcauguuuagugugugauuuauggggcuugacagguguauguagccacgugcucaccacugaagcuagaaucuagaaagucucuuuucagccagcuuauuuccaugaucauuccucuugcccaccuuuuccuacuggaaucccgcugugugugcugcuccccacguucaucacugcgacugacauggcugggaaaaugacaucuuuaugagaugucacauaccauguggagccuucuaacugcaugcuuucacguuugcccugcgcucucuuugaccccaauucuaaaacuugguguuuuguuugacuuuuuaaguuuuccagccucuucuugguugaauucuuggaacuuuacuucaucaaguucaggguauuguacucuguuuuuuacugccuuuucuguguuuuagaccuuguuuccuaagucuguaucuaccuuuucugggaacgcacucuguaguagacuccaggaaagagcauacaaacaguaauuuuuuucauguuuacauauucaaaaccacuuuuuauuguguuacuuguauaucaggucucauucugaguuauauauauauuuuuaauuguaaauaauaauguuccaucuuugagcaaauacauucuuuuuuuuuuuuuauuuuucgagacaggguuucucuguguagcucuggcuguccuggaacucacucuguagaccaggcuggccucgaacucagaaauccaccugccucugccucccgagugcugggauuaaaggcgugcgccaccaugcccagcgagcaaauacauucuuuuaagccacauuuuguuuuuagacucauuccugaagaugguuuuuuugcuuuggccugcuauucuaucaguggaagacaauuagggcauuuuauuuuugagaaauaaaauggauucuucuaguuuggggacuauuaugaauaauguugacaugaacacuuggucguguauuuuguauauauuugugucaccuggaggauauaauuuuaguuuucuuuuuucccuuagguguuuaaugguauaaucaccauagguuuaguuuauggugaauuaaugaaguaaacucccuuucagaaguuuauuggcaaauuuuggacacccccuuuugugaaucaccuauucaaauauuuuguacauuuuuguuauuauuauuuuucuuuuagaaauuuuacguguaugaguguuuuaccuguacgaacgucucuauguagcaugugcaugcuggugccugaugaaguuggaagaaggcaucagaucgcuuguaauuggcacuacagauugugagccaccauguggguggugggaacugaaccugaauccucuggaaagucaccaguguucuuuaccacugagccaucucuccagacucuguuuuaaucuuuacuuaacuagagauuuuugacuuuuuuugaaauaggguuucacuauaucuuuggcuagccuggaauuuuguauguaaaccaggcuagccucaaauucacagagauccaucuucugucuccugagugcugggguuaaaggcaugugccaucacauccagcuggauauauguaccuuuugaagagaugucuugcagauauuuucuuucguucuaugucuccuuuuuaaucuauaaaaauauuuugaugagcuagucauagaagaggcagaggcagacagaucuuuugaguuccagguuagccuggucuccguaguuccaggccagccagugugcuacauagugagacccucaccucaaaaaaacaacaaaaagaucuguugguaaauauaaaugcuuaguuuuaucgauuugcucuagcauuuagcugugcaucuuccgagacuggcacgucuguguucauaaggugcucaucucuggacauaauucuuuauuuacucauuugugagacaaauguugccaugcagccauugccagccuugaacucguggcaguccuauggcuucagccuguugagugcuaggauuaccaaucuguaucaucagccuggcccucugguagugccuuuugcuuugaguuucuugcugaugauaaguuacaccaccuuccuucuggugugugugugcuuuuacaccgaguauuauuucccagucuguuauguucaggcuugcuuaaauguuuuucuggcaggcagcauaguauacuuuguuuuuaaauuuuacuauacuaauugacauuuagggauuuaaauguauuuaauaugaugcuuguuuuucaaaugucauauugguucuguguuccuuauugggcuuccuuaauauaauuuguguguguguguguuguugggugagugcaggcacauguaugcauaguguguguauguaagucagaaagcagccguggaugccaaucuucagaugcccucuuucuuuguuugaagcacaggcucucauuggcuugaccuucaccacauagccagacuaccuggccugcgagcgucuagggaucugccuuauccucgucuguuucuggggguuauagguguaucccagcaugccuggcuuuuuuaaaauaugagucaguucuggagaucuaaacucagauccucacacuuguaagacaagagaguuagagacagagcuaucuccccaguccuugauguuuuuuuuuuuuaauuuaaauuuuauugagacuuaaaacaaccaaauuuacucaugcuucuaacccaauaccuggaaaggggaaguagagggaucaggaguuugaggcugucucaaaaaccacagugaaauuaccaguuguaaauuuucauuucagugguucguagcuguuuguuguuugcuuguuuugcaaauuaaggcgcuggagagguggcuuagugcuaagggcacuuagugcucaggagguggcuucaguuccuaacacccauguggcagcuacaaccaucuguacauaacuccauuucuaggggauucaaagccuacagaccucugcaggcacagaugugaugcacauauaugcagggaaacacccauacauaaaacauuuuauguuuucccaagacauaauaauaagauauuaaguaaaaaaaaauacuuuuagaaaauuaugcaacugucaccaaaauaguuuuggggcuuucugucacuuuaacgguucgcuuauauacauuauuuagucuucauaacagcuuuguuaaaguguuggcuuacuacacacgccccauuuaagucaccaaucaguagcuguuuauacaaagcuacauuuaccacaaaccaguguuuuagaacauuuccucacaaaacaaaucaaaaacaaucaaaaagaacuugauuauggucuguagggagcguagcaugcauuuaaucucagaacuuggaaggucaaagcaggaaggucagaguucagggccauccucagccacauagaaaguuuguggugagcauggguuacaggcucaaacccaaacccaaacccacccugugccuacagcggcuacuuuccaguuacugucucugguccuuggcagcagcuagucuuauuuauugaccaucucuuuggauuggcuuauucugaauauuuuuguauuaaauagaaucaaacaacauguggccuuuugugucugauuucuuucauuuagaauacuaagccucaagauuuaucuguuauuaguaucacuucuugccaaauaauauuccaucauauggauauccuauauuuuauuugucuguuuaccgguuaggugcgcucaaguuucuacuuuugcuuacuaagauaaaugcuguugucuuugugggcaacacuucuguggacauuugcuggguuauaugauaauucugggguguguguauguguguguguguguguguguguguguguguguguguguguguguguguguguguguguugcuagggaucugcuaggcaaguuucaccacugagguuuugaaacugagucuggcuaagugacucauguaggccucaaucagcgugauccuccugccacccuaccuucugaguagugaaguuagagucgcacuccauucuuccuggcuguauauugaacuuuucaguacuugcucaacugugacugccauuuuucauuuuuaccuggagagaaagagaguuccaguuuccccaguuccccagacaccaccaccaccaccaccucuucuucuccuccuccuccuccuccuccuccuccuccugcugcugcugcugcugcugcugcugcugcugcuucuucuucuucuucuucuucuucuucuucuucuucuucuucuucuucuucuucuucuucuucuucuucuucuucuucuucuuucuuccucuucuucucccccuccuccucccccucccucuucucucuucucuucucuucucuucucuucucuucucuucucuucucuucucuucucuucucuucucuucucuucucuucucuucucuucucuucucuucucuucucuuuucauuuucuguuuuauuuuauuuuuuuccaagacagaguuucuuuguguaacagccaggaacucauuuguagaccaggcuguccucaaauuuacagaggccucucuguuuccugagugccaugauuaaaggcgugcgccaccacccagcuucccaaacacuuccuucugucuuugugauuauggcccugacuggcgugccauagcuuauuguggauuugauugcuuuuccucugcggacacuggcacuggucauuugucacgcauuuccuggccaucugucuauuaccuuugucuauuaccuugucuguuuagggauuuugcccacuuuuaucugcacaucuucuaucguagauaguuacgucaacauuuucucuucuccucccgugacucuugauugugccauucaaagacugguccaguuaauuuaauaaaaguuuggucauagaguuguucacagaauuacuuuguuguuaaugucccugggaucaguaauaaugacccccauguauuuccagcauuaguaauuuguauccuuuuucuugguuaauuagccaggcuagaguuuauugauucuauuuuucuuuauagauucaauuuuuaauuaauuuuuuuucuguacagauuuccuguuuuuguaauuuaaucguuccuuuuuuucuuuuucuccuuucuuuuugucuuugggggagguccuuuugagaccauguuuuguucagucaguccucaggcuggugucaagcucaggucugugguuugaccucagccagcaagugcccgagguugcaaaagucagcuugaauccacuguucugcucucguuucauuucucucucucucucuccucugcuugcucuagacuuaaguuguucccuucuuucuuugacguguuacgguaggagcucaggcuguggacuagagcuguuucuucuuuccuaacacauguguuuaguacagauuuugccauacuuacaaacuuugauaauuuaucuuucauuuagcucagaauauuuuuacauucucuucaggcucauuugacucaguuauuuagaaugguuguuucaucuccaaauaccuuagacuguucaacuguucucuucauuguuuguggcuucuagacacaguacauggugguuugagaacacuuuauauaguugccuacaguugcuacuuuuuuuuuuuuuuacuuuugucugcauuuauuuuaugccaaauuuauuccagugccaugcguuuuuguuucuucaguuucuuuuuggauauuuuuuuucuuccgugcaaacuccucuuuuggcuuuggaacaaucuguuccuucucagugaggaucaucucacuguggcagggggagcucauggauggguuaaucuggccaugagcucugugggugucuuggcgcauuuuaggugacuuucuuguucaccuggauauguucgaugagcagacaaucuacaucuaaacccaagcucagcguuucuuucugcaguuuaagcaugugcagcagaaauucagcacuuuggccugggcacacacacugacuucaccauuauacuggcacacacaguuucauucaagugacauccuucagacguguguuggcuuuguggauaugcuuacccuugauggccugggcagcuucccggguguuuuaaaagugaacacggagguuugaaccucuugauuugcaugauuuugugagguuuucugggucaagagaguagcaaccaucuuuacaggugaccucugacugcuuacaggaagagccagcugcuacuuuuggaacuugccaaggugugcuuuguggccaaggauguggguuguucaugugacuuugagaauaguauguguuccucuguuguuagauuaaagaaguugcaaaugucagaccuaguuaauugaugguggcaauaaugucaaccuuguccuuacugauuuucugucuuguugaggauucaugaaguucaaaaauucaucaguuucuuuugguaguucuucgagguuuugcuuccuauauuuugguaagcuacuguucaguacacauauguuaagaacuaccaugucaucuuagagaguuggccccuuaacauucugucauggccuucuuuauuccuaacaguucucccuuuucugaacuguugucugaaacgucauacuacucuuuaagcuuucuuuuaguguuaacaugacuucuuuuucuccaugccuuuuacuuuauuguuuuuuaaagaucuaucuuauguguaugaauguuuuguuuguacauauguguguguguguguguguguguguguguguguguguuuguguacuaccugcaugcauggugcccauggaagucagaagagggcaucagaugguugugaucugccuuacgugugcugggaaccaaacuuagggccucuagaagaugaguaaguguuuagucauugaguuucucucugcauuccuguuuauuguuguuuugagacagagucuccuguagcccucacuagcauugaacucacuagguaacugaggcuggccuugaacuucuccugaccuuucugccucuaccucugaaguaauggguuuacagauaugugcuaccaugugggacucugucccuauacuuuuaaccgauacauaaugucauauuuaaaguaguucuuuuuaaaaaaagauguauuuuauuauuuugcuuaggaguauuuguauaaguuuguguuggguguguacauauaaagcaggcacuggaggaggccagagcaguagaacccccuggaacuagaguuaguggugguuguaaguugccugauauuggugcugggaauugaacuugggucuucugcaagagugguacaggcaccuaaccaugagccaucucucuagucaugaaagggguuuucuuggacaacauauaguuggcuuuuuucuccucuuauaacacugacauauauauuacuauauuuuacucauagacuuuuuuguuuuguuuuguuuuucgagacaggguuucucuguauagcccuggcuguccuggaacucacuuuguagaccauacucauagaccuuuaauugauacuguuucuaauuaucuuguaaaccugguaugcagucauuggugcguuugaccaugcacagacuugugcagcgguuagugacgugagaggguagauucuaccacaugcacagcugcauuguauuuguuuucuuaaccuuccauuuuuuuuuucuguggaugaauugagcauuauaugauuguacugacucuucuuuuagugaauuaucaauauuucucucuguguguauauacgguuuauguacuuuuguagguguuguauucccgugugugggcaugaauguguggagacuaaagguugaucucaggucugccugcuuugacacuuuucacuuguuuuguuuguuuguuuguuuguuuucuuuuugcgacacagccucucccucgacuuggugcucaucuauucagcuagucuggggaccacugaggcccagugcugggguuacagccauaugcugcuacaccugacuuucagugggugcugggaucugaacucagguccuugugcuugugguagcagacaguuuacugagggagccauguuuccagucccagucauugguuuuaaaagucauuuuuagcugggcauaugcuuauaucguaaucucagaaauccaggggcugaaguggaagauugcugcuaguuugaggcuaaccuaggcuuuaaaagggguguguauggugcuauauagugguuuguuuguauuguuugcccugaaguuuggagcauuucuaacagucaggcaguguuuguggguagaacaagcauuccaguccccugucguuucugauauugcugacauucgggucauaaucuaaaaaaaguuaauuuguauccauuugcuucaucagcccucuuuguguauaguguacagacauuacaagagacagguagccacagagauucucuaugguaucaguuuccuugucucuaaagagcuaccucucauauuucccauaggaaaggucaaguuuugucugagaaaauucauguuuuccuuuacuuucaaaagguaacaucacugaauucaguaguuggugugauuuuuuuaaccccucccuuuuuuuguuuuuuuguuuuuuugagacaggguuucucuguagcccuggcuguccugaacucacuuuguagaccaggcuggccucgaacucagaaauccaccugccucugccucccaagugcugggauuaaaggugugcgucaccaugcccggcuuaacccccuuuucuaugcuuuaaauuuuuuuucuguaugccugggguguguauguguguguacaagcgcacaugugaguguguguguacgcgagcacgugugcaccugccuguguauaugugcaggugcagugaacaaauaugugucgguagaugacaggagccucaguuguuucucaggcgcuucauguccuuguuuuuggagacagggucucucuuucucauugacuggaacucuccgagucggccagucuggccaaccaaccagucagccgggaacccucccgucuccagcucuucagcucugcauuuacaagaaugcccaccacauuggcuuuuuaaacuuuucuucuuuuaagaagguucuggagacugaacuuguauccucauacuugcaagcacauauuuuuuacuuagagguauucacuuauacuauaguaacauuuguugaggaaauuauccuaugguuugacauuacuguuugacgagacuguuaauccagucuugauugguguugacaugugaugaacuuacaaaucagcaauucaggauuacaaaacuugcaaccucaacacuguuuuuggcucuucugggucccugggauucccauaugagaguuaguaguaaauuaccaauuucuacagugaagacaagggggcuuugguaggaauuacaucagaucaacagcauagagcuauugcuguagaacaaugagcaguauggaagguacugucgugucagugagaucacugccuggacaugaggugcuuuuccaugguucuugguuuuguuuguuuguuuguuugguuguuguuguuguuguuuuaauaaugaaugauucuucuuuuuuaaaagauuuauuuauuauauguaaguacacuguagcugucuccagaagaggguaucagaucucauuacagaugguugugagucaccaugugguugcugggauuugaacucaggaccuuaggaagaacaguuggugcuguuaaccgcugagcggucucucuagccuguuuuuuuuuguuuuuguuuuuguuuuuguuuugacaaguucucacaguauaacucagccuggccuugguugagauccuucugccuugguguucugagcauccuuuaauaucuuuuaacaguguugaauuuaacaguguuuaauuuuguuuuugagacaguauuucucuguguaacagagcccuggcuguccuggaacucacuuuuuagaccaggcuguccuugaguguguuugccaccaugcugggcaaauaucuuauuuuuaaugcuacuauaaaguguaauugaugaucaggaucauguuauccacacauagaguguuccguauuuccaguucaagucucuuauuuauuuuucuugcccaauuguucacauuuauguuccuaguacauuguuaaaugcaguugguaagaguggacaucuuuaggucuuuuuucuucuugauguuaguaggaaaacauucgucuuuacuaguuagcaugguguuaguuuguaaauacuuuuagcugauugagacagcucuguucugcuucuagugugugcagaguguuaaucauggaaacauguuuggcuguugccauuuuucauuaugucuuuugacauagaccaaaaaaaauguccugaggauguccuguaggcuguugguuuucuguauguaauaguugguauguugaauuauuucugcuugcuuuugcuauauauguugcuaggauuuuguguguguguguguguguguguuuguuuuguuuugcaucuauauugguaagagagacugaccugcaguuuucuugugguauuuuugucuagauugguuaccagaauacuagccucacuauuuugaggagucugggugcuuguguuaguucuucuuuaaauguuugguacuaugugaagccuucagucuggaucuaggcuucuuuucuggaggucuuaguuguugcuaugugaaucaucacuaagucagcuucucggguguuccaggccugccugcugcucugucagucucacagccuguguucucccagucauuuccuuuagcuaucucgacuguugacauauggucaucuucaguacuugccuagagucucuucugcucuggucacugguggugguauucucucauucauuccagaguuuaauaauccuagccaguuguuagaagcugucguuaaacgcuuaucuguucauuggccucuccagaaaaucuugaaaugaagguguugucaauguuuguauaguuuucugcuuuuaguuuauuuuguuucugcugcccuguuuuauuuugcugagcuuauuuccccuaguuucucaugggagauaauuagcuugugauucccguuuauaauacuguuuaggauucucucgugcagauacucuguaggaauuacuuccgcagggucucagcuguagauuugcuucuugcuuuguguaaagaaaggaaagaaguuuuuaucuuuuuuuuuuaauuuuuuuuuuauuuuuaacuuacauugauuuugagccuaaacacuauauauaacauugcugcuauccagacauuuuuguuguaagucuuauuuccuguguuucgcccuaaggaaaagcauucuuuugagcacucucuguuacccccucaugccaucaucuaaaacacaguguagauagaauuaugagacuuguucauugcaucauggggcauguguauucagacaagcccaacauuauuaaagguuuguuugcuccaugcagacuguaacuagauacuuuugauuugauuggaccacaaaaguuuugugucugguguucguaauguggaaaugaccuuauaauccacucacguucugucauugugcggguguucucguugauaccuucagacauuuacucagccccugcuuugugcaagaacucugcaguugaaugggagagagagugugagugugugugugugugugugugugugugugugugugugugugugugugugagugaguguuuucuuaguuuggugucugcucugggguaguugugauccagagagggaaagggguggaugaacuagaagcuaugugcaguagguuaaaauaugugauaaaugaaguccuugaguagggaggggcccuaaggcccuaggaaggagagaggaaagccaacuaaaguuucuagcaguuggccuguauguaaaaaaaaaaguuuuauuuauuuguuuguuugucuaugugaaugcuugccacacgugugggugcaggcagagacuggaaggaggauguuaaauucuuugaacuggaguuauuugugguuguagcugcccagccaugugugcugggaaccaaauuugagucuucuguaaggauaggaaaugcucuuaaccauugagccaucucucauccccugccuugaucaaucuguccaucuguguaucuauccauccacccacuuauugcuuuguuuugaagcaggucucuauagucuaagcugaccuagagcucacuuuguaguucaggauuuuuaaaaguucuuuuauagacauagcagcucgcagcugucuguaacuccaguucuuggagaucuggcgcccucuucuggccuccaugggcaccaggcaaaaguuguguacagaccuacauguagguacaacacccauacacauaaaauaaacaauaacuuaaaauucuaauaaaaaguuucuuuaaauauuuaaguaagaguguguguguguguguguguguguguguguguguguguguguguguauacuccugugcuguagugugccugugggggucagaggacgguaugugguguuaauaagucccuuccuccccuuuacauggguuccaggagucaggcagguuaucaggcuaguguaguaagcagccuuacccacuggguggucuugcuggcccuuauugacugcuguuugaaggaaaguagcauuucagauagaaaagccugggggagagccucugggcaggggagaucaaguagagaaaacacagcugaauuuggagucuugagugugcacuggggaaagcguagacugacaaguaggguucagagcaguccuaugucaggagcagggcguaggcuacagcuuuauuugcugggguccuuggcuguuugggagucagcugcucucuuuaccaaaacuucuuccuugacaauaaaauauuucuuuguuuuuauuuuuuauucacaguucacugagaccuuuuugaccgagagggacaaauuguccaaauggaguggaauuccucaguugcuccuuaagcuguaugccaccagccaucugcacagugacuucguugagugccaaagcauucucaagguaacugauggggccuuagagggucugugcucagggucuucagaugcccccacuauugaccuuuuagaaauagccagcuuuuguaugagcuguaggacacuggagaaguuuggaaacguuaaaagaagaaaauaaucacuaguuauuccagugcccagggauuugauuguuucccucacccacuccuccugugaugcuagggacugaacgcagggccuugcacaugugaggcuggaauugggcccugagccccuauccccacuccuaucccuagauggcauucuuuuugaaaagaauuuuaaaggcccuauaucacugaaggcucuugggaggagcuuuauggcugucaauaauuaucauuaaugcaagauugaaguuggacugcuggucagguugagaguuagacgcuuguuuuccaacuugagugcugucucggugcuggcccacacucauugcuucugacuugggacugggaucaaacacgaauuuagagaagcaacuggagccacaguuguaaccuguguaagccuguagucauaacaacacugaauacuacgguacucuucagaggcaaaguguugaugacuguaucucacagguuuauucuaaccuugcuuauuaaauaaacguaguuguucccuuuaggaagagauauuacauacucauccuuucacagucugauagaaguaauuauagccuuccuaugugccuuaaaaugcuuuaaucccaacauuuaggagaccagaggcagauggaucucugaguacaagguugucuauccucuacuauguaguuaguuccagguuagugagggauuaucucucaaaaacaaaacaaaacaaaaacaacaacaacaaaaacuaaagguuuuuuccaaaaaccugccaaauuucuguuacagaacugagguaaaacugaaggcuugggaaaauaauauccuagugaccuuggugugugguacacuuuauucauucugcaaacacuugaaaccgcaguguuccaggagaguucuuucugucuguuacugccuuuuaugagcaaaggaugcuaugcccuucccagagcuugagagccaaugcaggcaccuacaguggugacuccuccucugccuuaagacucagaggaggaaauacaaagaagaaucuguccaaauguucaggggcuucaguuugucuucagggaacacugauucagucuaggggauaaaacucuaggcuuauaaauaguuacaaagucaagugccagauguuacaaguagcauaaagagaucccuuuggguggcuauggaagaccauaagaaugccuuugacauggagaagucaccaaacauuucugucaggagaucacaguccaacagagauuguuaugaccgcagaaccaguuguuucuugcaauaccuggugacaucagguagcugccccaucuucucucagcagcucucagugaaccagaaguucaucugcuucuuggaguauuuauuguagggccuaaagauguuugcacuguccaaaaugaccuuccugguacccuggcaagcugcugcuggaaaugagccaaggauacacagccuagcuuuccccagccagcugcugagcuuucccagcaugacagugcggguucuagcccuuccuuaaggcugaugucuaagcgugcugugucacagcagccagaguccaugggaaaaaaggacuccaagggucccggauacuucauugagggcuagcuuuguucagggggggauugaguuuguuacuaaaaugaauauuauagugauauuuuagugucuucuguuaaauucuaaaauggaaucugucuguacuuuuuuugaaccaggagauuucuccucuucucucuauggaggcuauggcguuuguaacugaagacaggaaauuuacucaagaagcuacauacccaaauacauauauuuuugacuuauuuggagguguugauguaaguagcuguuuaaugcuauuaauacuuaagucauugaaaauuuaaaacaagaggcaagaagaauuucagauuuauagcaaauauuucagaugguuuaaccuaaaaaaaacaaacccguuuuguuuuguuuuguuuuguuuuguuuuguuuuguuuuguuuuguuuugagacauggucucacugugcugcccuggcuguccuggauaucucuguguagaccaggcuggccucgaacucccagggauuuauuugccucugccucccgagugcugagaucaaagcugugugucaccaccaccagcuuaacuuaaacuuuuaauuuauaaaauguacucuacauuuaugaauucuccccucuugaggcugguucuuacacagugugaguucuuucagccuaggccgucagcgugauggcgugcgccuuacuuccccuguugagcauuuuucuggucuggaucuuaacuuugaggucaaugcauucucuuauguugaagcacuguaguauuugcuuugaaagaauuuauuugaaguacuaaagcguacagagugaaaggugucccaguguuguccuuggaagcugcugugaucacuaggucuuguguguaccagagcuguuuuugguuuagaugcgugugcgugugcgugugcgugugcucccauccccagcuucgugucuuuucuccucacacauacuggcaagucauauauccaagaugcucucuucuaccuugcuuuuuccccaugcauaccuaaauauuccauauuuuaaauaucuaguuaguauuuccugguguaauuauaguuuacuuguucauaguuuacuugcucagacuccaguugaacauuuaguuuuuucacuuuuuuuuuuuaaauuacaaacaagauugccaaagaacuuuuuacagacuuuuggagccuaaauauuuaucucuuuuauuuauuaaucugcaacuuauaccaacuuuuacaaacuuaaaucccaggaacaaauuacaaaagugucuuuuuaccuauaccaucacaaacauacuguauauauguguguacuuuuaaaaaauuauuucuuuugggcuagagagauaucacaguaguuaagagcacugguugcucuucuagaggaccuagguucaauucccaggacccacaugggagcucacaacuguauguaucuccaguuccagggggucugauccccucacacagacauacauacaugcaggcaaaguaccacuacacaugaaauaaaaauaaguaaaauuuuaaaaauuuuuauuuuuuuaaauuauaaaguaauuacauaauuucucccaucugcauauuuuuaaaaagcucacacauauuaaauaaauaaauaaaucccuuuaaaaaaaaccuuuaaaaaauaaaaacaaaagaaacaagagcuuuuuuauuuaaagauguauuuauucauuaaauguauaugaguacacuguugcugucuucagacacaccagaaaagggcaucuggucccaucacagaaaguugugagccaccaugugguugcugggaauugaacucaggaccucuagaggaucggucagugcucuuaacugcugagccaucucuccagcccugaaacaagcuuuuuuuuuuuuuaaagauuuauuuauuuauuauauguaaguacacuguagcugucuucagacacaccagaagagggcaucagaucucuguuacaggugguugugagccaccaugugguugcugggauuugaacuucggaccuuuggaagagcagucgggugcucuuacccccugagccaucucaccagccccugaaacaagcuuuuaaaagugcugagggaucuuuuuccucccacuuggcucaagguaucccggauaugcuguccacuacuggcacguggcuggaaaggaccaggagaacaguuuuguucuguuccaaaacucuucuuaauuugauuuaaacaauaaaauaaaguaaaauaccuauuuaugguaaaugucuuuaaauacauggacuuagauauuuuguuagcacaaaggcuacuuuaaaauacuucaauauauuuaaguagaaaguaggcuggaggugaacauuuguaauuccaguacuugggaggcugaaggaucaugaguuggauggaggcuagccugggcuauucaucuagacugugucucaaagacaacaaaaauacugaaauagaaagcaauuguauucaauaaugaaaacccguguuauaaagauucuucagagaugcuccuuaguugcguagagacacucagggauaaagaguguucacacuccuuuggaggauucauauucuguguccagcacccaaauggugugguaagucacagccucuguaacuaacuccagucccagagaacacagugcccccuucuggccuucgaagauuccuaacucuggccagaaugcugcuucuauugaaccuuaccuagaacaagggggcuuguggcagcuccuuagacuagacacguguacucauaguaaaaauggcuuuguaagcugugccuuugaauuaauuaauuuauuuauuuauuaauuuauuuauuugguuuucagcuucuuguagaaauucuuaugaggccuaccaucucuauccggggacagaaacuaaaaaguaaguaugauuguuaggcacuggccuucaccucagugugccagugugguggccauuggcaggaguugcucuuuuuugagauauaagaacaugucuuccagucagcuguaaguugcucuuuucauuccaagcuaagcagcauacuauuaacuuaauauuuguuagaaaggaagaaaagaguugcugucuuuaagaaaaagcugaaggccacugcuuuacaagaguugcaucucuugaccccgccuccguuuucuugggagguuuuuaugcugcguguguaguuaccugagaaagcaggggacaccuaggcagaccccgcuguuugagcagcccaucaaccguagccaucuuuauaaaggagguucaugcuuuuguauaaaggucagccauauuggauggggugugcagcuccucuguaccaacucugacucgucuacguagugcguuccaggacacagggagcuacccaggacccugucucuaaggaaauaaauaaaucaaugaaaaaaacaaguucauucauugccagagucacauggcaaaaagucaguguuugcacaauacgugguuuuuugguuuuugggguuuuuuugguuuguuuguuuuuguuuguuuguuuccgagacaggguuucucuguguagcccuggcuauccuagaacucacuuuguagaccaggcuggccuugaacucagaaauccgccugccucugccucccaggugcugggauuaaaggcgugcaccaccacgcccggaaauacaugauuuuuuaagcuggauguauugguuuuguucuuuuuauaaauuaauugugugacagucacucuuuuuuagguuucuuuuuuuuuuaagauuuauuuauuuaauuauaugaguacacuguagcuaucuucagacacaccagaagagggcauccgaacccauuauggaugguugugagcuaccaugugguugcugggaauugaacucaggaccucuggaagaagagucagugcucuuaaccacucagccaucucuccagccccuagauuucaauauuuuauuuuuaaaaacucuaccguaaagguauauacacauuuuaaauuugcaccugcaucaacaggauaccaugaggagugggacuucucuuccucuuuugcuugcaacuccacauuagaaaugaguagugaagccgggugugguggcacacgccuuuaaucccagcacucgggaggcagaggcagucggauuucugaauucgaggccagccuggucuacagagugaguuccaggucagccagggcuacacagagaaacccugucucgaaaagaaaaaagaaaaaagaaaaaagaaaagaagaaaugaguagugagcaaauucuugaugacugcgugagucuaacucccuuuggaaauggaaaguugagaacuaugaagugauuuugauccacugugcucugaaaucaugaauaagcaagauaaaauaaguugagagguagucagagggucaccacauuccucagacaggccgcucgcucacugggcucuugagggagaugcagauaguagagcuuaaggcagugaggaggaaggagaguggacacuguuuaagaguaagugccccaccacauagagcacucugcccugcauggcucauacgcggggucgugcccugcauggcucauucgugggguugugcaccucuggguuuggggcauaaaauuguuacuuuuugugcuaccaucuuguucugaguucuuuuuuuauugggauuggcaguauaucagacauuagaagccacuuuucuaauauaaaucaauguaacaacaaaccuaagcccccccccccccccccguuggcaaguuggaggcaaaagugaugccgugauuuucugccagcagaguugucagugggacaugaggaguggucagggucuuacucuggauucuaguaauucuguucugaaaauagaccugagucuuuuucugguggcacugcaguguagugaggagcucguguguuugcuuaaagcuguacacagucuaagggccugugcagugccugccuuccuagugcugggacugaaggcauacaacacaugccgggcauuccagaagugugcuaguguugcacuguguuuucuuugagaaaaauaauguuccuccuuccuuuucaguaagugacgagaugucgaaggacugcuugagcauccuguacaauaccugugucugcgugaguacuccucccauugcggcccacuuaccuccugucuucagauauuuuagggaauucauugccuuauuuucugugugccugagaaucaggaccagcagguagaaauaauggugaggcauaauuuuguaguacuuagacccaaagcuaccucagcaggccccacacccuguugccagcaccccauacacagguguccaagcagagacucaccauuaccaguugaaaggugacaaguguuggugguguacccaugucacagaagcaaaagaaauguuuaacucuguuccugcuaagaccacagaaugagaagcagauaagaaaggaauggauaaagaagaaguagauaagaaaggaauggauaaagaagaagcagauaagaaaggaauggauaaagaagggugggcgcauaagccacagaagcuggaugacagaaauggagaugguaaaugcuucucccuggccagcacagagagcgagcgagcgagcuguuagagcaccugugcugguugugucuggauuauaacuuaggcuuugucagugacucuacguuuccuuagagccacuuuauugaaauaggaaaaauaauuauuuugauaauauauuuuauuaacacaucuaguuaagaauauuaucauuccaaucaauauaguuuuuaagauaguuuacuuuuuugguaccacguuuuuggaaucuagugugagacucaacaccuagagugugugucaguuugccauguuguuacagcuuaguagcacagcaaagcacagguagauauuagggcgaaagguuuaauuguuaagaauguucaacuauuuuugcaauaagacagcauagaagagagugacuccaucauugucaaguucccuggagagguguuuuuuaaauuguggccacuauuaauuaaucagaggcauccuagugaacaguccaguuuuuaaaaguauagcuacagagauggcccugugguaacuccccaugcaagcguagggacccauuuugaucccagguaacagagcagaugugcugcuugccuguaaucgcggugccaggaggcagaggcaggcggguaccaggccugcuggcugccagccgagguuacuugcugaguucuagcccaguaagacacucagcacauuuuuuuaucagucccuucauuuugaaaauucaauuugauugacauauuuaccucauugauuguaauacccucucagugauuuaaaagccaagcucuugaaccugacuuuagagguuauuugccagcuaguuauuuuauuuccuucauuauccuuguuuuuuauucuacccuuuaaauaccguccauguucuaggcuuacuguagauagcagaggugcaaugauaaaugauagagugucuguuacacgacagcgcuggagggccauggauggggaaggaugcagacaggcagaggucaggugcuuugaggcuucagaggaggaaaagugcaaguguucugaguggguagggaugcuucacugaggagaaucaucuggauaggugaguugguaggcuugccuauucccaucuuuaacagaguguguguguguguguguguguguguguguguguaaguuggagaucaacuuguugaguggggcacuucuuccaccauguggguccaaggaucaaauuuggguuguugagucugguggcaagugccaccagagguaagucucugaaagacugucccugcagguaguguucauucauuugcaggacugucagugucagucacaagagugagucaguugacagcagaggagacuuaaagccuauugguucuccaagaucacuguggcuaagugagagaggcuuccuguauaggcaggguucacuguccucccucacuggagcccuccuagacuuaggagauaaccauguacaggugaagccauggaggucccggugagaagucauuugucagggucaccuagauggacucugcccucaguggucaugcuuugggcagugaguguguucaggccgaggcuccugcaggagccuugcaccgcccucuuaggaagcaucaccucacacgccugcuuguguucuagguggggcugcucacauuagucagcaggcuuuugucuggacgauugauucucuaaauggagcuauuagggccuuagauuuuaagccaucugaagcuguuaguugccuccugcuccacuccaccccccccaccccaccccauuccuagcuccaaauucggcucccuguuguauggucugaaggccaggaguuauuuuucacauauuugccacaguacacaugacuuccuagcuuuguuggcucaugcuaguuuuccaagaugggguuauuuucugcaucuggaauaguguucucuguuauggucacaagcuauucugccuuuucuccuuucucccugugacagacggaaggaguaacgaagcguuuggcagaaaagaaugauuuugugauuuuucuguucacacugaugacaaguaagaagacauucuuacaaacagcgacucucauugaagacauuuuggguguuaagaaggugagcugugcucugcugcugugggaggguguuuugggcacuggauuguugagccugguuuagacagggcuccuuucaaagaugcucuuccacucauaguguucugagauaggugagauauaaaguuagcuugugcuccuuaugccgcuggguuccauccauggcugugaaccauguaaguaaauauaagguaagucaaagaguaugaaacacaaaccucaccucgauguggugaauuuagugugauuuuuagcguuccuugcuaagaugaaauugcuccucauuaacauuaguggaacaaguuguucuuagcgugcuucugcuguuguguacuggcggggagugcucacaagccagcucucugauugagcuuuagauccgugugugcucccucuaguggcaauguuuggccuuugcuuacuuaaucuaccuuuauauuuucuuaccagccuucagcucaaguugguuaauuuccuuaaacauaagauauuguaaguucugauauccagccauucuuucuccuuccuguuuuguuuuuguuuuguuguuguuuuacaagacaggguuucucuguguagcccuggcugucuuggaacucacucuguagaccaggcuggccuugaauagagaucugccugccucugcuccugaaugcugggaauaaagcugugcacuaccaugacacuuacucuguagcucaucacagguuuaagggcaagagugagauauugucucaaaaaauagcaauaaaaagaugagaacauuauaguuuucucuucagaaacucacagacuuguaaaaauacacucauauacacuaugcuaaagucaugacagaagcucguuagggccucguuuacguucucgcuccucgccaugcuucucucccuguugauugccgauuggcagauuucuuaucauugcugcauagucucccggagguugcuguagcagaagggagaguacccacacacuguuacccagcuuucacuuaggccuugccugcuguuacccaggcagaagcaucacaagugucccauugucuguggggacauauucccaauguguccaguccccagacagucccuuugugcucuuugauaaaaugucuuuguuauuucccaagaaucaugugcucgguccagugugugagagcggcugucagugcaggaacccugugcucccuggcucucaggguuggagccagucauugcuccuucccagcucugccaaccugcucccucaagccuucuuauuccugucugugcuacccaaguaggugauagguuccaccacgcucuguaggugccuugauguuacauguguaacuaaaguggaaauggugccuacaauucgugcagcaaacagaggauucauauucagaauugauaaaaaauuccuacaaaucaaccugaaaaagacguagccuaguuaacaaaaggggaaauaggugagccauaaauaaauguuuggcuucauugaaagucagaaaaugcagaucuuuuuuuguugcuuuuguuuuuuguuuuucaagacaggguuucucuguguagucccggcuguccuggaacucauucuguagaccaggcuggccucgaacuccagagauccaccugccucugccucccaagugcugggauuaaaggcgugggacaccacugcccagccaggaaaugcagaucuuauccuguguguggugagagcagaucuuaaugaauguggaguguaaauacuugaauguguacaugcugugugccagcaccuagaggagcacugccccaagggcugaggucuuggugggcucugugugaccugugccucagcauaccuguagguaagugaucucagaaaugaaaacaugcagccagagagagccuagcagauauaaucaccugccaucaggccugagaaacugcguucaaucucugggaaacauaguagaggaagagaaccaacaaccgugaguugcccucugaccuccuuuugugcuauggcacacacacaccaauauauauacaaacaugauauauacacaugcucaacacacacacacguacgcacacauguacacaagccacauacauauacacauacacaaacauaugcacacauucauauacacacaaguauacccaacucucucucucucucucucucucucucucucucucucucucuauauauauauauauauauauauauacacacacacacacacacacauaauuauauaaaauguaauuagaaaaaagguuuuuuggcuuuuuauguuuuuguuauguuuguuugcuuguucuuagagacuagguuucuccauuuggcccuggcuuaucauggaacucacuguagaccaggcuggccucaaauucagagaucugccuaccucugccuucugagugcugggaucaaaggggugcagcaucacuacaccuggcuagaaaaauauucuaaaggaugugcaaacacucagggcagggcaguggcuuaggggauaaagcacugugguguaagcguggggacuggaguguccacagcagacacaaagcugaguggagaugacugugacaaagccagcuucagagcacugcaggcugugugccauuucauaucauuaacaaaauaaaacacaaaacuauuucauuauaaaguaauaguuuacaucugugacagaagcagaaagagaugauagggaagccacacacagugacaaagcccauuaugcuuuauaauguaucaaauguuaaauuagaaaaguuggugaggcugaguguaguguaacccauauucuggcacuggggaggggaaggcagggggauuacuggaagucuaaagcugacgcaggcuacguugugaguuuuaaaccagccuaaguuacagugggauaccccaucucauaagcaacaauaaaaagugggagugggguggugagacuugguuuuggacccccacccuggauuggacagggcuagaaggaugaaggagccaauagucauagccugagucagaugggcugggauuggaggagcugaaggagugugcugguaacaguagcugacgucagugugugcugaccggggagagaguagaggagcugcccccaggugguuucuccuccaucacugugucuagggaucguuugccuguuuagugcagucaugaggcuccuugcugccaggcgcugugcuguagaucccucccuguguagugucagauuacuugggaaauagauucaggacaaauaaugacaaguuucugugcagugauagaaaaauacccaggcuagugaaguuaaauggauugacagggaagagagagcaggugcuauccauagacuguuugaugguuuaaaacaaggaaagcuuuggaacauauauacagaugugaaggaaguaaaaccacgagacuacaaacaagcauuuuuauguauuuauuucacuuguaugucugugcaccaccugcaugcagugccugcagagacuagaagaagggauuagaucccccuagcuggaguuacagagguugugagcugccaugugccuggugguaauugaccggguccuaugggcgaguagccagugcugcuaaccaaugagcugucucuccaggccagaaagaaacauuaaaaagaaaaaaaaagauaaauaaauaaauuaaauagauuaaauaaauaaagcauuacaagguauauuaguaaaaaacaccugauauggacuccucagaaaguaaauuugaaguugauuugguuuauaguucugagccucaaaguucacacagcacagccugaguggcugugucaccucauggcaaauagcaacauggacuaugaagagagcugugaagagcaacuggguggcauaaaacucaggcuuuuuauaccuuucucccaugaguuauuuaggaaucccaggagaaccgccugcagcugcauaccccuaguuuccuaaggaucucuucagccucccaacaccuuucaguagcucuccuaagacccuaguucuccauguaugaaccugucaugagacugggcaggaggaaaauucuuuuacuugcuauagaagauguuaaaaguuacaguaaacguuaauuuuaagucuuuggagcuaugugugauaaagucaggagagaaguuguguccugagagcaugugcacaggagcaccucuguccugagugcaugugcacaggagcaccucuguccugagagcaugugcacaggagcaccucuguccugagagcaugugcacaggagcaccucuguccugagagcaugugcacaggagcaccucuguccugagagcaugugcacaggagcaccucuguccugagagcaugugcacaggagcaccucuguccugagugcaugugcacaggagcaccucuguccugagugcaugugcacaggagcaccucuguccugagagcaugugcacaggagcaccucuguccugagagcaugugcacaggagcaccucuguccugagagcaugugcacaggagcaccucuguccugagugcaugugcacaggagcaccucuguccugagugcaugugcacaggagcaccucuguccugagagcaugugcaaaggagcaccucuguccugagugcaugugcacaggagcaccucuguccugagugcaugugcacaggaccuaacaggacacucacugcgguuggagggagggcugcagugcacccagugcacagaggggagcagcgcuccauucggaaaagccacaacaaagaauuuggccuggggcugcuggucgaguuguguauaaaucucaguguggagucacaaggaagguuuauaucacaucacacacccaccgugauacggagguuaauggagguauuuaugaggacugacaaguaccugggaagaguaggcagauacaaguucaaaacaauggcuacuucugaaggaguaggagagaggagacugcaacuguaggacuucagaggccuuugacuaugaauuuuauuucuuuuuuaaaaaaaucaaucuaggaauagggucuguagcucaacuaguagagugcuugccugucuugugcaaagcucugggcuggguucccugcaccacgugaacuguacauagugcugcacaccuuuaucccggcacucaaaagguggaagcaggagaaucagaaacucaaguuaauccucacucacaguuuaucuauuaggggaacagugacucgugauuuauaaagcuugaauggagguuuuuuuuuuucuaauaagccgggcagugguggcacaugccuuuuuuuaaugauuuauuuauuauuuaucuuauauguaaguacacuguagcugucuucagacaaaccaggagaggaugguuguaagccaucaugugguugcugggauuugaacucagaaccuucggaagagcucuuaaccacugagccaucucuccagccccgaguuuuuuuuuuaaagggggcaaaauaugcuaccagaacacagguaaggcagugagaacaggcauaccuucaggguaaauggagccuccacacuaacugaacuaggggaguucuagucuguuacuaucaaagaaagaggagagauuccagaacuugacugagcuuugcagagcugggauuugaacucuaguggucucacugcugagccacaugggaggaugcaggagaacaugcauaauuuccugaauuaagcauggggauuguuuauuugugucuucuauaggaaaugauccggcuagaugaaguucccaaucugaguuccuuaguauccaauuucgaucagcagcagcuugcuaacuucugcaggauccuggcugucaccauuucagagauggacacggggaaugacgacaaacacacgcuucuugccaaaaaugcucagcagaagaagaguuugaguuuggggccuucugcagcugaaaucaaccaagguaaagagcucuuagcauuugcagaguguagcugaggcucuuacuacagcgccucucucuuuuuuguugcuguuauuuuacuuauucacauuauauccuccucacugcccucuucccagucaccucuucccauaauucuuucccuauccuuucucuccugauugggagugggggguacccaggguccccccccuucccccucucccccugcauauuccuuaagucagugaggguagguacauccuuucucacugaggcuagacaaagcagcccaacuagaagauauauucuacagacaggcaacagcuugugagauagucccuacuccaguuguuugggacccacauaaagaccaagcugcacaucuaguacauacuugcaaggaggccuagguccagccuguguauguucuuugguuaacccaccugacucuuaccauguauagucauucaguguauuagggcuucugggguccacuuggaagauguaaauguuauauguuuauauauuacauucuucuuauguuucaggaugaaguucauuagcucuagucaaguuuuuuaaugagucuagaaguucaaaaacccaguauauaaugagaauuacaugugcauguguuuuagccuucugaguuucuuauagacaugguguauacccuguuugucauuguagcauugugaugacaaaggaccaugaagaacccacgugcuccacagugagaggccacuuacacuguggaugcccgaauaaugaaaauaauagagaccucuguagacuagcacuguacugcaagagaggggaggugaacgagaccacacauuugcuugcugacaugcuuacaugaagaaacuaaaggcuacagugagcugucagugguuaccugcugcgaugcgguuggcagcauugccagacuucuugccgugugcaucuuaggcuaaaguuacacuguucuaaucuacuccaauaucuuucuuuuuaguggugucaggaauugaccccagugccuugugugcaagcauaugaugaaugagcaguccccuucccuuuucagaaaaggucucuuuacgguugcucaggguagccuugaacucuaugcuggccuccaguucagccaccucaguagcugaggguuuuuauuuuuuauuuuauuguaugugugugugugcgaguuuugccuuacaugucuguuuguguacuauauguguacugcagaagaccacguuguuugggacuggcguuucagauggucuugaaccaccauguggauccugggaauugaacacugguccucucuggaaagcaccagugcucuuaacugcugagccaucucuccagccccaguagcugagauuuucggccugugcugcugugccucaucaacuguuaaguugaugaaguguucugcuucgagcugggugggaggggauagaucauucaguuaaaugucuuuaaaacugggggcugaggauugacagcuacgcacuagaaacaagcuguaggcccuauuacacccagcugcagggagucccagcugauggccugugccauuugucucugcuccacugacuccauucuucaccucacagcuuuguuucuggauggagaaguuggcuuuagugauggcauugaauccagagccucguguguacuuaaugccacucucaaugcguuacaccacuaagugacaguugccuauagauaaucagguaggggugagagggguugagccccuccugcuuugcuguugcuaucugccuauugguccugagggagaaugggccucugggcucucucuacccauagcacaccauuggcagucaugugcagggcucucucuagaaaacagaacacagcagcaguguugugcaucaaagauacuccacucuucccuucuuucuaccccucuucuguguuccugagccuugaagggugugacacggaugccacuugauggcauuacacucaggcaucguuugcucucagcauuugcacuuagacucccuggaaauggaguuauaggcaagcguucuuuuuuuuuuuuuuucaaaauauuuauuuauuuauuauauguagguacacugcagcugucuucagacagacacaccagucagaucuccuuaagcaugguugugagccacaaugugguugcugggacuugaacucaggaccuucagaagagcagucggguacccgcugagccaucucaccagccccuuuuuuuuuuuuuuuuuaaaaaaacaagcguucuuaaucacuaagcucucucuuuccaccacacccaguguuugaagaaguauuuauauucugucuuguucauaaguaaaagaguagccacuguaaguacucagggauauguuuccuucuuuuuuguucuggcacugaggacugaacacagggccuagugcagccuaggugcacccagcccugcuccugcucuugacaguuuugaacaaaaaaugaguuuuaaaccaauauuguuuaacagucuguauguuuauccuuaaacaacuuugcugagaaauuauauaaaaaugugugucaucauuuuagaguguguuauauucuauauggauuuagcauacgugcuugguuugcuguugauagacauuuaauauucuccguauuuuuaccauuaccaaaagaacauuauucaguaucucuauacagaugugugugugcauauuuguugccaauuggcauccucggccguuguuccucaguggcuauccaccuugauuuuugagacaaaaucuuucaucuaggaccuuguccgguuuuuuguaaacaucacauagcaagugucacaugggacaaggagccucaauugagaagaugccgguggcauauugccuguaggcaaaucuguggggcauuuucuugauugguaauugacagaauggcccagaacaguguggguggugccaccucugggccugaaguccaggucaguguaagaaagauggcugagcaagcuaguacaaacacucuuccauggucucugcuucaguuccugccuccagguuccuaccuugcucaaguuccuguccugacuuugucagucauggacuguuaaccuggaaguauaagaugaaauaaaccagcccccccccauuugcuuuuaguuuuauuuuuaaucacagaaauagaagccccaagacagacuugccgagagccaacuuuucuuaugggugcuaaggaucaaacucagcuccucuugcuugugaggcaagcacagugcuaacuaagccucugcaucccuuuaacacagguacuuuuguuuauaagaauggauagcaucuucaugaaaaaugaccaagaaguuagucuuugacccaaauacacauauuaaaaccauaaagauuuuauacacacacauacauacacuuacuuagagucaaguguccuguacaucuaaaaauugaacuuauuucugaaguuguugcuauuuuauuuuggcuucauauuuauuauuuguuuuuugguuuuucaauauaguuucaccauguagcccuggcuguccuggaauucacucuguagaucaggcuggccuugaauucauagagaucugccacccucugucuccagagugcugagauuuguaccaccaugccugguuacuuauuauuuuuuauauuuuauguauauggguguuuuccugcaugugugucuguguaccacgugaguguuuggugccaaggaggccagaagagggcauccuguccccuggaacuggagucacagacaguugaaggccacuauguggugcugggaauugaaccccaguccccugaaaaagcaaacucucuaaaccucugagccagcucuagcugcggugacagcagucuuucuuagcgagaugugauagcgcaugucuguuuuccuagcacuugggagguagaagccagagggucaggaauucaaggccagucuaggccucagagacccugucucaauggcagaaaacccuaacaaaaggaaaaagggaccauccccgucgcucguuguacaggguugcagugcuguuguguacauuccuucucucucucucucucugcagcugcucuucucagcaucccuggcuuuguggaacggcuuugcaaacuggcaacuaggaaagugucagagucaacgggcacagccagcuuccuucaagaacuggaggagugguacacauggcucgacaaugcguuggugcuagaugcccugaugcgaguggccaaugaggagucugaacacaaucaagguacuuucuauagggccccugaguggugaguuuuuucugggccccuuggagaugauguuugaucuccuuuuuguggaaaauugagaguuacuuacaguagaauuuuccuuagugcaguccuacacugggaugcuauuaaaacguuaauaaguucuccuuguuucauaaaaagaagaaauaaaggagucugaauuguauaauaaagagauugaauaaggaugcaaaagcuacucaaaauaaaccuauagcacguggcuucccuggugauuucugccacacauuuacaggaaaucccacugaugcuuuguaagccuucuguagagcaaacauuucuuaacucauuuuuugagacaauguuuacguuuauaccaaaaccagaugaauagaucacaagaaaagaaaauuacagacuaauaucuuacaaauuagauauaaaaaauuucuuaaaagauuaaaaaaaaucaccuucuacugccaauuaagcagaccaaguuuuuccagucauggggggcuggggauaagggcugcacacaguggccgcuuugggaguauauguagucuguuaccuuuccagguugcccuaacagaccuggagacaguucucaugucucugaugucacuguugggcuccaggcuggcaugcagugccuuugggaagccuaggaaguguguagcagaugucacgggggagucugaccagacaccuuccacgggguucucagucagggcuucaaacacagugagcaggugagucauagacaaguuagacuucaccaaagucucaaacacgucaccaagagacugaaggacugagccacagaacagaacaguuuugcagaccauaccauaagggacuugaauauagaacgcauaaagaagucuaaggguaugguuugccugucacgugugagaccccgaguucauguacugacaaaaagaggugaugaauuauaugaagagagacagacagauagauagauagacagacagacagacagacagacagacagacagacagacagacagacaguggggcugaagaaauggcucagcaguuaagaacgcugcugcuugaucuuuuagaggaccuggauuugauucccagggauccagaacccucuucuggccuccauggucacccacauccacucacacagacaugaacaugcacaugaauuaaaaaacaaaacauacaaagaacauccagagaugaguaauaaaacucauuucagaacacagacagguaucuaaauagacacuucuccaaacaggaaaaaauagccagacacacaugaaaagcugcucaacagcguuagccauuaaaaaaaauagaaaucaaaaguaugaaguaacauuucauacucacuucccaucccucugaaccuuuuccaugcuuacaggggcugccuuuauccccucucugcccucuccugauccucauugcuuucagcacugugcacugcucuguaucuucuccccuccucccagagccugcugggcaggaauaacaguguugaggguucagggguguggcccggucuguuguaggcccuggcuaggaugcccauaggggugcagcgacccuggcuuuccuccugugcguacaagcguauauuaaauggguagcauuuuuucaggcuuuuuuuuuuuuuuuuuuuuuuuuuaugguacaauuuuccuuaaacuuugccuacugccacuugagucaccaggaagaauacaaacugaaaaaaauaaagucaaaaccaaaccaaaccaaaaaaaaccuguacaaauagaugggaaagggaauucuagucugcuggaugugacauauguaugcuguguaugccagcuuuaguccagcauguggaaggcaguggcagguaguuuucuguauucaaggcuauccuggucuacauagcauguuccaggcuagcuagaccuacagagugaggcuuugcucaaauaaagaaauaaaaguaaaaaugaaaaguuccaguggauuauugcccugugacuguagacaguauauuacuguauaucucaaaaaagaauuuugaguguuugaaaagauaccacuugauuaaauuauuaagcgauguauauguauguguuuaucaaagcccccaguaauagguauaguuuuuuauguauugguuaacuuuuuacugucuagacuagagcggcaagcauuggcagaagaacucaggguuuauuuauuucacacugugcugcucaagccaggcauugcucuaaccaccuuccauccguucuugcuuucuuucugucuuuguaacauuagccacuggcaccacugacaaggccagugacucacaagugaaggugaacagugcccagagaagccgcccugcuuccccagcaccacacagccagggcauggggcuuaacuccgagucuggcccgguaucugcugucuaaccacugagccagacugcugcuugucaucuuccuguagcacugugguuugcagagcucuuccuaaggauccagagcugggcucuuguucaguagggaauaaagagaacaagagggauucccaaaagggaagagaaucccacaugcugucggcaguguauggacagcuggucauuggaaccugaacaguauucucuacaguuugcuaucagacaucugucugucugauuggugacaagaaauucaagggagaggugacugugucggcugaguccgaauguuucacuugauguugaaaagcauggaacugcagagaccuuuuccuagguuucuaagcuggucuugcucuugagggucuuuuaaacugucuagugagagcuugagugaggucuuauggcucuuuaauuccagucucuucacagcagacuugugaggagagugaguuuccucaggagccaugccucacccaccaccccggggcuauggcagcccccacuguguucccuucucuaggcacuucggaggagggugggcugccacacaccucggccagggcgcagcugccccaguccaugaagauuaugcaugagauuauguacaaacuggaagugcuuuauguccucugcgugcugcugauggggcgucagcgaaaccaggugagugcucccccagccucagccuggcgagcugagagcagagcagagccugaggggccagagguguccccaccagccucagaggcacacacacucuagcccagcaacaugugcuauuugccuucuuguaaggaaaccagacugauucuagauucuuucuauugauagaagcaaaucuaguuuuuauacauucaguugauauaagauauacuuccuuucgugcauuucagugauuauuugcucacugcaugacaaagacuuggauucucucuuucccgcuccugcuuuuuaaucauuauuuguguaacuaaucuucagugauagaagugcacauuagagucucugugcuucaggcagcaucucuagguggugacagugugcaggccgagagcaagcgaugcugugugcuggguggugcuggugcauaccuguaaucccagcauucaggagacagagacaagugaaaauccuaaaguucaaggccagccugguccacagagcgaguucuaggacagccagggcugcacagagaaacccuuucuaaaaacacaaacaaacauacaaaaaauggacugauacugugaaaaauauaucaucaauugguuauuuaauaccaaaugucagcccuaaaaaggugcauacaagcagcauuagauagacugggcaaggguguguguguguguguguguguguacauauauguauauaauaauucaacaaaagagagcaagggaaggguuacaugggaggguuuggagggaggaaagggaagagagaaaugauguaauuauaaucucaaaaaauuaauacuauuuuuaaaaauccagacugguccuuguaggugcaguagagcaacugcuacuuugaugugaaucaggaaacgagggcagagucuaaagcugugcucacgugugaaaccugggcaaaugcuagggaaagggcucccuaagucucggagcaggagagaggaacaagauuuucuuacuuagguuccuguugcugugaugaugucugggaagcaguuugaaguuugaaggagggaugauuuauuucagcuuauguuuucagagguccgaguucuccugauugcauuuuuuugagguugugcaucauagccaaagagcauacagagcaaacuugcuuacuuggcagcaagcaggaagccuaacuauaaccccuauggacauuuccccuaaugacccacuucuuccaccgaggcccagugggaagcugagaagagccagaacugugggugagaugcccaaguuagggguguuuccuuagccagccuugcugaacuugccugccccauagagugacuguagcugauccuagaguuagauucuagacucauucauucucuggauauucaagaauauaacagggauagucuguucauaacgagagguagcaagggguuuguuucauauuguguaaaaaguuuaguaggcacauaauucccauaguugauacaaacuaguaucagugggaccggucuucccgcugggccccagcguccugacacacaucugagcauuuccuccaauagcucuuuuauaauuacagaagcaagcauuuguaugcacucaguugaacauaagacacauuuucuuucauguguuucggugauuguuuagcucacuacaugugaaagacuuggauucuuucuuuucuacaccaguuuuuuaucccauaauuuguuuaaucuucauugauagaaguguaaauuaagucugccuuggguauuauaaauaaugcuuccaccacugauguuauaauuaugucauuuaucacuuguaaaggucugucuggugauaaaaggggaaauguuggcuaagaaaauagagauuuuauacugccaaaccacccuccuucugcaggaaguaccagcaugcccugucaccggcaacauucauacauggcuggagucuaggucaccaaaacgauccuguaguagccagacuuuuucauugaugaccagacacuugagaaaagucucauaaaggagaaaagguuuauuuuugcccauaguuucagagacucauuuaauuguaguggggagggugugguagagcagagcuguucaugucauagcagccagaaacaaagugggaaaggagggagacaaaguagauccuuccuccuuaaguuucuaaagccacaccaaaguagacacaccagcugagcccugagcaccaagccuuuuaccaugacuagccuuucuuuaaaagugugugugugugugugugugugugugugugugugugugugugugugugugugugcgcaugugugcaugcgugugugcgcacgcgcgcgcgcaugcacccauaugugcacauaugcauggauaccccuggaggccagcagaggacaugagauccccuggagcuggaauccaccugacauggaugcuggaaaccaacuuaaguccucugguuacuagcaaaguagggcuagauaaagaugagacaaacucuagagggaaaacauuaaagcuguaacagugugucuaagugguguccucuuuuuuuuuuuuuuuuuuuaauguauguaaguacaaaguuacucucuucagacacaccagaagagggcaucagaucccauaacagaugguugugagccaccaugugguuccugggaauugaacucaggaccucugcaaggacagucagugugcuuaacugcugagccgucuuuccagcccaggaacauggugucuugaggugagcuccagugccugggagcuuuguccucugugugaccuugucccugcagccuucacagccucucuccuagacaggcuguagaugcucccugccugcaguuguagguauaccuagggucucaccauggcgcggguucaugcaucacccucucagaagcuccccagaggacucugucugauacauacuuacaggauccuggccucuaggcuuugcuugaaaccuccgugaaagcuucaaugauuccacaugcccacaaaaccagugaaucagguagcugcaugcggugcuauuaauucauagucccagcauucggagggcacgaagaccccaaggucagaaccagucugggcuauauacauggcaagacucugucauaaaaauaaaacaaaaaauuaauaucccaugggcuggugagauggcucagcggguaagggcacugacugcucuuccaaagguccugaguucaaaucccagcaaccacaugguggcucacaaccacccauaaugagaucugacgcccucuucuggugugucugaagucagcuacagugaauuuauguauaauaauaaauaaaucuuuaaaaaaaauuaauaucccauaaaugguaccaaggugugcuacugacucaaguaauggcuagacccacuuggacugcaacugcaguggucuucagugucugggaagcugaacugggagaaaagugcaguagaugccugugugagcagggcagccuggcagccucugcucacgggagaaugccucagaugaguuuacgagugggugccugggcugcgcagacguagucuaauccuggaaaugcuguuaggcauguuccuuguucuguuuucuguuccuggguaaaggauguggcuucuuucuaauggccccaucucuuucccgcucacauucucuucauccacaacuuacuuucuuauuuuucuucuucuuucuuuuuuugugugugugugugugggggggggggcaguguuugaggcaggguuucucuguguagcccuggcugucuuggaacucacucuauagaccaggcuggccucgaacucaaauccaccugccucugccucccaaguuauccacaacuuuuaacuccuuuuucugacuagcccacuugacuuuuaaaauucuucucugcuuuuugcuccuaguuuuccuaaaauugguuagaagcagucaguaauagcuguuccacagccugaaagcuguccugucuuaaagucccuccuccaauucgccugucacauuuaaacucagccucccagcuucaggagauggcaaaauauaaacaaguuauuugccagaguauuucgggauuguccucuagacccuguucccacugaaaccgccugagcugucccugugguccgcucuuggaugguauucuggccuuuugagaucccacuagaacuucuuguuaagcccugaugggucucucuuccuauacugcuccacuuccccaacuuccaguuuucuccagcaaaguuccaacggccugggggcgacauagucugguuuggccaaagcaguggcacugccucucuacaucccuguuuucucggucaggcuuuguuucacugugaaagccgucugaaggaggagguuuuguuuuggaucgauguuuagagggaucaguuccuguggcaggaagagugguagaacagaacagucccauaugacagccgggaaacagacagacagggaggagacaggaacgagguacgcugaagcaucuauucucaguggucugcuuccuccaguagguugcccuagauuugagaacuccugaaaugucacuaccaacugugaacugacacaguuacagaugccaaagucgguuaaacuucuuuuucauuugcccaucucaaaaagcaagagacugucugagaugugaauuuuucuuuauauugagagguugagguuuuccugugauuuaagaauauuuucucagggcuggagacauuguauguguuuaaaagcggggcuguucuuccagaggaucaggguuugauuuccagcaccuacaaagcagcuuacagcaaucuguaaauuccagauacucugauacucucuggccuucaugggcacuagguacaccugugauguacaaacauauauguaaacaaaacaccaguacacauaaaauaauaaaaacaaguuaaagagcauuucuuuccuucauguauguauguggggggggggcguguauuuuugccugacugugucuauacaucaugugugugugguaccuucaaaugccagaagagggugauggauucccuuugacuggaguuagagaagauucuaaauagccacguaaguguugggaaucaaacccccguccucuggaagaguagccagugcuuagaaacauuucuaagccaaguagaaggguuuacccucaucucugagggucugucgcccuucucuagcuucucaggccaccagcacaugcgcuucuaugcagucagguggagggugccuuuaaauggcagcacucacuacuagcaacugcugucuucacccugaagauggcugagcugggagaggccuugcucacauugcucacauugugcacacaguggucucaguguuucucccuuacauccuuacacagguccacaggaugauugcugaguucaaguugaucccaggacucaauaauuuguucgacaaacugauuuggaggaagcauucagcaucugcccuuguccuccauggccacaaccagaacugugacuguagcccgguaagcggagagcccgggagcgugcagggacuuaacugcaaagaguuagguguuuuaagaaccacugcucacccugagggccucauucuuauagaggagagcagagagaaagguuuuagaccaacuguaucucagagcauccugacaggguauugaaugagcaucagaaguccuuugugccacucaccuuuuuuuuuuuaagauuuauuuauuuauuauauguaaguacacuguagcugucuucagacacuccagaagagggcaucagauuucguuacggaugguugugagccaccaugugguugcugggauuugaacucgggaccuucggaagagcagucggcacucuuaaccacugagccaucucaccagcucccaugccagucaccuuugacugugucccagaaccucugaaccuguuuucuuggacuaggagggucaugugccuauugcccucagagccccaccuucccacaacucuggcccaaaagaccugaugugcuggcaggaccuggugccauggguuuccgaaccugcauugugggacuuaaccucggugcccugcccccaaccuugucagguugcuuuucauucuuccauuugaguuaguaacuuagaaugagucuuuccacaggggacugagcgcuuggucuuuguuccuuguggaaauauccugugucuucugcguuugcaaucuuucucuaauggcuucuuacuuacuuccuuauggucucuuggagaugcugcuguggugccagcagcuugugucuggguuuucacacacuugggguggcaugugugucguuuucugagguuugguggcagccuuccuggggaccuuugccaccucugcccaggacacacuuuggcucacgcuuuagaggagccaguuucauguucaguuucaggauuucuuacuucuccugggaggcuucaccagccaagccuaagcagcucacagcucggcucguccuggucacuguaggacacagaaaccauagccguguugugacucggucucucaccauccacgggcuccugagcucucagggccaggccuuucugagaucaguagguuucccuuuggagcuucuaaacuagccucauguggaaagggacuaggaugauuuuaguuuuuaaauccaaucgucuaggauguuguuagcagaaaaggucuacguuaguuuagcuugacacuggucagccaugaaggucugacuuuuccacuaaagaaaacccuccagggggcagggggaggggguagaggagagggggcuuguggaggggaaacuaugaaaggggauaacauuugaaauguaaauaagaaaauaucuaauaaaaaaaaaaggaaaacccucauugugcuggaggacagggacgcauaagaagcaguguagcuagacagggaugucaccagagcccagccuuguuuuuuguacaaguguugugacaaacguagcuuuaauauguguucuaggacaucaccuugaagauccaguuuuugagacuucuccagaguuucagugaccaccaugaguaaguauccccuggaggcaucgucugcaggccccuccccugagcuucucuguucucugacccaggagcagucuguagggcuggugggagcccccaauaucugugaggcugugcuccucagcccuguagguugacaacccuuccuucuaucugagcaccgaaucuuuccucugcccucacagccaccaucagaggaugaaagugcugucccucugugcccugggagcaacacccuugugcaaugacuagccucuuagcugcagagucccugacuggaaacauggaggcucccaccucuacagugaaguguguuggcucccccuucccacuuuuuugcgauagucucugauuuuuaaugauuaagcuuuuaguggagaauguauaagaaaaugauuguccacuauaagggaaacagugcaagggagggggaaacacgggauucuuggccguggcauuaggguaaggaccugacgacugugugugcacagaaagguggaugcacuggauuggaggccuccaugaagggcccagaggagggguucucaaggcagugcuggggcagccugaguuuucaauguuguacaaguuaauagaacaugccugaggacagugcugccuaggggccucugucucuuaugauucuguuuugugagaacgucuguggcugaaggcaucuguaguugacagaauuauaccgaguguguguguguguguguguguguguccgucccuguccuagcuuucaucagacucuaaaucaguacuucuuuguaccuggccuaguggaaauacuaugaucccugcugucauguagaguacauuugggagaggaaguuuaccauuagagaaggucaccaguuacagaaugccugaugucaaauaggcauggugugugggaacaaaagagcacacuccgugaaaggacaguugucaaguguccugaccggcuggcggugcucagugacuauugcagaagcaaucugugagcagaggccugaccgggaugaagaggcagcgugagagaguugagccagaaggcucccacauagagaagcccuguaggaggauauggcguggucaugaaaaccagaguggccagaugguguggcaggugugagcugcucaguuuguuguagccacagagguggccuggcugcacagggccucaaagacaugaucacucccuagggguucacacaacagggugugagaauuggguaagcauuuucaauaaugacauggucccaguccuguuuuagaaaucacucaaggagcugagggaggguucccuuccugugagaagcagcugagcaagugcuucugugcugcacagaccguaaugacaagccuggacggaaggaagaggagcgauugugucacaguuggucaggccucugcguugugacucuggccacugagaaugcugcagcagggcuaggcucaggacuaagauggcagacaggaucagaugugcugaagugcaggugacucugagaagucauagagaaguguucagugugcaacauggagaccuggaggugccgaggacgggcuuguuaggaaugacaagcacguguagaagugcugggggacucucagugcuccucccgacaggagugggcagagcagacuuugugcccgcugcagagcugcucagcagcuccagccccgcccuuuacccuuugcacccgucuguuucaggaacaaguacuugcugcucaacaaccaggagcuaaaugagcucagugccaucucgcugaaagccaacaucccugagguggaggcuguccucaacacugacaggugaucuuuguggggaccgcuguggauacagggcucccagcagggcacacgcggggcugcguacuugugcuuccucacacguagcuaccaccccacuggcuuugugagcuagauccucacaucuccugcauuuccuaacugaggaucacagcagccucagaaggaagugccaucgucaucuuccucuuuacauguauaugacagcaaaggucagcuauacucuguccuuccaccuuaucccaugcaaaucauggccccuuuacugguauccucauuucuugcccaguggcagcugugccaagcaggacaagaagaagcuaacccuucacccucugcccuaugucuaccuccucuuugggaucaacacagugccaugucuggcucaugggggcuugugaaguguggcccuaaucuagcagcuacagucagaaauccccaacuucuuccugagaagauggauccaucggugccccggcgucugcaggggcuggaaauggagcugccgugugaagagagaguuuaagggcccagacaccugccacugugacaggccuaaucauuuucuuaccuacugcugccuuugccucauagacgggaagcugaggccuggaagcccacagcugagcuggaacugacccugggcaggauaaagaacucugggcacugcccaauuggcacagacuuuuuauuccaucuggcauacucugcuguggccugaauuaaacccauuugugauguaaauggccgccuucuggcaguuuggagccccaucuggccaugggugugccucugccucuggccagugggucugaggagggaaaagcggccuaaggcgcaggagaaaugcaccuggccauugagcugacggcugcagucucugagguccuggcacacgguggagcaagaaagcauccuugcagacucagacauugccuguucuuuccuccauccacagcgacacaggacgagcucaguggccccucuuagccauucaguucugucaccagugcugucugucccuuugauuucaggagucuggugugugacggcaagaggggccuacuaacucggcugcugcaggucaugaagaaggagccagcggagucuucauucaggugaguaaggagagcugugcuugggaggggucuaggagccaggggguucccaauggguuagucuccaguaccuacuccuuaagguuggggaggcggccucaccagccgcuggcacuaugggauucagcugguaagugcguguguccuugucacaugccagcaggguauuuuaggagguaggugaucaucaggcugucacuagagagguagagcacaaauggauccaggcuaugccugugugacuuccagggaucaugggaaggaagcaugaaaggaaagaaaccugcuucagugcaguaugggagaaaauagagccagggaccgcccggggggggggggggggcuuggaaagguuguagacaagaggauuccaccaggccuggguacagggcucugucccuacaggguucaccuauucagacccucccucagguaucccagcugagucuuugggccacucaguaucuguuggcuccuaucuagaccagcucaaugcauaugaagucagugaugucgccacacaaacccuucugcuggccacacaucccuggucuaugucuuuccaguauucugagaguggaaagccuagagugguuuuacauggaacuuacuagaggccacucuuugagcccagaugccacuguguaugcccauauaccauagaaacacguuuugguccagcccacaaugaaagacuggccccugccgagcugugagcaccauacaugagaauggcgauccucuugcuuauugaucuguccucaagaccuaggacuggggcacagacugggaaauguuaaguaaauauuagacacugggcugcaaaccacucugccucugggggcauuuagccugcaccaggggagggcagccaaagccuccugguccaggaucaacacuuggguugcagguuuuggcaagcccgggcuguggaaaguuuccuccgagggaccaccuccuaugcagaccagauguuccugcugaagcgaggccuucuggagguauacuggaggaagcagggcgucgaguagcuguccuccccaguccagccccucgaauugauucuucguucugagccuuaaagaguuuggucaggaacagaccuuuucugguuguuccuagugcgcauuguuccaggguuggcccuggguugccagcugugggcucccuguagguauugagggcuaaaggacucagguaguugugcaggaauuuagaauacagaguuacccagcaagcccuuugacccuggggauaauuugguauugacuaaaaguuaacaaagccaccaaccaggcagcauacacaagcuaguccgaggcccccgacacauauacagcagaggacugccuggucuggccucagugggagaagacuugccuaacccuugagagacuugaggcuucagggaguggggaagccugguggguggcagugagggggaaacaaagcggggaggaagaaugggaugaggagcugugggagggggcagugauguaagaaaauaaaaguaaugauauuuccauauugauuaauggcauguagcaaaaggaauuugaagagagagcaaauagcuagaauuacaguugguauuuuuaggaaaugacuaugaacauggaaccaugaauuguaaaggaaagcagcugccaaucauguaagcucaagaaaaugaacugagcuuggagaccccacacuuuagaagcagaagcaggaguuguucaaguucaaggccagacccugucucacaaaaaaaacaaagcaggaaugaagagagggagggaggggaaaucagaaaccagaauggaagcagggaagaguucccuguugaggaguuaaguuggcuuacuguucugaguaacuauuuagugauuuguguguguucuaugcgguuuuauugguaaacauaagacagugcagagggucagaauaugugcccugcucuucaauccugggcccucgugcuuagggcagcagcccuuguuaggucuggagacagaaccauguagguagcugcagagcaagucagaggcguugugugggagccugggaaagagaauaccaccuacccacccuguucccccugcugaggucagccaccugguucuguccuuggagccaccaguauccucagaaaagagccuagacaaaguugcagguuucauccaccuguaugcuugcuugaaccaaguggguagucugagcuccaggccaggccugaguggcaaacagaugaggguggggggcagacccauccacucacucacccuguccccuguuugacccagcacaucuuauacugcauuguggacagugagugcaagucuagggauguacuccagagcuacuuugaucuccugggagagcugaugaaguucaacgucgaugcauucaagagauucaauaaauauaucaacacugaugcaaagguagggcuuguccagggcuccgugcuguuggcugaaguaccagcuguccguaagcuuuggccugcccaucuucagggguggucacacaguuggaagagucugggaucuggugggacagucaggcuucaagccagacccuaagacuauugggcugagaacuuuggcuguuagagcaucuuagcaggccacucggugucccaucugcggaguaguggagcugggguagaagguugguggugcccuggccagcagccugccaguaagcaccaucucugcuccaguuccagguguuccugaaacagaucaacagcucgcuaguggacuccaacaugcuggugcgcugugucacucugucacuggaccgauuugaaaaccagguggacaugaaaggugaggaggccaaggugccagugcacauggcugcagucuaacugccaggcaccuggccuccagccaggaauugugugccugggucaggaggacagucuugaccaaacucgauguguuagucaacuucuccauugugucaacuucuccacugguuugcuuccucuaaugagcaaguauaucaucuuaguaaagaaaaagcugccuucuagacugacugcuuggauugaacagggucccuucauucuguuuuucugcacaggacuauaguaugcagcuguggugggugugucagaccucaccuagaaucguguguaauaacgcaugugcacaucugugccuuuuucccuaggucuguggcaucaaacagauugucacaaguuuaugaacacuuccaaaagaggacaguguuccucaugguugucauugguaccaaaagcauccuguaauagauaauuagaccauuuaccuccuguugcuucucugaagggucuguuuuaggaggcuggugacaugcacucugauguaaucagugcagugccuucccaguaguaugagaggucagguguucagugcuccuucacccuuaacacagcaguggacacagaugugugagaacuauggcaaaccagucuccuuuagaguucuggcaaguuuaagauagacuguuucucugugugugguuuauguauguguggguauauaugcagauguggaggccagagguugauaucugggcucuuccuaccuuaaauguuuaaacagucuccugcugaaccuggagcucauggguuugacuaagcuggcugacuucaggggucuaccugcuugugugaccccagcucugggguuuuagauguaugcugccacauggguuccugugacccgagcucugaugcuugugcagcaguguuagugagucuuccugagggaggaggaagcugggagggagcugcaggaagggccacugucugagugugguucugaggaccaguggggucucugagauuuggugcagccugaugaccaaacauuggauauugaccugcuauugaagcuuuuaagaaagcuggguuuuugugguuguuuguaaaaauuuauuuugaauuauuauauaugggauuguguguguaauaaguacaggaguagguagaagcuggaagaagguauugcauacgcugaagagccaccguuguagguccucuggaagaguagcaggggguccuaacugcugagccaucucuccgacccucaacaugcuuguucugguggugagagccccagcugcagagucaggacccaaauggaccuggccuguggcauggaccugaugccucugccuuccuccacaguggccgagguccuguccgagugccgccugcuugccuacauaucccaggugcccacgcaaauguccuuccucuuccgccucaucaauaucauccaugugcagacgcuaacccaggugagacgcuaacccagccagugagcagucaggggcuagacugggaaccaccucuuauccugaaggucaucgugucuggguuuccucccuuucuggaaacaguucuuccuaggguguugcccagugccccaguuuacaggggaacuaagaccagauauccugaagucacagucaguugggcagagcugaguuuggcacugcauucuucugacuccaggccaguguucuuccccaugugcucagcccugccuucugacugcaguaggcugugggcuuggaccugaguuuugucccaucuccuucacuaauggcagccuucucuuccaggcucccaccccuucccuaagaugggagucaugcuggcaccucugagcaguggucuucuuuugccaacaugcugggaggcgaggccuggggcuggggaugcuuggugaacaaggcagacuagacucuuguuucugaagcucacagccuaguacagcacuaauaacugcacacuuagcuugugcacccagcccugucagggcagagaagcuccuagaagaagucacgccugaaccaaaguauagacgaggaccagugcucuugucagugugaaugguaguaggugggaauaggacacaaggggugcccaggacugcugcgccauugugugggccuaggauacccucuucccugcucuguggcuuccagguucacuggcauccuaaggcugcugacauguacccaguccaucugcuuuugaccuugcaggagaacgucagcugccucaacaccagccugguaauccugaugcuggcccgacggaaagagcggcugccccuguaccugcgacugcuacagcgaauggagcacagcaagaaauaccccggcuuccugcucaacaacuuccacaaccugcugcgcuuuuggcagcagcacuaccugcacaaggauaaggacagcaccugccuggagaaugugagugccccacccugagugacagugggaggacacuggcgugugugagccccguccucuacuaagcacagcccaacccucucgcuuucacucagagcuccuguaucagcuucucguacuggaaggagacaguguccaucuuguugaacccagaccgccagucgcccucugcccucgucagcuacauugaggagcccuacauggacauagacagagacuucacugaggagugaccuugagccaggcuucaagaagcugccaggcaggggcgagugcagagagccagagugcacgugccgccucgcacucugcccaucccugucccucuugccuccccagugcucuguccaccccggguguccaggugcaggcucaguggaaggaacauccuagaagcucuugucuccugggucugagggcccaggucauggggagccuguuucuucacuguccccaggguaaggacaauggcaccaugcccaccuuucccucgcaauccuggagcccuggccugccagagaaggggaacacgggaaaccaucugucugagcuucucccaucaguccugauggagaggaagaugcagaccccugugagccaaaccucccuggccucaggacgcaggcagagaggcuccugagcccugggcagggguggguaucggagaaugcugccuuccccggggucugcccaucucucccuuccucaccucccuugucuuccuuuagcuccucugguucuuugcucauuggccacuguguucauccaggaggcucccuagaaguggggggagccuuuucucuccaucccuuggggcauggagugccugugccugccugagcccagacacgggagccuggcugagagcuuacccuuggcuccuccuguguugccaguuuauuaacagcaaauaaaccgauuaaauggagacuauuaaagaacuuuauuuuaaagacugau

SEQ ID NO: 1203 - RNA, 4363 nt, Mus musculus
ccuccucaagccucggaagcaagcagcgggaggagaaacaggcagguccaggcaggagggcccacagcugggaggggccgaggcgagccaggcccccuaguaggaaaugagacagauccaaguaacacuuuaaaagccugacucccucuuccugcacgcguucucuuuccauccuccgcucugcuccggccccucccggacagccucccuucucuuuccuaaucagcagccugaggaacccgagccugccccgacccaggugggacccagaacuccaggauguugacgaaguuucugccgcuacugcugcugcugcugccuggcugcgcccuuuguaacuccgauggugaguuugggucaaggcuccugccuggggguguucuagggacuugguguauuugggaacuuugaccuaauuauaggacaacuaagcccacacagcauggaugucuacagcugcuggguccugggcuuugguuccuguuucaaagacagggugaggaaguccaguuaacucuccggagaaggcuggggaagcugguggaagggaccuguggagagaauaagaacaaggugagaaggcaaggagagcagugucagucuugggaaggcaggaagagauaugagauggacagauagggagacccuaggaaagcugagauaaguguggagguugugaugggaaggaggagaaagacaggagauguagcugaugaggugggagaugggggcagaagagccaaggccagaagaucaggcugcuggaagcucuuaaacagaaaaggggaauuaauugccaaacacuaucgaugcccagcuccccccacucccuauagccuccauuucucccucagaggggcaauauuuagagugacuacuguaucuuaugcacacauugacuuguggugcgccauauuaucacacuaaucuuacuaagaugaaaacuuggucacagaacaguuaaaggucauugcaggucauugcugagguuacucacaccaguauauccacacuugcaaacacagaaaucaacuucuccaacgcaacagugugugugugugugugugugagagagagagagagagagagagagagagagagagagagagagagagagagagagagaguggggggguguuacaaugccaacacugccaaagcccuuuccuggguacugaagacagauaaucaaacccagcuucaauagagauucgccaggcagaacaagggcagcagagagcaaccuggacaagcucuucauaugguggccaaaagucggcaugaggaacuccaagccauuugauaaaacugaacacggagauucgccagaaaaggcaacuagggccagauaacuuacuguggaucucagauugagccuagacucugagauccguccuguggacagauguccuacggagaggcaaugacuucagauuggcagguuagcuucagcuaccaguauucaaaucuugguuugcuuuaccaucuuggccucagauucccauacacaagggguuaauaauaguagcuaccauguuaaagcauuaguaggaaggcaugcauaaguuaauaauguguauaaaacagugccuaaggcguaacaaguacuucauggguauuagcuauuauuauuugggagggguaggacacaccccagcaggguuuuaaggguuuuuuggaucagauggagagccaguaagaagggauaaaaccaaguccaguguguuggugcacaguuuuaauuucagcagcaacaaguggaucccugaguuggaggccauccuggcuuacaaauccagcccgaggauagcuggggcuacacuaagaaauccuaucuugaaaaacaaacaaagcaaaaggacgaaauugagaaaugugccccccccccccccgcgggaugacagugguccaggagaggauacagggacuggaauugggaucucaucagaggccaggguuuggcaggcuggcccugugaaggagggaaaagcaucgaggaaugccuuuuccgauugcagaccucaguuuccucaucuguaaagcaaagauaauaaccccauccucuccuggagggguuguugugagcaucaaauggaggggcgggugggcgaaugcuuuaugggauugcgaagugggcggcaggccucuggguaagggguuauuaucucuggcugucagcuacccugucccuugcuggcgguccugacgcgcugacucugcccucaggcucccaaagccugcauaugcuccagaucuccuauuuccaagacaaccaucaugugaggcaucagggcaacgccucucugggaaaacuccugacacacacgcuggaaggccccagccaaaacgucaccauccuccagcuacagcccuggcaggauccggagagcugggagcgcacagagaguggccugcagaucuaucugacccaguucgaaagccuggugaagcugguauaucgcgagcgcaaggagaacguguucugugaguugggucgccuggucggagcuggugggagccauggaggaugaaagagccuaaaggggcuuuguggcagagcuugggcacuaaagcuaaugcucuagacagcaggauuuuugugaaggaaugggugggcguggucuuuggggcuagguagguaggucgauagaucgaucaauugaucgauugaugagauacuucuuggggccggugugacacagaccugcuuggggacccugucccucaucuucucugaccuccgaaguuucacugaagauccugccaacuccuuuuccucauagcgcccuacccuucccuucauccagccuccgaccaccucuucuccuagauguugaugggccuguccauagcucccucacaaccccgguuccucucaacaacccgauaucuuggaugucuuguccaggaaaccaccacugcuuuucacaagccuucucugccccuuucucccauggucccacguuuucaucgcggcuccucguuacaagggcuccagucccucuccucuguccccaggcaucccuuccuccucccacauccccuuugccccuggugaacaucccccaacaccuaguaccuucucaagcaagcacagagcugacccuaucccucuccauaguuccucucacuguuagcugcucccugggcugcgagcugccggaggaggaggaggagggcucugaaccccaugucuucuucgauguggccgugaauggaagcgcuuuuguaaguuuccggccaaagacugccgugugggugucaggcucccaggagcccuccaaagcagccaacuucacccugaagcagcucaaugccuacaaccggacucgguaugaacugcaggaauuucuucaggacacuuguguggaguuccuggagaaccacaucaccacgcaaaacaugaaaggucugaggggauucuggcccugccuguguguuggggagggcaugacugccaggcaaaugaagggacaugagggaucccuugagcaacaaaaugaggaggcuggagacucaggcgaggguacauccacaaagccuaagucacugggugacguccuuugaaaguauagaugccuugggguucgacccagacuucagacuccuuggggguaugcucuuaaacucacuuuuugccuguucugcagggagccaaacaggucgcucuuacacaucacugguccugggcauccugaugggcuguuucauaaucgcugguguggccgugggcaucuucaugugcacaaguggacggcguugcuaauuaucuaauuauucuccaggccccuuggagaaagggcuggacuggugggggcugguaagggaaggucguagcucauaugaugccaaacagacucccccagugggccaucacaucucaggagguuaaaagcaacaacuccaggucugucugccuaagaagugugugugugggagggggcaguauguagacaacaaaguaacggguuugcaaaggacuugagagcauuugugcuuuguguagcuggucugagaagugggugcuuaauuguggaaaucagaccauagacuuggggggaggcugggaggucugugaucucccugaauaggcagacuuacuguaggcauucaaaacaucuuacuaaauaaaagaaguugucuguaaccaaaaucaaacauaguuaauguguccagguguauccaacuugggaagggacacuggaaugacagggaagaaagaaccacagaaauaucaccguugugagguugaacaauaugggagcagugaauucauaaauauuaaauuucuuauuuauguaaaagguguacuuauaucuucuauuuuauuaaaacuucugaaaaaaaaaaguauagcccauac

SEQ ID NO: 1204 - RNA, 4363 nt, Mus musculus
guaugggcuauacuuuuuuuuuucagaaguuuuaauaaaauagaagauauaaguacaccuuuuacauaaauaagaaauuuaauauuuaugaauucacugcucccauauuguucaaccucacaacggugauauuucugugguucuuucuucccugucauuccagugucccuucccaaguuggauacaccuggacacauuaacuauguuugauuuugguuacagacaacuucuuuuauuuaguaagauguuuugaaugccuacaguaagucugccuauucagggagaucacagaccucccagccuccccccaagucuauggucugauuuccacaauuaagcacccacuucucagaccagcuacacaaagcacaaaugcucucaaguccuuugcaaacccguuacuuuguugucuacauacugcccccucccacacacacacuucuuaggcagacagaccuggaguuguugcuuuuaaccuccugagaugugauggcccacugggggagucuguuuggcaucauaugagcuacgaccuucccuuaccagcccccaccaguccagcccuuucuccaaggggccuggagaauaauuagauaauuagcaacgccguccacuugugcacaugaagaugcccacggccacaccagcgauuaugaaacagcccaucaggaugcccaggaccagugauguguaagagcgaccuguuuggcucccugcagaacaggcaaaaagugaguuuaagagcauacccccaaggagucugaagucugggucgaaccccaaggcaucuauacuuucaaaggacgucacccagugacuuaggcuuuguggauguacccucgccugagucuccagccuccucauuuuguugcucaagggaucccucaugucccuucauuugccuggcagucaugcccuccccaacacacaggcagggccagaauccccucagaccuuucauguuuugcguggugaugugguucuccaggaacuccacacaaguguccugaagaaauuccugcaguucauaccgaguccgguuguaggcauugagcugcuucagggugaaguuggcugcuuuggagggcuccugggagccugacacccacacggcagucuuuggccggaaacuuacaaaagcgcuuccauucacggccacaucgaagaagacaugggguucagagcccuccuccuccuccuccggcagcucgcagcccagggagcagcuaacagugagaggaacuauggagagggauagggucagcucugugcuugcuugagaagguacuagguguugggggauguucaccaggggcaaaggggaugugggaggaggaagggaugccuggggacagaggagagggacuggagcccuuguaacgaggagccgcgaugaaaacgugggaccaugggagaaaggggcagagaaggcuugugaaaagcaguggugguuuccuggacaagacauccaagauaucggguuguugagaggaaccgggguugugagggagcuauggacaggcccaucaacaucuaggagaagagguggucggaggcuggaugaagggaaggguagggcgcuaugaggaaaaggaguuggcaggaucuucagugaaacuucggaggucagagaagaugagggacaggguccccaagcaggucugugucacaccggccccaagaaguaucucaucaaucgaucaauugaucgaucuaucgaccuaccuaccuagccccaaagaccacgcccacccauuccuucacaaaaauccugcugucuagagcauuagcuuuagugcccaagcucugccacaaagccccuuuaggcucuuucauccuccauggcucccaccagcuccgaccaggcgacccaacucacagaacacguucuccuugcgcucgcgauauaccagcuucaccaggcuuucgaacugggucagauagaucugcaggccacucucugugcgcucccagcucuccggauccugccagggcuguagcuggaggauggugacguuuuggcuggggccuuccagcgugugugucaggaguuuucccagagaggcguugcccugaugccucacaugaugguugucuuggaaauaggagaucuggagcauaugcaggcuuugggagccugagggcagagucagcgcgucaggaccgccagcaagggacaggguagcugacagccagagauaauaaccccuuacccagaggccugccgcccacuucgcaaucccauaaagcauucgcccacccgccccuccauuugaugcucacaacaaccccuccaggagaggaugggguuauuaucuuugcuuuacagaugaggaaacugaggucugcaaucggaaaaggcauuccucgaugcuuuucccuccuucacagggccagccugccaaacccuggccucugaugagaucccaauuccagucccuguauccucuccuggaccacugucaucccgcggggggggggggggcacauuucucaauuucguccuuuugcuuuguuuguuuuucaagauaggauuucuuaguguagccccagcuauccucgggcuggauuuguaagccaggauggccuccaacucagggauccacuuguugcugcugaaauuaaaacugugcaccaacacacuggacuugguuuuaucccuucuuacuggcucuccaucugauccaaaaaacccuuaaaacccugcugggguguguccuaccccucccaaauaauaauagcuaauacccaugaaguacuuguuacgccuuaggcacuguuuuauacacauuauuaacuuaugcaugccuuccuacuaaugcuuuaacaugguagcuacuauuauuaaccccuuguguaugggaaucugaggccaagaugguaaagcaaaccaagauuugaauacugguagcugaagcuaaccugccaaucugaagucauugccucuccguaggacaucuguccacaggacggaucucagagucuaggcucaaucugagauccacaguaaguuaucuggcccuaguugccuuuucuggcgaaucuccguguucaguuuuaucaaauggcuuggaguuccucaugccgacuuuuggccaccauaugaagagcuuguccagguugcucucugcugcccuuguucugccuggcgaaucucuauugaagcuggguuugauuaucugucuucaguacccaggaaagggcuuuggcaguguuggcauuguaacacccccccacucucucucucucucucucucucucucucucucucucucucucucucucucucucucucacacacacacacacacacacuguugcguuggagaaguugauuucuguguuugcaaguguggauauacuggugugaguaaccucagcaaugaccugcaaugaccuuuaacuguucugugaccaaguuuucaucuuaguaagauuagugugauaauauggcgcaccacaagucaaugugugcauaagauacaguagucacucuaaauauugccccucugagggagaaauggaggcuauagggaguggggggagcugggcaucgauaguguuuggcaauuaauuccccuuuucuguuuaagagcuuccagcagccugaucuucuggccuuggcucuucugcccccaucucccaccucaucagcuacaucuccugucuuucuccuccuucccaucacaaccuccacacuuaucucagcuuuccuagggucucccuaucuguccaucucauaucucuuccugccuucccaagacugacacugcucuccuugccuucucaccuuguucuuauucucuccacaggucccuuccaccagcuuccccagccuucuccggagaguuaacuggacuuccucacccugucuuugaaacaggaaccaaagcccaggacccagcagcuguagacauccaugcugugugggcuuaguuguccuauaauuaggucaaaguucccaaauacaccaagucccuagaacacccccaggcaggagccuugacccaaacucaccaucggaguuacaaagggcgcagccaggcagcagcagcagcaguagcggcagaaacuucgucaacauccuggaguucugggucccaccugggucggggcaggcucggguuccucaggcugcugauuaggaaagagaagggaggcuguccgggaggggccggagcagagcggaggauggaaagagaacgcgugcaggaagagggagucaggcuuuuaaaguguuacuuggaucugucucauuuccuacuagggggccuggcucgccucggccccucccagcugugggcccuccugccuggaccugccuguuucuccucccgcugcuugcuuccgaggcuugaggagg

SEQ ID NO: 1205 - RNA, 1699 nt, Mus musculus
ucugguccugccugaauuugaagaugggguagccuccuugggaagccaggccgccuccuguggcucuagcagggccuucuucuaaguggggcggagccuugggcccugggcgugguuggcuaguggcccugccuuucccgugcucacggggcccgccccuggcgugcgaaggccuuccuucucugucucggcugcgucauaacgcugcuccucccaggccagacggcuuccgugcagcucugcuuucacuuuacugccugaggugaggacacgcgcggguagaggguggugauggguggggugacacuugcucuggcaugguaccaaaugggcuucuauuacagaccaugggcgcucuccugagugguggccaggauggcccggagcccgcgcagccccagccuccagcgccgcaggguccgcagcagccucagccggaaccuggcccgugggggccacuggacgacgugcgcuuucuaaucgccugcacguccugguacugacccggccaccccuggccuucaugcccuccugggccuggccuggcuuuuaucuccucacccugugauuuccugucuuacucccucugggcagagauucaagaaagaucgcggagacugaaagucccucagggccaccucagagaauugcaccucagcuucagacuugacagacccccgaaccagcucauucccacgcccccuuucagcucuguccuugggcugauuuccuuaagaggaagagccaggaucagaugaggcguccuggcaggcucuugaugcuguugaauccugguuucccccucgcuagaacugagcugcugccuggccauagccccaugugcccugucuccagagaagucuugccacaaugacccucccguacuccugagguuccugggugacggguuggggugggguggggaggacaggacauugauugcugguuagaagaugcacgaggcaacugcagaaguacacucccaggguacccuuuucucccugaaacuucuuacgggcacacauaugcccuggucuuuguucccauaccccaggggaaaaaacacuguauuucuguuuuauuuagaaaugauuuaaaaaacauuguacaaaggcugaucaguuuaaaaugugaccgacacugagaugcugugaugucacccaggccgaggggaagcugagcucugggggcucuaguacuuugccccucugacugcucugaccugggcugauggacaaacagaugaccgcaggcagaagaauccaagauuggaagccucuaggcugagcccucucugggcccggcccugugucccucacaucugcagccugggcugccugccuccauccccugcucuuucgcaacuggccuuggaaugccaggagccaacagggagccugcggggccuagagcuuucaagaagugagcaccaaccugaggagagggaccaggggacugggggagggaggcccagaggagaggacuagaagagacaguuuucucggacccuggaagggcccacugauggggacacaagacccagccagggccaccuggauggcaggggcagauaauaagaccuccuugugcuucaucugaggguaagaugagugcuacccucagccucucucagagccuacaggaguuucaugugaguggacagcugugagcuaauaaagugcuuugcaaaguauaaaac

SEQ ID NO: 1206 - RNA, 5941 nt, Mus musculus
gacaauaacuggugugacguguccaaccccaaacauacaggaaacacucaguaacugugguguguucagguguguguguguguguguguguguguguguguguguguguguguguaaaagagucuugagaccaggaaguuuuuggccugggcugcuagauggcccccuucuuuaugcagcaccccagcuucauacucucacacuccagacuugaaccugagcaugucgucucuggauggagggaggaucugucccugcaaggggcagggcuaggacucaaagcgacuucggagcugcuugaauuuggacuuguuguauuuagugaugagguccaguuugcuguggcccaaggucagccguuucucaggugcaaacaggucauugcuacuaccauucugauggccacucacgggagccccugggaugcccggcucagguuucugccuggcacccugcagcugaugauacuuggugaugagguccaguuugcuguggcccagggucagucgcuucucaucugcagagccuacuccagccaugcgaacugggcuugguucugggggacaacuggguccaggucccucacuccugaaugggccaaacuugguaaugagguccaauugacugugaccuagggucugccgucggucaucuagacuuggcuugcugggcccggcagaagaauaggcaucggaggguaucuuaggagccuggggcuugggguucuguggcaggagguccaguuggccaugguuaugguuuagggacagcuuccuguucucuagacucagcucaccaggucugagggaaccugacucaagaacacccugacccugggacaggagauccagcugacuguggcugugacucagggacaaucuccugucaucuagagccagcucacggugcugaagggaacuugaaucgggggugacccuagaguugggaccuccugcuucucccgcuuuagagaaggggcugaggcgauccagguggucauggcuuuggcucagggauacuuucuucucuuccacugucuccagagcugugccagguacccaacggccgcguggaaggcuagggucuuggcuugcugggagcccauucucuggaagccgggacagugcugggaccccccuaguaaaguggaggagagggcgggaacuugggagcagaggugaccccacugccagggucaaaggacugguacugcugugguugagggcgggagaggacugggaccauggcgaugcgcccagcuugcucagguuggcccuauaggguccaggaggggagauaugguugggaucugaaaguugacgauacagggauggcuggccaccagcuucaugguaggcaggaccuggggaugaggaccccauacccaugucauugcggccaccaccuccggguagagcaagauaggaagaccgggccagaagaggggagugcuugaugcugcugaggcuguuacuggaaggugaggagccuguggcgcuuggaacugcagguccaaaggccagagucacagggggagggcgagggaccuggggcaucaguggauccucauugcuacagaagcccuccacaggcugugacuccgcauacagacaucggaacucccgaucaaagucuuccacaauguggccccucagcugcaguaccaugcuggugugggccuggcugcauagccaagugaagcuggggggggggggggcagaggggucagaguuaggaaggagucaaagcacggaguccaaggcucggccagagucauaacuagagucgggucaaggaugagggucuccaaagcccuucuguuucccacgugcaguaguuacucuccaugccaaaguauugaguagagugggcuaccaccuagcucuugcccugcauggugccuagcacacaguaggugcuucguuugaagggauggauagaagagaugcgagccguaagaucucagaugcccuuaccagguaauggcccugcccccaggccccucucccucuagccuucucaccuguaacugccugccaccaccuguucacagucaaugaugacaaacuucuccagggccuggccggugaaucggcgaccugccuugcugcaguacgugucuccacaugugcuccguacacgcauauucugggccaagaguagagggaguuuagugggaggguggccuugggacaauggagcucagggcuggagagaugacucaguaguugagagcacucuuucagaggacuuguguucuagucccaacucuuucugugagguggcuccuaauucccuauaacaccagggcauucuggcaccacuggccuccaugagcaccacauacauggacccauaauuuaaaauuauaaaaagaaauugaaaaaaaaaaggaagaagaaaaaaacuggcagucaggccaugucugugacccaaaggguguccagucccucaaagcuaaaggagcccuaugucccacuuucgcugacccccuaaugcucaauggccaccaacuggcccucuugcccuccuaaauccccgcccccuuuccauguuuguagcgcucagcccauacugaccaccagguggcccccauugagguccaucuuauaacacaucuccaggaaguacuucaggugcuccugagccagaaggagauagacagggacgccacgucggcuggaggccuccaucaggucgcacaggagcuccaugucagugaaaacguccaucaccacagccaccaccugaaagaggaagggcauauuccggcccaggaaaaguauggggcuggaagccaggagccaacgcaacaccagaaucagauucucauauaucucuaucucuaugucuauuucucuaucucuauguaucuaugucuagaucuagauccaaaguccguaaccccgcaauccaagcuggccuugagcucacuccugucucagcucccugauuauugggauuucagcaugugccaccgugccuuagccuagcauucuuagcuuggccacagggagaauugacugucuuaaccugguuguuuuaaaguguuugagauguuuuucuuucucuuuuucuuucuucaagauguauuuauuauuccgggcagugguggugcaugccuguaaucccagcacuugggaggcagaggcagguggauuucugaguucaaggccagccuggucuacagagugagcuccagaacagccagggcuacacagagaaacccugucucaaaaauaaauaaauaaauaaauaaauaaauaaauaaauaaauaaauaaauaaauaaauaaaaaucauuuauuaugucuacagcauucugccugcauguaugccugcaggccagaagagggcaccagaucucauuacggaugguugugagucaccaugugguugcugauacuugaacucaggaccucuggaagagcagacagugcucuucaccucugaggcaucucuccagcccuugagggaugucuaaggacagugucugguaacagagucucaaagaugcuuauagaucaacuaugugaguuaaagcucuguuuguuagagaauuggagaaggcaggagucagaagcagaccccaguuuuuaggcugguuuccuauauuccucauuggcaccagcuucacucuggccuagaggagccugccucucugaggcuccauacaaggaagaaagcugcaauccaggcccagggauucucaugucuuuugucaagccuugcuuuugaagcugcagaggucuggugugacagcuuuguucacaacguccuguugucugugcuaagugaagccagucagcugagagcugagauuuguaccuccaauauacaggguauuucucaugcccccagcugucccuucuucccauugugugugucuacugugagucuucuguccugugaaguggccugggagggauggagaccaccacuguagcuuggagccaaaaggaaguggguucgaaugcauaauccuccacuuccuagaaguagagucuugggcuuagcuagagagccucagcuuccuagucugcuacauaggugcaucccauaguuacaagggauaaagcugcuaggcacacaacagaagcuaaacucuuuccccuucccugcugccuccuugguggcucagcccaggagcccgacucuuagcccaggggcacaaaggucuaauugguggugagcaggcagggcacuggggaugcucuccuaugcagcacaggucuggccagugagggaggagccagcaggaaagaucaaagggggacaaggaugacaacggcaacaaacucgcuaauuaccccacucucgaugccaaucaaacucaguccuccugugccuagggcacaggcgagcuugcuagcacggccuuggcggcgcuggugggaucucaggugggacuaccccuuccuaauguccccagacucagcagcgaccacucuucaguccuccuucaugacaaaauaaagacauagcccaugccaaaauccaccuaccagugcccuccgcccugcuucagacccggcugcugaugcugcacagggcuugcugugcagcugggguuaagcugagcugugccccggguuagacccagacaaccucucugggcaaguuccuucuagacccucucugucuuuggcgucuuccuucguuagucaaggugggcuguucauauguucaccaugguugcguucuuagucugggguggggagggaggagucacagaacuuucugagggccagagaguuaguucagugguuaagaacagcaccgguuucucuucuagaggacuuagguucgauucccagcacgcagggcagcucaacaacugucugucacucuaguuccaggagauuagaugcucuccucuggccuccacugacaccgggcaugcacaccgugcacacacacacacacacacacacacacacacacgcaaggcaugcaaaacacucaucaacaugaaauaaaaauaaaucuuaaauuuuuuuugauacucugaagucuacagacucccucccaagaaagauaacguaaggauccuuuucaguaacgcaacaugcacuucuggggugaaguuccagagcccugagcuaugcucuauaaguuaaggcucaugaaugccaaggguaccaagaaaaauaaaacaccugcccaaccucuacccacugggaaucuaacagagggcagagacucuaguuccaauucuccauuuacgcuucuguguggcucaaacuggucucccaccccccaaccccaccuccugggagcccacaucugugcccacagcuaugaaauguaugaagaggugaggcucuuaccguuugggccuggcugaagaggaaucgcagcagguccuugaugcucuugcccuugucucuuugaaaaugaaccaccgccugagugggacugaaaccuguggccuggggcacuucaggccagcccagguccaggucugggggaucuaagucagaagccauagggaaguaggugccugagguaacuucagagagcaugcugaggucuuggccuaaggucucugaccccugggccucgcugagcucaggaaccccacgcacauggcugaucauguaguccacguccagggcacucaggaagggcagcucccgcucuucggagaugaccugaagguaggcagccucuccccguuccaggagggcaucugccgccagucuugcagccucgcugugcuggagcaccaggggugagcucucccuccaccagggccgcuucagcuccuccacccggcuccgcagggguccugccaugcccugggucccagcgggugcuauucggcuaaaugugcguauccaccuagagcccaacccacccgaggcuccaugguuugcaucuggguuggcugcuauaaggaagaagauacuggcgccagcuuggcagcccugcaugugcaa

SEQ ID NO: 1207 - RNA, 84310 nt, Mus musculus
aggaagugcuucagccucuaagcucuggcuccuggucagucacugaagcagcaaugucuucucuuguccacuucucaugggauguaagcguucuuugacugagacaaucuacuugcccauugccacagacaacuccucgcauccuucuuucuccucaauuacuaauuuugcuuuguuuguuuguuuguuuuguuuuggagccaaggguuucuccuggcuguccuggaacucacucuguggacaaggcugucuucuaacucagagaucagccugucugugccucuugaguacugggguuaaaggcgugugccacaaugcuuggccuuccuuuacuaagucuuuccuaucagucaguauucaaagauguguuacagccaagcacgagccucaagcuccucuucugucgagcgucaggucaguacuugaccaccuccuuuucuggcuuuccaggacugugcccuuagguucucagacucccaggccucuuuuuuaacuauugggaagucugagccuuguggucuccugggggcggagucaggaaagaaauggcuguuagggguuaacggaaggaugagagggaugugagaggccaggccgggguguguguagaggaagaacgugagcccuugugacgcgcagcagcgacuuaagaccggcgaggagucucgcguccuggaaccucauucagauccacggcaggaaaaccgcgggugcgcaguugcgaaaacuacgccugcgccgccuccagagccugacuaccuuuagcaaggggacagcggcugaguggguggugacaaucgggauuccggaagcccaccuuucacccggaaaugauuguggaggaacauggcguugcuggugcgaguccuugugagugcaggaguacuuuucuagagacgcacgcgcgucuccagguugggcuuggagagggcggggcgggaggagcuggggagaaaugggggagccugugcuguagcuccuuugcguggucgccuuuccccagggaaacugaagcaccuuuccacuucuccuuaccccuguuuuggccuugacuccaccuuuuuagaagguaguggccucggaucuuuauguaaugaggaucguucuucaggauaaaaacacguggggcacugacuggaauaggggguugcggggaagaccgggggagguggguccaguccaugacugucacugugcagugugaccuugaguaagauacuggauggucccugguccaugugaaaaauaaggacauuucucuguuacaggccccuuuggauucugagguuuaguuuguuguagaaacuuuaaaugaauuuuuacuuguauaguucaguggaaugcacaaguuauuagagcaaaagcugcaggagaaacugccccguggcuuucucuuugcccagcguauuuggcccaaccuaacacuuguugaaugaaggaaggaaagacuucuagacugguucuaagucucguggggagcucuguucaauucccaccugagauuuggucuuaaauccucuggucuuaaauccucuuuagagucacuacugacuucuaggacggguuaagaaaaugacagaguggaauuggucccuacucaugaagacaugggcaguuuguaauuuaagucaggcauuuacagaacuuggucaagggcacuguuuuacauagcagacauuacuccugccucuggcugucuuuugcguuguccauguguuuugcaucaguucacucugcauucuacuuagauuccuugccauccuggcagacugcuucuucaguugcugcucaagagguuuuguuugagaggcaugugccuguuacccagagagugguucauuugcuggaguaauuacagaugcuaacuaaggcagaaguggaauugagcucugagggugacuggggaaaauggucacuggccuguuguaaauuauuuaugugugcacaugugcagcggcucguguguguguguguguguguguguguguguguguguguguagugaggguuaauuauuaugcaugcuagguaaggaguuuacugcugagcccuacauuauuuuuaaagacagauacuuuggugggagaaagagcagauugggccagagacugaagugaacaccuggauuuaccguggcgauucucggacagcucucuuagauuucuaguuccucagcguuguagggauuguuacagguucauuucuuugcugauagcauccauaaaaacuaucucucaucgacccucuauuaggugggccuauuuuucuauuuccuguuuaucuuucuugguacaaacaugcacaaguaaauaaggaaaaucucuuuuacaugcuuauucccuaagauugucuuauacauuguaacagaaugagaugaagcuaugaaaacgucccugggcagguucacggugaaagucaguaugaaaguaguggcagguguuacuacucaucugcuuggauugggauuugggcugcaagggcuccgcacuaacacucaacugagccucucuagaccugggaagccuugguggaaaucuuagcuccaccacuugcuguagacagaauccuaaguaucugccuuuuuuuugagccucagcuugcuuccuuccuuccuuccuuuuucuuuuucuccuuuuccuuuuuuuucuuuuuucuuuuuucuuccuuccucuauucaucucucggucuuucuuucuuguucuuuugagacagaguuucucuuuauagcuuuggcuguucugaaacuugcccuguagaucaggauagccuugaacucagagaucugaguuauuucuucaugugugugggugcgcacaugccugggcacacaugccacacugaauauggagguuaagugacagcuugugagucccagggauaaaaauccaggucaucuggcugccuuuucccagugagccaucacacugacaccagaguuuugcuuuuguuuguuuguuugucuugaagcaggguuucucuguguagcauuggcuguccuggaacucaagaucgggauggccuacaauucauagagauccugugcuguuuuacagcuccaccaccaguagacaaaaacauucaguuucucuaagcguaguuuuuauuuguuuuguuuucaguuaauagucauucuaaugggagugaaccaguuugugcuuuuaagcugcauuuccacagagacugaucauguugagcuucuguauccgucacuuguguaucucuggagaaaugaccaagcuguaugggaugaggucuuacuuuguagcucuggcuggccuugaacuugcauugauccuccugucuguuuuauuuugggggaagguggucucuacguagcccuggccuuccugggacucacuauguaggccagauuggccucaaaguuacaguugccucccucugccuuucaguugcugagguuaaagauuacuaugccugaauuguuuguuuuuuuaacaaacaugucuuuuuuuuucuuuuaaagauuuauuuauuauauguaaguacacuguagcugucuucagacauaccagaagagggcauccgaucucauuauagaugauugugaaccaccaugugguugcugggauuugaacucgggaucucuggaagagcagacagugcucuuaaccacugagccaucucucgggcccuuguuuuuuuuuuuaaaaaaacaguuucaaguaggucuuccuggaacucucuguguagcugaggcuggccuuaaaugccuuaccaugauaggcagaugcacuaauuauaagaccuagcccaugguaaaaguuuuuacacuauuuuuugggagagggaugggggaggguuguuuuugugauuauacuggagauauaauuagcacucuaauuuauuacaauuuaguuugaguugauacccacuugauuuuagagauauaagaacuaugcuucuauauaguuguacuuaugucuuguuuuaggauccuacugccacucagaucacagcuuucuauauguauaucaacagguuuauaauugucuuuuauuguuaucuuuuaaauuaaaauacugagacucaagucaagcagugaugugccuuuaaucccagcaguggcaggggcagggggaucucuggguuugaggccagccuggucuacagagugagucaggacagccagggcuacagagagaaacccugucucgaaacucuccuuccucccccccaagaaguuccccagagacguaaaaauaauuuaaaaauuauuugcuuaaguagcuaacuuuacccguguauuuuauuuccucauguagauuugaauuucuguccagcaaccucuuuuuauuauuuugugauuuuagguacaugaguauuuugccuguguguauauaugugcaacacaggcaugcuuggugcccacugaguuuagaaaaagguguuagaucccuugagaccagaauuacagccaguuaugagucaccaugugggugaugggaaccgaauccagguuuucugugagaacaacaguacuuuuaaccacugagccaacuugacagcccauccagcauccuuuuuuggggggugggggggagaguaauguuuuauagaauauguuugcugucuacacauucucucaguguuuguuugucugggaaguuuuuguuuuaccguccacuuuauuuucgauugauaguuuugcuggauauugaaauuuuacuuauuggucccuuccccccaccccuuuuucuuuuugagacagggucccgcaguauaacuuagacuagccucagacuuggccaugguucuuccugggggaccugggugcuagcauuacaguuaugucccgacacgcucaggguaugacagucuuucucguuuaccauuuugagcauuugcuucccagagcuucuuggcugcuacaguuuccgaggauaaaucagcccagcauuacugaggcccccuguguaugaugaguggcuucuugcuguugucaacacuuuuuuucccccucugucuuuugacaguucgacuauguuuuaucuuuuuauguuuguccuacuugaagcuaguugaauuucuuagguuguagaguaaauaaauggugggauauuuucuguugucuuuguguauguauguagauuuuacuuuguguauaugaguguuugccugaauguauuucuacgcaugauacaucaugugcagugccuguggaggccagagaaagagugucagaucccuucggaagggaauuacagaugguugugagcugucaugcgggugcugggaaucaaacccagauccucaggaaaagcaacccaugcucuuuacugcugagccaucucuccugcuccugcugucuuuggcuuguuuuccugucccuuuauuuccuuuaccccuggagccuugcuguuuuguguguguguguguguguguguguguguguguguguguguguguguguguuugaugcuauccugugggucuccagaccggauguccucaauugaaguaucuucaggcuaucaguccuucauacucaguucugcuuuuuuuuuuuuuuuuuuaaagauuuauuuagccgggugugguggcgcacgccuuuaaucccagcacucgggaggcagaggcagaggcagaggcaggcaggcggauuucugaguucaaggccagccuggucuacaaagugaguuccaggacaccagggcuauacagagaaacccugucucgacaaaccaaaccaaaaaaaaaaaaaaaaagauuuauuuauuuuauguaugugaguacacuguugcugucuucagacacacuggaagaggucauuggaucccauuacagaugguugugagccaccaugugguugcugggaauugaacacaggaccucuggaagagcagucagugcucuuaaccgcugagccaucucuccccagcccucaguucugcuuuugagccacagugcuuuucauuuugguuguuguauauuucaauucuggauuaaauacauuuucuaaaaucuuuuuuagacaaucucauguagcccauugaggucucaaacccacuacggaagcaagaaugaccuugaacuugugaagcuccugcuucugcuccccaguguuaggauuauagauguguaccccaugcccaguuuccugugggugcacaugggcuccagcccaaggcuuuaugcacacugggcagacacucugccaauugaacccuuacacagaacuuaagugcagagcaccauuccugcacauguuuauacacguccaguugaaacaggaguucucacugaaccuggaacuugcugguuggcuggguuggcuggucagugggcccuuggagauccuccuguaucuuccuccucagugcugggauugcaggucuacacugccagcuuuucacuaaggaacugaacucggauccuuucuacagacugaaucgucucccuagcagguagccccauuuaaagaucaauuucuuuguugaaauuaauagucucuguuuggugaggcaguauucuacuugucaguaggaucucucucucucucucucucucucucucucucucaauaaccacagggucuccugugucccaggcuagucucagccucccuauagcacugagaaugaccuuggauuucugaucgccagccuccacuuccuaggacugcuggcuacaacgcaugccagguuuauuuggugcugggauggcacccagggugucugucaugcaugguauaguaccagccaagcuguaguuccagucuaaauuugccuugcuucuacuuguaacuuccuguuuucccacaucucuuuagacccuggcucagagaauuuuaucugaaccugauuucuguuuuuaggaaaugauaccugguacugaaugacucuccucaauuuaucaguuuugguuuuuuaagaaagauuuauuuggccgggcuugguggcccacgccuuuaaucccagcacuucgggaggcugaggcaggcggauuucugaguucaaggccagccuggucuacaaagugaguuccaggacagccagagcuauacagagaaaccgucucaaaaaaccaaaaaaaaaaaaaaaaaaaaaaauuauuuguuguguauaugggucuuucccuguauguauauguguauauguguguguguguguguauguauguauauauacacauauguauguauguuuguacaccgugugugugucuagugcucaccgaggccggaagaaagcauuggauccucugggacuagaguuuaggaugcucacgggucauaugguggaugcugggaaucaaacccaggcccuuagcaggagcaacugguggucuacacugaugaaccugucucuccagccacaaauauaucagcuuuaauagaagaaaacaccaguagccaucucucauuuggaaaccauuucaagagaucgaaccuuagcuggaauaaaauauauuuuuaacucuguuugaaacgggguaucucugcguagcucaggcaugucuguaacucacgauccuucugcuuuagccuccacgugagggaagcgcucagagauguguaucaccauuguccaguuggcuuccucuuuucauuuggaaauaagguucugugcauguccugugagagauaucuaaucugugaauuuaggagacaacccacaaaagugccugaagauuuaacauuccagugccuuucuccagcacacacccaacucuccugcccucaaggaaacggggaguggguacagcuuauguggcacuggauuccauauuuaaucuauagaagaggggaccaaaucucauagagcuuauuauuucaugugguuuuuaugacuagagaagccaagaguagacucaguacuuucugacucugaauauacaguucucucuaugcugugcuacuuuuauuguuuuguguguaucugugugugugagugcagacacgugguauagcaucaugcguacgucuggucuugggaguugguucucuccugccaccuugagggaucugagaaucaaacucuggucaucucucuacccauugagccaucuugccagcucacaauaagcuguuuauuuauauuuuauuuuuauguuuauuuuuuaaaaagaugacucuaggccucaucuaucugucugucuggucuaucuaucuaucuuuguauuuguguacaugcaugugcucaugugcaccaugguauggggucaaaggaugaccuccaggaguuggcucugcauccaccaugugguuucaggggaucaaacucaggaggcaggcagcaacucauugugccuuccucaaguauggugcuuuuugcucuuuguuuuauuguuuuuuguuuuuaaauacucauguguauguacgugggagaauaaaagugccagcagaggccagaagagggcguuggaucuucuggaacuggaguuauagacucuugugagcuacucuguguaugcugggaauugaaccuggguccucuggaagagcaaccagugcucuuagccacuaagccaacuccccccuucccccaauucuaauuuaauugguucaaaacucuccuaaugguucuacuuccaguauuaggacuagaaagaccuuuaagguaaccuguucuuuuuugaucucuuaaaugugcaugggaucugaaggggcuaccuggguuccaguauuaaucugaaagcugcccuuuauuaacuuuguggcauugggaaguuguugauacacgugcauuucuuugucugauuaggguaguaacuacauaccuagguuacucagugucgcucuggccauugugagguugaagugguggguuccuuuacccaaccaguccuuugucuccagagucaagacauuagcaucaacuccuaaguuugaaagugguuguuacaaagcacagaacacucaugucuaaguuccaggagguuuaggaacucuugcuaggagccagacuugaaggcuaaauauguauuucuucucccucaacccccuuugaaacauggucucauuauguagcccgggcuggccuuaaauucacagagacccauagcuucugccucccaggggcaggaauuaauggcuugggccacuccagggccaaggauguaauucucacuauuucacagugucaccaguucgcucuacucugauacagauuccugacaauguuuucuuuuuuuagaggaaccagacuagcaucucucaguggguuccaguaugcagccaacugguaucagugucuccuacccaaagacaguggagcagcacuucccagguaaagccuauuuuguuuuguucuuaaauaauuuauuuauuuuuauuuuaugugcauugguguauugcuugcaugaaugucugugugagagugucagaucuuggaguuacaggcaguugugaacugcagugugggugcuaggaauugaacccagguccucuagaagagcagucaguauucuuaaccacuagacaucucuccagcuccauuaaguuuguuauuuugguugguauggaaucuuauuuaugugcaaaccacacugugggauggagaagccccaggagaccacucugagucucugugguguugguucaagucggauucuuucaguaugguguccaggguguugcuucuaacuccuccaguggugcggauagcaugucacagucugauggcguuuacugcuggggacuuuuccagagagucaucguagaguuaacuuuccaguuuucuucugaaauuacuugcuacuuuucuuugggugacaaaauauuuccuuucuuuuuuuuuuuuuugagacagggugucuuagucaggguuucuauuccugcacaaacaucaugaccaagaaacaaguuagggaggaaaggguuuauucggcuuacacuuccauacugcuguucaucaccaaggaagccaggacuggaacucaagcaggucaggaagcaggagcugaugcagaggccauggagggauguucuuuacuggcuugccucaccuggcuugcucagccugcucucuuauagaacccaagacuaccagcccagagauggucccacccacaaggggccuuucccccuugaucacuaauugagaaaaugccuuacaguuggaucucauggaggcauuuccucaacugaagcuccuuucuauaugauaacuccagcugugucaaguugacacaaaacuagccaguacacaggguuucucuguguaguccuggcuguccuggaacucacucuguagaccaggcuggccucgaacucagagauccgccugccucugccucccaagugcugggauuaaaggcaugugccacuacacccggcuuccuuuucuuuaugaacauaaaauccaagacacuauuauuuaaggccuuaguuacauugugaugucuugaaccuugaucucuuuaaaggguuuaaguuuucuuuucuuuucuuuucuuuucuuuucuuuucuuuucuuuucuuuccuuuccuuuccuuuuccuuuuccuuuuccuuuuccuuuuccuuuuccuuuuccuuuucccuuuucuucucuucucuucucuucucuucucuucucuucucuucucuucucuucucuucucuucucuucucuucucuucucuucucuucucuccucuccucuccucuccucuccucuccucuccucuccucuccucuccucuccucuccucuccucuccucuccucuccucuccucuccucuccucuccucuccucuccucuccucucuucucuucucuucucuucucuucucuucucuucucuuuucuuuuuuugauuuuucucuguguagcccuggcuguccuggaacucacucuguagaccaggcuggccuugaacucagaaauucacuugccucugccucccaagugcugggaucaaaggcgugcgccaccacgcccggcagguuuuaguuucuuaauuuuuuugucagucauauaacacuuuuuguuuguauguuuauuuuuguuuuuuaagacagugucuuucuguauagucuuggcuguccucgaacucacucuguagaccaggauggcuucaaacucagggauccaccagucgaaugcugggauuuaaaggcgugcaucaccaccuccuggcuuagucauauaauacuuuaguaauaaaggaaguaaaaaucauuuguuacuucaaaucugaaaaugucaauauuuucauuucugcuggaucucuuccauuuauggaaauaugugcauauuaauuuuuaccuuaggugcccugauagggcugacucugacccuuggguguagcucagguucuugcaugcaugaaggacugggugcagucucuagcccugaagaauaaaaaaaaaaaaagaaaaaaagaaauaguuaaguaccuuaacaaauaucaaauauacauagaauuguauauucaggugccuucucacucacuagaacagauguuauucauguuguuuagauaaccuuuauuuguuauuaaaaauauaaauuguuuuccuuuuuuggcauuauggacucuaauuuuccuagcauauuuuuuucucuuuucuuucuuuuuugagauggccuuucucuguauaguccuggcuguccuagaucuaacucugaagacaaggcuggcccaguacugggaucaaagugugcauugccaugcccggcauaauuuuuccuuauuuuuaauagggaguuugagcacacuaauuaucacauguaaguguagucucuuauuuuacuuagcuuaaggguuuuuuuacguucauguguaccauaggaauacaacaggguuucucuuugugugcguugggcuccuguuucauugugaaucauauuggggggggguugguuuuucgagacaggguuucucuguguagcccuggcuguccuggaacucaauuuguagaccagguuggccucgaacucagaaauccgccugccucugccucccgagugcugggauuaauggcgugcgccaccaugccuggcuccauauuuucuuuacucaugggauacacuggauguuuggguugcuucccugucuugugaguaacacuguaguggacucccgugugcagagaccucucugggaugcugcuucuggagguauguccgaaugggacugcuagaugagaugaugguucuccugaugguucuucacucuaggaaucacugcagugguauugcauagugucaacuuccucugucaguccuacauuuauuggcugagaauuaacuuauggagacagacucucuuacuuuauagagcagacucagucaacucagagcuccgccugccucugccuccacagugcuggcaccagaggcggcaccaccacacccagcuuuguaacugcuauuuuuauuacuccuuaaguucaugcugcuugaguaaauuuuauucucacuacaaagugaaacauuuucagaaauugccuaaccuaccuucuccaaauugcagccucucccuugguuuuaguuuccucaucucugaagugaaaaagcaggacgcggagagcucuccgucuuccaucccaguguuauucuaaguuacuccuuaauucuccaguugccuuuucuccaaacuaaacaacuucagcucauuuuaaccuuuccacuaggaccuguuauuccuugcuuugaucauucugugguucuuuuuuggaucgucuccagguuguccuucucuuugagcaaaguagaagaagaagaaggaaaaaaaaaaaagaaaaaccuaccuaguuuuuauugagcacugauuccaugcccagaaugguguugaguacuggggcagagaguaaaaggaguguaagugggcgguacccugguggagcucacaguuuugcugaacugugagacacguacccacagcauucaagaauucaagaccugcuugagccugccucugccccacuguaccccauuccaagcacggggccccuucacuuucaggaccuuuugguugucauuguucuacguauuuacuuauuauuuauuguugacucauaucucccaggcuggucuugaacucgccguguaggagcagaugacuuugaacugcugugugccugucauuguaggcuuauaccaccacugcagcuuuguguggcgcugaggaugggguccagggcuuuguguaugcuagccaagcauccccagcccucagccuuuuuggaaaugaaaaauaagugugagauuguuuuucggauuucauuucuuuuacugugugugugggugcggcuguacaugugcacagaacucaugggaaagucagaagacagcucucaggacuucacuguaggcauagaguuuuugcaaccuacuuuuaauaaggguucaacccuccuccagcucaccacccagcagaggcaguaaaaaauuauuaggauacggaggaaguggaccugcucagcaauaguucuuuaggggcgagcuugaucuccuuuggcagcagcucuguccuguagcaaacaccaaacaugauucagcagcugcagaccaggccucuagauaggcagacaccaggcaugaaccagcagcuauagucuaguccugaagaaaccaccaggcuugcccacuagccugaggugaggcugcagaaguggcaagcugccccaggaaccucaagagcaaugcuagggugaguuucuucucucaauggugguguuaccacaaguugagcucaacaacagcauguaagauaaacaaaugugugucuuuaucgaagaauagugagguggagcaaaccaaaucaaggcucagugcucaccucccacugucuguggggucagauuucuacuccuucaucagguguccuuucacguguuugguauuucaaaacauccuuaugccugugucugcuucaggaaaacagucuuccacauguuugcuuuagcaaaauauccuuucaucugugugccucagcaagacauuauuuaauaugaucacuuucaaagaacuagaaauguucacucauauuccgcuuucuguuuuucauucuugccacuuugaaggaucuggcuugaucuccgguuaucaggcuugugccccagggccucugccugcugagcauucuuuuuuuuuuuguugugugaaauuuuauaaccuuucuauucaucuaucuaucuaucuaucuaucuaucuaucuaucuaucuaucuaucuaucuaucuaucuaucuaucuaucugggucucacuauguagcccuaacuguccuggaacucacucuauagaccaggcuauccuugaacucacagagaucuaucuaccugucucugucucugagaucugucugcuucugccuccugagugcuggaauuaaagcuguacccagcuucaaaaucuuacauucuucuuagcuuagagccaugugcaagaguuuaucguugcaauugucuggaacagaccuauacauuuauauuauauuuuacauaucaucauuuggacaucucucuugcguacaggauuugguuuggauuuugguucuuagaacacuuaggagagagcugggacuucuuucgcuccauccugguuccuaaucugauacugacuuuucugcucugcccacuuguaggaggcauuuucucaugaaaauguuuucugugucugaguucuguuguuuauauacugccuaucccaaaucucaaugaaucuuuuucuuaauuaauuuauuuauuauauguaaguacacuguagcugucuucagacacaccagaagagggcgucagaucccauuacagaugguugugagccaccaugugguugcugggacuugaacucaggauuucuggaagagcagacaguacuauuaacugcugagccaucucuccagcccccucgacgagucuuguauguucuuauugggauacaugagaaagguaggaaaaggcacaaaucacggguacacagcguaacaacuuacuacaaaguaaacauaugcagcauccagaucuagcggaggacaugaacugaggcuaagucaccuguaggauagaggaggacaugaauugaggcuaagucaccuguaggauguuuuccuaccguuuaugaaacucugggcucucaguccacagcagcauauaaaccacaugucaguaguccuagcacuugagaaguagaagcagggggucaguggguuauccucagcuaugcagugcauuugaggcuagccugggcuacaugagacucuugucacaaaacaaaaaaaaaacccgcaacacauccccaagauugcaagagcuucuuugauuccccguuacccacucccuacuccacggcuagcagaacuuuguauuccauacauucauuugccuuuagacaucugcucugcaucuccuguuugucugcugugagagaugcaguaaguguguucuuuguagugaugguugauucauucucacguaguaugcacuuucugguccuggggaguuggcugcauagcauuuuauagauggcuauaccaugaugcauuaagguccucugcugacgucuguguggauuguuucugcugugagugcaugcuuacacuucuguugaggagagaauguagcauucccgagccuggcaugccgggcauugaucuuaccaaagauguuugcacuuugugcucacagcaggagugucuguucggggugcuccccacucuuccugacauuccuuacuucuuuuuguccagugacaauuucagggugauacuugguucuaugucucuaugcuaaauucauuuuuuucuuuuuuccccccuccuuucuuuguaagacuaugagcugucugaggacagagauucauuucuaucccaaaaccugucugagggcuagcauaccuugaacaugacaccuguaucuacgguguauauguguucaaagauggcggaggucgguagucaaauaaauaauuugcaaaugguaggauuuguuucauccacaaagauuuaugugccacccaugugccuugaguuggacuugauucugaugagagaggcaguucuugccaucaagugcccugagcgccauggaggaagugggcagccuacugcucuguagagaauaaugcuuccugcuuuuugauaaagugguuagggaggccccuugaggacuggggaaagcccuguuggugcuuacccggcauguuccaaguccucccugggauccccagcuccacacaaagcugggcccugcaggccgugccugucauucagugguugguguguggaagcuggagaaugaagaugaaugagcuccacagugaguucagagauagccuaggcuacgugagacccugccucauaaagaaaacagaacaaaaagccccgaaucaacaagaaaccaacccaaagaagagagggagaaagaaggccucuuugaaaaaguaauguuccaauuauuuugaaagauuaaaaaacgugagguguuccaagguccuuuuugaaggaggcauaggcaggaagggugguccaggagguaguguguaugugugggugaccagggcaguggaaggcguuguccuggcacgucccacauuuucagcaguugagugaaguagagagaaggaguccauugaccacuguggagcuguggggccgaggaaagaugccucaccugacacugacuagggagaagcccaacucaggcugcacccaccccguccucugaggcaauuuaagugcucugcguccuagaugggccauuucacugauguaugugaugucaugggaggggucuguguuuagucuguauuucacaaagccugcuugguacuugagaauuaaagcauaagucugacuaaucuuuuaauauccuuguuuggaaagaaauucaaauaguacuauuccacaaugagaaacuuauuuuuccuuuauuaagaugaaacaggaaaaucauuguuaauuuuauuuauuccuucucuuuuuggaauaaaccagaauugaaggauuaacccucccucccaucuuuuuuuuuuccuugagacaguguccugucugaaacuuucuauguaucuagaccaggcuggccucaaacuucugccccucugcauccugagugcugggauuaaagacaugugccaccaugcccagcucccaccccuggccccuuuaauuguaaaggcaguuaaaguguuacugggaauuuggacccugaauucccaagcuuacccguaacucuuucuuccauuucccuccccucuccccgcucucucuuuugugguucaggggaucaaacccaaggccuugcccauguuaggcaaagugcucuacugccuuuuauuccuagucugcuacccacaguuccacuguagccaaagaacccuuccauucccguguuacuucuuagauuuacccacaugcauucaugauuuuguuuguaauuuuacuuauauuuuuaaaauuaaaaaauaaaaagguuacuuuuuuuucauauuaacuguuaguauaaacuauggacuuugaguggacagugauagucaaaguaggcucauucccggggcugcaaugcugacaggaugagugauuguguggggaaaggaggagaauguaugugggaacccugugcuuucugcucaguuuggcuaugaaccuaaagccauauuaaaaauagcaccauagccaggugugguggccuaagucucuaaucccagcgcucacucgggaggcaggcaggagcgggcagagcucugugaguucaaggccaggacaacacagugagacccuguccccaacaacaacauacuguaaucucagcacuugggaagcugaggcacaaagaggccagccucagcuacagagugaguuugaggcuagccugguucacaugagacccuuucuaaaaauaaagaaguaaaaaauaaaguuaaauagaguaaaaaauaaagucagauuuugaaaauugaauccagggguagaaugguugcccuacaaguacagugcccuggguucaauucuugauuaccuguuuuugugagucaucauaccuuaauuuacugucucuuaguggguauuucuguuuucacuguuguagagcuuacauauagaaacugauuuuccaaacuguauucuugguuauagcaauacuaaccaaguagaauuguaagguggguaaggaaucuguaaggcauuuagugcagcccugacacaugaccacaguuggcuguguagucccacaguggugucaaaggcagugugacugaaagcaaggcaggugugaccugguggcggcugccacuuccuuuauuauugaguaccuguuuugggagaugcacucucugucucuuucccauccgggccucacuguagcagaggugcagcaugcaguuaauggccaaugcgccuuuagguggcagaagcaggauuuuucuuuuuuugguuuuauuuuauuuuuaaauucauuuuaguuuacuguuauugguauuuuaucuugauguauguugcauaugagggugucagaucuucuggaacuggaguuacagauacuugucagcuaccuuggaugcugggaauugaaccuggguccucuggaagaucaaucagucagccaguucucuuaacagcugagccaucucuccagccccaagauuguuuguuuguuuuguuuugcuuuguuuuugagacaggguuuguuucucuguguaguucuggccguccuggaguucacaguagacaaggcugaccuggaacucagagagaccugaccguuggcagaguucucuugccuauuacaaucuuaguccucucguuugacucagguucagucuguauuuuuagggcugaauccuuuuauuucuucaagaaguaauuaauuuucugguuuuauuuuguucuuugggucagucucacacuaugcucugggaugguacugaacucacagcaauccuccugccucagucuuccagagauuuuaggugcgagccaucaacaccugagcaccugguacauaccagaugcuguucugggugccggucauggguccuuuggaugaucccucaugggaagcugggcuaagcaaggcuggguagaaccggacagagcagcuccaauugggucaaccucacuaagcaguucucaguguugccuacgucugcuugcucauccuccaguggcuccagaagaaucagucucgaguguguuugggaucagaacagacuguuggagcggacacagcgcagaauaggaaauaccacaacacaaguaaggugagucuguucucugcuguagacugcgguaagugaauguggucggucagcucggggacuuagccaagguuagagcggaugguaggagucaaacuaacugaauaugugcaccucugucuccugagcagauagccugagguuuucccacuguagacucuugccaagaaaauauuuuagaaggaaacaauuuuuuuuuaauggauuuuguacaaauuaaaaauagucauaugugggcugggcaguugguggcacacaccuuuaaucccaguacuugggaugcagaggcauuugugggcugaagagaugcagguacgagcacugacugcucuucugaagguccugaguucaauuuccagcaaccacaugguggcucacaaccaucuguaaugggauccgaugcccccuucuggugugucugacagcuacaguguacucauauacauaaaauaaaucuuauaaaaauauagccguaugucaccuuguugccuuucuuaugggugauaaugcaccuuucuuugcagaggacugguucucugguauguuuuucccuacucccuccuuccucuuccccuucuucucuuccuuccucucucccaguccuuuccacucucacccuucuccccacagcuuugccuuuccuuacguuccccuuccucacucucauugcccuuauauaaaacaguagugacuguuuuaccugcauguauguccugugcaccaugugugagccuggagcccugugaggccagaagaaggcaucugauccccuggaucuagagugagagacaggcgucagcugcuaugggggugcugggaauugaacccagguccucuggcugagcagccagcgcuguuagccacugagccgucucucucuuuuucaugaugccgcaagucuauucuuuccuaaucaugggaucacaggcacgcgguuguugagguggguaugucucacucuguauguaacauggaggauaucuguuagauagcauuuagauguguuugcacacuuacgugagggcucugagucggacucugugaaagcacacuugccuagagugugaagcccugggcuugacugaaguaaaacagaacagaaugcucagagcaaacaaacaacaagcaaagcacccaaaucauuacaaagaaaccaagagcucaggcagaagagaagaaaccuaugcaguaaauauguccuuagagcaaacagaucaaagcauucugcuuagaaaauuuucuguaacuaauuuugauuucuuucucuuuguuuaaguagcuucuuacuacccaagauuucccacagccuguugaagagaaggucggucccuucacgaagauaauagaagccaugggauucacuggaccuuugaaauacaguaaauggguaaacauuuuuuacguucccuugggucuguguucuuucuguggcucauagauuuguuuuaaaguuucuggccugugaaauucauaugauauuuugagaauuucuucagaauacaucccucuaucaucuaucagauuuaugugguagauaagaccaagguacuccuucagccuaguucuuugcuagucagaacagugagguggaaguuuuuagaugcuugcuugguggcaggauaauagcaucuagauaaguuuaaagggacagaugggccagcugucccucugggcuguucucauuguugauuuuuaauaggucuuaugaaaaauugaucucaugauuuacuauaauacauauaacggggggcuggugggaugccucagugguuaacagcacuggcugcucuuccacaggacuugggcucaauucccagcacccacguggcagcugacaacugucucuaacuccaguuccagggguuauagacacagucucacagacauacaugcuggcaauguagauaacauaaaaauaccgggaagggaaauuucuagcuagcuggucaucccucgucaacccugggccucucacauuaccuguuacacagaaggcgcuguggggaggcugcagaugcuagaucucagcgauagucuugacaauccauagauauuuuucauaaauauuuauuuauuuuuaaagauggagauaaaauagagugugaggccaguugggcuacaaaccauucagacaacaggggcuacgugaggucuugucucaaaaacaacaacaacaagaacaaaauaaacugucggcaaauagguuuguggcccucuuaguugagggaaggugagagcggcggucugacagugucucgggacacuggagucuccccugucagggcuugaguuugcuuuccuuccuucuuuugguguagaagaucaagaucgcggcccuccgcauguacacgagcugcguggagaagacugacuucgaggaguucuuucugaguaaguggcuccgauuguuccggaaggcauggacccgcuguugauuucuggggcugugggauugaaguuuguuuauaagcauuuguuuuguguguguguguguugaauguauuuauuuacucaugcacauauaagccagaggacuaccuugguguucuccucagagacaccucccugucuaccuccucugcaacagacagggucuuucguuggccuggcgcuuuucagcuaagcagugcuuaaugacuggggagcuccagcgagccuccugucccugccucccccaucaccggggucccaagcauaggccacucugccuggguucuagggaccaggcugagguggucauguuugaauggcuagcacugucaccuccccagcccuuauuuuaucuaucuauuuagguauagucucuugugcagcuaagggugaucuugaacuccugauccuauugucucugccucccaaguguugggcuugcagccuugugccucugcucccacucuuagcaucugaugaggacuuuuugucaguagguuuucuuuuuguuucuaguucugaauuguuuaguugauccugaauuaaauuucaugguucuucuuucucuuugagggcgauuggccccaaaggguaauauaacuuuauaacuuacauccaguugauccaucgcuuaccaggggauuuuacugguuuagaucacugcuaacaguugauuaucucaauauaggauuaauuugaugcuguaaccuguaauuauuagcacagcuaacuaaaauagguauuuguaagaacacuggaaaaugucagccaucccuguguccacagacuuuagagcagugguucucaaccuuccuaauguccuaauacagugacuuuaauacaguuccucacauuguggugaccccaaccauaacauuauuuuuauugcuacuucuuauuuguaauuuugcuucugcuaugaaucauaauauaaauaucuguguuuuccaauggccuuaggugacccgggugaaaggauugguuuacuccagaggggucuggacccuacagguugagaaacacugcuuuagucagacaccuaugcucuguguucuuacaacuggcacuuuacucugcaacaaauaucuguccguaguuagcgaaggacacuagaugcaguuuugauugcuugauaacuauauugguuguuuaaaagcucaaauauaagcuauuuugguuacuuuaccacuucaacagauaaauauuagggacuuaaaauacuauaaugaguuauaauucuauauauauuuuuacugguuuccuaacugugcuaauaauuacaguuuauagcaucaaauuaauccucuacugauauaaucaacugcuaguagugauccaaaccaguuuuaaaaaaaaaaaaaucuauuuucuuguucaucaggaaagacaguuuuucugcuucuuugaaaacaagcaguuuuuuuauuguuaauuaaaaaaagucacaguguguguauguguauguauguaugaguacgugugcacacaaaugcacacauguacauguauaucagcauaaaugccauggggcccauguagaggucagagucagaggacaacuuauaaaaguuguuuuucgggggcuggagaguuggcucagcaguuaagagcauugauugcucuuccagagguccugaguucaaaucccagccacccacaugguggcucacaaccuuccguaaugagaucugaugcccuugucuggucuucuggugugucugaagacagcuacaguguacuuacauauaauaauaaauaaaucuuaaaaaaaaaaaaaaaaagaaaaaagaagguguuucucuccaccauguggauucuggggaaucuuacacaguuugucaggcuuggcagcaaacacuuaccuccugagccauuuugcuuugccauuugacccgaguuugccugagugaauguguguuaucaaccugggcacagccacgguagaguccuguagccucagacccacagaaaaauggcaaagcuucucuggaugaggcucagggauauccaacucuuccucccaugucuggguucgagagcugacgcuuuggguagaaaauguccgcuauagcguucgcccuccaggaagguacagcuugacgacugcaauacagagacugucuacugagguuagcuaaccuugucugcuuggccaucuguguaccuuaaacucugccuccugguucagccggguccauaaccccaucucuguucaaaucucuguaauagacacucagcuuauggggugucaugauuuccccaucuaagaccuuaguccaccugaaccagcauuucugucuguguccaaauguccaucuguuugucuuuucuucauuuccucacuacccccacucaagucccuugagccauccaaggacacagccaccagacaugccuguaccucugcauugugagagggagaugacaccuggugcaucugggagcuugcuggucagccaaauggugagcucuuccugucucaaaggaauaagguggagccauaagggaagacaucugauacucuccucuagacucugcaucacaugcaugggugcacucaaagauucauaugcauguacuacacauacauacuguacccacagaaaagaaaaaacaaaaguuuaccaucagauauucaauacuugauuuaauuaauuauucacauuuauuauaauuauuuuagaugaaugcuuauuuucauucccuguuauuaaagguuccuuuuuuuuucaguuuuacuuucuguguaugaauguuuugucugcauguguguaugcacuacaugcauguggugguguuccacagaggccagaagagagcauuggaaaccccggaacuauaguuacaggcauuugugagcugccaugugggugcuggaaaacaaaccugggucuucuucaagaacagcaagcgcucuuagucuagcucccuacugaagauucuugaguuuggauuaauauuauagaaucaaauaaaagacaguuauuacauagguaguuaguacucauauuucaguccauagcuugugaugaccaacugaagaaaaguuucugaaaguuacaauuaucuauuaauagcucacacuuauuugcuuucauguuugucccuuuagcaguuucacaaucuugugggauagugugugcuuuuguauuauuguuuauuuuuguuuuguguuuagaagcaguugaggcuuaaaguggcucagugacuugcccaagauugccuagccaaggccuugcaccuguguugucuggcuuaaaccucagggauuuuccugcugugacaugcugccugugaaugaauguaaccacaaacuagaaauugcaguguggcuuaaaaauuuggguuuugcuuuauuuugacaagagcgugcucugugagauguuguuagugcuggacacuguguguguauacacaccauggcgugcgucuuggugaguuuggccuggcuuuguccuucagugcaaguggcagugaguuuucugcuggucacacucucccuucaguuuuucuaagacuucaguaggcauuuaccuauuaaaaucuauggcuuagccugggcauggugguaccugggaggcaggucucugugaguucaggccagcuaggacugaauagagagaucccguuuccaaacaaaacagucacaaaacccuguaacauaagcaggcauuguugugcuuacuuguaauuuuaguacucagaagagagaggcuugagcauagccguaaacuuaagguaagccugaucaacgugaguuccaggcuagccaggacuacaaaccaagcaaccuauggcauguuuauuugcugugcccucgcccccucccuuuuuuuuuuuuuuuuuuguuagauuuacauuuuaaaauuaaaccaaaggaauuccaaaguguggcuagugaacaaagaacagauuuggaaaguaacaucuggaggcaaaagauguuuguuuguuuguuuguuuguuuguuuguuuguuuuuaaauuugcaaaauaauaagaaugacuuucuugugguuuggauucuaaggaaguuaguggggguuggaauaaaauagguagauuuauauauugcuuccuaagaugauaccuuuaaaguagccaugcccacuuaggucuuugauguaggacuugguuccaagaguccugaggacaaagagccuuggguaucugcaagugucauucucccuggcucaagugaggcugaggccauuucuugaagacuaugugugagcaaguugggucaugguaugcugugucugucagcuucuuggacaguccucccuaagaucccagagccagagcgugugauguugugauguugagaucucaagcgcucgcugcaucugagcagucagauucuuuggcagcuguuguuuaugggacggaugcucuggugaugcccuugcccaucacaugcgcaugccugcugggugaugcaguuuguuccugguguuuuggagcagagguggucaguuaucgaagcucaugcuuaauucugaauucuugucuguggcucuuuuugccuccaagacacugaucaccguaguggggaggaggcucuaaugaagaaauucugagccagcaguugagguuucaguccacuuuguggcacaauuucaauuaaccgauaaagcuuuucaaagauaauuugaacuguauuauuuaauucacuguaaaaaugacaacaguggauauugagucccuauuuuaaaugggacauuuuguuaagcccccuuuuuuuugagauggucuauauagcccuggcuggccuugaacuugauauguagaguagcauggcuucuaccucagaucuccucacauaugucuccugagugcuagagcuggggcuagaggcuugugcuaugaccacuggcuuugcuaacuaagcuggauauaggccuuuuaacccuuguuugucaucacagcucugagcugggcgcucuugcucugccuuauggagaaggaaagugggucuagaaacaucaucuagaucugcuuaaaaguaacagggucuggauuuuugccuauuaaaaagugggaggcagaggcaggcggauuucugaguucgaggccagcuugaucuacagagugaguuccaggacagccagggcuacccagagaaacccugucucgaaaaaccaaaaaaagaaaaaaaagaaaagaaaaaaaaaagugguauuaucacucucuggugacaauagggaauuauuuaaucugacugcacuuugucccuuuuuugucuauuggagcaggagugugcucauggcagugucucaggguuuagcccugagguuuguaaacacucgguugagcuaagaaucguauuuuuguguugcucauagucaacauccauucguugguuugauauuuuugagguuuacucuguggcuuuuuguucugacuugcaugggcacaggggcuuacucacgcgccagcucuucucaucagcccugagcugaccccagaagggaaaacuuugacccagggccagcugcugaccugucugucugucuguuugucugucugacugugcuuuccaacccaagaacugacucuccaucugaggaaauuggacaggcuccuggagguagcugggaagccgugauguagagguagccauuggacagacuguccuguacaaacagccagauuucacucuccagcuugaaagacagacuuccaagaaaaccuuucuuuuuaauguuuuguucuaacauccaaaaaugacccaacuugagauccgggcuugagaguuucucggggcuauucuuguucuaggcggagggcggcuggccggcacucagauggcauggguuuuaguagcuggauggcuggucaggccagccuccagcucccuccugcugggcucagagaggaaauccacuugacagcugcugggcaccacccgguaagcucacucgagauuuuugguguccuuuugugacagaccuggauucaaagccuagccuugccucuagcuuaacgugguagcuacccauagcuacuuggccuucuguuuccuuaucuuaaaguagguuuaugguacuucuuuccugcguugagguaaagauuaagagaaauacuguaaaagaugauuagccuugcacuggguguggaguacggccguuucuccacauuuuggcauuagagagcuucuugcguaacaauccacacacugcagauagagucagggaagugugaaguucaucucagguaccucacuucgugggcuguguuucccugauccuugauuccacugucagcuuucucacuggccacguacucgggauguuggacagauuuguugagcugcaggccgugaagcacuuauuacgccuggccuguuagaagcccagccgcagugaccagggacucccuaauuaaugcugacugugguccucccuccuaggguccugcccuggguguucacucuuagugacccugguuaaccaucaccucacugaacgcugacuggcagaggauacuuugggagguuuuuuuuugggggggggggcaggggaguagggaggggugggcauaaguucuaggccugcacuaucaugcccggccuuacuccuccuccucuuugugagucgucacuccagaagacugauccuaccacaagggcucacgugcccacuaauucccucucauucauccauccuuccugcuccuugucaagcuuugcuccuugucacauaaggaggauggaacgucuaguagggaucccuuagcuacuggagggcuuucucagaugugugaggaaauggaugucugaacugagaccuggcucgcagguuauaaaccaagagcuuagugugugugaucccugggggcugacaucuggccuuugaaguggcugcugucugagucccuguucaguccuagcuccuaagaguuccacuuuucucucuccuggcuauuuggguaaaucauuuggcacauucauggccauaccacauuggauugucuuuacaaacuuggaaacagagaccacaaggcuuaaccuuugcugcagggcucaagugauuacaguagcugaugcguaaggggagcaggagaggugguguuugcuuagcauuuuagacuucaagccaggaaaaggagaauagcacagaacuucaugagguuggaaggaacguaagagaucaugucugccacauugugucaaaugagaaacucagagggaagacacagucugcucaagguugcuaggcuacagucugcucaagguugcuagccuauggucugcccaaggcuguaagccuacagucuguccaaaguugcuagccuaugaucugcccaaggcugcuaggcuacagucuguccaagguugcuaggcuauagucuguccaaggcugcuaggcuacagucugcccaaggcuguaagccuacagucugcccaaggcuguaagccuacagucugcccaaggcugcaagccuauagucuguccagggcugcuaggcuacagucggcccaaggcugcuaggcuacaaucugcccaaagcuguaagccuauagucugcccaaggcugcuaggcuacagucugcccaaggcuguaagccuauagucugcccaaggcugcuaggcuacagucugcccaaggcuguaagccuagagucggcccaaggcugcuaggcuacagucugcccaaggcugcaagccuauagucugcccaaggcugcaagccuauagucuguccaaggcugcuaggcuacagucugcccaaggcuacaaagcugcagcaaggcuggagcuaggaggcugguugugugcaucuguugcuccagccuauggucuuacauuguguuuuuacugaucuuuucuacaaaugcauaaucagaaauaccauacugccauguauuuuagcugaacaauucccaccagugguuaaaacaagucaguaugccuccucugcgccuucaccuacuuacacuucccuguuauuuccuagggugucagaugcccgauacauucaacuccugguuucucauaacccugcuucaugucugguaagugaggucaucaaaggcgugcgugcgugcgcaugugcgugugcgugugcgcgcguguguguguguguaugugugugugugugcacgugugugugugugcgcgagugcuuuaagauguggcucuccuugggucugauuauauaaaugguacuuguucaagcaugaaaaccugucccucucauuuucauaacuggugucuggaagcacauuuuuauuaaaggucaaagcauaaacccagagcgaaacuaauauuuguaauauuuuuuuuuaaaagaacaccuaaccccaugaauaaugcuaucaguaucucuaagagacucucugaggcuggauggaaaaguccugucccucagcuguuuuaggaaaguucacauuuacguaaaagugguuugaauugugagaauccguggucauuuucaucgcugaucaucagaaaccuauaacaaauuauaccacugacauuuacacccgugccucugagugugcaugcagguuagaggcaagccagauuuguugcaugugaaaauauuuaacaccuuaaacaguauauuuuuucuuuugcugugaaguagccaaaaaaaaaaauccauuuuucaucuacuguuacacagcauuaaaggucaaagggggaauaggagucacugagggggggcugggggcacugccagaucuugggagaguaaacucuggagaacugguuacuauacugaccacagcgagugcuccauggagcacgggggcggcugccugucaaagggcccuuguuugaacccgccuuuagcugaaccucgcaccacaggccuggcuacuguauaaagauguuugguccugauagucucugcagugccccucuuuccaaacucacugaguuuggcugaggagcccaaaggggcaguuuauggauuuuuuuuuuuuaugaacccucuaaaccaguaguuuauagaagggacacuaugcccugggcacuuugcuggguacuagggcuggcucucaaaaccggggcccaguaagggagagaggccagguauaagcuguauugcuaaguuggacaacgugugugcuucuaggagagaagagugcgcucgggcuguuggagcccuuccuagcgcugcucgucaucaggcagauucugugcuacucgucaggagguugagaaggcucacugucugccuuugguguccacggcggggguuaagcacggggugcagggagggauacuggauacauugagaagaaaacuacuuuuuuuaagagugaggacuggaugguagaauuacucauugggaaggcgggaggguugcgagaaggcuaagcuguccccagaggagcucaaugauaauauucagagccuguaugaaagacucuuuauugcccauauagcuagagguauccgagugggagagggaguggauggcaaaauaaaauauauaaucccugugaccacaucccaaggucaaugccugacuaauagccgagaguaccuugaaauuacuuagauuucuuuaaacuuuccaaacugugucugcucagcucuucuugcugaagguaacucuuuuagaggaguggggugucccagcaccagcuaaguagaagggggugggggggcuucuguuuuuuugucuuucuccagcccuguccuuggucuuacuaucuagauaggguuuuuuguauuuuuuuuuaagucuuuauuuacagaugguugugagccaccaugugauugcugggaauugaacucaggaccucuagaagagcagucagugcucuuaaccacugagccaucgcuccagccccuagauagguuuuugguaaaaugucuuggcccuuuuuuauuggacuuagcaaauccuugucaaggaccuacugaguguuugggaucgugaggugcuggagagaaggcugugauacgguucacacguuuaagaaacuggugggccuugaacacgguugucuaugguagaugauaaugaaaugccuggcucaaagcccacagaaaagcugcggaagcacaaagguagacuacuacucaguggcaggagggagguaccagacccacagaacucggaguauuucaaggcagccaauuggcugaaguguuugggguagguuuguggaggaaucuagucaaaggaucaucacaaaagugguuugggcccaguugaguugugaucuucugagaacuggggacucccacuccuaagggguaaaaaacagaagagggguggauguacccaacaagucuguaggaacauuagguucuucuaguccuguucucuuggcucugagaucccaggguauaaacugaggggcagccaaacuccgacugagagugcaguacagagagacacugcaggagcacaguugaaucaccucuuggaguggcagcugugagggaggagguggggaaacauggagggacagaagcuuaagaagcaaucauaaggaaggacaaaucccuaccaaaccaaaccacaccagacagacgcuuaguaaaugaaaguauccugaugggagccuuuccagaauguuugucuggguccaauaggcgauugucaucccuagcugcuggguccuugucggcaggcgagauaggaacgggaugcuagcaauccuguacauugacgaugguccgcuucuccugucugcucucgcuucauaauuuucuguggguugagauuuaaggccgcagacgcccuucuguccuuugcuaguuguguauucagugagccugcuguggcacugaccgugugucuguugucucugcugaacacggucaguauugacugcagcugcugggaaagaugcuguuguugucacccagcaucccuccaugggcuugguaaacagccuuccuucucccagccagccacugggaguccagucagguggcuggaccagagaccuggaagcucaucuugccuguccuucauucauuuccccuggucagucauuccuuacuuagcucaaacucuuuugacccugagauaacaguaacaaaugaauuuacuuugaaaccaguacgcaugcucacaugggaugcaaacauauaaagcuuguuuuuacaaugucaggaaaugccugguauuuccuauuguauuuggacuaauguuagcuaguaguugaaaguuuaacccaccaaauugauuucaccagagugcaacccccagucccugauuuccuccuuugcucucaaguuucugagcaugccauucacguccuagaagaagccgccuguaccuugacugcucuugucucugccaucgugcagugccguggccuuuacccuacucacuacuggacaacucuugguuucccucaguauguaauuaaagcauuauguucauuauaaagccuuccccucccaucugaaagccguucuucugugacucuuugguagguuuaaacaauuuuaaguuuaaaaaguggauauauaaaaacauaaaaauuauacaugucagugggggcugugcaauauuuugauaccuacauaugugcauugcaugauuuguguuuggacaugugucugucugcauguggcuuuugugugcagaggccaaagaagggugucagguggccugcuucaucacucugccuuaauaaagauugaacaacucagcugcguggugaugguggugguggcgguggcgcaggccuuuaaucccagcgcucaggaggcagaggcaggagggucucugaguuugagugagcuccaggacagccagggcuacagagagaaacccugucuuaaacaacaaaacaaaaaccaagcaauaaucauagagcugcagggguuuauagccccauaggaagaacagcaauaucaaccaaccagagcucccagggacuaaacuaggaucaaggaguacacauggagugacccauggcuccagccauacauauagcagaggauggccuuguuggacaucaaugggagaagaggcccuuggucccgugaaggccgaugcccuaguguagaggaauucaagggcagggaggcagguguggguggguggguggaugggggcacacccucauagaagcaggaggaggggagaugggauagggaguuucugggggggggugaaucaggaaaggggauaacauuugaaauguaaauaaauaaaauauccaauaaaaagguuaaaaagaggaaaaauuauuauuuauauaugagccaucucuuuaagucucagccucucucucucugccccccccccaucauuuuguaauguuuaaauuacagucaaguuauaaaugcucucauuuguuguuucacugugaaaguuuuugaaauucuggaagccagguccccugcagaaucgauaugcgcacuucaaugcugagcucugcacagaguaaaucuuaucccagccacauuguaagugguaaaaagguuggugcuuggagugaaggcguggaaaugacguaacuacuucuuauguguguagcacacaugcacaaaaggacccugaagccgcuuccuggaaacccagaaggcaguuuucaaagccacgucucuacuucaguucccuuguuuacacgaggagggaugguucuggugaucugaugacauuugucacaagucacuuuaugucccacauaacaaugaagaaucugagacaaacccaaagcugacucugugaacgggaaugcccuaguguuucuucuuggugaccaagggacaggggucucuuuuucugaauacaaauaaugacagaaaugacuuuuccacgacuagcucuacagugaacgcugcuuuucuuggcauucacugugucccagaaagcccuggagacaguaggugcuuaggaacugcaauccuugauuucaggggcccagagccagaggaugggccugaacuguuaggagagucagaaguaacuuguaaagauguuuuaagugccaaagcaagauggagagugaacauuaggggagccagguaagacucuuauaaagaagaaaaggaaguaagguauggacuagaaaggguuuggaaaacauaccauccacaucccaguccagcuagggaacuggccuggcaagcguuggcagcaucugccagggccgcuuuaaaagcgcccuugcaguuuugauguagcugugggcaucugggcuccugcugacuccagcagcuucagaccugcuauauauggugugcccuggagcuguguacagcuccuuucuccuucccccagccagaggcugcgcucacacaucuacacacauagguuguugaguuccuuuuuguuuaaaccaaagacccacgcacaagcguuucaucagcacacuugaccuucagugcccugguacuugccagccaagaccuugaucuuaaggaucugguuucgagccauauguagcuuaugguaguucacgucaggugaggugcuuucaggaagcauuuugauuugcuuucuuuugccacagaugaaucugguggcuaccgugcucccccuagaaagcuuagagacgaaguuuaggagacuagauauagauaaccaugcacauagccccaggaaagggucagugugccagcucaccaauauauaaaccacuccuuagcaaacaaaggggcugaguggccacguuggcaucucucucguggccucaguggauggcauaguaaggcaaacaagcucuaaaaaaaucccacuugagauucguuuauagcugucaguguggcagaccugugcgcaugcccacugguuauggaguucagaaucacauccucucaacaguagacuuggucgaaccaggccaaauuccaaacaugguugugugagacaggauguucagagcugccaagauguggcaggagaucagccuuaagucacaggauucuacccucucggcugaugcugggaagagccauggccgcucuucuuggcucgaagagagaggaggcucuugcucuuuugacugcagacagggacgcucucucgcaggaagaggcugcugagcugggccucacugaauugaaggaauagugugagaugugagagacacuggccuggggaaagcucagcuggugucagcuccucucuucuccgcugugugaccuuaaguuacguaagcacaugaaaggcagagagcuggacuggauaaacaguuguguaaauagaggcaggugacggguaccgaugcaucgggucuucuacuguagagccugucucugggcuggccuucuacagagacuggggagccgucagaggaaggcuugaacucuccuguuuuucuuuacuuugcuaguuggguucuucgccuuccuuauauguaaaagagaucaggauuauuuaugaggcccuggaaucacugagagacagggauagugcugaggcuuauaaccucaauaauaaauugcagguuuaagagcaucagcaacugugggaggagcgugucggcuugcuguagagcagcgcagcucgcagcccagcucacagccuagcucccagaucagccuagcucccagaucagccugcauuuggaguaggugcucacgaagacuugcuaaacaugugauuaauuaauacaugaauuuuauuguuacuuucuuuuuaauguuuauuuuugcauucguaagggucauuuuuguuugagucuguaagccuucccucccccaaagagcccuuuucaacauuuaaccuaggaccaggguguggugguacagggcuguaaucccagcucuuuggaagcagaagcagcaggaucaaggcguucaagacgggccugagccgcacaacccccucuaaaagaaagaauaaggaaaaacaaacaaaauaccaguuaacaugagugcuuagucuaaggauuaauuauuaauccaauuacguauuguauugagcuguuugguuuuguguaaacguaauuuucaguauucuccaaauuggcucgcacugacucuucucauacagugaggguguggccuguguuagcuuugucuuagacccuaggucaucuagucauuagaugagacauuuugaauuuguuucauuaauuuuacuuucucuuugggccucacuugguugcuuuaaucuguucugucaaucuucugguggcgaggggcgauucaucuacguuugugcuuucugaggcagggucuccccuguguauccugggcugcccucaaauucaugguguccucgccucagccagugcuggagucacaggcuugcaacauuaugccaggcuauaucuuuaucuuuaguaaaauuugguuucuuccuuucuaggaguggcuuuuguuuuacagguaagcccgugucagcguaagcaucaaucccuuccagugugcuguuuucauuuagauuuuagauuuuuuuuuaaaauuagguauaggguagggaggagcugugcacaucuguauauaucaucaccuguguaccuggugcccucagaggucagaggacauuggaucccuggaacaggaguuacaggugauugugagccccugagugagcucugagagucucugagagucgaagcccgguccucugcaagagcagcuguguuacuaaccauugagcauucucuccaguccuccagaaugcugcuucuagugugaugcuagucuuaaaacuaugcccugaguggauuaaagggaaaacagagccaguagauucuggaagguuuguucuggucguugaguaagccaagcaaacuuccauguaauucuaggugccggucucaguguugacacuggguuuguaacauuggguggauuaugcuccagacguggggguuuuuucuuucuucuguauguucugacaggaaaacccauucuugccucgguuucuuuuuuuuuuuuuuuuuuuuuuuugguuuuucgagacaggguuucucuuuauagcucuggcuguccuggaacucacuuuguagacaggcuggccuugaacucagaaauccaccugccucugccucccaagugcugggauuaaaggcgugcgucaccacgccuggccuugccucgguuuuguaaggagauuugcuguggaguuuauauugaguggugcuugcgugggucacagauccguggagcgaguuuggugugguguuuuaggagugauuugguuuucucucguugacagccuucaacccacauuuucuaaaccauuaggaacgccaacauuuuaacgauagagguuuaaagcaaacgucacuguuuacauuucucucgaggcagugcagucuuguauuuccagccagacaaugaaagaauuccuccauguugucacucuccagccuuggugauguugauauuuaauuguaagcauggaggcugggaggaagaguuagccucccagugucucagcuguugaauacaggcguauucaucugucucaccagcugcugaguacagguguguucaucucaccaggucuuccucccagugccccagcacugucugcuuagccuacagaaagccagacuucuuuagcacgacauuucaaagccacccacccaugacuucucuggcuucacuucuuagcuucuuauacucuaucagccacaaaucgaggaaguuguuccuucaacagguacggacgucucccuuggcccuaccuuuguucccauguuccaucucuuuggaagccuuuuuuguuuuguuuuguuuuguuuuuguuuuuccgagacaggguuucucuguauagauagcccugacuguccuggaacucacucuguagaccaggcuggcuuugaacucagaaauccgccugccucugccuuccaagugcugggauuaaaggcgugugccaccgccgcccagcuuggaagccuuuuaccguuuguucugucuucacuucagcucguccuuccaaggcucauguauguuuccuuucccaucaaguuuucucagaucccauucagaccuccuccuccuuccuccuccuccuuuugccucuucugcuucuucuuccuccuccuccucuuccuucuccuccuccuccuccuccuuuucuauguaagcguucuaucuuuacacacccagaagagggaaucagauccaauuauagauaguugugagccaccaugugguugcugggaauuggacucaggaccucuagaagagcaaucaguaaauacccuuagccacugagccgucucuccggccugagaguuccuucauuuucuauguaugaccuuuugagcccagcggcccauugagcugcucauugucuuacaauggcuauagaacaagcuguucugugaaaccccaacaaccucaccucauguugauauaguuaaaaguuuaugaucugaaaaaaaaucugugccuuuuaaaccucagugggcagguguauuaacagacuacaggauuuucaaauaaaugaagaauuccauuaccucacuguugcuguugaugaauuagccuccuaugacacuuaagcaucaaaacacugcaucuuuucaggugagaggcugacaagaacaaauuaauuuauuuaaaaaguacuauugaaccuuacccagugcauuucugcugugcagugugcucucuaucccgugcccagccuuuucacggccuguuucauuaucaucuccaagucucauucauaucuuagguacugucuggguucagagguuaaaaguuagaaugaaauugccaauagauccauuugaggucgauagugaaccucugguuggaaagcugcaggcucugggucuggagagauggcccugaaguuaacagcagauacagcuuagucagaggaucugaguuugguccccagcauucaacuugggcugcucauaccuuccucuaacucagcuccagggaacccagugccuuugaucuccaagggcauuaaguucauaugcacauacccagacacacacacacuuaaaaauaaaucuuaaauuaaaaaaagcuggauguucaccagacauuuauucuuuuaugaacagauuuugaaguuguccauucuauuacuuaaaucuuuacauucuuuccugcuggacaguuuuuacuuuaaguaaaucuuucgcuuuggcccaaccucugguuuugauuuuaauauuugaauagauaaauuuagggcccuucuccuguuuucuccaaguuagauauucuuuggucucuuucucucauucauguacauauauauauauauguauguauguauguauguauauauauauauaauuuauuuacuuauucguguguguauuucgucuaaauugagaucaucaggauuguguggccagugcugauccaccuugccaguauguucuucgaucuuuuuuuuuccucuuuuucucuucucuuaauuuuauuauuuauuuauuuauuuauuuauuuauuuauuuauuuauuuauuuucgagacaggguuucucuguguagcccuggcuguccuugaacucacuuuguagaccaagcuggccucgaacucagaaauccgccugccucagccuccuaagugcugggauuaaaggcgugugccaccaucgcccggcuuuuaauuuuauuuuuaguuggccuaucauacauuuuuauauauuauauaguauuuugacacaugugcauuguguuacaaucaaaccauugucauuaacaugcccaccaucucaugugcuauuucugcagugagaauauucaaacuacacccccuucuagcugucuucagauauacuacacugucguuagcuguagacugagaauauucgcgcacuccccccccuucuagccuacacuguuguuagcugcagucccacuacugcucaguagaacagacguacucuuuaauaugacuggaagcacuugucucuugagauaaaguguucaacauuagaaucaguagaugcugcuguaccaagccgauuuggagucuugcuuugcacacuggguacguauuuuacuaucuaaagccuguuaauuuggggucaguaucacuauugacuugcauugagcgucuccuaguacuucccuuccucccucccucccucugucccucccccacccccaaaggcucuuucacacaggugguugugacucgcauauccuggaccucugaggcuuuauuugcuagacauaauuguguacagggccuuguguucucccugcucagagucuugugagcugcggucuacugagauagacuguggagauauuuuugguucaugguugggucauguaacauuuguucucuugccgagcuugucaucugcccauuugauaaguaugucccccccuccccaauuuagucauggagacauugagacagauuggacugaaaucaucccauuguugcuuguagauuuuucuuuuacaaaggagaguagugagacagggucuuguucuguagcucaugcuggcuuugaacuuccaauucucuugccucuacuuccugucuacugggauuuguauguauguguccuaagagccugcuccaaauaggaaccugucuaguugcuuugccuuaccuugccuugccuugccuuccuuuccuucuuuuuuuuucuuuccuccucccacccccagacagaaucaugcuauauagaccaggcuggcuuugaauuuacagaaauccucccgccuuugcuggaacuaaaggcagaugccacuacuccuggcugauuuuccuuuaaagauuuauuuuauuuguguauaugugugugagugccuaaggaggcuggaggaagagggugcuagaccccucagagcuacaguuacaggccacugucagccacucagcguaggugcuggggacugaacucggauucucugcaauagcaguagaugcuugcugcuaggggcagugggugaaugagaaguggucagacagacaccuguacaguggagcuaaugcaauugcugccuacacugucuggaaccucagcuccauggggaagaggcucacuggucuugguaggaagcuugugguccugcagucucaggacguuugggaggaggaagcugcagcugcuagucuuugucuuugugcauaccaguaaucaucuaaacuuugacucccaagcaaagcuuugccauuucucuugggccugggccugggucacauggguaacggcuuuaccaguuuuccuaaugggucugagacuuuguucauccucaagauacggccaugcuccugucagaguacacauucaccccggaccucacugacguggggcguccucagauccccacucgcucacuuagcugccgagccuucucuccagccccuugcaguugcuuuuaaugggcagguucugcacggagagagacuugacaauguaaauaagauauucuguaacuauaacaggaauuguccuucagucugcuccagucacuuggcaccuaguucaaagcaccagaauucaguuuggucauaagaauaacguuggggauacuuugaaaaguuaguaaccuugaauauauucuuuuucauaauuaaauacaauacuuuaaaaaguuucauuauuuuuauuauuuuuauuuuuuuauuuuuuuuugguuuuuuugagacaggguuucucuauauagcucuggcuguccuggaacucacuuuguagaccaggcuggccucgaacucagaaauccuccugccucugccucccgagugcugggauuaaaggcgugaccaccacgcccggcuucauuauuuuuaguuaugugugugugcacauguguaugguacaugugaguguuguugauauucaaggaggcuggaagccucagaucccccuagagucugaguuauauucugaguugugaguauucugaugugggugcugggaaccgaacauugaauuuggguccuuuggaagagcaggaugugcuuuuaacuauugagccaucucucccacaacugaauauauuuuuaaguuaauaaaaaugacaaaauucuugcugggugauggugguacauaccuuuagucccagcacucaagaggcagaggcaaguggaucucuugaguuugagguugaguccugucuggucuacauagaguuccaagacacccaggacuacauacugagagccaaucucaaaacaaggcaacaaacaaacaaaaacaaaccugaucuuuacugucaauggaagucacaucuagugggagacugguuuggucauuauagagaugugauuguaguauucuuggugucuaugugcugaacagauauuacccaagacaaguggacaggagacacagauacaauggaagaguuucuacauuucuaauuacauucuuaaaguaaaaggaaaaaaugaaagugguuuugaaaagaguguuagguuuuuacugugggggugggaugggcguugcaugcauaugaauauacacacacccacgugugagaccagaggaaggugcuaugcuccuucuucuauugcucugcugaagcucaugguuugggcaaagccagcugaccagugagcucucuggagcacauuguccccagccccaguauaacagucacaggcaugcuagccacacgugucucuuuauuugggcccugggauucuaacuccauucuucauguuuauagagcaaaugcucuuaccuacugagccauguccuugccccugaaacugauucaaugcuagacuuuauuuaaacuuauauuuuaaugugacagcaauaucaaacauguaauuuuuuucuuacucugucuuugaaauccuuggacuagccauauuucaagugcucaguagccauaaguagcuggugacuacugcacugagcagaaaaauucuuugcccacauuuuaaaauucuauaguagugaacaaauaucuucccuggcugaauggagaauucagauuugaccguccucuaacagccacgugggaggccuuccacgucugagggaagcaucugagguagccucaucugugcagugcuuacacuaucauaugcacugugcaagccuuuuccaaacugcacacuugagauggacuuuuuuuuacagugccugugucauaggugucuuaaagcuguagcuuuaauauaguguggauauuaacgacaauaaggucacuccugcauuucugauucguugugcugugcuaaaaucccuccugugugaacugugugaauucauggaacaugugguuacccagcgacuguuuugcuuccacucaggaugugucuaguccgaaugaagcaggaaggccggacugggaaguacaugugccggaucauaguucauuucaugugggaagauguggagcagcgcggccgcgucaugggggugagugcuuccccaggugcugccacggcagaauggcugagccaagccugggguucuuucagcuuuaggauagauuugccuuuggaauucugugaaauguugccuaacgccagagaggcggcucagcuauagucaccuuuuuuugccucuuggaagcuugacauaccacggauacuuuauggguuugugcacauuauugugguuugucgguaugaggacaucuuguauacagaaguggauagaauucuggugaugcggaggacggaguggggagccagauaguaaucuagcugaaggacacugccuuugacauugcuucaauauuugaauuaguuccccuuuuacauuaguucuuugauuggucgguugguugguuuugauuuucuuuagacauggauucauguaccuuaugaauuccugauucuccugccuccaucuaagugcuaggguuauaggcacauacccccauaccugacccucuagguuaguccuuaugggaagauccugguacgaagggcgguaguccucagggauuaaggaaaauucuggccacuagcuaccuagaauauuuugcccaaguauccauuaaaaacgaauaucuuaguaaauucaguaauuagccugagaaaagagaauauggaucaugcaaguaugagcauacuugcuuguguguguguauauaugugugugcacacacauguggauguguguguaaaaugacugcucgcuauaggauauauguaguacuggguuuuaugcauguuugcuuuguucuacaugaucucaguuuugugugcguucauacaacucucuuuuuucaaucacaucauguucacggucuauccaugcugagugacuagcugacugucauugucccugucuucacacgcucccccacuguugucugcuaaccccaugcacuuuuucuuugagacuuauauccugcauguagguggcggucuccuccugaaaaccucugggucccuuuggguugaggguuuucucauaucuuugaaggaauuguaguguaggagguguaggaagccugccuggguuugccuuuaaguaucuuuauggacauuagcaugacgcucuauaggaauagcguggcaguggccuuuccauugauucugagaaaaugaaagaccaguuguaccugcggucaucacaucugccuugaaaucacgauugagaucucuauguauuaaaguguguguguuccugaguguauguauguguucuacacguaugcaggagcucagguuggucagaagagagaggguguugggucccucuguucccuuucccagauaguuaggagccaacaugugggugcuggaagugaacccagauccucuucgagaaccacugagccgugucucuggucccugcugagcucucauuauauccgccuugguucucgugucauuucuccuccguccugcccggcuuucuuugcuguccagagggaggucagcagacuaagugacucagacagcugggucucuuacguccucgaauguuuacugcucacuguggcagcacacacuggauucagagcaguguuggcauuucaaaccacccugcuaaugaugaccaguaacacccucuggccagccagagccugcgccggcugccaggcguugcguuacaggcucuuccauuagaugaaccuguuuugcuuaucucuguugacugaacucugccgguagugagaccaccaggaccaugugagccacagcuguccuaucccaaauagccuaauaauccagaaauugcugacuucuggaccacaggaauuuuuuaauuacacccucucccacagauuuucucugccacauuuaacagcaguugacacugugagccuucuccguggugcuuugugucuaaucucccuccgaccccauuguaagcuuuaugaaugcaggaagcugucuugcucuauuuuuugcuuaggugguaacaucagagggauaaauaggaugaguugaguugaaugagugcauaaauuagaccuccaccuuugguauaaucagugaguuuguuugagacaaggccucauuagguagaccaggcuggccuagaacuuacuauguagacuaggcuggccuuguauucacaaagauccaccuucauuugccucccaaguacugggauuagagauguacaucacuauguuaauauauucuauuuuaagauaacucauuagauaaaugcuacuuaacucuuuccuuucugauacuguucuauaggagucuuuaauuuuucuucucuaucuuguccacuuggauuauucuagagagugugccauccuauauggugguacagugccccucuuaguguaccuacaguuuaucuggggucuugauaaagaaccaaugugauuuguuaaguuucugaccagacccauagaaucuacucucccccccacuccuucccucucucccccuccccuuccccucccuccuuccuucucucccuccaucccucccuuccuuccucucugucucucuuucccucuaucucucuuuuucagaguguuucuggcuggccuugaacucacuauguaacucaggauggccuuaaacuuuggauccucuuaccuccaccucccaaacgcagagguugugggugugcaccaucccaccuugcuuucuguugugcugggaaugaacccagcgugcuacacaccaacugagccauauccucagucgggagccuuuccucuccauugccuuguucuuucacaggaucucuuauaacccagacugaccuugaacucacuguauagccaaggaugcccuuggauuucugggccuuuuguuuccacaucccaaguuguggaguuacagacauccacaucacauccaguuuagagugucuaguuuucuaacaaguuuccagguuaugccuguguuaauagggguguggaagguggcaaccauacuuuaaauagcaagauauuaguaauuuccuuaguacaagcuccuacauuaccuucauaaugagaaaugccugagcuguggugaaaacuuuaagugagagauaguguuuucaaaauagaaacuuagagugguaauuacuguucuugaucuucauuguauuugacacaaccccuccccucuagcuugaugguauaacagauaccuuuucuauaggaaggacaguuggaauuuggaauuugugaguguguugcagguauaggggcuucagucuguuagcauacagccugcagcaguggaacacauagagucuggccugggucucccccaacgaacaagucuucccagugcuucaguagacacagaagcaggcccagcccaacuauguggcugcagaguuucuucucagcuuuggggugggggugggcacagauuuaaaggugguaauuugcaauucuuucugugucauuuggcguuccagguauagcucuguaagaaaagccauagaaaaagaaaacuuauaaagccaguucagcgguguggugguuuuucucaugccagagaauucuuagaagccauuacuuugaguggauggguguggcagcgcucaagagccaaaccugccucuugcaaacugaugacgagucagaaauuguaauuacgaaucccuuugaagccagaauuccuaucaagaacucauucgauauccaaguucuggugucaugcaagagggaaauuuuccuuuucaucggcuuuaagaagccaacuguuauggcacggacucacgagucacuggggaaaccaguguaaaaagcaacugcuaaauuugagguuacaaaaauuacaucaauaauuuaguguucugacuuuuuaaaagggaaaaaaaauccaauauuugagauuuaaauauauaaauuagcuguggaaauaagguucauuauaucaccucaucuggccuuguuuuauuucauuaacugguucuuaaaaaccuuugugagccgaguugcagcugaagagguuggagaccauuuuuccuugggcucuugccgugcuucugaguguugguaggaguaagaaccaggacuugacacagcuguaaaaacagacagcccuuuggccucagcucuuucuccuguggcaggcagauuucagauguaaauuucacccugccucuccugcuaaugaaguaagcgucuuuugcugggucugcaccagguguguccagucuuggggcuaacugggagcuuuacuucguuuuuccauuugugacauuucaaccaaacuucaaaaacaaacaagaauuagcucaaggcaguggcucagcguguucaugguaaccuuagucuggugaaacgacuuccugucaguuuggcccugccagacaucuccaccuuacgacucacaaugguuuaagcuuuccaagccaaggugagaagggugggcauaggcuacaguuaaagaauuacaguuucuucucgucggugguuccuacagacaggugccucaguaagacuucagauagaugacuucuugccaaugguauuccagcauaagaauaaaucuccugucgccuucugguccccuauccuuuaucagagcugcuugaugagaugguaccgagggaaaaguuuguugguagagagcccugaaacaaacuggucucuuuggugaaccuuuggauucuccaaauuuggauauuaacaaaggcuuuagauuuucugaaaaucuccuuccaaucuuccaaguuucaaauagccccuccccauguucuuccuccccguaaagacuugccuugcuuaucagaccugcuguuugcauugcaagcuccucccuugucacacucuguggucuauauuaaugccagaucauuucccacaaugcuucuggaacauucagcacuugcugcuucuagccuagccuggcacuaagcgcucucugagauucacauacccacccugccagccaagccagggccucgcuguuccugucuuuuucucauucagggcauacaucuagauuguccucauacuuccuucccagcaauuccaccagacugggaccaauccaguucccccucacugcgagcaagugccuuaauaauuuccauagccgucuuugggcuuuucuuccuucucucuuaugucauaguuguucgugcauauuggcuaucuucuagaugaauuccuaagggucaggacugcauguaucacucuuuguagucuccagagugcuuauaauuuaccuguuggcugaauagugacucucugaagaaugaaagaacacaauucuagaggccugggauagguauuagggaaauggggcaggagauaccguuuuauucugaggauauuuaucuguguugguuuuaaauauugggagaaagacugauuuuuuuuucuagugacaauuuuuaaguuacauuuauuugcaugagugccuguacuuguguguacaggugugcacgugcuagguauguguguggaggucagagaacagcuuccaggacucagcucucugcuucuaccgugcaggugcuagggaacugacccaggcccaggcuuggcagcaggcucacacugcugagccauccuaccaaguccccugccuucauuuuuuauguuucuauuuucugugcuuuuuaauuuccuacugaaauugauuguuuuguuuuguuuuuuuaaaccugagcuuacaauaggguauuuuacguuucaaaaaugggauuaacaaaggcuuuagauuuucuaaaacucuccuuccaaucuuccaaguuucaaauaaccccuuccccauguucuuccuccccagaaagauuuccaaagagggcuagggaucuaacucgggauagaaugccuaccuagcaggggcuguaagucggugauaaaaugcucaccuagcauucauguggacuugcguguuaucccuagcacuuaaaauaaacaggagacaaaucuuaaauuccuaguuuacugugcugggcuucucaucucaaggucaggcuuaaaacucagugaaauauaaggacugcuuuaaagauguuuuuuauaaucauaaauauagaugguguguguauguaaauaaagaaccuuuggaauggauaacacacaaauaagaaucaguuugcucuucgaugacaguagcuccuuggaaggguuuuaaguggccuaagcuauuggaauuggacacucaguuauuaggaugaauauuaggagaaagauaaguuuuuagguuuuaaaaguguguguguguguguguccauccacagcggccagaagaaaguguuagauccccagaagcuauagucacagcuaguugugagccaccugggaaccaaacucagcuccuuugggauagcagggacacuuucaaacugcugagcccucccucuagccugaaaacuaaauucuuagaaggaaacgugcuuuuuuuuguuuuuguuuuuuguuuuauuuuguauuuguuuguuuguuuguuuugagacaggguuucucuguauagcccuggcuguccuggaacucacuuuguagaccaggcuggccucgaacucagaaauccgccugccucugacucccaaguccugggauuaaaggugcgugccaccaccaccuggcggaaaagugccuuuucacuggagacuggguugugaauuugagcugaguccacagaggauguaccuacccccuggagguacacucuccgcccauguaaguuucugaaaaccugaugaggaagcauucaagcaagucguuugccaaccgauuuggcaccugcacccagaacccagaauacuauucugauggcucagucacuuguccuucccagugacucucugguucacaacccccaccccagccucccacaaugcuagggagccacucuaguuccuugcgcaugcucggggcgucugucauugauccaggacccuagccuuccuuuuugcuuuuuguuuuuagaauaaggucuaacuaaguugcccagguuggccuugaacuucuguaucucaguuagaccucgaucuuugauccuccugccucagccucugggggagcuugcaccaccaggcucucccggagccacuuccuuuuaccagaaggccuucaaaaaagauugauaacgcuuuccauguugaaaaugaguugcagcacggaauucccaguacacuuggucauuuaucuggagugccauuccugccuugaguuacaaacugugggguuccugacgcaucagaaacagagcuccgaacaugauaggcauucuguaaauauuccuuuuccaaguggguaaaaaaaaaaaaaaaaagaauuggauccuuucguuguuuuuaaaaucacacuuauuuaguuggaugucccacuccauaguguuucuguaaaggagcagugaccuuguuccacuuuucaaagucuugcucggggccagcaagaagauagauggcucagcagguaagggugcuugcugcccagccagacgaucugaguucuaaccccaggccccacacgguggauggagggaggcauuucccacacuuguccuuacuucaacgugauggccaugguagacaggugcaugcauccacaaacaugcacgugcguguacaccuuguaugugugugugugugugugugugugugugugugugugugugugugugugcgugcacgugugccgucuauaagcucauacuccacaaacaacccuccuuuagugccccauacaccgaaugcuccuagcucagcucuccuuucaagggaccagacuucccccucaagucuuuguuuuucuuugccugauuacauuugauguccccuguucacagucaucacaccgugaaaggugagugcagggacgugggagugacggauauagccagccagagucauuuuccggcucaccuuucaggggcugccaaggcuucuuccaaauaagucucccugucaggagucacaggacaaacagcccuaugaaacauccuuccugucucccucugucgucaccaccguuaguugagccuccuaagcugaauucuuagucauccccgagucccgccucuuccucugcaucugcuuggcuugccuguugcaugcuucacauaucucaguggauucucaguggcccauugcuucacuucgggcaacaucucgcuuuauugcaagucacuucugaagcaauucuuggcuauucccaauccaggccuccugccaccugacugccagaggccaccuuucugaguccugcaucuggucaugucccucucauacuagagaccugagugcuuucaccacauaggggacaaaauuuaaauaccuuggaaguguguauagaaccuuugguagguacauaaaccaacuuguuuaucucucucucucucucucucucucucucucucucucucucuauguaguccuggcuauauuggaacuugcuauguagaccaggccagcuucaaacucacagagauccuccugccucugcuucugacugcugucuuuuuuuuuuuaguaaaacauugaacuauuuaaauguuccuaaaauauuaaaaucuuuaaauuuuuuauuuucaguuuuuugaaacgucaagaacuuauuuuauuuauuuuaaaauaaacauuggagccuuccccauuauccaccaccuuacaaaacucuugaauguagaauguucaacagccuaagcaguuuuaguagcuacaaaaccagcaaaaacuacaguugucuaaugaugaauaucugagaauaauuauuguuuugaguagcugauuaccaucuuggaaaaaaauguuugcaaaaggcuaaaaguaaaauuuaauuucuguacagaaaauaacauuaacuuagccuuugcuauuuugagucuuuaaaaauuaaaauacgauuacaucauuucccccuccuacacaaucuaaaaugucuugauaucugcaguuuaucaaauauuuuaacaacaaaaaaaggggggcggguguuuaagccuaaaaugauaacuguaggcucuggggaucugaacuugggcccuuuugcaugaauggcaagcuuuuuacuggcugagccauuuccuguccucuguacagaucuuuuuuuaaaaaauagauuuuuaauuuuuauuuuccaugcauuuuaccuguaugugugccuguacaccaccugugugcuugaugccugagugggcaagaagaaggcaucagguccccuggaccuggaguugcagaugguugugagccucuguguuguugggaauugaacccagguccucagcagggacagccaguggccuuaaucugcuaagccaucucuuuagcgcccucuguaauaaacuuuugagccuuaauugauuuaugcaguugauuuaauucaaauuauauaaacuuaggaucuuacugucccugguguucugggcagcccggugccucaggccucaguacacagacuuguuuggggagcauagguacuugacugucauugucuucuggcuugacugucauuaucuucuggcugacagucuucucugaucauuugcuuucuggggucaucugaccaccaucauccccaacaaaaggcucauuauucucuccccucccugccucauggguucuuucugugguuaugcuccgaaucuacuuuauaaggaaaaugugccucagacuggagggggagagccugagagauuuuuuuuaacuaacuaacuuacuuucuuucuuucuuuuuuuuuuuucccgaaacaggguuucucuguguagcccuauggcuguccuguguccuggaacucacucuguaggccaggcuggccucaaacucagaaauccgccugccugccucugccucccaagugcugggauuaaaggcgugugccaccacugcccggcuagcuuugauuuuucaauccaugaagauugugcauauaccaccgauaugggucaggcccuucccaguucugugucaaggaaacagaguuucaguaauguacagugucuuacccuggauuguagagcuagcacgcauuggcauggggaccgcagcugugacauuccuaugcccaguauucccauaccgucccugaaauuccaccccucaucuguugguuaccaaacaccaagaggguggcuguccuugaaucuggaaaugccugaauccucguugauuuggaguuuuugaaccuaguagguagagguuuccuaccucugaacuaccagagauggcgggagaaaagacaggugcgcaugggcgugcuccuggaccugugcuguccucgucucccagcaguuagagcuucaugucuccacaucgugggaauuugccucaguugaucuuaguuauuuuucagagacuccucaguuauguuuuuuuaaggagagcagaacugggaggcugagcacgggcucaagaggcugggccaggagacuaacaaaggcaguauuauguguucauggcaaagccaauaaaugaauucaagagacaccuagauguguuucuagaggaggacaugggggggggaagggucugguggagaggcagaaaggugggauuaagauaaauuauaauggagccagcuugcuggauaaggggaccaccccuuccuguucccaccgagcuucagauuccuuguccugcacaguugaaaaguuaaaacccggucuguaccacguaccucauagucacuccuucagacccugccucaggaaaagaagauugucccaaggcuauuucagcauguguuugggugcuacacccaccagauguugcugggaaucuuagauucuaaccuaaaacggagucuugagcuaacugguccaaggccuagguuuuaauuuccaugcaucccugaagccucagcaucacguggggauuuguuaagaaucggcuggcugagaaacucugaauggggccuguggugguuugaaugggaguguccuccaugggacguucagauguuugaauacuuggucccugguugguggcacuuugggguagguuuaggagguguggccuuguuggaggaagucugucuuccagguuucaaauccaccugcccucccgguuugcucccucugcuuucucuuugcaguucaggauguaagcccucagcuuguuuguuccuccagccgccauguuaugccugccucuugaugcugcucccuccuccacccuuuggaaccauaagcccaacuccuauauccugaucacaguauaaaccaaacccuucuguuucagaaccgcuuaucccucgccugacccugucuguuaucuacuggagagcggagagagaauuguaaccagaaacugacuguggacccaugacugucugggugucaguucuuagcucuucuugcugggugggguaggaugaggucaggcacaaaugccacacagugguugagugugauggugacagccauuuauauccgcucacugcucucccuuccugcguacuuuacgagagcuguggcuuuuacuaucuuauaacuguccaucugugagacuguacucuaccuccacuuuacagaugaggaaaccagagaccagggagacaaguguacuguucccagcagcagccauagcuuuuauuaucacaaacuugguggccugaaacaacagaaauugauucucucauaguccuagauucuaggaccucuggauccagguguccuucugauggcucuagggaagggucuguuccuugcccugucagccucugguggcuugccaacauaccuugacuucugguugcaucuccucuuuucucugacuugaauccccuucagccucucucuguaaggauggaugggaugcacuuagauugauguccauaucuuaaaagucuuaaucaugucuucaaauuuaucuauauucauaugaagaacauuucaagaaguaaggacacaggagucuucuggaaggcugcuuuucauguaguauaacugggcuccuccaccugugccccagcucccaaauaacgacuaggagacuuauucauuuaaaaaaugccuagaccauaaacuagguuuguuucccaacuagcucauaacuuauauuaucccauuuauacuauucuuugucugccauagggccgguuaccucuccucaguuucguaugucugacucccucugagucugggcagggacuguccccuagaguuguaaucucuccacuggaacgcccaccuucuacuuccugccuuuuuauaggccaucagcuuuuuauugacaggugaugcuuccauacacuauaaaagagauuaucccuccaauguagauaacuuaaccaaguaugcacggaauccccaaaacuuaccacacuuagucuccagggucucccucagccucccaggugcuguggcuauagauguaagcgucccccacccccgcucccauaccagccuugcccuggucacuguucugugcugcuggauaaggucaauacaauacuaacauuguauuuuacauuagacauuuggcuuaagguuuugucugaacauguuucuauucucuugugauucacuggguccaauggcaacugucuuccagcuuuaaugggaaacaguauuguuauaucaggugauucuaauuccuagcaugauauccauaccuuguuuauagauuauuuuuuguuuuuaauuauguaucuguguauaugugcacuugagugcaguacuaaaagaaaccagaagagugugccagauccccccagagccggaguuacagaugggggugagcuguggguucuaggaaucaaacuuggguccucuucaagagcagugcacacacauugcugacuuuugagccacacaacccucguuuguuuauuuugaaauaacauucuuacacuaugcaguucuaaucacauuccccauccuaccagcaaaugaacauuuacuaccauuucaggcuagugacggggugauaugggcgugguguaaaggaagcagccccaggcagccuggucccucggcucagucaagucucugagaggcgaguuaaauagucuucacauucuuuuccagacucagcgaugacucugcaaugagagaacuaaaaagccugccuuuauuacguuccagaguaauaaaggcaaguguuuguguucuugauuuuuuuucuaauaaaagcaguucauccggcacagaauucucucucucucucccccucccucucacauaucgugacccaccagcuucccucuacuaugcuaagcacuagagauacaaggaugacuaagacguccuggucuagcagagggaaacaaacaaaauuauaauauugagaaacuccgguguuucaaugacugaaugccagagaagagcucggggcagauggcauuugggauggcuuucugggcaaguguuacagagugacgugcaagggcaggaacuuccuuuggguccuuguuccuuugccuguucuggugagagcagguucucuguagcuccacucugauccucugucccucugaaugcccugcgaggugauuacagguucauugacuccagagucugaaaacuggccacacagaaucccucuucccuguuuuggguuuuguuguuuauccugagauagggucucuuucugcaguccuggcugaccuagagcucucuaaguagaccagguuggccucggccuuuuaaggcacuugccauucaagcuugaugaccugaguucuaucccaggacccacgguggcaggagagaacccacuccugugagaugaucucugaccucugcacauauauacacacgcuuaaaaaaaauaaaugcaaucuuuuuuacuuuaaaaaagaaagcuauguggaaggcuuuguuuucagcggccgccugcccagcccccagcugucaggaggggucauugugcagcucuuuccacgcucacucuucgcuucacuuuuacuggagggcaaaacuagggcagagaaauaauuuuuauucacuucugaaagguuacaguaauaaagaaacucuuguuaacaucagagaacguugcagccaagaguuuucacagucuggcauuguuuauuuuacauguaauuuggaaccuucugcacucuuaaaauauuggcacaaagacguuuuaacucuugcaguacuucacuggaggcaacagcuguguggugugagaggggcagccgggcccuggagaacuauucaccuucuuccuucuggcgagagcaaaauggggugugucugugucugugugugacucuaugugugucacuguguguguuuguguaugugugucugugugucaguuugugugugugucacuguguaaaaauacacauacacauuugccuuuacucgaggguaucuggaagccuugccccuguccugaggaucugacaggcuuccuuuaucaaccaugagagcggugugacaguccagcuuccauuuguguugugaccccggacaacacagagcuuuccuuauuuagaggcuucgguaggacuggccaguggcuccuuucucucgcacacucuauuucccaccucuuuggcuuuuguuuuaguuagagguauucuuuguaggagccagaugguuugccuggcagcuugcagacauugucgccucauuuaucccuacaguugagcgcagggagccccaaaggcauccaugauuuacaucugaugugagagcuaaggaagaggagcagagcguuugccuguggccacuucagagucacuggccaguuuugaucaguucaaaaccuccgcccuuuuagacgucauguauacuuuuuaaguuacauugaaccucuuuuggaaguagguacaauauaaguaauaauacccacgaagcaagcaaaugaauccuguguauugacggcaacgugaacucauccuaagaucacauaagcagcugcugggguaaagaaggggcugguuccaucaaaggcuuuaguuccuguuuuguuagguugagauuaagacuuuaaaacaauuacaggacauuaaggguuaaauugaggaagaaggugccagucugggggcucaccaccuaggccuccuuagcuccugcucaacuuuguucucacaguauggggacccuucuccuucuuccaucugucucccuggccuuuauuugggcccaggcagucccuaugacuggccaugguuuuccguagucuuucuggcucagggacuguggccugcugcucucuuuccuccaaguccagcauuuucuuucuuaguuuccacaauagagcguuugccagauagacagagcauagggcuauuaggcaaguuccgaggugcugcuacugcucagugcccuucagggaucuccaacaaaggcccuucccagcaggaguuugcguguggaggagaccagcuucuagcuccuugacuugcagccggaaggacgugguccuaacuaugucacugccccaguuggcuuuaggacccuuuguagaucucuuuaccucuucuugccucuguuccuucuucuauuagucacaugguguugggugauugaaacaauauaauuuaguacagugcucagugcuugggacauuaggcacugguaagugggaucccucgugguuguauaagggccucgaaauagcauuucaccuaaacagaaacgucguaaggggaaugcgugugcaccugccaugugccacugacucugcuguucaugagaacagagauccuauuucucaucuuugugagggauggagguggugcuuugggucuuuguaacccucuuccaggaggccuggaucaggcacagcugucacucagcucagucccuuagcauggcuugggccaaccauggugggcacaaaugcuuuaguuucuacauuuguacuuagggaaauggcccuuauuuuggggccuuuaaggacaauuuaauacgaaaugugugguguuuggagcccuuugaaaggaaggguccuagggaaauuaaugguguuuuugcuguucuugggaaagcccuuugugguucuuggugaauaaauuauuuggagugaguuuucuaacaccucccacucagcuggucaccgcagcuuuuuuuuuuuuaauaacugucugcaguaaugcuuuuuuuugcucaugacuuauaaagauauauaguuuggguguuggacuuuugaccccugccugcucccaggagagacauuucuaucugaauaauaaaaggugugaacuaucaguggcucauuuucugggccaugggcuugugaguggcuggggcaggggguaaaagaugauccccccggaguguucaguggcuuuccguguguccccacuccucuccuguucaagccccuccuguacccuuugcuaagguucuuuggauuucaggcaagccauugucuuugacauuuugggaugcacggcuuucugcuuucuguugucucccuugcuuuagguccaggucccaaagcgaauggccugccaaaggaagccugucuggagcucgggagguuggcccugcccugucuccuccagcuuuguacguguauggccuguaacgcgcacgaggcuuuugcuucuuacacuuccucccucucuguuccagaugccugucccacugugaagcguucacuugggcugggaggaugggucagucaguaaaguccuugccacacaaguauauacccccagcauccacauuaaaaaaaaaaaaaaaaaaaaacccaaaaccaauaaagaccaaacgaacaaagcagaaccaaaaacaagguggcaagcacuggagagacgccuggcacugcccucuggaggagcuaggguucccuauugggccaccgggcuagccugcauccauuauucauauggccugacugaggguucucccuuacggugggggugccucuaacuccaucacuugggagauggaggcacgagggucaggaaaggcgagucauucuccacuacauguagaauuucagaacagccuguuaugugagacccugucucaaaaaaagaaagaaagaaagaaaagaaaggagaaaggaaaggaaaggaaaggagaaagggaaagggaaagggaaagaaaagaaaaagauuguuucauucauugaaggagcacccuuauucauuccuuaccaugcgcuaaccccaaaauccgguuagcuaaaagugaccuuacaaggcuuacaagcuguguaaugccccgaagauaaauggaucucuuccuggguucaguuccaaacuaaauagauaaacgagaaagauaggagcucaccugcuguuuuguuugcuuuugaggcaagcuuccuagugaagcugucauagggagugugaaagaaggggaggggccagggcuaaggguggggcagaagagggcgaacccuccucuccaggugagcugguagguugagcuugaaacuuccuuucagaggcaugccacagagugguugacagugccauagccuaaggcagacugugccaaaaugcugccucuagccaugaggccuaggccagggugcauagucugugugcuucaguuuucugucuaugaaauggagguagcaauguacccagccucuuguccuagucuauagugcugugagagucaagugacguaugaggcucuuuaagcagcgcugggaagugcaguuucuucauggucuugauuacagagcaccaaaaagauuuucuuaccagacacagucaagcaagguauucuuuuuccuuuggauaaaauaccauuuaaaggacauuuuaccuuaaaaaaaaaaauggaggccuggagagaugacucagagguaaagagcauuggcugcucuuacagagguccuggauuugauuccuagcacccauacaguggcucacagucacuguaucuccuguuccagagaauccgauaccuccacagaaaccaggcacacacuuggagaacagacguacaugcaggcaaagcagucacacaauaagauaagaaagaaaacggaaagacucuuuggggagccacucagagcucacaggaccaggugccagcuccauuuuaaggacacccaaagguccucagucacucugcagccuucccgggauacuucugcgggacucuguaagcucucaucuggauggcaagucucucugagccuuaagagaacacuguaccgaaacugaagaggcugcagcugagcccaccugagcaucaccugagcccaggaaggaauccuugaacaaaacagugagaccuugucacuucuaaaccaguugggcugugauacuuggacaggucaccuugagcugacugagccuuuguccccucacgucugcacugcggaguggccucuuccucagauuaccacuggguuggucauuuggaaaaaauuaacuccaaacaguaagcaaaaggacacaguggcgagagaggaacauccuguggcugacggaaaugucugcccuacuguuuagucuggguccaggcggagucaccaguuaaacucuuccuugggggcagccccucuggucuaccugaagaggaaggcagcacugcuggaugacacagcuaaacgcgucuucguaugacaaggagccagacagcagguucuauaagcaaguguggccauguggaugucacagaucugauugagaacugugguguggaacaagaacugaugccgaugaccucaguguggccuuuagcccuccacauuuauggagccuuuaccuugacuuucuuaguuaagaguagccugaguuguuaucuguuuuucccuguuggguccuguuuguguauuugauguggcuaauugugauagggaacgcgcaucuugugguuuuccgcugugcccugucugcccauguuuaauaaaaaaaaaaaaaaauuaaaaacgcuaagcuuugccuauagcuuucugaacucauaaaaguaguuaugaggcccaggguucaauaggagccugugaaugucucuagaaaccuauguguggccgcaucuucucaaugaucgucgucagaucugauggccacagccaggguagagaagaccagaugaauggcaccuacgaaccuauagugaacacauuaccgaaaaggaagucaggcucccaaagcuguacccguaugcugugccccugcuccccuggagaugccugcugggcucaagcuaaauacacaucuugcucacguuacaucuuauccuaguaagauuuuccauuaccacagcauaaaagacauuaagggcacagugaucgcuaaaacccuacaaggcuacaggucuacacgccgcgcgaccagggucagaaagucacuggugugguuguuuugguuguugccuuucaucuugcuucuccguugcuuucccucagugaggucuggcuauggucucacccuguccccuucaucggcugauaacgugaugcuguugguccugcacuauaccacauagcuccucccccuuugaggcaggaucucagguagcccaggcuggccuugaauucauuauguagcagaggcuaacucugaauuucagauauuccuuucucugccucccaagugcucagaucacaggcuuauggcacugcaccccgcuagacuuuccuccucaguuccuucuguugucuguccugguucagcuucuccugacugagccuccuuuucacucucgccuggacuguuacacggccuccuccgugguuucugcuugaauacacguguucaugcaucuuccuugucuucagggccauuuaugggcaguauagccuguuagccucucugcuucugcccacucugagguuugguuuacacacacacacacacacacacacacacacacacacacacacaccaugcauaauggcacacaugagagucaguucugucuuucuaccauguggguccuuggccuugguggcaagggcuuuuauccucugagccaucuuaccagccccucacuauaaacuguuguuguuguuguuacagcucugaaaaaugugcuggacaugguagcauaggccuuuaaaaccccagcccucaagagguagaggcaggagggccacugaacuugaggcuagccuggucuauguugugggcuauuguccugugugaguggcugaugguugugagaguucucuucacucagaaacucuacucagguuucgggagagaucuccuguugcuucuccaggaagugcgaguggggaaggagacucccuugagacuuuguugcagcaaaggugcugguuugagggagguguggggucucauagccugugugagggcagaagcugggucuccucaucuccaauggaguugugugugcagaccauggggagagcugcagcucucuucuugggccuggagagcuuucuugaaacguggaaagguucgugcacaccacugcuucaagacauuuauggcaaaccguuggcugguucagccaccuugggccgcccagcaugcucguugccuccaaggggagcucuagcuacaggccacgggaaggaaagacuccaugcaacuguagggucaccgaacuguagcagaguuuuauuuugugguuagaaacaagaauuugaccauguggugauggcgcauaccuuuaaucccagcagagacaggcagaucucucugaauucaaggccagucuaaucuacagagcaaguuucuggcugucuuaaaaaaaaaaacaaaaaaacuagagaaagagagaagaauuugauaagccagcuugggcuaugugcccaucuccgaggagaggucaggauuuuaggaucuguaguguuccaacuuacuuuggaagcaaaguagacucuugaccuaaggaaaugcaaagaaggaggaaagaacaccauuguuagcauuggaagaacuaagucuuuugaguucuuggaguuugaugagggaagcaacccaggcagucugugagguaguaacuucugagugacucuguuggucauauaucagugaguguucuugccaggugucagcuuuaaccuuuguaacuguauccguucuucacugaugcuucucugcuuucaucuauacaauucauucuuaaguaugguaagcuuauaacaacagcaacaacaacaauaauaauaacaacuuuaauauuauuucauguauguggguauuuugccugcauguguaugugcccgaugccuguggaggccaaaggggaguguuguauccccugagauuagacuuagacaguuguaaauccaguucagguccucuaaaagaguagccagugcucuuagccacugagcgaucucucaggccucuaucaauacauuucaaaucuuuauaugaaguucuuuuaaaaaauaugucugacuguggcugucuuagcacauuucuggguuuugggaguauauuaguuacuuucauucuugcugugauagcaacuuaguaaagagggcggggaaggccugacagccggagggagccaaggacugaccagucugugccccugcagucaggaagaagagaggggaauggcagugcuuggcuugcgcuguccauuucauucagugcuggaccccagcccaggguaacacccauguucacaccauauacacaugcaugcacagaaagggucuucuccccucaguuuaacucaccuagaaacuccuaggugauuauauguccaggcaaaugauagugacaauuggccaucaaaguaagggguuuuugguguuuuguuuguuuguuuuugugggacuagauauugaacccagggaccagugagcuacagccccagccuguauuuuauuuggaaacagugaaguugcucaggcuggccuugaacucagucuguagcacaagcaguccuugaauuugugauccuccugccucagcuuccugcaucauauggauuacaagcccgcaccucuagccuucucccauuuccagcuuccuauuuuauaguuggagauuugcucuagacucugcucucugcuuagccaaaccuuucuucuguccuuacuuguuuauguuggcaaaugacuacucugccuugaccuugucaaaucuuaucuuguaguuguaacaguuuuucugcugacuguuaguuguugaaauuuuaccccuauuccaaaguacaagagugaacaacuuuuguguauaucugugucauuuuucaugugucaguggggugguucagcugccugcgccacuacuggacaaguucuaaccauaagaccuaaagaagaccaacacgugaacacaguaucccaccaaauguaauacauuuuucuucccaucacagucaccaucaauacagauuuuauggguuguuuuuguuuguuuguuuguuuguuuuuuguuucucgagacaggguuucucuguguagcccuggcuguccuggaacucacucuguagaccaggcuggccucgaacucagaaauucaccugccucugccucccaagugcugggauuaaaggcgugcgccaccacgcccggcuucaauacagauuuuaaauggaggcuucaccaucacuuccuuuugaacucugcacuacagggcuaccgcuaaaacagugacuuucccaagucaaguguuaauaccccuguucaggugauguaugaaacuugucaaacaagauacaauccaaagcuuccaagguguguguguguguguguguguguguguguguguguguguuuguccugaccuuaagaauauuaagcugacguucaguugucucaagaucuuaauguaucguaucagcugcuuuucaguguuauauucguaugccuguuaacuggauuagugauggcgauuuccaaggacagccaucuguuuagauuugauaguuugauuucaagcuguagcccaggcuggccucaaacuccuuuuguagacuaaagcugaccuugaacuucugauaugucugccucccaagugcugggacugcaagacaugugccaccauaccuggcacaugcuuuucuugcuugauuugcuugguaacaaaccuaaggaaaagcccugcguacaccacgugaccauucagaaacgaggcugcugguucugcaguucuuaccgccaaccaugucccuugcucuuccgcacaucaucagccuaguuagaguuuagauagagaucucaaccagcaaaacuggaauuucaaagaauggagauaagauaauacccucucagagacccucagaaaggaucaguugagcugauaugugcuauuggcaugcuuagcacuuggugguagcuacuugugugaccgguuccuggcgucacauuguuuugggcaccuguagacuagagagaaaguauuuuggagaucuuucuagaucuuugaagaugagcaggaacuagcaucccuuccaucaguaaagacaagaaggacuccuguuaguguggcuaagaacaggggagcaugcugcaaaaaaaaaaaaaaaaaaauggcagaguugacucugaccaaggccuaaaugaacaugggggucacaagggaauggggucaaaaaaaugaccuaacaaaaccgagaaggccgugaaggccgugaaggccagagcucauagaggcuacagcucagucuccuucaggcuacaccauggacucauccucugcuaagcagucuauaaacguccuuaagggcugcaacagugagaggggacagaccagugauuggccucagaugaacuggcaucucuuuaaagcccgugucccuccuuaagaauacuuccauuaauuaaaugugugccuugcaagauccccucugguugugcucccugucggcugucucauucauuaaucugcugauuaguaacccugaacacgugugcccccuguuuuuugcauuccccuuuuaauauacugugccauucccccgggacauaaacuccaggacccgucccuggcccgcucguguuuguuuucuuugccccuugugccugccucugcuauaacauuuguaguauguguuaaguaauccuuaagguaacauuuuuauuaugucauaaaaagugcauggcaaauauauuauaacucauggacuuuguuuaaaaaugaacggauaauuuauugaguguguuacaugagccucgcucccucccccaccucagcagagagcggcugcucauuuagccucgccuccuauugagcgcucccacccugugacaugcugagaaagcagggccacgguuggcuagaagugacaucauaguuuauguacucaauaaaaauuuaauuaagucauuacaggaauugcagucaucauuuaacccucugauuucuucuguuuaguuuauuauuaaacauucaguaauagcagccaucgaauccugauggcuuauaaaauaucugcaugcauuuuaauagcuuaaauaaaugggaaaauaugaguaacauauaaaggucucccuucccaugugguggcucaguauguauggguuuuuauaaaaagcaaagcguuauggacaggauaagauuuuaauaagcaaacagccccaugccaucuucugcugggggagcuauguauucauaggcaacaugcucuguagaggacacucuggcacuguagagacgggacccugcacagggugagggaguggagucggguagggggucagcagagggaagcuccggccacaagggcccaguggggugaguccaggagcucggcacaggcuccuucgucugcugccugaggucaugugcugcagugauggagaauacacuguccuucagaaauggacguucucaugucuaauccagccugagcgauagcaccugaaagccacccuuagcuguggcagccuucucucgggaucuuuggaaagaccuucaaguagcagaauagcaccauuuguccggucuaauccugcucuggugggaaccggaugcauuagccuggaucugccucuuucuguguuugagcuucccuccaccacugcuuuccuccuucugggucacuaguccaggugaccccugaagccccuucagcaucaaugcugguuggcguguuacagucugcacgcuaacugccaacugagcagguccgguaaauacuuuccuaguaguggugccuuaacauuggccgccccugucaugcguuccuggcuccagucaucuuccauaguuaggagaacaaccugcacauaagcaagaagaacacaguggguauucagagggcugggugacaucacauccucgaaucauugagcagugagcuccaacucuggccuguucugacucuuucaccaaagcacauuagaugaagcaguagaaagaaauguagucauauuuauuugugggguuccagaagcaugcaaaguguucuuucagcaaaacaaaacaaaacaaaaucauuuguggcuuaggauaggacaugcugugaguggcccuugcuuuuguuuguggugcugacuccaaggccucaaacuaggcaaguucugagacccgagcucuagccccagcccugaguggcaguagaccuuguaaggguucauuaucagcaugccugucuuagccccuguccugggccagguggucgggugccaaaaugauucaguccugccuccugugacccaagcuugaguagcucacagucuggugggagagauggguauauaagcaacgccagccauacuguguaccuagggggagaaacgcacacacaacuccgagagcacaaagcaacagugguucguguggccuggcuugaaggcagguaggaaaggucaugguuuacacucccagcucccaccaaucucauauuuuccagccacgaacuccacaauucucucuuuacuuuugaaaauuguccaugacuguaaagcacuggggcuggcuuuagcuuuaguuuuguauaaacaaggcaggucuuacucagagcccugugugcucucagcauucgauuccccaacuuccaggguaugcuggguucuuuuguuuuguuuuuaaauauguauuauuuauuuauuuauuuaauguaugugaguacacuguuucugucuucagacaccccagaagagggcaucuaaucuuguuacaggugguugugagccaccaugugguugcugggauuugaacucaggaccuauggaagagcagccagugcucuuacccgcugagccaucgcuccaggcccaggguaugcuguuaacuuaacauuggaacguaaacaaguucaugugcaccugagaacaguucugugugcagggcauuugagagacaaaacagccucagagaggucggccgugcucaagacauccaaaacaucuacaggaacucgaauccagguuuuuaugagucuaaacccaacccccuuugccucuucuggcuuccagagaccaguuugugagccccaagauaaaaaucacuuggccugaccuccuauagacucauguguuugaacacuugguuucuaggugauggauguuaggaagauugugggaccuuuaagaaguggggcuaccugaagaaaguacauugcagggcuggcuuugaggauaauagugguuccucaucucugguccaaacuuucuacuuagccacccaccaagaugugaacaagcaaccucgcuccccugcuacaugccuacagccacaucuuccauugcucaauggacuguguccucucagaaauucagaaauaugagccgaagcuaauccuuccucccuuaggugacuuugcucagaguacaggggccuguggaauucagggaacggugacuuugaauggaugaugaacucagggucaccaguauugggacauuccucagucucucaggcagucagcuuuugggucagccauugugacuguagcacauuaagguaugaguucugguggagauuagaggagacgauggccuguaugggugugggaaggaugauuaagcaagacuuagucuccacacgagguucugaaggauguuuggcaguuucuugaaccugucaagcuaaguaacagucuguagcccauguuguauggugauggacuuuguccuguaucccagagaagagcagcaccauggcccuugcccccaguggacgaccacguggugcccaaguuuuaacccuugauguuuggugaagugccgcagacugcaggugucugaugaguuuaaucggcaucucaugagucucacggggaauuauguuucuacagcaaucccuuugugguaccagcagcucuguguccccacuccugcagccucccaggcuccuuguuccucacagacauccccuugucuugccuuucaccaaaagcucuucuaagcagcccuugagauguucccuaacauaggagggcaguguucccgccuauucgucugucuggugcccccaauauuccaucccucaccucugcacaucuuguuccucuguuggaagggccuccucuccagucucucccuguccuggcagacuccuuuccccaaguccacuuaaggauguuuuaaaguguguguguguguguguguguguguguguacaugaaggccagugucugcagaggucagaggugucacuauccuuagaacaggaguuacaggcaguuguaagacggcaaugggaucugaaccugggucuuaaccguucacucuugucugcagggccagcucucagggccacuuaaaugcguccuccuaauguaagcuuucucaggucuccaacaugaggccauuugcacugaaauucauuguccuuacacauuugugauuugagccauuagguaguggugguuuuguuucacugaaagcuuucuagccuggugugguggugugcguguuuaguuccagcaccuaggcagaggcagguagaucucugugaguucaggccagccucaucuacaaaguagguucugggcaaaccaauauuacauagagagaacuuaacuaaaaauaauauaaaauagaauucuaauuaccggagcuggagaggugacucccugauuaagacccaaaugguggcucacaacugcuuguggcucuaguuccugggaucuggugcuuuguucugcucuccaugggcacugcacacaggcauacacauauacaugaauacacacaugcaugccuacgcacaugcauaguaagauaauaauaacuuaaauuacacucauuugcucacaugugugugcauguagaggucagagaacaccuuacaagugucccucucuccuuccguuguguggguucuggggaacaaacuccaguugccagauuggguagcaagcaccuuugacugccaaaccaucucaauggcucuuugguuuguuuuugacacauuggcuuagguagcccaggcuggucucuaacucauuuugaccuugaacuucugauccucugaccccuggaugcuagggaguccaggagugugcuaccaccccgaaaguaguucuuuuuuuuuaauuaauuaauuuauuuauuauauguaaguacacuguagcugucuucagacaccccagaagagggcaucagauuuuguuacagauaguugugagccaccaugugguugcugggauuugaacucgggaccuucggaagagcagucggugcucuuaaccacugagccaucucgccagccccccccccccaaaguaguucuuaaugccugauuucuuuuuccuuuccuuuuucuuuuuccuuuugucugccugccugucuuucugucuuucuuucuuucuuuuuuuuuugguuuuucaagauaggguuuaagguuucucuguguagcccuggcuguccuggaacucacucuguagaccaggcuguccucaaacucagaaaucgucugccucccaaguucugggauuaaaggcgugugccaccacugccuggcaaugcugcuuucuuaugcuaggcugugugcucuuaugaucaggcaguugcugaugcucuguguucaccagcacugacucacaaccagacaugcagcugagcaucuguuuauuaaaauuaauguaguuuugaaucaaaaucugaaagaagcaguaguuucauuguggggaaucccaacagccaagagcauuggaaauggaccagcugcuuagacugaguucccuucugggauaacagacuaugacagcuaaaugacaucaugccuuuccuuacuuucauauuuuuguguuuguagguuaauuccuauauccuaaagaagaacauggcccucaugacgaacaauuucuaugcagcaaucuugggauacgaugagguaagagcauuggccaagccuuaggcugcauggccuccccagcaaaagcccaccagccucccucccuuccccuccucuuccuuccuuuauaaagaauuuuuguuaacuuauguguaugugccugugugagugucugccacaggugugugaggccauguguccgcgccuguggaggccaggucaggugugugaggccgugugucuguaccuguggaggccaggucaggugugugaggccgugugucugcgccuguggaggccagggcagggcagggauccccuggagcugcaguugugagucauacagcauggguacuaggaaccaaaagugguuaacuuaacuguuauuucuuaguauuuauuucuuuaccuucauugaaugcuggagaagugcucauuauauaaauuagucaacauucaauaguuagcguugagugucugaugggugcuggaugugggugcaaaggugaaucagugccccagccccagcucuuccgagagaaaacaagacacucauauguaaacaauauggucugugggacaaaaggaauacuguuuuaauuuucauuuuaaaguagcacauaacucauuuauguguaugaacuuuuggcugcauguaggagugcccgaugccuguggcggucagaaggggcaguggauccccuggaacuggaguuaugaugauuuugagccaucauauggaaacugggauuuaauccagucccuccgcaagagccacaaaugcccugaacuucugaggcauccccccagauguuuaucuuauuuauuuuuuuccagacaggguuucucugugucaccuugguuguccugaaacuugcucuguagaccaggcuggccuugaacucagagaucugccuuccucugagucugccucccgagugcugggauuacuggcuuaguggcgugcacaaccacacuuagcucuguuacacucauuuuuaaaguucacaaaaccauguauguuccugcucgaagcacaaagacccauucucccuccagccccaaggagaaguagucauagugccucgaucuccuuccggguguucucugugcauucacagcagucccucaccuuuauacaaaugaguuacaccuacacgcuucuccucagaguacuuuaugcacagagcuguauauguuggcauguacagucucaaacucuaucccauuaaaugccaauucccuauuuccuccuccuccuccuccuccuccuccuccuccuccuccuccuccuccuccuccuccuccuccuccugcccucagucucuggaaacgacaguuuuauuucacucucugaauuugacuaguaccuugugugaguagaaucguagugucuggucuucuguuaccggcuuauuucaccuagcagggcaucucaggcucauccucucagguauccgugucauuucccggcccuccgacuuuauaacagaaauuucaauugcauagaaaaguuaaagacgguauacugagccccugugugcgugcucacggccuucgucauaccuuguucuuuuccuaauaaaugaugugcuuguacacucauuuagggguucacucccaacauuaugcaagcaccacccuccccucccgggaaagggucccuaaccugcuccaggcucagcucauuccaccgccuuggaugcuuacaacacacaccagcacugacugauagucuguccccugguuugguguggguuuucucugggaagugacagugcccagggugucucuggugucuugacacagugcuuggcaugcuuuggagaggggaugagacauuuaggucagggcuggggccagaccuuagcugguuuguuacuugcccggaauucccaaagccauggguuugauucccugaagcacaugccuauaaucucagauggaauguucucucacugacugauucgugcuagggauugaacccagggcuuuauggaugccagguaagcacucugccaaauuagcuaugucucuaguccauuggaggcuuuuuuuuucuuucuccauuuucauuauuugagaauuucacgcguguaaauaauguguuuugauuaaaauccaucucccauucccucuccuacaauuucuucuugcuccuguuaucaucauauccuccauuccccacccaucccacuuuucccuuccaacuuuauuagcucugucucuuuguuuuguuuucccacugaguuuacuuguuguugucugugugugccuggauuuggucuugucugauggagcauggggagccuccuguugugcacucaggagaugcaguucucucuugguuagaauguccugaagcucuccauguacucccauuucuuuaaugauugauuuauuuauugucuaucugccugcguguauauugugcaccgugugcugacaugucugcugacagugagugcugggauucccuggaucuagagcuacagaugacuuugaagugucauguggaugcugggaaccaaacccaggucaccaagugcaagugcucuuaagagcuuaucugagucaucucugcagccucauuuauucaguuguuuugagacaugcuggauguccuggagcuugcuguguagacaaggcuggcuucaaacucacagagauccucuugucucuaccuccugaaugcuuaaggguuaccaugcccagcuaacccucccuauucaucuuuuguucuguuuuuuguuuguuuguuuuguuuuuuggguuuuuuuuguuuuuuuuuuguuuuuuuucucgagacaggguuucucuguauagcccuggcuguccuggaacucacuuuguagaccaagcuggccuugaacucagaaauccgccugccucugccucccaagugcugggauuaaaggcgugugccaccacugcccggccauccucccuauucuuuuuuuuuuuuuuagauuuauaugugugaguacucuguagcuaacacuccagaagagggcaucagaucuuguuacagaugguugugagccaccaugugguugcugggauuugaacucaggaccuuuggaagagcaguuggugcucuuaaccgcugagccaccucuccagcccauccucgcuauuuuuauaggcccuuucuuugcacacuuugcuaagcucucuggcucacuguggcauauucugcauuucacugcccauccauucaacaguggguuugguguguuugucaugugggguagaugaggaauauguuggugaaucaaacaaucauggcuugaucucuuucccaccgaaguuacugagacagguggcacacaaguaacuacucagcaaguggauaaauaccuaguuacuaauagagugcacugauggauaauaacaguggaagauacaguguggccagggggagcuccccagggacucagucucaaguaagggcugaggaugaggggcaaugcaauaguggaucauggucacaccaagugacuuagcaucugugcacugcccaaggcuucgcucugugcuauguugucucuucuggauuguaaucccccgagagcugauucugugcucuuagcauuaugccaagcacauagugguaguugccggguaguugccauggcuuccccucuguuacucuagaccuagacucccuaauuuccuaaagaagaucuuuugugccaugaggcaaacaguggguauccuguuagauugugggaagcuggucugcaccuuagugguuggcuccugaguaucucucuccucuucugcugacuuacucucagaucugcacgccugaugagucuccuaccuauucuaccuucucccugaguuccuagcagucugauggaaaggaggcugcagcuggguauggugcuggagucugccauuuccagcacacuggugcuguugccagcacuguguaauggcuaggcaggcaccauuccugaccucagcagugcagggacgguccccucuccauaccaguuaccuugcuaacuucuaagccuuggugcuuaucugucaagaggggguaaucauaccuggugcagguagucauuagacacucgcuggcaaagaaacaugguggucuggaacagguuguuagcagagcuaacacccccugagcccuccuuuccuuccaacugcucgggacccuuguguauggauuugcccugucccagccaucucccccugcuccagggaucccugauugcagccagccuuggcuccccugcuucucuucugggcucugcucauucuccaagccccugugacaugccugcucacuucuuccaauaucacacaagugggucucagccaacagcauccugccugugcccagggcacuucacacacaggcgggcugucauguucacaaauagcuugcagggagaagaugugccugugcuugucccuggccaugucgccaucaguuagaaguggauuucuccaguucagccaucacaccaggaugguguucagcuguggaaccgugggguucuuuaacagaaggcaucuugagcaggugaaaugucuucccaccuaucugauaaacuccccgugcuguagguugaaccuuuuugauagcugaccuggaaucagcuucacacacccaugaggcuggaccacuguaaacucggacuaaaugccccugcgucuuuguagucuuuauuacauagagaccucucgugggcauugucucuuaaugcuuacaacucuguggcauaggaaugaucaggcuuggcuaacuuaugagaaagugaggcuccagacgggguaagggcuucucaaaggccacacuaccaucaagagacugagcuggcauugaacuuagguauuucuagcucccagaucuugcugcugucucagcugcuaacuaaagagugcucuuauguauuguacccaacauguuucacuuuuugaaauggcuuugcagccuggcacaauggcacaugccuguaauucuaguacuugguaacugugggucaggaguucaaggccucccuuggcuacauagagaauuuaagggcagccuugggugacccuguugcaaaaaccaaaaagcugugcuagagagagcucacucaguuaagaaaauuaccacggagccuaugggccaagcuggaucccagggacccgcauggugaaaggcgagaaccaaaccuugccgguuguccucugaccgucacaugcacccuguggugugugcacacccaaacccacaugcgugcaaaucaguaagugaaauuauuuuuaaaacccguuacuuuauuugugugguggaacuaggaauugaauccagggcuuugaagaugcuaggcaaguccucuaccgagccccaccccagggcacauuaccucauccuuguaaucugaggaugguguagguagagcacguguuugcuuuuaccuccugcuccaguucuggggucagaggcaccaccacacccaucuuagagcaaauguuuucauugcuuugaguacccaagaagccugagacugggguuuaguuguuaccaucaaacccgacuguggcagagcucagacucagucuaguagucugcauucaacuuuaguuccauguccuaccuugcacauuggcagaagacacuucugggucucuuccuucagugaccuuccuccucccugcacuagaggucugagcuagaaaugucuauaauugaccucuauaauaucugggcuuccaaacagacuucccagaaccaggagaggcaauaucaggcacacaaacagguucugagcacggcccugugcagcccccugggacccauggcaauccuacugaacaaccuguuccucuccucggggagagucugggccaaucauggccacauggguaccagugaaggcaagguacccaguucccuuucccaaagaacuagcuaccuugcagaggugugaccugagaccaagccagugugagcagucacacccauccccaugcccagccaaacacagacgugcagugcugccagcccgcacuuuguuaacggcagcagaaguguggcugcuaugcugcccuuccugggcuuuguagacacucauugucuaggccaggcacagaauguaggggugaacggaccacaccuggaagggucccccaaacacgagugcccgcucugcauuaccuuagccagugccgugccccucagagucccguguucuucuguaugaaaagaaguguugaggggcuggagagacgcucaggggguaagagcacuggcugcucuuccagaggaccugggcuucauuccuagcacccacuugcugcugcuucacgacugccuguaacuccaguuccaggaagcugacauacucuucugaucucugcacacuugccaggcacacauguggugcacaggcaggccaaacccucauacacauaaacuaaaaauaaaauuuacuuuuaaaggaagaagcacucgggaagcagaggcagcuuugugaguuucagccuggucuacaucauacauuccaggccagccagggcuacacagugaaacccugccucgacccccacccucccucucaccccacugccaaugcccucuugcuccuucugaauccacuccggggucuccuguugaaauauccgaguuuuguagcauggcucuguaacacuuccuguccuguguuccaggggauccuuucagaugaccauggccuggcugcugcgcucuggaggaccuucuucaaccagaaaugugaggacccucgacagcuugaauugcugguggaauaugugaggaaacaggucagcaccaucuuucucccugugcaaacauggcggcgucugaguccuccugagugugugcgguuggcaucuuagugggugauaagaggcugacauaccaggagcuaguuuaagggcuucugacccaaucucauaagcagcaagcauugaugaagacagcuccuuccucccucucucucuccucccugcuucccucucucccucccucucuucuucuuucuuucagacaagguuucucucguguagcccaggcuggcccuggauuccugauucuccugccuucucuugugagccaccaggccuagcuuaagacugagcaucuucaggcucauucauaguguugcacgccuuuaaucccagcacucuggaggcagaggcaggcagaugugaguuugaggccagccuggucuaaauagaaaguuccaggucucuugucuuuucaaggcuguuucucucuuggacaccaacaaagaaugagcauguccgugugcagcugugacuaggccgaggaucccagggaugggaacagagaggaaaggaagagccgugguuauugacucgguguuucguuacugcuggugcugggugcugugcuaaauacugugcccucguccuggaagcgguggcaugaggccgagugacacccaccugcccaucauguacucacagagaucuucugcucccgacuuguagcagagccaggcuucaggccacaccuaacaaacacaucucugguucuccccacuggcuaucagggucagguccuuacuccuggcuugucagggcuccugucucuaaagcuuccagggcgcucuuugggaaggccugcuugagcccaguuaguucugugaauuaacuccugaucacuugccccagauccugccuggguaggaaacucacucacgccuucuggaugaaugcauucagucaucccgagguggaauguggaggcuuuucuggggucuccaagucgguucacccuucgugacuggccucagaccccacgcugggugaaucauuuaaccccagagaccacagcugcugcagacagcucaccagcuggagcuguuugugagucacaccuuagcuucaugggcuuggccucuggggcugaagcagcaccauggcauaguaauucuugaguucaccuccauggccuugcuggccuccagcaaccaggaaagggaagaccagaucccggcucuaggaccagcgcauugccuggugaaaggcugacacagugaagcccguugguagccagaugguagggaacuccagaagacaagacugccauuugacucuucuugagaucugccaaagccagggagaaggcacugcggccggagagccucacccgcagacaggagucgaaacuggcaaaguaaacacugcuuugugagagacccacccaauuuucccauccguccuggugggcuugugccaaaggccaugacaaggcacagcuaggaccucuccaggggcccagaaagaagacuuugccauaauuagugucuuugugaauaguuuccuuuggaaccauuagaagugggcaguagcgggacccuaagaaagccaggagcuuugaauggagacccagcucugucaugccuugagggccuguugugucaguccuccccucgaggagguuacaggcagccagggagucgucagccugucaugugacccagguucaggaggggcuggggaagaccaaggagagucagguucugacugggugugucauggcagcccaggaagccgagccuugagcagucucuggugcuacacgccugcuacuauuugauaaccgaucugcaguaauguugaggcuaacaaccggggguggggggggggaggcucaggugagaggcuggggcuaaguucaagaggcaucauaagaugcaagaggagcagugagcucuuuaaagaggggacaauccaagaccgaagaugaagcuaauccgcagucuuccugccucuccugguaagggagccugcccuguggggccacuaaaggacaguggagucacagacacuagaaaaccagcuggccugccguguucugcguacaccuugcugucucucuccccaguccccaugagauacacauuucuagcuggucggugcauugccgccagcggaggucggggaguacaaucuugugcucugacuucuggccugcaagaacuuugugaugagaauguagcagugguuaauggcccucgucuggaguggguggaguggggaugugugacagugugacucacuagaccacucagugguugguucucaaccuuccuuaugcugcgacccuuuaauacuauagucccucgugguguggugacccccaaccauaaaauuauuucauugcuacuucaucacugcaauuuugcuacuguuaagaaccauaauguaggggcuggagaguugacucagcggguaagagcacugacugcucuuccgaagguccugaguucaaaucccagcaaccacaugguggcucacaaccauccauaaugagaucugaccccuucuuuugguguaucugaagacagcuacaguguacuuacauauagcauuaaaaaaaccaacuguaauguaaauaucugauaugcaggaucugaccugcgaccccuguggaagggaaaauugugccccagagguugagaacugcuguacuucuccaggucuucuuuuugugguaaucguggaugugaacagucagcucaccaccgcccccacccccacugcccuggucccucuccucuccuuugugucuuugcccccuugggugagcaccuaaccucuguuccgugcucucuccacuugcagaugcaauaccuggacuccaugaacggugaggaucugcugcugacaggggaagugagauggcgcccucugguggagaagaauccacaaagcaucuugaagccccaugcuccuacuuacaaugaugagggccuuugagagacuggucccuccggacagcuggcuggcuggcuuugaggaccuuccauggaagaagugccuguuugccccaggacccugaagaagguggccugaacugacuugugaacaguaccuguugaauacucagcccacucguguugaguuucuucuuccugaucuggugggguuacuggggagguccucuugcucuuugacagguccccucccucaagagaagccccaggcacacuucccaaguccccucagcaccacacgugacugagagcuuuuuccgaaggcugaggaagggauggguagguuagaagggggugccuucacucagaaaccccugugcuuggagcaguuuauuaaguuccaaagucacaguggguaaccauauacuguucccccucugugagccaugggguugaaguagccauuaaaaagagagacuuauuucugccaugguuuuucuuuguuccaaggucuuuuagaaacauaguuaaagcccaguguaguggugcaugucuuuaguccaaguauuugggaagcagaggcagaugacucuagcuagguucuaggucagcaugaucuacagagugaauuacagggcaggcagagcuacacagagaaagccugucuugaaaaaacaagagaaaagaaaagugcaggugaggccguggguucuccaagcucagggaauaacugcagcucaguuagaggcagcacggagaggagcggagaggagaggagaggagaagaggccaggggcucucugcugcuacuccuguccccaggucacagagaggagucacugucugggcaagguacagucugccaggcauguucacugagauccaggaggucucaggaccaaggggcuugucacauccuaagucauuuagaaagaacaaaagucccuuugucacccacagugaacuggggaaggaacacacucuccgcacuuggccucucuuuacgugagauacuguggcgugcugguaccauccaagccucggcccggugucuauccccuccccaaguucuaaagcacgggcugugaugggaacuugaggggccuuuucucucugggcacuugaagggucuguucucucucccccgagacuuugggucaucucuuggaagguuuucugaaauugaggaacggggguggggcccgucuccucccucccuucccccacccagcuuccuucauugaacuugcuauaaaaugagucauaugaagaaacccuauacugugagguaugcgccacuucugugaaaacauuacaaaucaagccgccuucucaguuuauuuaagaugcuuuuguugcaagcggggcucuggagugaggcguccucugugagcaugagauaauagcaccuuguaacucauuacaucugggcacuauuuacauaaaccagaggcgagccaggcagggauuugcugauuaauuuauuuuuaauggacugaaguaugccaugcaccaaaauaaacuuuacuguguguaccuaacugcuccuggaauggauggaaaaauuaauggaacagauuuuggcuccuaacucugcacauuaauucauauauaaaaguuauuugagcauuaacccauuugcugcccagggcagcucccuagccacagaucccagcccgcggcaccaccuuagcugcugggcuugcuuucguguccugggaccucaaauuugcuagccacuuuaaaggucauuugcagccguccugguacccuugcccaccuuucuuuccguguucauacaaacccuagcugagucccacagcagaaaauagccccugcuugcagagcuuaugucuacagga

SEQ ID NO: 1208 - RNA, 10430 nt, Mus musculus
caaagguccaaggagaggcacuuaccacaggugcugucacuccgcacccaagcaccgcccucugugcucccagcccgccccucucggagcacugcccaauccgcgcgaggaggcgugacaauguccacaagcuagacugccuuugaggaggcaggugaggggguggagccccacuuacgcaccgcuacgccugcgcaagacagcgaggggcgugaccccggguccaggccggaagcgggaggcuggaggggcgggccggcugguguccccuuuccggccgguccccauggaggcgcuggggaagcugaagcaguucgaugccuacccuaagacucuggaggacuuccgggucaagaccugcgggggugccacggguaggucucggcgcgggcaggguugcaaggagggagcuguccucgcguucggcccgggcucccggacccuccguggccugcuaaggggcugaggggugggauauaggccguuccaaaucucgcucucgcccugcagugaccaucgucaguggccuucucaugcuccugcuuuuccuaucggaguugcaguauuaucucacuacggaggugaggggcguggccuagagcgugggcggggccuggcauucuaagggcaggacccuuaaaggugggagaggggaggagaggcgaggagaggcauaggggcgaaucugacugagguagacaugcucuaggugcauccugagcucuacguggacaagucucggggggauaaacugaagaucaacaucgauguucuuuucccgcacaugccuugugccugugaguacccgauugugaguggggaguuggacuccuggacguagggugggcuuccagauuuacaccucuggccuuagaucccagagugaaugccaggccauccucauuccccgaguccauuucuuccucaagauacaucuuucccaucaaagcucagcucuccgggucccuggugucguagcgccuuagcuugccucucuguuuccagacuugagcaucgaugccauggacguggccggggagcagcagcuggauguggaacacaaccuguucaagaaacgacuagacaaggauggcguccccgugagcucagaggcugaacggcacgguaaccaggggagggggacaggucuccgauccuacagcuggacaugccugccuuccacacaugggccguugcaggcucagugacaccguagacagaagucagcuggcuugcuuaggguucuacaacuauuaaaaaucaagagucaguugaauccaugcuucugguauuggaacauugaguagaauaccuuaggggcuggagagagggcccagugguuaagagcaagacacuuugcucgguuaucguuucucaagcuugaacaugggucuuccuuagguaaaggaaguuugcuuguccaccucauuggcuagaguacugucccccguugcagugcgaguauccuaagauuaagagcuuaaauucucgaguagaguugccuggguucggaucuagcauugucuugcaguuugugagcaugaugcagggcuggaugcaauacagaugggucucagcuuacaacacucugacuuggagaugguuugaaagcacgccuguacaaccauucaggucuucacuuugcguagaggacucagucauuggagguacucggugcuuuguuaggaacuagucuucaugucagaugguuugcccagcuguuggcuggguaaguauucugagaauguuuaaggcaguaucaguuaagcuauaauguucugugucuuagauguauuaagugcauucuaaaauaugacauuuuaccaugggaaaccucauccugaguugggggaaucaguaauauauaaucaguacacaacccauaaguaaucuuuuuuuaaagauuuuauuuauuguuuuuuuguuuguuuguuuguuuguuuguuuguauuuucgagacaggguuuuucuguguagcccuggcuguccuagaacucacucuguagaccaggcuguucuugaagguuuuauuuauuguuaaguacacacuguagcugucuucagacacaccagaagagggcaucagaccucauuacagaugguugugagccaccaugugguugcugggauuugaacucaggaccuuuggaagagcaguuggugcucuuaaccacugagccauaucuccagcccauaaguaaucuuucuaaaagaccugguauagaguguacacuuugagcaguuucccuaaguugcugucucuguuacccucagcccaucucacuguguagaacucacagauccucuugccucugucucgcaagugcuaggguuaaagguaugggcuacuaucccagucucagagucuaaggggauggaacagggcaacaggaacuugccuguaccaacugacucuuaguguuuacugcuguuuucugauacugaguauauguaauggccuuaacaccugaccaucauguauguggcugguuuuccccagcccagggacuuaugugggagggagcuguggccguggaugucacugugucugcuucaugcugugcuuuugccccugcccugcccagagcuugggaaagucgaggugacaguguuugaccccaacuccuuggaccccaaucgcugugagagcugcuacggcgcugagucagaagacaucaagugagccacgccacagggcauggggagugagaccugagaugguagaggcauuauauuccucacuauucauccugaugcaagugauaacaguuagccagcaggcccgcuggcaacugcacaccuagggggccugcucuucagccuagagaaccagcugccaggcguccaguccuugucuucaaucugagccacauugcuucucuauguagggauaauaacacccuccuugccaaaguuaaguguauguuauauguaaagcccugacguacagggccaaagcuacauuauuacaccuccacuaugugccaaccacugugcgacuucacagccccaaccccugaaagacugacucaacaggucuagagagauguacuuuucagaaagaagagggggaaaaauaauacuguuacauguggcugacaguuggcuuuuauagccguuuuuaugugugugguuaauuggcgcuaagaacauucacaccaccuucugcagugcgcagaauagcuuuuggcuauucccccagggcaccguggcugggcucucaucccuucgugacuucucaacaggugcuguaacaguugugaagaugugcgggaggccuaucgccgucgaggcugggccuucaagaacccggacaccauugagcagugucggcgagagggcuucagccagaagaugcaggagcagaagaaugaaggcugccagguguacggcuucuuggaggucaacaagguacccggagggagcaaagcgagacagcugggugagucaggccuguuggugaugcggagaaugagaggaaauguccccuacagguggcuggaaacuuccacuuugccccugggaagagcuuccaacagucucaugugcauggugagugauccagggucagcggggcucuuagcucucagauucccucguggcagguuggugugcuccuuaccaggccaguguucuuuuaacguggagccagaguaagagagcaggagcacaguuguagagaauauagggcagggcuauggaugcucagguaguaguguguaccuggugugcaugaagcccuggcugugaccucgucuguauggugcaggauuuggugcccuuagcggaguuaauguguuuauucacuagacaguagcaaucaccugcugcagaguuaauguauucauucacuagacauuagcaaucaccugcugcgugccguguguuagucuagguauaaagauccuaagucaguaaagucccugcacucaagaguauucagacagacagcugggugugguccacauacccagcacuuggaagguagauagaaggauuggcuuaaggucauccuuacauagcacguuugagacuagccuuaguuaaaugagacccugccucaacacgcuccuuacacacacacacacacacacaacaaacaaacaggcauauaaaguacaugauauauccucuacuauuaaguaauguggacuugggcuggagagauagcucagugguuaagagcacugacuguucuucccagagguccugaguucaaaucccagcaaccacaugguggcucacaagcaucuguaaugagaucugaugcccucuucuggugcgucuaaaaacagcuacaguguacuuacauaaaauaaauaaacaaaucuuuaaaaaaaaaauuaauguggaccacaccaaagaccaaccuggucuacaugguuaguuuugggcuagucaguacuauauacugagaccuugucucuaaauaaauagauaacauaacaauaauguagaccaaagcaaggcagaguaagaugguggaggggacaccgucugcuguuuuaguuaaggugguuuaggaaguacugugggguuacccgugugccaggaccugagcagagcgaggcggccagcaguggugaugccuaggcagcauagcaggcagagagagcagcaaauguagaugccgagggccugcgugugcuuggcaagucccggugauagugagccuuggaacacagaagcugaaggacagccacguagggcagcagggccaggcuucugugcugugugagcugacuucacccuuacaaauaaugucaagcaggauggcucagacuuuugauaccaacacucagacggcaggauuaggaggaucucguugaguuccaggccagcgagugcuacauagugaggccuugucuucccccaccaaaaaaaaaaaaaaaaaagagaagcacaagguaacacaaggugguguguagagggugagaggggaccagggcagcacacgaggcucaguggagaaggucgcagugaccaggccuggcaaagaugcuggagcauggcucagaauggugguggugaagcaguggguucuggauacauuaaagguagaacugagaagauaccagugggugugacagagaaggacaaaggaguccaggacaacuugaguuuuaugaguuuuaugccugaguagugggaagguuagaacuaccguuuagaagacuuaggggauggguuggagagggugguuguucacaggugugggcauagcacagacauucaguuucugacccuuucaggccaguaggauuuucauuuccuagguucugugcuuaccaaguaguuuuuccugggaguugggggagaggaacuagcagggagcugcagauguuggaccucacacauacucagagcucuccugcaggcacaggaugguggagaagggaccucugccugaguccuccagcuucugccauuagaggaggcuaaagauggcuggugagccaggggagcagaccauggaaugucaggggcauugguggcccucucagacccuggcuguaaccagggucugagauuguguuaagggcaaggugcuugaaauugaagcuaagaacauaugucaucacuaccauugucaaaguuuagaugauggugacagcugaggacugggaaguggaggaugagacggagaaggaaggaaagacuacccaggaacuggugcacagaccucagaaggcucacaugaagcagggcugugcacaugcagggcugugggaagucaccaucacaucgcaaaagugaggcuagagaggagagcgacaguguggcgggugggucuggaggggacagguuagugccugagcaugaagacuggccagcuguggcagccaggagagcagccuccaggcacagcaggcagaagcacaugcagguugucccuagcugcuguucuggcauaggaagcaaggucauuagcugaaggcugaggagagggggauggagguggcggagauuugagaaaggccacagugggcaccucuaguuucuaggacaguagguagaagugagaacaccugagggauucucugggguuuagagacaagggagucaggagcgcaugaucacagaggugagccaugggaagaagugagcccuucggguuggguagcaguggaagccaguaaggaaacugaggccgcagacugcgccaggccuucugugugguggcagagggcaguuggauuugggugggaaggaccaggaggaaguuaggaugguggugcagcuacugcuaaugucagguuagggaaugagcaauagcuggagguauggguugggggagaggaacagggagagggcugcccaacugugaggaacggaucuuggaaggcuccuguacaugacugugggacucaggagaagcugugacucagcugucgucaaggauggacaguccugggggugccuaguaguauuuugugauuacacaguaaggugcuuugaucugcaccagagcugaggacugagaguagaucaggggacagugaucugacaauggcaguaaggagcuagaaaggccaaagaggggauagauacgggagaccacauagucacugaggggauagaauagaguuggugccuguggaugacacaaagaguaaagggccuagguagaggcugaagacaggagucugcuaccuggugggguguggcuggguggcaguuaagaucacacugggagauggcuaccagguaagaggaaggcagggaaugagcagagcccauaggccuggcugcucugagugacuaagguaagcauguauggggucaugugcagcagcucugcaggucuaucagauagucugugccuacauugggggaaaggcaaggggagcaaggagguggucuagaggacccugcagagcucuggaacccugcauccccuuacucuugaggaguaaaguggacuugcugaaacuauagaaagauaccaguguggcacuguauaaaacuguaggcgccaggccucacagacacucagaagauugggcaggcaugacagcagcaugucugcgccuccucuuaggucuacccucagaguccugaaccccaggaaaaugacucugaguacaacgaugcccauacacagagcuccagugccaguggccagacaucugccggagcccucagaguauuuuuuuuuuaacaucuugguuaauugcagggugugaaugauacagucuaauuucuuguaaaguugaccagguacugccucucuuagauccuccugguccuuaggacagcccucugcagagaaggucguguagcugggagacgguuuuaaggcucuaggucuuugguucuucuuagacuagcuauuuuuuucugcuuaagccaccuccuaugccucuuuggucucagaagaggccuuuuagcuggggcuagacccucgugcugaagcaggagugucaguccucccuccucccauggaucuugcuccauagaucucacugugaagcucugaaucuuuguucucuuccuccucucuccuucccccaugcugcaguccaugcuguggagaguaaguggcccugcccccagggaggccaagcccccacuucugaggcagccugcccuccuggaauggggagguuuggauggguccgggauguaucuuugaggugggguuccucacagcagguaguugggacuagaagaugggaugaaauuguugcuucaggacccccuugagacaccuuuggggaauuuugagggcagaagcaccagagucccugucccuuucccccucccccccaugcuggcucacguuggggucccaugauuugccauuaacucuaguuagugaucuagucaguagauuuuguuuccugagcuaaaagccccgccuggagucaguugccuagagcugcugucagggaagaaagaucuguguucuugcccaccccaugugaggguaugaacucucacccagguccagggcaggcccugaccagcuguccuuaagcagcaccaggguuaccagggugauagugacuagggguccgagaagagcuaggugcgucgcaccccacagcgaggaagacagccugagaggagacugggagcagccaggagccugguccugccuaccuaaugacccugucuucuucucuccuaguucaugacuugcagagcuuuggccuugacaauguacguaccagguggaaaccauggagguuggguggcauggagacugggcuucucaugucugacauggggcgcagagaaaccucuccccauugcucagcugauguuucagacucggggguuguggaaugcaaccuugagaaggagccucagagcaaagccagaagggaguaugacauuccuagguggguauagauggccaaggcugacaaacguuggcagggccagagcacuugggacuuggcagccacccugaggaaucggcucuuuccuucagaacagggggcaguugucugcucacuguaaccaggggugugacauagauuugcauuucuaagcaucccucaagaaagcuggcaguuaggggcuucuggcuuaggucuucaucccuugagggguccaggcaggaccaaugucuacugugcacuccaugagucuuugaaguuguaccuuaacccuggagccccaggaaccuguggacugagaaaggaauccuucagugaaagcaggagaugccugguacagccaguccuuccaucauuguccuagccucucccguguaggcuucucccucaccccucccuuuccccugcauugacagacucaggcgucccucucugcugcucuagauaguucuggguggcgugggugacguaaugucgggccucagccaucugauugcuugcagaucaacaugacacacuacaucaagcaccugucauucggggaggacuauccaggaaucgugaacccccuagaccacaccaacgugacugcaccccaagguaccauccugggagguagccccuucucccaucaaaacccagcaugccuggcagcagccaugcccugugcucuccucuccacacagccuccaugauguuccaguacuuugugaagguggugcccacaguguacaugaagguggacggggaggugaguucagguaguacggggacaacucaucuccgagcacugggaguccuuguguaguuccucagccuggccaaggagguacugcucuccguacaauggaugcagcucugaggccugaaggguagaggucugcccucacugcagucacaggcucaacaccaccuggucuuccugcuucccacacugccuccagacaacccuugggugcucagugacucccauuguauguucugggcuggguuauccaggucaagcaucccuuacgccuccucuguuuuguggucuguagagcagccagucuguugagugcuauaacagggcucaggggcaaggaagugagugccagccuuaggguggcacugcaagaguguuuucucaccccuggaccuccagcgaaaggauugaccagaugucgcuacggcaggucaacuguaaggugcugauuaguaggcuagcuggcuaguuaggugaccaggcaggggaccacaggaguucugacagcgcuaguuaccgauaugggacccucaugucucuucagauagucauagccucacaaugggcagggcucagaacaccccugagccaguuucugagccuuucucugucucggacccuuucuaccacaggugcugaggacuaaccaguucuccgugaccaggcacgagaagguugccaaugggcuccugggugaccagggccugccgggggucuuugugcuguaugagcucucaccaaugauggugaagcugacggagaaacacaggugagguauagagcggcaguagccaaggcucagggccagugagagccggugccugcugagcccuccuguugcuuuuuuagguccuucacccacuuucugacaggugugugcgccaucauugggggcauguuuacagguaagagguugcagggcacuuuugggggaaacgggugccccaggcuccccugugcuguagaucugaggauguucacauacugggcaagggguccacugcugaguagcauccucaguaguaucccaggccuuggcuggggaagaggaaugccuuaaggaccaaggaaaaugcucgcuggccaguuaggugacagcagggguccucggucucucccucaguggccggccucauugacucgcucaucuaccacuccgcucgggccauccagaagaaaauugaccuagggaagacaacguagcucucucccuuccccacagcuuguccugcccucucuuccccuguggguuuacccuccagccugucaacuacccauauccucuccucagccagcccagcccagggcaauaaauaugaauugugauaggaaugacu

SEQ ID NO: 1209 - RNA, 20552 nt, Mus musculus
cgcaguuacuuccgggagcaugggcugaggacuugcaagcgccgcggauggugggcucuguggcugggaacaugcugcugcgagccgcuuggaggcgggcgucguuggcggcuaccuccuuggcccugggaagguccucggugcccacccggggacugcgccugcgcgguacguucccuuuccuuuucguucccacgguuucuggaggagcgaacccccuugggucggugcugcuaagcacugcauuauugcggauccuacccgccuuguuccaucgcccagucucuuaaaccuucccgucgcccggucuccuauuuguuuucgggagggcccuuacauacugcuccgcacuucccuugagcggaauucucauccuucaguucucuccugaccaagucuuaaagaugcuagaugagcuuccuccugccgugaaccuuugaaggaaccugcgcuuuucacuuuucuucuaaauggcuuugcuuuuuacagcucgucccacucggugcuauguaguuuaaacauugcccccgacugcugcugcccgcgcccuuuccaagaacccugugucuauuacuuaacucgaugucuuucagcgcguguuguuguuuguuuacuuugacacuggaccuccgccuuccuuaaauucaccucaaagaagcuuugaccaucuguuguuuugugugcccuucguccacgguuucucacuuugccacugcuaucuguuguuaguuguagaucauggcccccauucgccuguucacucagaggcagaggcagugcugcgaccucucuacauggacguacaggccaccacuccucugguaaggacuaacagagguucuuuguagggaggaaagguuagaaggacaaauuucaccgacaggcuaaaauucauccgacuugagaacuauuaaaugugcuaggaaaaggagcugccaggaaucaggaggcuaagauguuaguuuaguagaaaaggcuuuacuguuuuuuagcuacugacccugucagauccuuccaguacaggcauuauaacuaauaguaauugcucggguguuggagcuggacaguguggcauggguaguuugagugagcuuaagaccagccuaagccacauagggaguuucaaaccuauguuguuauuuuguuuuguuuuuaauuuuauauauacacaaggacacuguagcuaugcucagacacuccagaagagggcaucagauuccauuacagaugguugugagccaccaugugguugcugggaauugaacucgggaccucugggagagcagucagugcucuuuaacugcugagccaucucuccagcccccucaaacuuuuguuuguuuguuuguuuguuuguuaaaugugccaggcauugguggcacaugccuuuaaucccagcauggggggcgggggcagaggcuggcagauuuccgaguucaaggccagccuggucuacaaagugaguuccaggacagccagggcuauacagagaaacccugucucaaaaaacccaaaaagaaaaaagaaaagaaaaguguguaucagcacaccuggcaggcuuauaaauaugaggucagauucaacuacauaagaccuuaucuuucaauaaguaaaugaaaaaauuaaagaaagacuugugggaauugcagaacauugcaguuugaagugggcaaccuggcaggcuuauaaauaugaggucagauucaacuacauaagaccuuaucuuucaauaaguaaaugaaaaaauuaaagaaagacuugugggaauugcagaacauugcaguuugaagugggcauauaucagguugcuauuugauuagugucugagaaguggaagaaagcagagaguaucugaaagguuggaaaugcacugagcaagguuggcagguaaugguggcucgagcagguucugaauugacuuugggcucuguuuucuucuguucaggaucccagagugcuugaugccaugcucccauaccuugucaacuacuaugggaacccucauucucggacucaugcauauggcugggagagcgaggcagccauggaacgugcucgccagguuagcacgaaggacugugaggaguuccagucaguggucuaugugaccuauuucuuucuuacagauggaaauagcuguuuuucuagaagagacucagguaguagcucuggaauuugacacuaaguguuuaauuaguucccagcuucccuaggugaccucugacaaauccgcucauuucucuaagccuugaacuccucaucuaccaaguggaaagugaaauaguucaugcuguauaagauuauuggggaaauuaaaugaggcagugcucguaagguuaacacuugugcauaacucaaaacacauguggaaagaguucaauaaauacauuuuuaaaaaugcauuucgcgggucaaugggacauguccauggguaccuuaacacaaugacuugaauuugaucccuuaaaucuccgugguauguguaguuuugucuacaccacuuuauguucuuggcugguuacaccuguguacacggcccagaaccuaucucacauccaggaauaggaaaccacacacaccacgagcuggagaguuggcucagccguuaagagcacugacuucucuuccagagguccugaguucaguucucagcaacaacaugguggcucacaacugucuguaaugggguccaaugcccaauucuggugugucugaagagagcaacaguguacucacauauuuaaaauaaauaaauaaaucuuuuuaaaaaagagccaggugaugguagcgcaugccuuuaaucccagcaccugggaggcagaggcaggcggauuucugaguuugaggccagccuggucuacagagugaguuccaggacagccaaggccacacagagaaacccugucuuaguaaauaaauaaauaaauaaauaaauaaauaaauaaauaaauaaauaaauaagagaaaacauacacacaucaguuauucuuuuuuuuuuaagauuuauuuauuuauuauauguaaguacauuguagcugucuucagacacuacagaagagggagucagaucucucguuacagaugguugugagccaccaugugguugcugggauuugaacucuggaccuucggaagagcagucgggugcucuugcccacugagccaucucaccagccccaguuauucuuaaaaugccuuggaaagcucagugaguguguacuccuaaauccuccccugcuacccuaggcccagucgguaaaguggccgcauauccauuaguuaccuuuagcuucucuccacuacugugcuacugugcacccuucuccucucuccccacaacucucagugucccgcucucugcucaaccauugguuacuggcaacuuuauugauagaucaaaaagcaacuggaggcaaggaccuucggggucagcgagcgcagauuccugaugaaaugaaagccucagaaguguccucugcauaaaccugcuguggcaggaacggccuccaccccaaaguauauaaauaagugcagagaacauuguuuaaaaacaaaaccugccauuaaaaauaauuaugcauauggauguuuagugugagugcggaugcgcaugcacacaggcaccauguacaugugugaugcugguagaggccagaagaggcugucagaucccuuggaacuagaaauuaaagauggcugugagcuaccaugugggugcugggaacugaaacuggguccuccgcaagagcagcaagugcucuuaacuuacucagccgucucuccagccccccgcuuuucgcuuuuaucuaagauggcuuggaacuuccuguguaucccagacuggccucaaacucuuggccucaaacuuaaccuccuuagugcaguugauuugagguuugcaccaccuugcuuuguuugugcagagcuggaaaucaaacccgggcuccauaaauauuagguaagcccucuaccaacugagcuacauugacauucuuuuuguuuugucuuguuuuuugagacaauauuucuuugcaaagcccuggcugugguggaacucacuuuguagaccaggcuggccucaaaccccugagugcugggauuaaagggguaugucaccaugccuagcuuacauuugacacuguccaccggucuuagacuggagaaaggauagaauaucugagccaugacaaucaguuccuuuuuaucccuauccaggcuuaaaaguuauaccuaguaggcacagagugucuuuccuuguaggugguugguaggaugcaguagaucuucucuugguccaaagcuccguccaggcuguaucuguagccccaucgcugcccaggauugaugcgcuguaucuuugucucuuggcuuucagcaaguagcaucucugauuggagcugauccucgggagaucauuuucacuaguggagcuacugaguccaacaacauagcaauuaagguaggaggagggauggggauguuguguggccgacaguugugagggguugugggaagauggaagccagaagcaaaaaagagagaaccugacacuauuucuggcuucuuggguuuagcgauuagugccccucucucauuugaacucaacuacccaugucucccuaggucuuucucugccuuaaaaaaaaaaauguguggaggacagcuuuguggagucugaaaucaccaucuaccuuuacuuagguucugagugccaaacccaaggcaccaggcaugcguccuugacuccggagccaucaggcaggcuuuccucagccuuuugcagccaagucuuuuagccuauuggucugaguucaguguggcaguugguuaggaaagaaggugguucuuggaccacuaacaguuuggauuuuuuaggaugcuaguccuuuaaaaaagugaguaacaguguccggcuuaggucucuguugcugugauaagacaccauggccaaaaucaauuucggaggcaaguauuuauuucaccuuacaaccucgaauccuugaugagaugaggggaaggcaaggccugagcuuagggcaggaaccuggagcagcaacugagauagaagccaugcagggaugcugauuauugccuugcuccccagggcucgcucagcgggcuuccuuucacccagaaccaccuaccagggguagcaccacccccagcaccacagccucccagcaccacagccccccagcacuacagcccuacagacccccagcaccacagacucagagcaccacagacccacaaacccacagucccacagcaccacagcaucacagucucauagcaucacagacccacagcacuacagcaccagccaugaaucauaugugugccuaugcaguugucuucagguggccucaugggacauguuuucagccaugucgauguucuaagaugacuuuggcuugcuuguaguugaucaaggccacuuuccuaucagcuuuuccuuucugagaucuguuuacagaauuccucugccuuuagaggugauuguugcuaugguacccucugcaggccuuugacuuggucacucaguccgguauuggucauccuauauuugggucaugcaccaucuguaagggaaucugaugcccuccucuggugugucugaagagagcaaugguguauuaauauucauaaaauaaacaaauaaaucuuaaaaaaaaaaaaaagagccaggcggugauggcgcacuugggaggcagaggcaggcagacuucugaguucgaggccagccuggucuacagagugaguuccaggacagccagggcaacacagagaaacccugucucgaaaaaccaaagggaaaaaaaaaaaagagagagaaagcaagcaagcaagcaagcaagcaagcuuuagcucccaguuucucauuuacaauuuuuuaucuuuugaaaacuaauuugugcacaugugauauuaguuucucucuuuuuaaggauguguuauuuaauuuuuuuguuuguuuguuuuuauuuuuguuuuuugagacaggguugcucucuuauacaaaccagaggagggcaucuaaucucauugcaggugguugugagccaccaugugggugguugcugggauuugaacucaggaccucugaaagagcauuuagugcucuuaaccacugagccaucucuccagcccccguaucuuuuucuuuuaauuuuaauuaaaggugugcaccacaugcccggcuuagcauuuaucuuuuuuuuuuuuuuugcauuuaucuuuuuuaauuaaucaguuuguaugugugcaugcaugugccacagcacacauguggggucaucaguaacuggugggaguuggcucccaagguuggauucuggcaguaagccuguggcaagugcccucacgugcugagccagcauuccagcccauuacuuguuucuaugucugacuuauuuuacuuaacauagugauuucugauuccauuuauuuuucugcaagugugauuauuucauuuuucuuuuugucagaauuaagugguauuguauaucuuuaucccuucaucugucgaugaacaucuagacugguuccacuucuuagcuauuauaaguaguuaagcagagcugggugugacaaugcauagcuuuuuuuuuuuaacagguuuuuuuuuuuuaagauuuuuuauuuauuauuauauguaaguacacuguagcugucuucagacacaccagaagagggagucagaucuuguuacggaugguugugagccaccaugugguugcugggauuugaacucuggaccuuuggaagagcagucuggugcuuugcgugaccccuucaugccuucaaaaccaguaccaccugggugacccuuacauauugccaagucccgcugcagcaggaguacaaccuuggccaucucuggaacacagccucuuugugcuuucagaaaacacuucccagaagaugucaccucgaugaugcuggucucuucuuaaucacugcuaauuucuuagcuccagcuaaccagcaucaauagucccaguaaugcaaaguuuuugcuuugguaguucugguaucuuguuaaucacagcugauucuucagccccagcuaaccagaacuacagaaucuucacaaucaaaacagcaauggcucugaaaagagucuuuaauuuucccucugaaauuucacaaaccaggccuccaucuucugcacuguucucaacauuaucuuccaagcuccuacacaacaucugacagagcucuuaacaacggauggaucuucaagcccaaaguuccaaaguccuuccacaguccuccccaaaacauggucagguugucacaggaauaccccacucugcugguaccaauuugucuuagucaggguuucuauuccugcacaaacaucaugaccaagaagcaaguugggcuuacacuuccaugcugcuguucaucaccaaaggaagucaggacuggaacucaaacaggucagggagcaggagcugaugcagaggccauggagggauguucuuuacuggcuugcccacugagccaucucaccagcccgaugcauagcuuuaaucucaucacugggaugcagaggcggguggaucucugugaguuccacagcuacauaguaagacugucucaacggccgggcgugguggcgcacgccuuuaaucccagcacuugggaggcagaggcaggcggauuucugaguucgaggccagccuggucuacaaagugaguuccaggacagccaggguuguacagagaaacccugucucgaaaaccaaaaaaaaaaaaaaaagacucuuucuuaaaacaauaaaucccugcauggugauagagauugaacucugaaacgugugcuguucaaaaagagcaucucucaaauaaaaacagaagagacaucuaaacuaauccauguuuauauugcaaagagacgugaaagcaacacgaaaaagcaaggcagugugacuccuuaacugcugaaucgauuacaccaaacaguuuagguaccagaugugaagacauguauguguaaacaaugugcucaccuaccuagggaggcaucaugcucaccaacaccagcccggucucagcaccagagcucccuaccugggccagccugccuggcuggugucccucggauucuccggucucugcuucuguaggaugcaggagcacuggaucuggguagagcucgguccuuauaccuauuuauuuaagcuuaaaagaaaaaagauuuauuuguuuuuauucugucuguguguguguguuuguguuugccacuuaugugccuggugcccucagagccugaagagggagccagauccccugccaagggcaguugugaucaccaguggaugcgaaguacagagcccagguucuuuguaagugcucugaacugaugagccuugaggagccuucaccccagcucaagcgauccucaugugugugcagcaagcaccuuagggaaugaguugugagccucauuuaucuuuuauuuauuuauuuugagaccguaaguucuaaugguccucugcccucaguccccauaguaguaccgacuccaggcuacugcacucagcugcgcugcuuuccugucuuacuucucccucuguuccuugugcucuuuugauuguuuggagacaagaucuuacuaaguaguccugaguguccugaacuuacuguguagaccaagauggucucagagugcagaugcccucuugucccuuaaugcugagaccguagguaugugggcuauacuugacuauguuuuguuuguuuguuuguccuuuuaauaacauaaauguucauuugauauuuuggguuuuuuuuuuuuaauacaggccacuucacugcaacaauuuuuaugucuuuuucacuacaucauaauauuuuuuuugauaugccauuuucuuuuuuuuucuuuuuccaauuuuuauuagguauuuucuucauuuacauuucaaaugcuauccugaaaguucccuauacacucccccuuccucgcuccccuacccacccacucccacuucuuggcccuggcguucccuuguacuggggcauauaaaguuuguaagaccaaggggccucucuucccaacgauggccgacuaggccaauuucugcuacauaugcagcuagagacaggaacucugaggguacugguuaguuccuauaggguugcagaccccuucagcuccuuggguacuuucucuagcuccuccauugggugcccuguguuccauccaauagcugacugugagcguguuugccaggcacuggcacuuuuuuuuuuuuuuuuuuuucaagacaggguuucucuguguagcccuggcuguccuggaacucacucuguagaccaggcuggccucaaacucagaaauuugccugccucugccucccaagugcuggcauuaaaggcaugugccaccacugcccggcaguauuucuguuuuuauuagccuaucuuuauaguuucuccugaugcuaaaaguaucacaugcaccaguggggccuuggucugucacaugaaacgucuucagcguacuugaggcucugggcaauccugagcccucccucacagaagggcuguuuaugaaugggauucaugguaccaaggaugcuaugcuuuguuuucauuacauuaucgucaacucuuagggaguggccagguucuacaggucaaggaaaaaacacuuggucacaacccagacagaacacaaaugugugcuggauuccugccgcucccuggaagcugagggcuuucgggucacuuaccucccugugcagaagagcgggaucauugacuuaaagguaggagcaccccggccugagggacaggaugggaggagccugccuccuuccuguaagucugucucuccaguuuuggguggagccuaaagguugaucagugagaguggagcauggaucaggccuggcggagaagauuguguucuuuaugugugugcuguucuccauggaaaacuugccucugagggauuuuggugauccucuuuuguacagagcuacuggacaugaggguaggaugucagggacuuacaucaaaggagagcucuggccucuuucuucccugcauugauguuucuuaucacccgacaaaggaagcaggcugacuggagguuuagcucaguaguauaauucuugaauaguauacacaaggcugugggcuugauccccagaacugcaaaagccaacauguuaguauggguuagauaugggggauucacucuuaaacucagugcgcuggaggcucaaacaagaggaucaucagagccgggcgugguggcacaggccuuuaaucccggcacucgggaggcagaggcaggcagaucucugagucuaggccagccuggucuacaaagugaguuccaggacagccagggcuacacagagaaacccugucucgaaaaaaaaaaaaagaggcucaccagaguauggggcuagccuggacuggagagugacagccugucugaaaggaaaggcuugaguauaggugcuuguccauguuuguaccaugugauuacgcugcucuuacuccuguagcuuugcagcagcuugaaaucaccuuuguuuauuuggccuagguagggucucauguaagcuuuuuggaguuuuuuuguuuuguguuuugguuuauaucuuugucuuugaaacaguguuucaggaaucucaggcuggccugcagugguuauuuagacuugaauggccuugaaccccugauccuccucacucaaccuguuagguguugguauuacaaccauggcugcagggagguuuucuuccuccuuuuagauugauuucauaugugccuggcuguuacagguggcuaugaguguggcuguggggacuccaacucagggcuucuacaacagcagcaauugcuauuaaccucugggccaucucuucagcccauauuuccuuuuuaaagguuuguuuauuaguguauaugaguacucuauucacauguaugacucuaugacgagauuauacaugguuguaagccaucauggugggugcugggaauugaacucgggacuucuggaugagcagccuggccuuuuuuauaacuucuaguuuuuguauuugagugucaugccugcaugcaugucugugccugguacccguggagacuagaaaaaaguguccagugcccuggaccuggaguuacaaacaguugugauccuccauggugugcuaggaaguaaacauggguccucaggaugagcaggcagugcucaccgcugccgagcuauggcugcagccggaaagcugcuguuauugauuguuuuuaaacaguaacacuagggagugagcucagugccucacacaugcucuguaccccuguuaacuuacaugcuuagauaggguuagagugaaaggcuccucuuguagauuuaaaauugccuuuauucuuauuuauauagcuagcugucucuuggcaucauauaaacuccuuacuccuacauucuuaggaacuagaggcugccauccagccagacaccagccuggucuccguuaugacugugaacaaugaaauuggaguaaagcaaccaauugcagaaauaggugaguaugguagguuagccugauccuuaccaccccaggguccgugaaaggagcaggggcacagaguucugacauaaaagccaaguggaccaacgggaagagcugugugccuugcugacccgcauucuagcuggcuacuaugugagguuuuagaguuuaggguuuugugcccuuuaugguuguugcugcugucacauuuuauuucaguuuuugcuccaaaugacaacaacacaguaagaaaaagccauauccuuuuuucuauuuuaaauuaaaaguaucuaaaaggagauguugcguuugcaaaauccagaguuaauaagggagcaugaagaauaucgggcaccggggcugguaagauggcucaguggguaagagcacccgacuguucuuccgaaggucuagaguucaaaucccagcaaccacaugguggcucacagccaucuguaacaagaucugacguccucuucuggagugucugaagacagcuacaguguacuuacauauaauaaauaaaucuuuaaaaaaaaaaaaagaauaucgggcaccaaaaugucguguguauuugugauuugguguuuugcucuugauuuuuacaguaauaacaaagagguggggaguugggaggaagcuagagaggcaggggcagguggaaagacagggaguaggagagggcacguacacacauacacacacguacacauacacacauaugcacacacacauauauauguguauacauacauauauauauguuaucaguaacuuaaauuauucauggugcuuagcaagauugcugucagguuacauucacuaugcuaugugucuuccucucugucauuccucagggcagauuuguaguuccagaaagguguacuuccacacugaugccgcccaagcgguugggaaaaucccacuugacgucaaugacaugaagauugaucucaugagcaucagcggucacaaacucuauggcccuaaagguaccaaccaguuccugccugcuuuuucccauucucagcaaaucauuuagcuggggcucaacccagucaagacugugaugguccucugagaagguuguacguucaaaguggccuggccuauggacguaucauucaacaauagccagaaacacuugccucuuuguagauccaagcagcugcuguacauagcuggcauucuuucuugaucucuucaccauguccuuaaaagggacauagguauagauuuggcugagggaacuggauuccauuaauucggguuuuagguuuuacuagacaaacaacguaaguacuaacaaagaacaaaacagauuuuacuaacuaggcugcuauuucuaugugccucuccaucuggcugccaagggcacucccaggcuaugauuaagucuugugagcucuuccugaagaucucagcucagacucuacagugugacuucauuaugagcucuucuuucccucuccaccccucccgaggguugugagacauagucccaccugccuuugaguucggauuccuccuuccucagucacggguaauggggcuguagacaugucugcugugccaugccuggguagcuuuuuacaguugccuauaaggacagccauacuugcccuccacucauuuuuacccaaacuauauauguucugaucuugcuuuuucauuuaucacuacaucuuuuuuuuuuuaaagauuuuauuuauuuauuauauguaauaaguacaugauggggaucuucagacaccaggagagggcgucagaucucauuauggaugguugugagccaccaugugguugcugggauuugaacucaggaccucuagaagagcagucagugcucuuaaacaaaugucagccauuuuaccauauucuuuaauuccaauacccuacagacaagcagaucucugugaguuuaaggccuaucuggucuccauagugaguuccaucucuacacagucagacccuaucuuuaaaagaaaaaggaaggagggaaagagggaaggagggaaggaaggaaggaaggaaggaaggaaggaaggaaggaaggaaggaaggaaggaaggaaggaaggaaguggaaggggaagggaaggaaaaggaaaaggaaaaaggaaaaggaaaaaggaaaggaaaggaaaaagagggggcuggcgagauggcucagugguuaagagcacugacuggggcuggugagauggcucaguggguaagagcacccgacugcucuuccaaaggucuggaguucaaaucccagcaaccacaugguggcucacaaccaucuguaacgagaucugacgcccucuucuggugugucugaagacagcuacagaguacuuacauauaauaaauaaauaaauaaaucuuaaaaaaaaaaaaaaaagagcacugacugcucuuccgaagguccugaguucaaaucccagcaaccacaugguggcucacaaccauccauaacgaaaucugaaaucugaugcccucuucuggagugucuggggacagcuacaguguacuuacauauaauaaauaaauaaaucuuaaaaaaaagaaaagaaaagaaagaaacaaacaaacaaacuuccucuugguuacaaacugaguucuaggucucucuagaauauggaagacucuaaaaagaaagcugaaacaaaguaaaaaguacagcccagcgcuggggaagcccuccuuccuucccuuucucuuuaggcuuuguacuuuacccaaagcuggcugugggccugggccaccaagccugagcucaccguuucccagcaguguauuuuagaguuuuacaaugauagcacaaaagagcaucagugucuucugcaguugcuugguguuucauuguggggacguuccauaauguauuugacauucucccaacgguugccaccuacguuuuuucacgcuuucuuaagauuuauuuauuuuagccuggcagugguggcgcaugccuuuaaucccagcacuugggaggcagaggcaggcagauuucugaguucgaggccagccuggucuacagagugaguuccaggacaggcaggguuacauagagaaacccugucucaaaaaaccaaaaaaaaaaaaaaaguuuauuuauuuuagguguaugaguguuuugccuguguguaccugaguauaccauuugagugcaauguucgugaagaccagaagaugacacagacuccccuggccuggaguuugagcugugugagcugugucuggguuucugggaacugaaccuggguccucugcaagggcagcaaaccauugauccaucuccacauccccuagugggcuuuugcccucuuccuccuguccuccuccccuuccucuucuuccuccuucuucuuuuugagccuuuuuguuguuauuguuguuuuucgagacaggguuucucguguagcccuggcuguccuggaacucacuuuguagaccaggcuggccucgaacucagaaauccgccugccucugccucccaagugcugggauuaaaggugugaaccaccacugcccggcaagccuuuuuuuuuuuuuuuuuuuuuuauucuuaggaaguuuuaugauuauuuuuauuguguggaguuuuaugaaaguaugugcaggugccugcaaagacuccgagagcgagcaaagggcacugcaucuccugaguucugugacgugggugccaggaaccacacacagguccucuuuaagagcaguguguacucgguaccaguggccaucucuaacugguuucugauccuuuugcucuuaggaauaguccucauuguaugcugucauuucuucgugcauaguggccggcuuggaaucauuuuggucauugauauaggguauaccugcuguaacauaguuaugcuggggacauuugcuacaaacuaugcuuuuuucauuucucuuuuucuuuccucuuuuuuuuuuuuuaauuuagaaaaaauuaacuauaaaacuugaaauauuuuaaucuuauuuuuuuaaaguaauauuuuguuccauuguguuucuuuuuuuuuuuuuuucuaacaccuuuuuuuucccaagggguuggugcuaucuauauccgccguaggccccggguacguguggaggcccuacagaguggaggcgggcaggagcgggguaugcggucugggacagugcccacacccuugguggugggccugggagcugcaugugaguuggcacaacaagagauggaaguaaguauuggggagagcaguccccucuccaaguucuccccucaagcagguucccuguuuagugacacauuagcauaaaugagucugaucucuggaacagcagggcuaaggcuguccugccuuugagcagcugacauccuuugcuuguaauccuagcugcucggaggcugaggcaggagaauaauuuucaguuuaaggccauccugggcuacauagcaagacucaggaucaaaauuaaaaguaaagggcuggaucaguaggaguguucuugccuaggguggguaagaccuuggguucagucccuuguagauaaacguaaaauguacauguguacauacaaaauuaauuaaaaccuacuuugucaaggaaccacagccccuuguucugaaagagaugguuuaaaacccauacaugccuugcuuguaauuaacaguccauuuuucaguauguugcuggcacccuguguucggcucauaagcaccuuuuauacaccagacacuucgcccagugcuggagauaguguggucuccacaccuaacaggucaucagauggggcuguucgauagauacagcgugacuccugaguagggagaagggcuucaggaguucguucuucugagcugauugcuggucacuguacuuccuucuccccugccugcuccuuaguacgaccauaagcggaucucaaaguuagcagagcgacugguacagaacauaaugaagaaucuuccagaugugguaaugaacggggacccgaagcagcacuacccugguaugggcucacccuuucagucuucuucugcuuugcuuuuugcuuuauuuuauuuuauuuuauuucauuuuuuuugagacaggguuucucuguuuagucaugacuguccuagaacucacccuguagaccggacuguccuugaacgcguagagaucugccugccucugccucccuugugcugggguuaaaggcguguaccacagacacccagcuauuaugugaggcuggaggaugcccuccacuguacacauggagagucauuucucuugucccacucuccuauagguuucagagauagaauucagcucaccaggcgcauguaguaagggcuuuaccugcagaaucauccuggugccccuacuuacccuaccauucugguuuuguuucugaaauauauuuuguaccuaaaaaagguuuuuuguuuguuuguuuguuuuguuuuguuuuauuuuugacuguccuugucuccuuuaugguaggcacucuguaccccuccacugucuccagcucucagucuccauucagacagaugcuggggcccagagucccaucacuguguguucuuuucuucaggcuguaucaaccucuccuucgcguauguggaaggagagagccugcugauggcccucaaggauguggccuuguccucagggaggugaguuggacggugucgacagagaccuugccugucagguacccugugugucagugagcuucccaguguggauaggacaggagcacuugaucacgauaaagcucaggccucaggugauggccguggcugaggugaccguuccagcggcucuccuuggaaacuggggucuugucgguccuagaagaugugucuuuuuuguuuccuuuugagacaagaucucucucuguagcccuggcaguccugaaaugcuccauauagaccaagauccucuggccucugccuccugagugcugggauuaacugugcuuaacugaagaugccuuuugcagggaugagcuaacaguuuggguguaagccacaaggguuuguuuacccuccaggcuuacauacuguauuuucugcccuggcuguuuugucagguccagugugugggcucuuaugcucuuucagucauugguguccucaguccaggaaguugucuauagggaccacagaagcuggguuuacaucccaggcuguacagggcaucaccaggcuguuucuucuguccccaugguaugauuucaggguguguccuauggacuaaaaggaucugucuccauccuuagugccugcacuucugcaucauuggagcccucuuauguccucagagcaauugguaccgaugaggauuuagcacacuccucuaucaggucagugaggucagcugcagagagagagagagagagagagagagagagagagagagaaggggggaggggaggggggaggggaggggaggggaggggaggggaggggaggggagagagacagggugugagaaugugugugaguauguguguauggggaauguuucuguguauguguguguguauauauguguaugaguguggggguauuuuuguguguguguuuguguaugagaguaggugugauuaugugggugacuaugugugggggcgaguguauguaggggugugaguggguguggguguguuccugguuuguuaaggucuugucagaaauucaggcuggucuugaacucuguccugucuuugcuccaaagugcugagauuacaggagugugcucacuaugccuaguuuaugcaguuugggguaauuguacaugauaggcaagcacucuuccugcugagcuaugucccugaugagggugucugaguccuguauucagcuccucugcccacgaggucuaggguagauggaggaagcuugguggagucugccccucaagcuguguucucagaacccuuucccuagagaggcauggcgggucucccaccuccuguuuaccuagagaggcacugugggucucccagcuccaguuuaccuccuuugcuccaacaguuuucaugcagcccaguuggcuuccaauugacuguagccagagaaugccccugcuugcucugugucuaccucucgagggcuggagaugugccaccaacccagucagggguugaacccaggacuucaugcaugcuaagcaagaacucuaucuacugaacuccauccccagcccuuucguuaucuuuuauuuaguauguccucagagaguauuggucaaaacaaaaaacaaaaagcaaaccuguugccagguguagcgaucuucuguguucucucagguuuggcaucggccgcuucacuacagaagaggagguggacuacacggcggagaagugcauccaccacgugaagcgccuucgagaaaugaggugugugcgccugcguguggacucuauggaagacaccguaccgcugacaccuuucuuguccuuagacucuguucauacagccggaaacccgaguguaaagggauuguaggcuguaaagaguccacaaagcagggaaguugaccuccugucuucuuguucuucagaauauguuuuaaaacuaggcuuuuguauauagcauagagguugcuuauguaucaucucuaaacagccuggguuugauccccaguccccaaaaaccaauggaaggucagugguagaguaccugccaggaagacaaaacucaaaccagggaucuugugcaugccugauguugugagccggagacugcaguaggaagauugugcauaaguccuuuucugagaaacaaaaacaaagggugggacucagugacacugagcaaaacuaacuggggacacggaagcaccaagcucaguacuggugucaggcuuggcucugcagaagaugcugccucguguguguguguguguguguguguguguguguguguguguguguguguguguguguguguguguguguguguuuguguuugugcacaugcgcgacucugcgucucagcgucagugguaaaaacaaacaaagaaauguucacagucaucacucccaccaugcacaaaguaggucauuacccacaaucuuccugggugcucaggccugagaucuaaggcauccuuucaggcuaaagcaauaaauagucuuccugaugcuagaaauuaggaaaggccugggacugagcaggacuuacagaagcuagaagaggcuuguuugucucuuguauugggguucaccagggcaaaaggcagagaagcaucaaggacagaagggaaaugauugaucagggccugagaggcaguguuaccugcugcuuccugucuaacccucacucacucagugccucuucucuuuggcaguccucucugggagaugguccaggauggcauugaccucaagagcaucaaguggacccagcauuagaggagugggcugugacuuugugcuggccuggcuguucuggccucacugaucugugcacagccaggaaccucacugccugacgugguccaugcucaaagcagaugggaagcucugcagugacuucaccacagaauguucucuagugaaagcugaggcuagcuuucuuagccucggcuccuguguaggcauguauuccguaaucuuccucaggaguucuucucuugccuggcguggccauucuuaucugagggccuggaggcacugccuuguuacugccacagggaggaccuaccugugcagagauggaagaacuggaagaaggcucuagguucaaagacugcuucucugugaaucauuacucuagcugcucagcugaacuggcgccauuagggacuggcauaaacaaacuuuauuuuaaccuuuuuuguggcuuugaaagacaucucuuuguaucgacuucagcugaagaacaccaaguuguauuaaagucuuguuuccuuuggggucucaucuucuuuccucucuuuugacuuaauguaaguagaaauauccaugaccccaaucauuauucuaauaauuuacuuaauucauuaaacuuaauucaauaaauucccauuuccuguccuga

SEQ ID NO: 1210 - RNA, 1755 nt, Mus musculus
ugggcaccgaggaccuucccagggccaaggagguagccgccaacgacgcccgccuccaagcggcucgcagcagcauguucccagccacagagcccaccauccgcggcgcuugcaaguccucagcccaugcucccggaaguaacugcgcugugcuccggaagcgaucccacggaccgcgagcgcccuccgccuagcauucggagugagacgucgagcugagcgaucgcagcggagaacgaggugagguggggcccgacaguggccugcgucgcgcgugcgggguccuccaucgcgagggugguggaggcgugccgcgggcuggcuucugacccgggugcuaugugacccugcugugcguccccuggccgacgccacggcuggugaccaggcccucacuguccuagcacucucgccgcagaugccgguggccgugggucccuacgggcagucccagcccagcugcuucgaccgcgugaagaugggcuucgucauggguugcgcaguggguauggcggccggggcgcuguucggcaccuucuccugucucaggugagccucgcggacagaacuuccugccuuccgagggcuccagagcccacucagacgagguugaaagcacaggauuuacggaucugaguucuaaagucaaaauggcuuucugacuccuuuguuaguucaguguuauugaguuuaguggaguacuggacacuuaccuccacuuuuguaagagccaaucauauuaguaugauuuacauuaucuggcacgucguaauuacuuagcgaaggguuauuauuguugcauggcguuuuaacucccaacugcauguaaugaagcaagccugaugagaauuagguguagugaaauauucuaccucugagauaaacugcuaucacauuuggauacugugcuuauaaauuacuauuuacccagcacuaguuuaauuguagugcuaaguacuguaguuaaccaccgagcauuagcugugagcaccuuaaauccaccagcacucuggacggaguggcagauuccugaguucgauacuagccugguauauaaaugugaguuccagacagccagggcuguuacacagagaaaccgucucaaaauaaauaauaauaauaauaaauaauaaauuaaaaaguguaguuaccgagucuguaauguccauuuuacacuuuaugcaguuuauaaauugcagcgcuugacucaaucuagguuaaacaaaacaaaacacuaaggaauuaucuagaagaaaacuggcuacucaaugauaaaauaccauagaggcacaaacacgacugcuuucuugcccauguacuucauuaucucugcaucuacaaacuaaugcagcauucagcacagguccuagagacccuagauagauauuuuccuugucauugcuaauccuauguggggaagaguagcauuuuaagaaugacaaaugagauugucaagcuguuagugcuuaauauauucaacagauuuuaaagggggguacuuaguucaaaucucuauuccuguaauuguauucccaaauugcuuucuugguuuccuccucaggaucggaaugcggggucgggagcuaaugggcggcauugggaaaaccaugaugcagaguggcggcacguuuggcacuuucauggccauuggaaugggcauacgaugcuaauuagggcuaggaugcccugcaauaccuaaacuuccccauccauuucgacccuuguacaauaauaaaguuguuuucuucucguuau

SEQ ID NO: 1211 - RNA, 1302 nt, Mus musculus
cgaaaggcuucucggacucccccgccagagcugcacccaagucucgcgagggugcguccucuaucgggcaaagacaguuggugcccugacugucaaucuuugggaggauuccuugcugaguggugcaucguugcugucauccuggcuggugucaucuccucgcugggugugaagguuuccccucucagagccgacccccaccccggacacccgcccucccacacagauggcugucaaggucgccauaaggcaaccuauuauaauacauauggcugugggcuaagacagucguguccagacccaccaguggugaaaacgcaugcagacaagaacgagcuguacacaggggaaugggaauaaaaaguacgauuuucuugucguuuggugucaccaguuagaugugggcucgauagugaagcuucgcaacacccuuggaaaccggaggcgguggccgggcugggaagaaaccgcaguguguagcuuucuaaccccugaauuuagucgggcucugaaucggggugguuugugacuuuaaaagguccccucacuuuucccuaggauuuugacugugugaauuuaccgcuuuuguuuaauuuuuguuggauuuuauuugguuugcuuuuuguguauuugggagugguuaauucugugguagagaagcugagugaucauuggaagguuuuuuuuuucucccacuuuuacauaauagaaaacguuuugaaauaaaauaucaaaccagucuggaaaccuaucagcagcuuaauaauugaggguauaaaagguccaaaaugucacaccuugcuugguguagccacuccaacaaugugaccuugagcaaguaaauuaagcucuccauauauuccgauuccuccucaaggggggaauauuauaauuaguagcaaggauaagcuugacacuagccaagacugcaaauauucacuaauucccaaguuuagcaggggauguauguccagguggacucucccugaaagcucgugaggaguaggaagagcauguggaaugaugacaggaaacuucuuggggcuggcaauguaauacaguuggcaggugacuuuucuagcaugccugguagagcuugucuauaguuaugcacucagaaaacagaagcagggggauuucugugaauuugaggucagccuuaugaguuccaaaaaauuuagcugaucuggcuuucucucucagauguggcacacugcaugaaaucacugauaguuuccugcugaaagauuaggcuuuccaacuucccuuguggacuacugaaacuucucugcuccuauaagg

SEQ ID NO: 1212 - RNA, 1518 nt, Mus musculus
uagauuuauuuauuuauuauaugaguacacugaagcugucuuuagacacacacuagaagagggcaucagauuacguuacggauugugagcuaccaugugguugcugggaauugaacucagaaccucuggcagagcagucagugcucuuaaucauugagccaucucuccagccugcaacugugugcauuuuuaaguaagucuuauuugaaauuaucucaggucuaugaaaauguuguaaauauagaagaaagaagaguaacaugguggcuuacacacucauaaugccagcacuuugggaggcuaaggcuggaggguaacagugaguuugaggcuauccugggcuacccagugaguuuaacaucaacagcaguuaguagguaggauuucuguuacuuccuucugugaggacagaaugugguggagugacagcugacaggacagaaguggugcagacaccgauaaagccaccuaggacuccucaaguggguccuucuccucuggcugcuccugugcuuucguaguuggggggggggggagacagagagauacugcgagacugccucccuuuauagcccccaaccagcuacaaaaccaaacccaccauugcccugcaucucucccagguccugggauuacaagcaggugcggccucacuguuguaucuguuuucuuaguauacauuguucuaacguugacaggaaaaagcacaaugccccuuuauaauuuuuaauuaauucugagacagggucucuuguauccuacauuguccuggaacuuguauagaugaaaauaucuucaacuccugauccuccugucuccuuccauugugcugugacuguuggccaccagagcuuaguguauucaguguugggagcuggaugaaggcuuugcagagcagccaggcagcugucaacugaucuggacccccugaaauccuuaacgguugguuuauguuagacagggucuuaaucugcauuccagguuucauuuaaauucauggcaaaccuccugucucagucucuuaagugcuggguuauagacuugagucauuauaccuggcucuuccauuguagucucuucugagauuggaacagcagccucacaugugcucuaucuagccucuauucucuuucaugguuguuuaaaauuacaugauacaguagguagagugugugcuuagcuuggaggaauacuguuuaaaccucagcaccacauaaaccagaaaagguagcacacaccuggcauccugcucucaggagggucacaagcucauggccagacuguaucucauaaagaaaaaguuacagccaucucucaugguggugucacuccuuuaaucccagcacucaggaggcagaggcaggcggauuuuuuaguucgaggccagccuggucuacagagugaguuccaagacagccagggcuacacagagaaacccugucucgaaaaaacaaaaaaaaaaaagaaaaaagaaaaaauuacagccaucucuuaugggugguugugacuccuuuaguc

SEQ ID NO: 1213 - RNA, 1518 nt, Mus musculus
gacuaaaggagucacaaccacccauaagagauggcuguaauuuuuucuuuuuucuuuuuuuuuuuuguuuuuucgagacaggguuucucuguguagcccuggcugucuuggaacucacucuguagaccaggcuggccucgaacuaaaaaauccgccugccucugccuccugagugcugggauuaaaggagugacaccaccaugagagauggcuguaacuuuuucuuuaugagauacagucuggccaugagcuugugacccuccugagagcaggaugccaggugugugcuaccuuuucugguuuauguggugcugagguuuaaacaguauuccuccaagcuaagcacacacucuaccuacuguaucauguaauuuuaaacaaccaugaaagagaauagaggcuagauagagcacaugugaggcugcuguuccaaucucagaagagacuacaauggaagagccagguauaaugacucaagucuauaacccagcacuuaagagacugagacaggagguuugccaugaauuuaaaugaaaccuggaaugcagauuaagacccugucuaacauaaaccaaccguuaaggauuucaggggguccagaucaguugacagcugccuggcugcucugcaaagccuucauccagcucccaacacugaauacacuaagcucugguggccaacagucacagcacaauggaaggagacaggaggaucaggaguugaagauauuuucaucuauacaaguuccaggacaauguaggauacaagagacccugucucagaauuaauuaaaaauuauaaaggggcauugugcuuuuuccugucaacguuagaacaauguauacuaagaaaacagauacaacagugaggccgcaccugcuuguaaucccaggaccugggagagaugcagggcaaugguggguuugguuuuguagcugguugggggcuauaaagggaggcagucucgcaguaucucucugucuccccccccccccaacuacgaaagcacaggagcagccagaggagaaggacccacuugaggaguccuagguggcuuuaucggugucugcaccacuucuguccugucagcugucacuccaccacauucuguccucacagaaggaaguaacagaaauccuaccuacuaacugcuguugauguuaaacucacuggguagcccaggauagccucaaacucacuguuacccuccagccuuagccucccaaagugcuggcauuaugaguguguaagccaccauguuacucuucuuucuucuauauuuacaacauuuucauagaccugagauaauuucaaauaagacuuacuuaaaaaugcacacaguugcaggcuggagagauggcucaaugauuaagagcacugacugcucugccagagguucugaguucaauucccagcaaccacaugguagcucacaauccguaacguaaucugaugcccucuucuagugugugucuaaagacagcuucaguguacucauauaauaaauaaauaaaucua

SEQ ID NO: 1214 - RNA, 1046 nt, Mus musculus
gaaaagcuuccagaauguucuuccacacauucucugcggcaacaaucugaugagaaaugguagcacacagcuaaucaccaaacuuaggaggccucacuggacaauauagagacccuggcucaaaaaucaaaaugaggaaaggauagccagggauaagggcaggagagaagagguuaaagagaggagagagacaugcagggcaugggguggggugggguggggguggggagaagcuagacaaggaaggggguaagcuagacaaggaagggcauccugggguaagguuaaggcccugagugaggagaagccauaggugggcuucagaaacucacagaguggaauacaguucuccgaguccccagagcagucacagggauuuagagagaagaaaucugcagagguaggcguccucuccacagccagcagggagcucccguguggcuacuccuaugaacucagugaccaagcaugcauggcugggucagugugagccuucugcucucccgcaccauccuaagaucaaacacaacggaagugcuugcugcacugcagaggugguuaguaccauuuaacaaggagcccuaucaaccagggacggcuucccucgauaacgggaccagaccucagagcugagccugacaagcaucugcaauaagagccaucagcaaaugauuugcggggcagggggccaagcugguaucucagcacauccuacagucuucucuaaugaccuggcugaugucaacauuaaggagcagccuggcagguggaggucagagggucacucacccguuggcagacaaggggagaggguacugccuaaaacauugguggggaagggggugggccagucaggguaggacaacuucugagcuucugagcugagggauacagaaaggaucaguucccaagccucugccucccuacccccagcccuuaccugaagcaaugccgauccggggucagcaucacucaggagaguucguucagaagguagauaugauuccccauggcacaaguguuagcaaaagaggauggcuucacau

SEQ ID NO: 1215 - RNA, 1489 nt, Mus musculus
ugggaaggcacugccuucaggccugacaagaccaggcuccgcccuaauccagccaaggcuccgcccagaagccaagagaccugaaaccuauagggcacuugacugggugcgaccugacugacugccuacagcugaauggccacagaugccaucauugccugauaacccaagugugucuggcuguccgacugaacacugaguucacaggugccugacagaccaagacaguuggcucuguacaucccuaccacagcugacugacuucccuuacuuggcucauggugucucuccugcaggaggcuuuugucugaggugaucuaacugcagcugaccaaccagacccuacccacucgugacaagccgcaucugauugguguuagccaccugugccuggaugguggcaguuuaccgauugaguucaucuaugccaacugccugacccccuccacuucaccccagcuuuacgagaucagaugagcugaccacaguuggaucugagugccccaaugggcuuuggaacuacgaccaggcuaccccuaugggucucuccacaacacugagaugggucaguugaccaaacccucagcccaguuggcauggcugcugagucugccucugagugaauauguaugucauggacaggacauucugugugacugggccugcccgauauccuuccauagcuaccuaugucuggcccaacuagauucacaacaucagcaacaccugcauaagggccaugaugucuaaccacucuagcugugucugucucuuauacaguagccauucaguaagcaauccaguccaguccgauugccuggcuggucagcugccucagguugagugggcccaugacauuccucuccaugacucaugacagaucccuuucgacacagauguccaugaggacuucugcauguuuuuugugcagggucugggaccugaacauuuuuaauuauaagacucaaccuugaggaccaaagcuaguguaccaacagggaagggggcuuaggaaaagccagugauggagcaggcagcaggaguaggaguccaggcccagugguggacagcugcaagaaacagcagggcuggggaagagacuauaagguguccagaccuccuaccucaggaaucuaauucuauaccaaagucaaaaucuggaggagcuggcuuggugugugagugccuccaguaaacaucugaccgucugucuuuuguuccuucggauaugggaaaucucugugcccugcuuugcagaaggggcauccuguaguccucccaaauuuagaucuucccugucaugucuaugugaggcugccaggcugaucuccaggcuucaucuccaggaagacgcucuuugcuguaagaggggaggaaguacuggcuagagaguuuuuuuuuuuuaaguaaguguaucgauugcauggguaugcuaugaauuauaucuauugcuauuaaugcuaauaaaaugagagcauuggacaaccua

SEQ ID NO: 1216 - RNA, 391 nt, Mus musculus
caugugcuuucuuucuuucuuuuuuuuuuuuuuuuuuuuuuuuuuuuacauaaauagcccauuuauugcaggcuaggcaagucucagacagcagggcuucuacuggucuuucaguuccuucagucuucugauggcagacuucacugugacugcagaggugguguuguagguccaggccccgccagccacuguuuucaugcaggaaccacagugccagaugccaacggcucgucucuucaucuuggucuugccacagaaggagcaaguguacuuggcgugcuggcugauuucaauuuucuucaccauuuuccggagggaugcaccauagcggguuccguacuugccgacgaugccgaccuucuuggugcguuuagccaugucgccagacuuu

SEQ ID NO: 1217 - RNA, 2954 nt, Mus musculus
auaagcauaagucuuuuuuaaaaaagaggauagucuggauuagggcauagcccacauguuagggcucagcacguuuguugaaugaaugcauuaaugagugucacaucuuuucaagcaugucuguuuguuccucacaacagccuugagagaagguagggcaagcagaauaguccccauuuaacagguaaagaaacggaggccagggaagauggaauggcucaucuggagcaacggaaguugaguuuuauagaauuggcauagauuccccccccccccccacacacacuccguuuaaccuuugcuuccggaaggcuugacugaauaccuuuccuaccauuugcacagccacuggggaugugccauuuaacacgaacaaccgucucuuucuuccaguaguccagagacucugacagacaacugagauaaugugcuuggugcugggaggugcacccgagagcugugggugcccgugugggagcccagaccuggggaaagcaaggcagcuacuucccaggaggaagacagcuaacugggccuggcggacagaaagcacagccccguggccggccugguggacaguggacuggccccauccacccaguugcguccucuucagcguucacuauugcaagagucagugaggugaccucauuaaugagggaguuacuuuaaugcaauggugggcgucuucccgagcaguggaguauggagccugugccccguccagacucaggccugcguggagaccucauucugcuacugcgaguuucugucuggugcuucuucccucaaggccuugauugguccaucugugaaguggaaucagggaugguccuuacuugagugagagcaaaggcaacuguaaaagugacuucuauuugucugauguaacugucgucucugaggcuuuuggccucagucugucagccuaggccuaguccuggaagcuuccagccucuuaaacacucuuaccuaggccuaguaagccucugagacugacugcugaguaagcucgcccuuucuagcucuuucuggacucuggcuggcugguucaacucaacuguucuggcucaaacccuucuccaagcugacugauucaacccagcuucucuuggcuugugacugaauugcucugcuuggccucaugcuaacucuagcaaucuguucuaaucuucuggcuccuucucauuuucuggcuuguccugucuucaucugugucuagcuuguucucucucuguaaccugucucuguacaacugucccaguaaagcugcucucucucugucucucugucucucaaccgcuccuucuuauguuggcucucuuugcucaauacuaugccuggcacauaguaggugauuuauacuacugaguaguuagaaccaugauggugauugauauuuagauauugagaucugguggggccaucgaggccagugauggucguguuaguguugguaguuucauauguguuuggcacuuggcaguucacagaucaugugucucuccaucacaguacaugcgcuucugaagagucguuaagggaaacaggaggcggcagcagcucccuugugcagaggguuaggccaauagcuccucaugcuuucagcucgggucucccugccuugaaagcuugauacucacauaccagaagugcacacuggccugaaguccguguguucagagugguugcagcaaccagcucuccugcaucuugagagcgcugagcccacagugucucuguuuguuccauagccagguagcuuucaacaccuagauucccauuuucuuuuucuuaucuauuuccugcuuucccacuccgaacuccaugguugugccucagaaaggacccuguccccggcugcuucuuggcugagcuuuaagccacuugcccguuccuugggcuuucaccacacacgaggaguguccuguaugcuggagugcaggaagcgagcgaaugaguaaacacaugcuguguuuauguccccaggagucaaguacuggccugguagcucugggugcugguuuuaaggugaggcucuugggggugaagucuccuccccugugaauggcgcaugccuaccugugccuaggaaagaucccggagagccugcuuguucuucugucauguggggacaugcuggaaggugccagaaaguagaguccuuagcagacacuacaucugcugccaccuugaucucagacauccuagccuuuggaagcgugaggcacaaagccagcuguugaugguauuuuuguacagcaguaacccucagggacuggcagggccuggguagugacaugaauagagcuuucuuccagucucuggaauuuccggggauagugaggaaggggucucuugguuccuuggugugaagagugauuuuugaauuuguaaaaauaccucuccuguaaaaguugggguguucugggaagucagucuuaugugggguccuaucucugccauggucuugcugugugaccuuagacuaguccaugcuugucucuggucuucucuucauuugccaugugaggauuuggguugagagaggagacagucccuucacaucugugagacacacaggcucacaggagcccagccuuuuaaugaagccuuucuugccuaccaggaguuucuuggucccacggggucuaagggugguuccugucauuuugccaccuucccugccuucugucuuauuucucagaccuaccucugguuucuugcauagugacacagcuagacagaaggccgucuguccccaccaggaggggagggacguggagaguggcccugguuaauccugauucacugcauuccagggauagaaagcugagagaaccaaccugaccccaggcggugaagagaccucugggcugggcuggcagguugggaggagccucucuguccucucuuuccggucccagauucuugcugucugcugccuugccugc

SEQ ID NO: 1218 - RNA, 3562 nt, Mus musculus
ugagaaaacagacucaaggcagugaggcaaggggaccugguuugaaccucggcagcggcggcagcggcagcagcgguaggguaacaccauauccucaugcccagucagcccuggguugugguggggggcuaggagggguaugguagggggauccucaucccaggaaauagguucuacaggcugagggaaguccaaggcagguucuguuuaucccccugacccuaggaacagagaacugaaugcugcacaggauggcaagucacuauguauggcgacuucagccucugccuccuagaggccuaccccaagagaccucccauggauacagaaagagagaugucugcagcauauuccgggugggucucuuuuauccacacaacuacagacaaccugcaaggccgucaacaggaaagggauauguccacugugugccaauggcacacucaguaaugacacagacuaucucagaguccuggagugccaaccaugggauggcacaggugggauuacagcuccguaaggaaccagaaaagaaagaguugggaggaaauacaccaagcucccuaugacccccaggcaugacuccccccucccccuggucucagaacucugaauauuguguuacuuucauuagguauuagagaaacaucaauaacuguagcagggcgccaaggagccccaacacuggaaagaggaggaguggaaaggaaagagaaggccagagggguucaggaagagccagagggggccagaaagaugggugcaguguucuggagaccaagcagggagugcugcagaaggcgugugaaugggucggugugacuugggacaccugccucugcucccaccuauacucaugagcaaaccugacagcaaggagucucuaagguccccauuccagucuucacucaggagucugagaaaauggcccccaccaugacccguguggagccaggaguggcaucuacaacacaaaccaagcacaccuuuaauccccacacucacacucgggaggcagaggcgagcagaacucugugaguuugaguacagccuggucuacagugugacuuccaagacagccagggcuguacggagaaacccccgacuacaaacaaacaacaccuggaugaauggccacacccugcugcccaugcccacccaaggcaaacagaccuggccucccagaaaagcgccuaggaugauguaggcccuacauggaacuugcuaaugucucuaggauggucacgccauuuguguuucccuagggagccgcuaacacuacacuuagacacacacacuccuuggcccaucccuuggugccacugagaccucugcccuugguguaagcuacauaccaugcccggagggaccuguccacugcauagacucaagcauccacccacccacaucagucuccugucuuccucugaggguucucuuccucccuccucccaguuccuuacccacacccucccucugggagcauccacgggagcaagguccuccagcacauccugccugauuccagugucucauuacugcuucccacuacaugggagauggacggcggccaacacgcagcugcugcaggcccagagguagugggaggcugggcuucagaguccaugcucugaaggccaauggccucuguagccaccuuugacccucaaucggaugagucaagaaaaaacagggcugagucacucccagaugugaccccauuaagcccauuugaaggcaacugaugcggcauacugaauaccacacagccggggagugagucuugcaaggccaggacaaggucaaugccaacaaggcuacccauuugccaucaggaagugcuuugcuccucucucucugugccgcugaggaauccuuaagugagaucugaagugugauucaaacaucagcuccaacucaggccuccccacaccagacaccaucaccacgagacaaugcucuccucuuccugcuccuuggcuucuaggaaugagcagcaucccagccuagccguggggcaccacagguccuguggaagacugcucccccauugcugccuucuccuccccuggccuuugccgggcgggagacacuggagacaggcauuuggagcugccaucuugucagcccagaugacagcccugacaggugccauuauuacuccuguguuaccaguguggaaacugcagccacgcuauccucccaagaucaccuaggcagugaaagacugggauccuaggacagcugaggcccuccugcuccaacaaguucugcucugcaugcugcccagccagcccauggagaacguggggugucugucaggcaccuaaauaauccuuagcuuauuaaccuaagccugggucuagcuggagggaaugaggucaagaacagcugugggacuucgggggcauccaggggagacuucggagaccacagcuucccuagaaggggaaggcaagauaaugaaugucucauucacucauucauucauucauuuggcagggcucgaucucuaucuccgaguuacaaccccaugcccuagaguuuugagacaaggucucgcuuugaagcccagguuaggccuuaaugucauccucuugacucugccuucccagugcugggaugacaggcacagaucacauuacccucugaccugcaucucucaggagaaacaaugaaacagagagccuugaaagagaccagacgagggccacggaaagucggagaagagaggacuugagcuaccuggauagggaagagggagcuggaaggaucgaggcuuuuuauuccagucauuuugguuugguuugguuugguuugguuugguuugguuugguuugguuugguuugguuugguuugguuugguuugguuugguuugguuugguuuuucgagacaggauuucucuguguaacccuggcuguccuggaacucaaaaagucauuuuguuuuuauaggaagggacacugagaccagaggguggggacaugaggccucucaagaugaagaguaaauguauggaaacaucaggauucgaaggcaacccaucgaucgacuucuggguuagguuuccuggaaccagauaacagagucuuccugggaaaggcgaaugagugcaggggcaaggagagugcauacacccacacagugcccccggggaccccagccucacuaugaccucugcucugugcaaggugugggaaggaggaaggcccuuccauucaccaauguucaagcuccacgagcagccaaucggggcucugaaggaggaagaaacuuugguuccccuggcaacacauacaaaagccucucuccucagcagcaagcagcuggaagagggauguggacuggauuccacccaaccagaucucagaagcaggagccuggaugagcgcuuuucauucuaacuccugaacucugguucauccagguccauccccaggagcgggggaccaacgggccaaagacgcucccaacaguggugacuccucuuccaucuuucagaauccacugacaacuaaguuguugcuuagggugggccuggggcuggggcuauccuucc

SEQ ID NO: 1219 - RNA, 6294 nt, Mus musculus
uguaaggccgggcggccugcggacccuccagccccggcuccgcccccagagcuccgagcaucgagcaucggucggagcugcugccagccaacucucgaagcaccgcaacagcgccgaggacuuuucuucucugcagcaggugggagcccacucagcacccgggcagcuacaguagguggucaggcugaaccucacccggccuucugagggcuguggcaugcuuaguggugugggcuggggcuacugccuugcuuggguccuaaaggggacccuggccugggacugagcaacuggugguucugcgccccggaaaacuggucuuugggcaaggaaacaaggauccagaguguccuuuugcuaaagagccuaacacaccaagccuggaaacuccaggcuaccugccuguagagaugccagugaggggguugagggcaucccugacccaagaaacuguguguggcagaggaaauugagcccuacggaagcacagcgcucacacccaguuuugcaaacccuaccccaggagggaugguaaccaccucaugccuuccuuaucuccagugcugugugcacuagagaacggugggaugagggggucuuggcuucuucacaacccuccagccgcccugguugcuugaugagccgguuggaaagcaggguaucuggcacagccagcuauggagacuaguaaugaggagggagggauggucuagccaugaccgcgccaaguuccagcugucugauccuuggugucuaggaccccagagaggggagcauauggcuucagaguuaaggacacagcuuauuccuaauuuaagucacucaaccaagucuagaaagugccuggcccuucaagagccaaaccugccacccacuggccccagccuagcgugguguccuggcucccaacccucucacagguauucacuucccuuugugugugugugugugggggggaugccucucagggauguagagagggcagggauacacuaggggagccuagcugggccugcccuagaggucugcagacaggaugggcuaagaaagcugauggccaaaccgggcagugauggugcacgccuuuaaucccagcacuugggaggcagaggcagguggauuucugaguucgaggcuagccuggucuacagagugaguuccaggacaaccagggcuacacagagaaacccugacucaaaaaaccaaaacagagccggguaugguggcgcacgccuuuaaucccagcacucaggaggcagaggcagguggauuucugaguucgaggccagccuggucuacaaagugagcuccaggacagccagggcuauacagagaaacccugucucgaaaaaacaagaaaaacaaaacaaaacagacagacagacagacagacaggaaagaaagaaagaaagaaagaaagaaagaaagaaaggaaggaaggaaggaaggaaggaaggaaggaaggaaggaagaaagaaaagaaagaaagaaagaaagaaagaaagaaagaaagaaagaaagaaagaaagaaaggaaaaggaagaaagcuagcugauggccaucucagccugggccacaggagaugggggacagcuuccagggacaacauuucugcccccgguucuuaccaauucccacccagcacuacacaaaggaaccccaaagccuggugcaugcuguggggcucacuggguuuuauacagcuagagucucaagacugcagguagauguggcccugggacuugcuggagcugaccaugaccccagcccagaggguauuagaggcagggauagaggaggaaggacauaggcccugggccaaggucuacagagcacagggcagagaagaagacgugcuggggccuggacuagcugaggggaagcagacagaaguuuugagauguauuuccccacaaguuaugaugggaucagguugaauucuuucccuggccucaguuuucccaucuguacaguggagcucauaaaccuuucacugaagaauccucuacuagccugcugcugugggcugcccuaguggugaaggaugagggaguccgcaaguguuuguuaucaagauaaggguggagaacagcaccccugggacucuagagcucagccugaggacagcuacagaaggggggggcuggaaggaaguccuggaacagcuguggaaugcuagaggucaaggaggagacaaaguggaucagucaggagcugggagagcacacuggguccuuucaugccaggcuggggcaucgagguuuacucucgggauguggagagggguuuuaaggaggcgacugaaggucugaguuugaaugggaugggagagaccggccgaagccaaaacaccaggucuaaauggacuguaguuucaacuugagggagcuucgauguacaggaagugacagagggcacaggaugaaaccacaagggaccagucaggcucccugaggagagcagcuguguuccacagacugugcagaagaugggggagauagggggugcaggggcauggagugagagggguggggagggaugggggaggggugaaggggcauggagugagagggauggggagggaugggggaggggugaaggggcauggagugagagggauggggagggaugggggaggggugcagggacauagagugagagggaugggggaggggugcaggggcauagagugagagggauggggagggaugggggaggguauuaucagaguacagagcugggggguccgaccccuccuaggagagcccuaucuucccgccauugagaugggcacauugcuaugaagaaauaaaguagacaaagcacuuuaaugguuggcaccaagccaauccuauuuuacccacucaaagcaaaaugaauuguuucuaggcucagcaccacuccagggccucucuagauacuaaauuaacugauuccuguggcaggcuacucuguugccccccuucccagaggaagacagauagaugaagcacucaggaucacagcccacaggcugugcucagaaagaacuggguggcugggggcccaaaccugugggaugcccugaagagcaagcugagaccuaacuuuagaccucaggggaaggcagggaugaucccuguccaucaucaucccccgccccucccuguagggaaacccccaacacccaaaggcaagaugucgagcaagagagccaaggccaagaccaccaagaagaggccccagagggcuacguccaaugucuucgccauguuugaccagucccagauccaggaguuuaaggaggccuucaacaugauugaucagaaccgagauggcuucauugauaaggaggaccugcacgacaugcuggccucucugggugagugggacgggugcucagggagggaagugcucagcacugacagggcacuuccugugaaaugagagucuuagugcuccacggcagguuauacugcuccgggucugcccacuuaacagagaggaagacugaggcaaggagaaggaccagcucaggauuugaaccuagacagccugacuucccggggaaagucagaucugugcauuggauugugugguaaaucuuaaagaaaugugccagcauuuugaguuuguacggaugggaaaacugaggcuuagaagggaggccagagcacucacuccucuauacccccaaugacaccuccaagguuagggucuuacggaucaaguccaaguugccaauguucagacggguacucugaggccuccagagugcaccucuccccaugugccggccagagccagccacccucagcagcaguuccuggcauagccuucccugaggccagaggaucagggcgggaugacagauaagaucagucuaguacugcugccacaccauugggcuuggccaucccugucagucccuggcaucguuccaugccuacuggacugccugugaccacaggucuggugggaggccagcagcacagauuagaaaagggggugcuaucccuccagcuacuggccaggcuuucuuggggccucucucuccccagaagaaagcccagcacuccaaucuggacccucucagcaucccggaagagaaagacugugucaggggacaaagggcugguccucaugggcuaagaacuccucugggcaucuuauaaaaacaaagcaaggggucugaggcucaaaagacacacagucauaagcucccccccacccccccguuggucaggccacaccuuguauuuagacuggcugagucuaacuagguagccagaaaaacacuugccuguguaugguggguucauagaggggagguuggaggagggaacugggaggagugggggggagaggaaacuguggucaugauguacugcaugauagaagaaauagauagauaguaagauaagauaagauaagauaguaguaaucucuacagccaucacccuaauucuccaugcagcccccucuuggggguggcaggcaaagacucagaaagaacaaacaaucugcccgaggaggcacagcagcccugagcauagaugggaucugaaccuagcagacugcagcaucccagggcugugccaaugacugcagugagaccauuagaacaguggcuuacugucacgguaacuguuccucuaaaaacaugggaagcugagccacaggaccaggacuuaaauccaagccucuaugucaccaaagcucacugauguaggcacuucugaaacguuucuggaaucugguacccuaaguuagacuaccuaaguuuagcuacugaccccugcuccucccuugcugugugaccuuggauaagcugcccuaccucucugugcggcaguuccuggccugugagaaaagaauaaggcugcuguuggcacaagggagguaggggguacgccaggugacccggcacauggggcagcugaucuuacaccauaaugguggaggagccaggaacuuguggcaugcccucauaccucaaaagcaggcggggauaggagcuggaugcccagaaagcaggaaauuggcugccuggcaccugcuucccagucuacaaacgucacugggaaggagucacccaaguuggggacagcaaccgcaauguccacccaccacagggaagaaccccacagacgaguaucuggagggcaugaugaacgaggcgccagggcccaucaacuucaccauguuccucacaauguuuggggagaagcugaacggcacagaccccgaggaugugauccgcaaugccuuugccugcuuugaugaggaggccucaggucaguguacacgggagaccugggcuagguagggggaacugggcuauaaggaaaggggcugggccagacaucacuguccccaacuucccagugcccaggacacacugcuuaaaccuuccagagaucaaaccacaucuugccauuucuaccccagcuucugucacagauaauuuccccccucauagugucacagucuccacagacgcucuguaaacuucuguaaacucuucccucgggagcccugaggaucuucuagccccgcccacugugagguuuccaagggcugggagggugggugggcguggccagagccugcagucauuaacccagucgugccgugccucaggcuucauccacgaggaccaccugagggagcugcucaccaccaugggcgaccgauucacggaugaggagguggacgagauguaccgcgaggcacccauugauaagaagggcaacuucaacuacguggaguucacucgcauccucaaacacggcgccaaggacaaggacgacuaagcuguucuuagcugccccagugccuagaccccaucccagucaccuaccuccccaacacauacacucuacccuccccgugacgaauuagggucccagcucccagggccggaacugaaccguaagacccacagggugaggcaggugcucuacaaugggcccaggcacuaacuagaagggaucucugacccuacaaggagggaccacaguggggaggugagccgaggguggggccagcaagcaccaagguaaagccacugaagauagcacucagccaugcccucccauucccgggcuggccugaggaaggaagcacccguguucuggugucggacacuaauucccagcauccccacaaagguacacacccauucaccaugucccuucagaggaugacagucugcucuuaggcuuguggaguugucucagcacccccagaaugcauugagggaagggaagcugccugagggacagucucuuaauacaaggcugaacaccaucu

SEQ ID NO: 1220 - RNA, 6294 nt, Mus musculus
agaugguguucagccuuguauuaagagacugucccucaggcagcuucccuucccucaaugcauucugggggugcugagacaacuccacaagccuaagagcagacugucauccucugaagggacauggugaauggguguguaccuuuguggggaugcugggaauuaguguccgacaccagaacacgggugcuuccuuccucaggccagcccgggaaugggagggcauggcugagugcuaucuucaguggcuuuaccuuggugcuugcuggccccacccucggcucaccuccccacuguggucccuccuuguagggucagagaucccuucuaguuagugccugggcccauuguagagcaccugccucacccugugggucuuacgguucaguuccggcccugggagcugggacccuaauucgucacggggaggguagaguguauguguuggggagguaggugacugggauggggucuaggcacuggggcagcuaagaacagcuuagucguccuuguccuuggcgccguguuugaggaugcgagugaacuccacguaguugaaguugcccuucuuaucaaugggugccucgcgguacaucucguccaccuccucauccgugaaucggucgcccaugguggugagcagcucccucaggugguccucguggaugaagccugaggcacggcacgacuggguuaaugacugcaggcucuggccacgcccacccacccucccagcccuuggaaaccucacagugggcggggcuagaagauccucagggcucccgagggaagaguuuacagaaguuuacagagcgucuguggagacugugacacuaugaggggggaaauuaucugugacagaagcugggguagaaauggcaagaugugguuugaucucuggaagguuuaagcaguguguccugggcacugggaaguuggggacagugaugucuggcccagccccuuuccuuauagcccaguucccccuaccuagcccaggucucccguguacacugaccugaggccuccucaucaaagcaggcaaaggcauugcggaucacauccucggggucugugccguucagcuucuccccaaacauugugaggaacauggugaaguugaugggcccuggcgccucguucaucaugcccuccagauacucgucugugggguucuucccugugguggguggacauugcgguugcuguccccaacuugggugacuccuucccagugacguuuguagacugggaagcaggugccaggcagccaauuuccugcuuucugggcauccagcuccuauccccgccugcuuuugagguaugagggcaugccacaaguuccuggcuccuccaccauuaugguguaagaucagcugccccaugugccgggucaccuggcguacccccuaccucccuugugccaacagcagccuuauucuuuucucacaggccaggaacugccgcacagagagguagggcagcuuauccaaggucacacagcaagggaggagcaggggucaguagcuaaacuuagguagucuaacuuaggguaccagauuccagaaacguuucagaagugccuacaucagugagcuuuggugacauagaggcuuggauuuaaguccugguccuguggcucagcuucccauguuuuuagaggaacaguuaccgugacaguaagccacuguucuaauggucucacugcagucauuggcacagcccugggaugcugcagucugcuagguucagaucccaucuaugcucagggcugcugugccuccucgggcagauuguuuguucuuucugagucuuugccugccacccccaagagggggcugcauggagaauuagggugauggcuguagagauuacuacuaucuuaucuuaucuuaucuuacuaucuaucuauuucuucuaucaugcaguacaucaugaccacaguuuccucucccccccacuccucccaguucccuccuccaaccuccccucuaugaacccaccauacacaggcaaguguuuuucuggcuaccuaguuagacucagccagucuaaauacaagguguggccugaccaacgggggggugggggggagcuuaugacugugugucuuuugagccucagaccccuugcuuuguuuuuauaagaugcccagaggaguucuuagcccaugaggaccagcccuuuguccccugacacagucuuucucuuccgggaugcugagaggguccagauuggagugcugggcuuucuucuggggagagagaggccccaagaaagccuggccaguagcuggagggauagcacccccuuuucuaaucugugcugcuggccucccaccagaccuguggucacaggcaguccaguaggcauggaacgaugccagggacugacagggauggccaagcccaaugguguggcagcaguacuagacugaucuuaucugucaucccgcccugauccucuggccucagggaaggcuaugccaggaacugcugcugaggguggcuggcucuggccggcacauggggagaggugcacucuggaggccucagaguacccgucugaacauuggcaacuuggacuugauccguaagacccuaaccuuggaggugucauuggggguauagaggagugagugcucuggccucccuucuaagccucaguuuucccauccguacaaacucaaaaugcuggcacauuucuuuaagauuuaccacacaauccaaugcacagaucugacuuuccccgggaagucaggcugucuagguucaaauccugagcugguccuucuccuugccucagucuuccucucuguuaagugggcagacccggagcaguauaaccugccguggagcacuaagacucucauuucacaggaagugcccugucagugcugagcacuucccucccugagcacccgucccacucacccagagaggccagcaugucgugcagguccuccuuaucaaugaagccaucucgguucugaucaaucauguugaaggccuccuuaaacuccuggaucugggacuggucaaacauggcgaagacauuggacguagcccucuggggccucuucuugguggucuuggccuuggcucucuugcucgacaucuugccuuuggguguuggggguuucccuacagggaggggcgggggaugaugauggacagggaucaucccugccuuccccugaggucuaaaguuaggucucagcuugcucuucagggcaucccacagguuugggcccccagccacccaguucuuucugagcacagccugugggcugugauccugagugcuucaucuaucugucuuccucugggaaggggggcaacagaguagccugccacaggaaucaguuaauuuaguaucuagagaggcccuggaguggugcugagccuagaaacaauucauuuugcuuugaguggguaaaauaggauuggcuuggugccaaccauuaaagugcuuugucuacuuuauuucuucauagcaaugugcccaucucaauggcgggaagauagggcucuccuaggaggggucggaccccccagcucuguacucugauaauacccucccccaucccuccccaucccucucacucuaugccccugcaccccucccccaucccucucacucuaugucccugcaccccucccccaucccuccccaucccucucacuccaugccccuucaccccucccccaucccuccccaucccucucacuccaugccccuucaccccucccccaucccuccccaccccucucacuccaugccccugcacccccuaucucccccaucuucugcacagucuguggaacacagcugcucuccucagggagccugacuggucccuugugguuucauccugugcccucugucacuuccuguacaucgaagcucccucaaguugaaacuacaguccauuuagaccugguguuuuggcuucggccggucucucccaucccauucaaacucagaccuucagucgccuccuuaaaaccccucuccacaucccgagaguaaaccucgaugccccagccuggcaugaaaggacccagugugcucucccagcuccugacugauccacuuugucuccuccuugaccucuagcauuccacagcuguuccaggacuuccuuccagccccccccuucuguagcuguccucaggcugagcucuagagucccaggggugcuguucuccacccuuaucuugauaacaaacacuugcggacucccucauccuucaccacuagggcagcccacagcagcaggcuaguagaggauucuucagugaaagguuuaugagcuccacuguacagaugggaaaacugaggccagggaaagaauucaaccugaucccaucauaacuuguggggaaauacaucucaaaacuucugucugcuuccccucagcuaguccaggccccagcacgucuucuucucugcccugugcucuguagaccuuggcccagggccuauguccuuccuccucuaucccugccucuaauacccucugggcuggggucauggucagcuccagcaagucccagggccacaucuaccugcagucuugagacucuagcuguauaaaacccagugagccccacagcaugcaccaggcuuugggguuccuuuguguagugcugggugggaauugguaagaaccgggggcagaaauguugucccuggaagcugucccccaucuccuguggcccaggcugagauggccaucagcuagcuuucuuccuuuuccuuucuuucuuucuuucuuucuuucuuucuuucuuucuuucuuucuuucuuucuuuucuuucuuccuuccuuccuuccuuccuuccuuccuuccuuccuuccuuucuuucuuucuuucuuucuuucuuucuuucuuuccugucugucugucugucugucuguuuuguuuuguuuuucuuguuuuuucgagacaggguuucucuguauagcccuggcuguccuggagcucacuuuguagaccaggcuggccucgaacucagaaauccaccugccucugccuccugagugcugggauuaaaggcgugcgccaccauacccggcucuguuuugguuuuuugagucaggguuucucuguguagcccugguuguccuggaacucacucuguagaccaggcuagccucgaacucagaaauccaccugccucugccucccaagugcugggauuaaaggcgugcaccaucacugcccgguuuggccaucagcuuucuuagcccauccugucugcagaccucuagggcaggcccagcuaggcuccccuaguguaucccugcccucucuacaucccugagaggcaucccccccacacacacacacacaaagggaagugaauaccugugagaggguugggagccaggacaccacgcuaggcuggggccaguggguggcagguuuggcucuugaagggccaggcacuuucuagacuugguugagugacuuaaauuaggaauaagcuguguccuuaacucugaagccauaugcuccccucucugggguccuagacaccaaggaucagacagcuggaacuuggcgcggucauggcuagaccaucccucccuccucauuacuagucuccauagcuggcugugccagauacccugcuuuccaaccggcucaucaagcaaccagggcggcuggaggguugugaagaagccaagacccccucaucccaccguucucuagugcacacagcacuggagauaaggaaggcaugaggugguuaccaucccuccugggguaggguuugcaaaacugggugugagcgcugugcuuccguagggcucaauuuccucugccacacacaguuucuugggucagggaugcccucaacccccucacuggcaucucuacaggcagguagccuggaguuuccaggcuugguguguuaggcucuuuagcaaaaggacacucuggauccuuguuuccuugcccaaagaccaguuuuccggggcgcagaaccaccaguugcucagucccaggccaggguccccuuuaggacccaagcaaggcaguagccccagcccacaccacuaagcaugccacagcccucagaaggccgggugagguucagccugaccaccuacuguagcugcccgggugcugagugggcucccaccugcugcagagaagaaaaguccucggcgcuguugcggugcuucgagaguuggcuggcagcagcuccgaccgaugcucgaugcucggagcucugggggcggagccggggcuggaggguccgcaggccgcccggccuuaca

SEQ ID NO: 1221 - RNA, 10723 nt, Mus musculus
gcugucaacuuugauggcaguggggcuugucaguagcaccagguagggucccuuccaucuggguucaagguugcuggaucaguggcgcuggaccaggacgggauccccuauuugaaauuuaugaggcaccacaguggccccuggcuuguauguuuccuucagcuguucucagauccuuucugaccaguucuagggccuucaaacaagcuagcagaaguugagaaaaaggggcaucagggucaaguauuccuccugcuucuuuuaaggggggcaguucccugugaaggagcucaaagggugugggcuuaaauuucccugggauguuccguacucggaacaaagcgaaggguagaagggcuguccagucuuuccugcuggucucuaaggccaauuuagucaaggucucuuuuaauguucuauucauccucucuaccuguccugaacuuuggggucuauaagcacaauguaauuuccaaucaauccccaguugaguggccagucccugacuuaccugggcaacgaaggcagggccauugucugguccuuagggaugccgaaucuugggaagauuuccucuaauauccucuuugccacaacauuagcggucaccucuuagccguuuucugggggcgcucuuguggugccuggcacuggugagagcacaggccuugcauuuaucaacaauauccugggcaacauuggacaguuuuauaacauaguaguuugagcucuuaacaauuuccuugagcuucuuaguucccaggugcgugagccgguguaaauuagcuacauauuguuguccuuccuuggugggcaagacugagcaaccaucuuggguccuugcuacuccaugaggagaauacccugauaucucagguaguuuguuuaucaguuccugauccuuuggaguguaguuaaagccugcguuucggaguucauaaugguccuuagguuccuuguuuuucucucuagucuugagaaucauagcucccugggcugccuguuuggcggcuaggucagccaucugauuucccuuuguuauggcaucuuggccuuucuggugaccagggcaguguauaauggccagguuuuuuuuuuucuuuuuuuuuuuggggggggcaaauguauggcuucuaguaagcucaagauuucuucucuauuuuuaauaucuuuuccagcagaugggaguagcccccucuguuuauaaauugccccauuuacgugaguggugacgaaaucguaccugcuguccguguagauauugauacuuuccuucugccagucacaaggauugggugagugcgaucagcucugcuuuuuugggcugacgucccuucaggcaagcugcuggcccagaugguuuguuucccgucgaccacugcugcccccacuuuucgcuuacuuucaaccaugaagcugcuacuauccguguacugaaagacccccguggggagaccccccaucaagucucgggauggugcgcacccaaggaaacacgaaagaccaucuugaugcaaaaacacgagggaguuuaaugacggagcuccaggccaacacaugucucaugcaggagacagaggaaucgacccugaggcucaaaaguuaggaguuuauauagaaaaaaagucagggguaggggaaauuggcgcgguuacacacaauuggacaguuuaaacaucagcaagcggguacuugcgggucgggacaacagcaacucuagagggagggugcuuaucuaugucagcagagcaucugguuaaacucaaaccguaucagaaggagaccagaacagguggcccaaucucaacugggccuguccagagauuguucuugcaugccucuuaucuuuauggcaagucaguuccuggaaugacuuaacagccuuugugcuggccugucuggggccuugaauuugguuuucuuucuuucauuccccucuucuucuacuaaauaauucuaaucuuagaauuuuaaaggucuguauccucaugugggggguaggaaucauauucuucuucuaucuucacuauagguuaauauugguguuggagaaccauaagcugcacuacauucacucuacuguuaacgaaagcaauucccugauuuauuaagcaggggccgaagaucaaugccaaacauauaauaagaagcggcccggccaaagcagaaaauaaaguggucauccacggagauuuaaagaaccacgacucaaaccaucccuguugagcuucccgaucucguuuucucuuuucuagccuuucucucaauuucugcauagaaucucugacuauccccauguggucugcguagaagcagcauucuucuuuuaaagcugcacauaguccaccuucccuuaaagacaguaaaucuaaaucucuucuguuuuguaauacuacuucugacagggaggucaaggauuuuucuaauguauugauagacuuuucuagcaugcuuaaaucuucauuuauagaaucucucaaggacuugauuccuugucuacccucaauuaaggcugauaccccuguuccuacucucaccgugagaccuacccucaccaauguagccaggguaaggguaacugguucucuuuuaauucucuuauugguauauucgucuucuaggcuggaggcaguaugauaauauaugcgggguaaaaguugaaccaugacacaaaaaucuuuggaggagucaaacacauuaguugauacacacggugugagucccguguuacaggcccaccagccgacugguguugguacaagguaaugguugguacuuguccuagauacaggauggguucgguuacauagguguugaugggaaggggggggugucccuaugcagagaccagggcucuuucccgacaccucagucaggguuaauuuuuuuucuguuccccaugagcaggaagcaugacuggugguuguguuaaacucuccauuaagggcgauccccucauaauagggagggacagaggacaggcauagccagcagucaguuguagcaucuggaucagugcuguuaagggcauaaaaggccccucuaaucagguugaacagucucugucccgucgagggaucugaggagauuguggucggggaaucuugggaggugccgaccuugaggggguucucaauuauuggagccagggguuuggguuuggcagggagguccuguucugggagggccuuguuagguccuaugggcacuggggauggacucuccacagucaauuugauuuugaaaacuaauccagggucuuucccuacuucguccaaucgcaaaccccaauuguuucccuuaagccagcucuggcguucucguuucccuuggucaguaaauuuuauacguaugggguugcaauaguuaucuuuacaagguccauuagggcuguugaaccaggaacacccgcucucaagguauuuagaacuaucucucucaccuugguuuggcuggucauagcuacugccccuuuuuaccgugaucaggucccagguagagguaggauuccaauaagcuccaccuguggucucgcaaccccaugcagcacaguaaaaguccggugccccuccacacugaugccgaagcuuucgugguuggccagggcaaacauaaaauucugcagaccgaagauuggcucgguagaacuguccugagcauccaaacgugcucccuaucccgcucgggacacacuguuuaucagguggugguuuaugaaggucgguauggucggggaggucccagguaagugacccugcuacuaacuuacaaauaucaggugugaggucgggccaccagguccauggggguuguacugcgguggucgaccauacagugucccccuccucauuaagcacuucccaugauuguuggaguaugaggguugaugucucuguucugagucgcucuugcgacgcaagcgcaacuuaagaggauuauuagucuuuuccaggguccacucaucacgaucagucucagggggagcccucuuaacaugugaggcaugaacccaagaggggauuccuucuacuuuaagggugguggcuguaguuaauaguaccagggaggguccuuuccaacgcggcucgagguuccccgcucggugccuccucaccagggcugugucucccacuucaaacugaugugaaaccuguaagucgcuggcgguguagguuucuuucaacugcucccaguuucuuuccucacgauuucgagagccuucagccgggcuaggagggaauggaggaaacaucaggacaaguucuauuuucuacagucacauagauaggcgggggguuucuaccuguccugaacucuggggucuguaagcacaauguaacuuccaauuuauccccagcugucuggccaaucccuggcuuaccugggagacgaagucaggcccguugucugacccuauuaccuuagguaucccgaaauggggaaggauuucuucgaguaucuucuuggccaccacauuagccguuucccucuugguggggaaugcuucagcccacccugaaaagauaucuacaaaaacuaaaagguacuuauucccauaucgagcuggcuugaccucaguaaagucaaccucccaguaagucccaggccuaucuccucguaagcgucuuccacuguggcauuggugagggcacaugcucaacaguucuucacuaggucuucuacugccuuuuguagucuagggauaugguaaggggaucuauugacuaguucugucaucuuuuugggucccaggugagugaggugguguauauuagucaaguauuccagccccucuucuucugugaggaucuuuuuuucugugaucuccucaaccagcuggggugugguuuuaauuaccaaagucauuggccccugugcugccccuuuagccaccuggucugccaucugauuuccuuuuucuauugguccaguucccuuuugauguccugggcaauggaugaucgccacauuacagggcaaguggacagcuucuaacaaacuaagaaucucuucuuuauuuuugaugucuuuuccagcagaagucaauaguccacacugucuguagaucucuccgugaacacgagccguugcaaaggcauacaggcugucaauguaaauauuaauagucuuucccucugcuagccuuaaagccugaguuagggcaguaaguucugcucuuugggcugauguuccuucaggcaggcugcuggcccauauaacagacuucccguccacuacagcugccuuggcucugcucuuaccuucuaccaugaagcugcuuccaucggugaaccaggccaccgcuccgcgccaugaucggucaguuaaaucuggccgagucccaguuuccucugccaguaucuccucacagagauguacggggguuucauuagcuucaagcaguaaagugguggggguaagaaugguggguggagcgaaggucacccgcuuggucaacaacaagcucugguggcugccgaauaaugcucucaagggugugcagggccaccacugucacauuuuggcccauagucaauuuaucagcaucuuucaccaacacagcuguggcugcuauugccuguagacaggagggccaucugcuagccacgggguccaguuucuuugacagauaggcuacugggcgcuuccaagucucgguggagggccucaucaaagaggguaagagaguuuuugaauccuaggggcaaacguguccaaguuagcuguccagccugucccgaaucugggucucuccacccgaaagcaaacaucaccuggcuuaugggauguaguuucaggcaaaagaaugcgucuuucaaguccagaacccuguaccgucgucuguugggggagggggggagagaacugagcagguuguaaggguuagggacaguaggaugaaugucuuguacucuuuuguuaacuucucuuaggucuugcauugaucaauaaucauuagugccuggcuuuuuaacuggcagcaacggaguguuccagggagacuggcaggggaccagaacacccagucccaagagucuuugaaugugaggccugaugcccucucgggccuucuucuugcucaugggauauugucauaucccgauaggagucgcaccaguuucuagcgucacgaugaugggaggcacccuuuuugccucucccauguccccagucucuacccaagcuuggggauaucucucuaacuaggucccuuccaguauuuuucucgaugggucuggaggcucguguaaucuauauucuucuucuaauuuuagagcuaaaaugauagagguggggguuugccaagugacugugguuccuuccgaggagaaguucauuugggcuuuuaauuuugauaguaagucucuucccaguaauggcguggggcauugagggaugacgagggaggaauggguuaccuggcuucuuccuagaucaacccuccuaucagugguccaagaauauggcuucugaccaguggccccaaucacuaugguucucuuguuucuuaauuuucccaguggcucuuucaggacugaaaauucugccccaguaucaacaaggaaauccguaggggucccuuccacaguuaggguuacccuaggcucggggaggggguccaagccccgucuccccuaaucaucauucucuauggugagaaucuugggcggucuggugucucuuucuuggggcagucucuugcccagugucccuuuucuuuacaguaugcacauugauccuuaucuagagguggucgugaagguccuucaggauuccgaggucuucucgacccuauguugcccagguucccugucuauuuccuccuccuucucuauaaacuuccuuaucgccuacaaaugcagccaaaauccuaguuaaauaucuuuccugccuucuaucuccucuaucuucucuugccucagccuccuucuucucucuuucucuuuuuucuuccucagucucucucuuaugguacacuuuccuuaaccaggucuugcaaagacaacguuugcagaccuucuagguguuguagccuucucauaaugucagaagcagaaugccccauaaaggccauggcaacugccgccuguuggcccucugauguaggaugaaaggggguguagcgccuauaugaugggagaagacugcuagcacgcaggagugccuggauucuaucccagcaccagggggaggagggguaggguacuagguaagcaacuaaacucaacuacaggaaagcuaaaaccacaugugcuugaccaacaggguaucacagcuuuuaagaagcaguuaaaugggaauccacaugggauggagacaagaaccucacaugggccacaaucuccauccugaaggcuggccugcuguggcuccuccuccauccauuccaccugaucucuaagcucuuccuuagucucuagaagagagguccgggcaggaucccagaucucuucacgugagguaacugccugucacagucagucccucugccacucccauaacuagggcaguggccagugauucuuuucuuuuccaaucaaagcagauuccugugacaucuacugcaccucugugaucagcggguacccuaggaacuggcagcuuggagacagagccugccuaccaugagcuucucugaccugcaguucuuugccuuagagcagaguauagaggaagaugaaccaggagccacucuccugccucacucuagacccuccccugaggucaggacccggagcucauuaucaggaaggcucucuccuuccagggauggaugcagucucucuacuuauuuguguuugguuguauugagacagggucuccugcucuacagcagcgguucucagucccuagggucgugaccucuuugggggcagugucacaugguguggaucagauauuuacauuaugagucauaacaguagcaaauuucguuaugaaguagcaacaaaaauaauauuaugguugggggucaccacaacaugaggaacuguauuaaagggucacagcauuaggaaaguugagaaccacggcucuagagcuaaggcugaccuugaacucacaauucuccugccuuaccucuggagugcuggguuuacugacaagcuuugacacacaggccugagggagcuuuugagaaaaccuccaagucacuggguuccuuuuuuccguuuuauggaagaucugagcauugaagcuuucucuuuugagacaaggucucacaguguaccuauagcucgcaguguaccuauagcucgcaguguaccuauagcucgcaguguaccuauagcuggccuggaacucacuguguaaaccaggacggccuugagcucacaaagaucgacuugccuccaucuccaagugcugagauuaaaagcuugagccaccucgcucagcaguuucuuacuguaugggggaacgggggaaagguuucuugccacaacaguaguguguauccauagugcuggauuucaaguucacguuugcuagagaagauugacucuaccaaaacuagaugagagccagguguggcaggaaaaacagccucaggaagcugaaguacaagaaggauuccagaccccccacaucucaauaaauaaauaaauauaaauaauaauaacuuaccaucaggcauggggauucacgugugcagugugcagugcuauuugggaaccugaagcaagaauauccuugagcaccggagucugaggccagccugagaaacagagagacuuguuacaaaccaaaccaaaccccaguuggaaaaagcuugucaggauuaucaauacgucuggccaaagucccuucuaggccgaauauuauagcugaaaauaaacucaugucagaccucucugacuuggaacacagauuuacgggaucguaugguuccaugauuaucaguuaccauccagaucccaggaagggcaccuagacguuuggcuuuuccagaacagcgguaugaagaauacucucaugcaagcuuuaacuucaugcacagcugcuccaggaucaugaacccaggagugggaaugccuggggugaagaugcacagagcuuaaacuacauuuacagagcagucagaccuggcaacugucgaguucaugguauauuuaggcuagggaaguuguuuaugugaaauccugacacagagccagccugacacagagccccccucaccccaacccuggauccugccaagcgggucagggagacuccagaccugucacccagcauucaguccgcucugcugcuggccauggggaggaacgcgucacucaugugagcaggccuggggucacugguggaauccgugggcuugugacugcccaccagaggcuccugucacaaagaaaagacaccugcugcacacgccuggaucguaugagauccagggcacaucuccagauucacugggcuaucccucuauuuucccuccaugucacaccuauaugacagucccugcuuuuugccaagaccuaauugguuuuuacuuuucuuaccuaagauuucccaucuccuucauucuuucaaaggucuguggcuggaauaugacuuggcuaagaaauugcuugugaccaacucucugagacuuggugucaccaucaguaaaaaagaggguucugggcaauguuuuugauuuuggauggccaucuugguuucaaggauuuccaggcaaguccggcuucuaugaaacccaccuuaagaugcuuuuaaucggcauccugacuggcuuagggccuucugguaggaaaacuuaacuuugguugccaaaguuuuugugacuacaguacaacgaaaaacaaaagcuugagucugcugcagcaaugacagcuguugucucugucacuuagcugcagcaggugcgccacucuuaagucugacccaagacccaaacucaacaguaaaaugauuagaagauaacagcauuaaaaaaaauaacaaucagggaagacuguucggaugcuguugguucuggcacgugggucucagguuucugggccuauaugaucacaaacccagaaaaggccuguuagcuggaguuaggcuaugccacacuuaugcagauagcaagagacagacaaacagucagggaacuuggacgcaaggaaaacuugagguaaaaugacccuagccuggaccgcuggaagcgccuagccucacccucuccaacugggguuagccaccaagggaaaggcucggcucuaucaucagacccaccuggccaaaggacacuggcacacgugguaaggcagggaccagcgaguaaaugcggccaccuccaaauugcgacacggugccugccucacucacgcuccuggggugcagccuguacucaccccuggccgaccaucugcgcuaggcuugggguuuuaucccaaguggucuucgccgcgccguuugccuuaugagcggacaaaacaacugguccuuuagcaccugggaguuacucugagccgacugagccucaguuuccccauccccacaagggcaagcucccagaggaggaggcgaacuuacaaagguacggggacuggcacccuuugugccugguagugcccccacccccauggaggagcacacaguaggcgcuccggaaacacucucugaaaggaggagcgggccacuuccugcccuggagcugacuccgggagcccuggucccaccgcuccgccccgggccccggccaugcggcauuccuaaggugggugggcgcaggaaggag

SEQ ID NO: 1222 - RNA, 18249 nt, Mus musculus
gccacgcucugcacaaaguuuguuucugccucggggcggugggggagggugcggcaggcgggaugggaggagaggggaucugacgucaggucgcgaggugcuuuccagccgcgagcugucaggcgggugucagacccggcagguacgcggcgcguucccccggugccccccgccccggccggguggucccacaccccaccgaggccgcgugggccggaaagccgccagggaaggugagugcggggcgccgaggggcuggagacgcgggaggaggcgcgcggacaacuuggaaaguuucuuggggcgacggggcgggggagggggcgucgucccggcgcgugcgacagugggugugugagccccgggggugugugugagucgggaccgcggaacgcuggcgcggaaugccgggguuggcggggggggcgcuguucgggguccuugagggagggcucggcucccaaagcucccaaagcuccucugggagagggcagccggugcccugcagcggggugagcgcgcggggagcggguuuguuugguuucaaaagugcacguugcuaaccgccggcagccccccccccucccgcacggcgacagagcgggaccgggggccgccgagugacagcuggaggugggggccgcgggcggggcuccgacggagagggcuugggagcccgcgcgaguuccccuuuccuuuggaacaaaggaaagucugucuccgaggcaucugucacucccaggcgggccaaggcuguggggcgcguggggcuggcgacgcggagaaaguuugugcgcgccgggaccccgggaccaggcgaagggcagccgagcgucuugcgggggcugugcgcguccccgauguagggggggcggccaacauggaguccaggcgcagaguuggggggggggggcggcgcggagguuggagcccagcccccucuuuuccccucccccuccgggccgaguucggagcacaaagccgagcgcgcacgcuccggcggccccgcgccccaagagucacccugcgcggaguaccagggaacgggcugggaacuaaacuuuuuccugucccaaaauggacacgugaguuuuuuuuuuuuccuugcaaagucgucccccccccccaacccccaagcgccggguggcggaccgacaggggagcuguugcucgcaccgugacucuggugggggacaguugagugagggugccuugagcgccggcggauucgucggcgccccaugagccaugugcuccguugcgucugggccgcgggggaggcugcgcgcuuugugugaacugcugggaacuccagccucagugugcggcccgggggauuguaucuggagcugggcgaguugucagaaaguuccugugggaguggcugcagaugguguugugggaguguguaggagauugauggggugcaguguccaaggggugccuccaauaacccaguuguauaaaaaacugauggauggccgguguggugacgugcgugcuccugggucggagagaucgugggugggcaggucacuuggaguucgugggugggcgggugcaggaguugggcuaguuucgauagucuagucguugguccuagguauaguguguaaauuuagcuauguguguuuguaaaacucugggaacuugcgggaugugagcagugggucgggucgguuauuuaaacagcgcucaacuugcaggagggaaauugagguaucgcuggugugcgugugugucuaaccugcagacaacccuagggugcaggacccagagguggggaaaguucaugcggaggggugcucuucuggaagggaaacuaugaagacuggguucuggcaggcagccagaguggaauaagugaagauaaccuugaguaaacuugucacccgccgccagcgcugccucccugagcuggucucgcagcuguccugguggccgacuacaugucugcccucagaaugcauccuccuugagcuccucugaguaaacacugccuccgagcagugcccgguucaccuccagguggccuggcugaagguagacccuucccucgaaagucuggcuuagccagcccagagaucugggcucaggcccaagucgaggaaacaaaaccugggagauggcagaguuuuuuggcugggccugcugaggagcuguuaaaaggcagagaagggaggagcaugcagauccuggaccagccuuggccuagaacuugugcuauuaaaauguaaauuucuuuugcuuuugugaacgggaacuuugucugcuggaggggcagcugauaggaguuaucuaggcagaaaccuuccuucacggagcaggggaggaggagggcuucagacucugaaaggacacuuuacugggaucacacagcccaguggaaguuaaagcagggaccagagccacacuucauuggucaggauucugagauuaagucuggaccaggucagaggccggaccaaggaagaaggucuaaaaaccaacggaggaaugacucacuacgcacacggccugcggcaggggcggcaagacuuggugaacaguuaccagacccgccuccgggccuuggagggaaaauuacccgauuucaaauccuucuuuauaaucagucuuaaaagaugggacauuuuuuauuuuauuuuuuauguguguggauuuucaucugcaccugggauguugagagagagcaucuacuccccuggaacuggauuuugggugguuguguuccuccauguggguguggggaguggaacccaccgcuucugugagagcgcguuacagcaaaugcucguaauugcugggcuaucucuuccagccccagaaauucacuuuuaaaauaagcaggcccggggaccugggggagggggaggcuggagaaauggcucaguggguuaagagcacuugcugcucuucccgagagccuggguucagaugccagcacagacaggcucacaacaauccagcuccgguuacggaggacccgccuccuucuguccucccaggacuccgcauauguggugcagaauguuuauauauauaaaauaaguaaaauccugggagggacggggagagaagggauuuggugggaggaggaaaauaagagaaaagagcacuuuggucaaaggauauuuuauauauguauauauaauaaaauuuuaacuaaaacauucuaaaauccuucuccccucccccucccuaacuaacugcugaacagcuagcucuguagagugagcagccuguugagcgcaucccuucguacaugggaccguguaacagugggcuuucauggccggccucuucucccggagcaugugcucaagguccauccaugucauagcacacaucagaagugugcucucucuuuuauaauuuguuugguuuuauguguaugaauguuuugccuacgugcgagugugucuacaccacguagauguccauggaggugacaagaaggcacuggauucccuggaacugggaguuaugguggcugugagcuaccaugugagugcugggagccgagccagguccccuggaagugcagcagccagugcucuuaaccaccuagccaucucuccaggcccacgguauuucuuuuuaugaccaaauagcucguuuguucggccaucuguugaagaucucucuggaucguuuccacccuuugaacguugggcuucugcgaggggccaggugugcauuucucuugaguagcuagguaguagugagagugcaaguuuccccuuuuagcagauugcaaaagaguuaagugagguaauagaugcuaaguuuccaggacagccuggcaaacagaauccaagcugagaauuggcacugaggaggcagaagcaggaagauugccugggcuauggagugagugagaugcugucucagaaccacaggaugaagccguaguucuuucuaguccucuucuguuuuuaaaaggcgccaccuacgucccaguggucccucuugguuccaugaaucguggcauuuaggauucauccagcuugcucaggcucuggugcuacuguccaggguuugagacuaugaccccugcuugugagggugaacucacuaggagacuaaggcaagggggacaggcacuaagugauaauguucuccccauccccuuugucacuugucccaggcuccccagagguccagcuuagccccuaagcaucaugucggacagcgaucuaggcgaggaugaggggcuccugucacugaccggcaagaggaagcgcagagggaaccugcccaaggagucaguaaagauccuccgggacuggcucuaucugcaccgcuacaacgccuaccccucagagcaggagaagcuaagucucucuggacagaccaaccucucggugcugcagguaagaggggaucaggcaucaagucuccagcucuguccccauuccuuguggccuuggccuaucauaaccccugcugggauaagaugagaagcccucuccuggcccccagggaaagugaggucgccgaggcugcacuggaggcuugggcccuuaggaagggaugaggagugguucuaguugaccuugaaggugagaagacacaggagcagagguucuggggggcagcccagagcacuugcuuaaaaaugaauugagugaacugaggagaugacccagggguugagagcgcguccugcucuuccugugcauccgaguuccggccucugcacacagcgggcagcucagagccuucuguaaccccagcuccaagggcuucucgccucuacaagugcacauaugcccauggaauuuuuuuuuuuuuuuuaauuucuugauguaaaagagaaggucuuuuagccgucgagcuggagguagguagacaagccggcacacgccugugaucccagcccugagaaggaagaggaggaggcuaguuacacauuccucucugagccugguggaacuguuaggaggaacgcauuuuaacuggauauaaaaggaccuuugugaaccacauugaggggcacacucgagacgcuuguacuagaaguugugucucuuuucaguuguccugccgaccagcagauggguuugcucuuugcauaaugcugacaccccacccccaccccaccccccagcgcucugggucuggguuggcucucagcuucccuaguuuaugcaguaggcccuuggucuaggccagagaccugcuccuggcuggcuggccucacugcuccuuucgugagccagcaggccuccucuugcuucucuccucuggccugucuaccaucucuucaacccacaagcuggcuccuuccucccguuaccucaccugauccugcgacuuccgcggcuucccacuucuguuccuccuucccggaaaaggcacagcaaguggucagccuauaaaaauucugugaccucacucuacacccuagacggccguaaacccaagucugucuugagacggggucuagacucaaguuauaggaccugauugucagcccaacuuuuucacaagaggacucuggaucuuagccagucugcuacuguugcccugagccucauuuccucaucugacaauggaaagaggcuuggagcauucucaacaauuuaaacaccauuuggggugcucugcagcauggaacauuucacauuuaauuccugggcccagcuccuccuacuaggauacuuucaaggaacaucuagcccuggggugugggguacagauggauuaauacuaagacaaaccaagagggacaagggaacgcagagccuggggccucuuucaggacucccuggaaggugucuuugaacuuacgugcucuagaggcacauaggcagaaacaaaaggcugagaguuugagaccagaacugcacagacagccuuugcuggucccccugccuccagccuuuuaucuuucagucacggaaguacagaucagaucaugugacacauccucggaugggguucagaauucagagcacccucugcaguacuuccuggggcuagcccuugguuaugacuauccagggucaauccuggccuugguuuguuucacucucaucgagcacuugucucuugcaaacccugcuugcuguuuggggcuauugcaguacaucccuauggcuccucacacauguccugucaagcuacuugucauacaguauugaaauuucuucuugucagggacacuauuucucaaaacugagaaauggacugaccguuuuuuuaaaaguuggagaaugggcugagugguaaggcccugacuggccuagcgcaccagggagcaggguucuccagcacugcacaaaagagcuguucuguggcccugccuccccucuccaugcuaacuuuaaucauaaaugugcauuacaaacauaaaacugaguuuaaaacguuuauuuuugcucuuauauauagcuaucagaccaguuuuccaaaguaaauaaauuuacuguagcguauuuugcccccugcuccagauguguaguuggacaugaugcaucuacuuguacaggccagagugaaaagagaaagucaaaauguccuugcagagaccagugagguuuacaggaccauagcacuucagcauccaaguauagggcagggaucagccacuagcguguacagagaacuggagacaaguggggaccaucuggcacucccuaaaggaucccucacaucagccucagcagcgcacccacuuuucuugaagacucuucaggcaccucaagugccugaguggaaauugacagcuccaguuggcccugcccuuucucacacuccuuugagaucuugagccccuguacacauuuccccuccauguuauggaauauaagguuuugguuuguuuguugagauaaggccuugcuguggagcccuggauggcauugucucauuaaaaguuguagcugccugcaccuuucagugcugggccuaaagguaccacagcaggggcuugucuguauuguuguuguuuaagcuuuguuugauggguguuuuuuguuguugcuuuuguuuguuuguuuguuuguggcaggucauccugaccugauaguccuggaacucucuaugaggaugaccagacuggccucaggccucuggccugcaauucacaaagaucuaccugccucugccuccagggugcugggauuagaggugugugccaccaugccuugcuggaaugcagcuucuugauuccaugcuuuucccguuaccaacaucaccugucacuccaggacaucaguugccuguuuacaagucugucucaucucugacccucaucccugcugugggcucuugauaaccagaucccuuacucugaccagggaaccccaaccucuaaaggaaucugcugcuuccacaggaccugggcaucucuacuggacccggcaguaggaccuuuagcuggcugcauuuagguggcacagaguucuguggguaugggaagcagagaccuuaguuuuguuguaauugcuccacuccagguguuuuuuaaaaucagugucugccaggaaaggaagacacuggaaagucauugcaacugcagaaaaugaaauggugguggaaauguucgaugcuuugucuguauuuaguuucaaauuuuccuuugcucuuaaggacauuuccaagcucucccaccaagcuacacugcugccccaaaggaagaacauuaaaugaacuagccacuggcccgacagguaucugcauuaugccaagcugguuucgucucccuggggcaccucuuuugauugugucuuuuuacuugcccuggagccaugucauuagcaagucagugagucauguguuugcuaggcuuuguccagggccaggcaauugggagaauaaggcaccuccucuucccccaaaaaacaacaaaauuguauuguggaggauuggcacgguccuugggacugucaaagccuauguuauugauuggauucaucugguuuccuguuacaggacugcccggaggguucugaguccauuucuuagcuuccgccccaccugggcugcacuaggaggguucugcacuguggugaaggcagucagaacugcgccuccuaaguccuuuucugacauuccugagcccaccagcugcauagcuaauccccugguuaggcccuggggaagaaaggaaccuggaaaggcuauguaggaguggccugucccccuaugcaggcagucacuguauuuacggccuguccuguccuaccuaagcugagucuuccauaggcaauaacaugucaccuauccugcaaggcucuccuguguauuuucugagugucugugugacgcuguugucacagaccuguugguacucagcagaacaggcuagauaaaccccuguucuaaaucugaagagcagcucucuagcgaccuuguuuaaaagcaugcauugccagguggagguagcagcucacaucugugacuacaggaggaucaccaccagaucaggucaaccuaagcuacagagacccagucacaaaagaaauccaaagcuugccaugguggcacauaccuuuaacccuagcacucaggaauaauuggaggcagguagauguuaaguucccagccagggcuacauagugagaugugagauccuaaucuaaaaaaaggaaaaaugagaugugucuucgcaaccccaguucauccuaccugccuagaauccauagagcagauugaaaauagccacuuuaacagauuuuuuaaaucccucccaagaacuagggaugaaacugggugauagggcacuuaucuagcacacacaaggcccugggucagucccuaguacugggacagggaaaagugagacccaucugugauaaagggcugagcaugaaguucaguucgcagaguacuucccuaaucgucagagcucugcggguccccagcacugcauaaaucuagggguugcucucucacccccucgggugugcaguuuuaugggagaagacagagcaguagguccaccacagagucugugggacaggcugaguguggaggcuguccugggcuagcugcccacacagcuggcagcugcuuuccagaaagccgccuugcuuucuuccaagcuacauucaucuccaacuuugcuagacaagucacuaaaaugguaccuguuuccuguucccaccucacagccagagggaagagaaagaggcacauggcuccuauuccaggugacugagggagguaggaagcaggugauagguggugccugugguggggggaagggccuaaagccugcccccuccugcugucugcucagguguagccuucaaaccugaacuccuagugauggccacuaccucaacaguggagagcgucaacaaaaccgugucacgauaaagauuaaaugaguaggguggucgggagcuaaaguuuuguguuuuaagugaugcuuuuaagauuaugagaauuacuuaaacuguccuuguggcaggaaagggaagauggagggagacucuagccaagagaucagcuugugaaaccagcuguguaccccaagguagugugacuuuaggcaugucucuucaucucuguguucccccuuuguaagguuuuggggacacugccuaugucucccagauuuguguacagauuuaacagaauugucgacaaagggguugcaagacaccaaugucacuucugcuuccaacccaggcagcaguucagcuccccuccccacuuuguaaaggacccagcuagaacuccagccaguggcugcuugugugugaaaguacugaggagaagagagagaaaagaaucccaggggcagcccucuuagagcuggaucggagacgggaagaggagccacagcugccucugucagguuagcuugacagggcucuucuguaggauuuguuauaauugcagcuggcugcugcuuaucagucucuaucaugacagguaucuugucucuuugguuagacauggcggagaucucaugagaagacuauacccaagagcuugcucaagaaauguaccaagaaagaagccuaguacuagucagggcuggaagauggguacaagagccugggucucugaucugagcaggcuguagagaagucugaggcauugauugcugcauccuucuaaggaagaaggcuucugaguguucuuuuuccuacagcagcugguacuuaguccaggcuuggaacacgucugcugaugaacuaacaggacagaaggacggaccuagggugugaaacuugucaaaccacauggucccagcugaggacuugucccccgccaugaccucuuccguguugaaguuuuuguucuuggaccugggguuuuuacuggguugcuuucucagccuaggcuccugaguaacaaggaccacacagacagacaacacacguucacaaccuguccguucaggaguccuugcguuuaccuguuugaagcaggguuuuacuaaguagcccaaguuggccucacucacacuugaacugaucuuccuaccucagcagccucccagugcuggaauuacaggugugugccaucauagcugacuucauuaacucagcgacccguuagcauuuguuuuuuaucgcucauaguugcagaggcuuggucugggauugcuugcucauuguuucuggccugguuaugaagcaauggcauagcagugugcuggacaguggggaagcuguuuguggccaacaggaagcagauagagauggaucucauagguuuauauacuguuccuuccuguuucugggcauguccugguggucauucaccuguuuguuuacugccauugcauaaccagaugaugucagcaccucagggcagggcauauguuaaaaggcggccccagcaagcaccagugacuggccugaagcauaaaacaacgaugaauaagaagcccugaaagaagaguaggaaaaugugggaggcucuaacucaacuguuucagagacuucauaagcuggccucaggguccugagacagauagggugagaagugaccaucuggguccugccaggugagauucugccuuuugcaaggcugagcucuaaguguguucaccaggaaugcuggagauggcccaaucauuuuacagaauaaaaguaggaugcacugugcucaguaaguaguagcuguuagagagcucggcacuggaggugcaaagccugugucuugguccaucaguaggcaagaaguguuccaggaagaagggagugugcuauguagaagguguauguauuagguguagcguucuuuggagguuaaguuugguuuggaguuauuuuggaggugggggggguugggauggguuucucuguguaaacggcccuggcuguucuggaacucacucuguagaccaggcuagccucaaauucauaagagauucaucugauucugccucccaaguggugggauuaaaggcaugugccaccuuccccccucaggguuuacauacccaaagccuuugccucuagagugcugggauuaaagacuguccuguguuuuguuacuuuguuuugaaugagcagggccuaaaagcaguugcacagcugacagcaaaagagcgggaaggaacugggucgggcuggaaagguaaacugggcaggaaggaggggcuuagugcccuggcuccuuaucuggacucaagacuagugguaguaggaaacaaucagccacggccuagccguaccacacugagaacagaagcuggaaagaggaccgaaagagagcugugaagccaggagugaacucggugguaaucgcuugccuaacaugagcagggcuguggguaaacccucaacacugcaaagacgguggacacgugggcacaggggguuaggccuguucccauccuacacgcaccgugagcuuugaagcauacacagcauacagagagggcugacagaccccauggcccuaguguagcuuggaagcaaucucuccucucccugguagccccuucgguaucucugugucucuggucuguagcugcucuacaggccuaagagugagugacuaguuuuccuaaacagucaaacauuuuccucccugcaccuccuuaaauauaaucugaacuaccaucgccaucccaucccccaauucuccgcauaauuggucacuccuuugcuuagaacucuccuaugggacuggugagaugaacugaggaucaaugacgugauccagagggugaaggugcuaccugccacagaggcuaaggacccacaagaugaggagaggaccaacucccacaagccguucucuaaccucuuugagcacaugaugaacaccugcguacacuuguguguucaugcccacaugggaggcagaggcaggcagaugaauuccaggucagccugauccacagagugaguuccaaaacaccucagcgauacacagaaucccuaucucgaaaaaccaaaauauaaagccaagcacgguggcuuuuuuauuuuuuaaguuuuauuuuauuuauaugaguacacuguagcugucuucagacaccagaagagggcaucagauccuuuuuauagaugguugugagccaccacgugguugcugggauuugaacucaggaccucuggaagagcaaucagugcucuuacaucagugagccaucucuccagcccaagcaugguggcuuuaauccugggaaucagggagaagaagcauuugaggccaccuuggucuacauagugaguuccagaacagccagagcuuuacagugacccugucucaaaaaaaaaaaaaaaaaaaaaaaaaaagaauaacauaaaaaucaguaacuuguauggcucccuguguucauaguaaaacuaaauccucauccuaagaggugaccucugauaaccacacugcgccaagccacacaugucugccuucagccuucucauagggacucuccagccacuuugcaagugugaccucacugucuagccuuggcuuucacagaacuccuauuuagaccaggcuggccuugaacucauagaaauagguacaucugccucugucucuuaagauuucaauugaaaacuauucccuccacccuuccacuggccggcaucuugucugagauguuugcuucugucuuggugucuggaacacuaugagcauuuuguaggucuuuugaaugucguuaacugauaaauaucuuuaacacucuuucuagauauguaacugguucaucaaugcccgucgucgccuucucccugacaugcuucggaaggauggcaaagacccuaaucaguucaccaucucccgucguggggguaaggccucugauguggcucuccccaggggcagcagccccucucugcuggcugugucuguuccagcccccacuaacaugcucuccuugucugugugcuccaugccacuccacucaggccaaggugaaaagccagcagcacccuucccacaaguggagcuggaaucccccaaggcccuggugaccccugcuagcacacucacccugcugacuagggcagaggcuggaagccccacggguggacucuucaauacgccaccacccacacccccagagcaggacaaggaugacuucagcagcuuccaguugcugguggagguggcgcugcagagggcugccgagauggagcuucagaagcagcaagagccagcgccaccuuugcuacacacuccgcugccuuucgucucagaaaacgccaaguaggcaccugcucccggguggcuugagguuccuggcucacugcccuuucaugcagaggguuauccaaguacggaucacugccaagcaucaggaccauucuguccaguccucagcggaugucgcugcgcugcacuguuacggggccuguacucugcugagugccauuccuucaagcguccucuccgaggagaccaaggcaccagagccaggcaugguguugcugcugcuccuccagagagcccugggacaccugcacuccagccugcuuuccuaggcaggcucaggaaagcugccaaguccagacuugagcuggguccaagccgccccuaagcugugccucuuuuggucgagccaggugugcacauuccaaccuauucaaaggacaaaggaaaugcccagcagaugucacagaaccgacuccaguugaauguuuagauuuuugcuaaauuguuuuauuuuccuuuugcugugguuuguguuaaugcaguagguagcccagaagcacagguguggggagagagcaccuuacacgguggguggagcucgguaaguggguaaucuacuucccacaggaugguuguauagggaccagcagauucucugcaguggugcugaguucagacuagagugguuguuuaauucuugguuuggucuucccuauuauaaaagacagaaggaaaauauccacaggugguggguuauuugcaccagacggucauuuagacacagcagagacagaugacaaaaccagaggcacacguguuucuauugucgugguuaagcuagagugaaacagcucuguuuuucucucuguucugaguaacuccccucaccccaccccagcgacccccacccugcaccaccuuuguagcuuguuucggauuuauucuggagcuuggcaagaaugucgugugccagcaucuacuugggaggagugagccaucugcuggucauuaggcccuucggaaagcugcuuguucacagaggcagcuggaaccuuccuggaggagaggcugcugaggcuaccgacuggcccaccucccuucagggugggauugcaagggccugccuaaauuucccggggaaacagaccacacuuggucuuaaucucuccccuuuucccguuuacuuugcuuaguuuucagcaacaguauaccccaucuuuauauccuaagaaacacuaauccuagauuuguauuaaccaaaauacuuguguucugaauaaccagaagaugugaggagcccugacuguggucugagguucacccgggugugagcacagacggggcucuuggauguugacuggcuuggagugccuguuccgaggaaggcagagaccacucuggccuuuccagggagccccugaggcuuagcaggcuuccauaccucuccugagugacuucacccaucccuugcugugcaagugggcgcgagaauggcuauuuguaaggggcugcuucccugggcucugccucaugccucccucuggcuuccuguccuguaggagacccagcaggcucaacucucugucacccugaggcacugcugggaagggaacauggcuucauugacuuugugguuugcccacugcuaccccaccugucugugagaccccaugauggcuguaggaugcuaaggcgggggugauacuaggaugagggauuucuuuuccccccacagugcacugagcaagggaggagggagggagccaugcugcugacauauucuggcauucccccuccugggauaaaacagggcaucagaaagguagagcggucucugcuuagguugccuguaagauaaauguggagaagcacgguugucccauugaacaauauuugagcaaaaaacuacuguaaauaacugguuuuugucuuuugucaaauaaaauuguuuugguuuuguuuauguuuuaaagucaaacugaauuuuuuguuguuucuuuuucaagacaggguuucucuguguagcccuggcuguccuggaacucacuuuguagaccaggcuggccucgaacucagaaaucugccugucucugccucccaagugcugggauuaaaggcgugugccaccacugcccggccaaacugaauucuugauuggaccuaaugugcuuuggaaauaaguguuuugguuuugguuuggcucuuuuuuuuuuuuuuuuuuuuuuuuugagagacaugguuucuuuguaggccuggcuguagaccagacuggccucaaauucugagauccuccuggcucugcccacaggugcugggaucaaaggcgugcacccgucacugaguucuaacccuaccuuaccucugcugcucucccucuagcccccuagguguugugcaagccuuuccuggucugcaucugucccgucaagcacugucuacagggaugcauucccuguaagccuggccaguccacggacuacagguagacuuggagaacugccacuuaggaggugcaguuuugucccccaggugaggagaagcaucauaucaggcggauaugagagacacaccugcuuuagccacagcucaaggcaagaagaccucugcuucucugcguugucagccuguaaauucccauuugauuccauucgcuguggguguauuuugccacaucaugauuauaauuguggcauaaaguacaaacgacagcaguagugaccagcucugcugugugcaugggcagugcucaucugugucuuacacacuuacacagguuacccacacccugagaaaggcaacugagugaggauuuagguaacugaacucagccaguauagguauggauuuaggacuuuuaagugucuugcuucaaggucacugagagacauccaaaacccaguuaaaguagugguaagcgguuuaccacuaacaggcauccaguuaucuuuaacaucaaugugggcuaagcacuuccacaaucaaaucagcuggcugcauuuuuuuuuuaauuuuuuuuuuuuuuagauuuauuucauguguguauuuuacuuguaugccaccacaaguuagaagaggguguuagaugcccuagaauuguaguuagagaaauuacaagccaccaucuggguucugggagccaaacucacguccuuggcagaaggaacaaguguuccaacugcugggccaccuccccagccuucguuugauuugguuugguuugguuugguuugugauaagugucuccuguaugcaucuagucuagccuugaacuccugauccuccuguacucuuucauccggggucuguuaguguccccuacagcucaacaguuaggcccaagacuuacaggaauagguaaacucaaaagagguuugcuuuugcugggcauaguacacagguccaguguucuuggaguagaggcaggaugaugagagacuccaaggcuagccuaggcuacacagcaggauguuaugccaucugaaagguaauauucugugugugguuuggaugugaaaugucucaugaaggcccuacaguuaaaaaaaaaaaaaaaaacuguugcaaacugaugggcuuuugggacuuuuuuuccaggacauaagggcuuuagcugacuagucauuggaugaguuuauaauugaggggugugggaaaguggagacuaagggggcacuaagcaggccacuggaugggugggugugcccuagcagaaccugugaagaucgcauuccuguuucccuccccuucccuguugcugcuguaagcacccuuucuccaccuuaaaccucuaggcaagccuugagcuagcauaaaccuucguuccuuuacauuauuucucaagggauauggucauggugaugaaaaugugacugauacacccugaaaaagagaaguguugugaggguuccacuuuguaaagagaaauggcuucucuaaaugaaacccuaaccuuuucagagaacuaaaacugaaacuaucugccgagagcuaaagcccuagcccuguugacagagugaaugccuggcguucacaaaguccuggcuuugauccuagcaccacucacucaaaugauaaccagacaagccuguaucucagaacucuugaagagcucaguguaugaaugcacugcugcagagcuugauggccugaguucaauucccaggaccccugugacaaaaaagagaagugacuacuacaaauuguccuuuugucuccucauauguagagggguacacacguauccccacaugcacaaauguaacuuaaaaaaacuuuuuuuuuuuuuuaaguucaagauggucuucagcuauauagccaaguuggaggcuaccugagauacauaaggccuggucucaaaaaaaaaacaaaaaaaaaacaaaaaacccucagaagcccuagguugauaauuagcuugaauuuacaugcaagugagacugaugcuucuuguuuuuaggacagagucucaccacguggccuaggcuagccucaaaaucagggcacuuccgcaucaucuccaggucacuccaccugucuguguguguguugggaagaaggguuggggaucaaaccagagacuugccaccuaccagggacacuacaagucagcuagcccccagacucccaaucuuaacaguuacaagaaagaaaaaaggucucggguug

SEQ ID NO: 1223 - RNA, 20472 nt, Mus musculus
cuuaaaagaugggacauuuuuuauuuuauuuuuuauguguguggauuuucaucugcaccugggauguugagagagagcaucuacuccccuggaacuggauuuugggugguuguguuccuccauguggguguggggaguggaacccaccgcuucugugagagcgcguuacagcaaaugcucguaauugcugggcuaucucuuccagccccagaaauucacuuuuaaaauaagcaggcccggggaccugggggagggggaggcuggagaaauggcucaguggguuaagagcacuugcugcucuucccgagagccuggguucagaugccagcacagacaggcucacaacaauccagcuccgguuacggaggacccgccuccuucuguccucccaggacuccgcauauguggugcagaauguuuauauauauaaaauaaguaaaauccugggagggacggggagagaagggauuuggugggaggaggaaaauaagagaaaagagcacuuuggucaaaggauauuuuauauauguauauauaauaaaauuuuaacuaaaacauucuaaaauccuucuccccucccccucccuaacuaacugcugaacagcuagcucuguagagugagcagccuguugagcgcaucccuucguacaugggaccguguaacagugggcuuucauggccggccucuucucccggagcaugugcucaagguccauccaugucauagcacacaucagaagugugcucucucuuuuauaauuuguuugguuuuauguguaugaauguuuugccuacgugcgagugugucuacaccacguagauguccauggaggugacaagaaggcacuggauucccuggaacugggaguuaugguggcugugagcuaccaugugagugcugggagccgagccagguccccuggaagugcagcagccagugcucuuaaccaccuagccaucucuccaggcccacgguauuucuuuuuaugaccaaauagcucguuuguucggccaucuguugaagaucucucuggaucguuuccacccuuugaacguugggcuucugcgaggggccaggugugcauuucucuugaguagcuagguaguagugagagugcaaguuuccccuuuuagcagauugcaaaagaguuaagugagguaauagaugcuaaguuuccaggacagccuggcaaacagaauccaagcugagaauuggcacugaggaggcagaagcaggaagauugccugggcuauggagugagugagaugcugucucagaaccacaggaugaagccguaguucuuucuaguccucuucuguuuuuaaaaggcgccaccuacgucccaguggucccucuugguuccaugaaucguggcauuuaggauucauccagcuugcucaggcucuggugcuacuguccaggguuugagacuaugaccccugcuugugagggugaacucacuaggagacuaaggcaagggggacaggcacuaagugauaauguucuccccauccccuuugucacuugucccaggcuccccagagguccagcuuagccccuaagcaucaugucggacagcgaucuaggcgaggaugaggggcuccugucacugaccggcaagaggaagcgcagagggaaccugcccaaggagucaguaaagauccuccgggacuggcucuaucugcaccgcuacaacgccuaccccucagagcaggagaagcuaagucucucuggacagaccaaccucucggugcugcagguaagaggggaucaggcaucaagucuccagcucuguccccauuccuuguggccuuggccuaucauaaccccugcugggauaagaugagaagcccucuccuggcccccagggaaagugaggucgccgaggcugcacuggaggcuugggcccuuaggaagggaugaggagugguucuaguugaccuugaaggugagaagacacaggagcagagguucuggggggcagcccagagcacuugcuuaaaaaugaauugagugaacugaggagaugacccagggguugagagcgcguccugcucuuccugugcauccgaguuccggccucugcacacagcgggcagcucagagccuucuguaaccccagcuccaagggcuucucgccucuacaagugcacauaugcccauggaauuuuuuuuuuuuuuuuaauuucuugauguaaaagagaaggucuuuuagccgucgagcuggagguagguagacaagccggcacacgccugugaucccagcccugagaaggaagaggaggaggcuaguuacacauuccucucugagccugguggaacuguuaggaggaacgcauuuuaacuggauauaaaaggaccuuugugaaccacauugaggggcacacucgagacgcuuguacuagaaguugugucucuuuucaguuguccugccgaccagcagauggguuugcucuuugcauaaugcugacaccccacccccaccccaccccccagcgcucugggucuggguuggcucucagcuucccuaguuuaugcaguaggcccuuggucuaggccagagaccugcuccuggcuggcuggccucacugcuccuuucgugagccagcaggccuccucuugcuucucuccucuggccugucuaccaucucuucaacccacaagcuggcuccuuccucccguuaccucaccugauccugcgacuuccgcggcuucccacuucuguuccuccuucccggaaaaggcacagcaaguggucagccuauaaaaauucugugaccucacucuacacccuagacggccguaaacccaagucugucuugagacggggucuagacucaaguuauaggaccugauugucagcccaacuuuuucacaagaggacucuggaucuuagccagucugcuacuguugcccugagccucauuuccucaucugacaauggaaagaggcuuggagcauucucaacaauuuaaacaccauuuggggugcucugcagcauggaacauuucacauuuaauuccugggcccagcuccuccuacuaggauacuuucaaggaacaucuagcccuggggugugggguacagauggauuaauacuaagacaaaccaagagggacaagggaacgcagagccuggggccucuuucaggacucccuggaaggugucuuugaacuuacgugcucuagaggcacauaggcagaaacaaaaggcugagaguuugagaccagaacugcacagacagccuuugcuggucccccugccuccagccuuuuaucuuucagucacggaaguacagaucagaucaugugacacauccucggaugggguucagaauucagagcacccucugcaguacuuccuggggcuagcccuugguuaugacuauccagggucaauccuggccuugguuuguuucacucucaucgagcacuugucucuugcaaacccugcuugcuguuuggggcuauugcaguacaucccuauggcuccucacacauguccugucaagcuacuugucauacaguauugaaauuucuucuugucagggacacuauuucucaaaacugagaaauggacugaccguuuuuuuaaaaguuggagaaugggcugagugguaaggcccugacuggccuagcgcaccagggagcaggguucuccagcacugcacaaaagagcuguucuguggcccugccuccccucuccaugcuaacuuuaaucauaaaugugcauuacaaacauaaaacugaguuuaaaacguuuauuuuugcucuuauauauagcuaucagaccaguuuuccaaaguaaauaaauuuacuguagcguauuuugcccccugcuccagauguguaguuggacaugaugcaucuacuuguacaggccagagugaaaagagaaagucaaaauguccuugcagagaccagugagguuuacaggaccauagcacuucagcauccaaguauagggcagggaucagccacuagcguguacagagaacuggagacaaguggggaccaucuggcacucccuaaaggaucccucacaucagccucagcagcgcacccacuuuucuugaagacucuucaggcaccucaagugccugaguggaaauugacagcuccaguuggcccugcccuuucucacacuccuuugagaucuugagccccuguacacauuuccccuccauguuauggaauauaagguuuugguuuguuuguugagauaaggccuugcuguggagcccuggauggcauugucucauuaaaaguuguagcugccugcaccuuucagugcugggccuaaagguaccacagcaggggcuugucuguauuguuguuguuuaagcuuuguuugauggguguuuuuuguuguugcuuuuguuuguuuguuuguuuguggcaggucauccugaccugauaguccuggaacucucuaugaggaugaccagacuggccucaggccucuggccugcaauucacaaagaucuaccugccucugccuccagggugcugggauuagaggugugugccaccaugccuugcuggaaugcagcuucuugauuccaugcuuuucccguuaccaacaucaccugucacuccaggacaucaguugccuguuuacaagucugucucaucucugacccucaucccugcugugggcucuugauaaccagaucccuuacucugaccagggaaccccaaccucuaaaggaaucugcugcuuccacaggaccugggcaucucuacuggacccggcaguaggaccuuuagcuggcugcauuuagguggcacagaguucuguggguaugggaagcagagaccuuaguuuuguuguaauugcuccacuccagguguuuuuuaaaaucagugucugccaggaaaggaagacacuggaaagucauugcaacugcagaaaaugaaauggugguggaaauguucgaugcuuugucuguauuuaguuucaaauuuuccuuugcucuuaaggacauuuccaagcucucccaccaagcuacacugcugccccaaaggaagaacauuaaaugaacuagccacuggcccgacagguaucugcauuaugccaagcugguuucgucucccuggggcaccucuuuugauugugucuuuuuacuugcccuggagccaugucauuagcaagucagugagucauguguuugcuaggcuuuguccagggccaggcaauugggagaauaaggcaccuccucuucccccaaaaaacaacaaaauuguauuguggaggauuggcacgguccuugggacugucaaagccuauguuauugauuggauucaucugguuuccuguuacaggacugcccggaggguucugaguccauuucuuagcuuccgccccaccugggcugcacuaggaggguucugcacuguggugaaggcagucagaacugcgccuccuaaguccuuuucugacauuccugagcccaccagcugcauagcuaauccccugguuaggcccuggggaagaaaggaaccuggaaaggcuauguaggaguggccugucccccuaugcaggcagucacuguauuuacggccuguccuguccuaccuaagcugagucuuccauaggcaauaacaugucaccuauccugcaaggcucuccuguguauuuucugagugucugugugacgcuguugucacagaccuguugguacucagcagaacaggcuagauaaaccccuguucuaaaucugaagagcagcucucuagcgaccuuguuuaaaagcaugcauugccagguggagguagcagcucacaucugugacuacaggaggaucaccaccagaucaggucaaccuaagcuacagagacccagucacaaaagaaauccaaagcuugccaugguggcacauaccuuuaacccuagcacucaggaauaauuggaggcagguagauguuaaguucccagccagggcuacauagugagaugugagauccuaaucuaaaaaaaggaaaaaugagaugugucuucgcaaccccaguucauccuaccugccuagaauccauagagcagauugaaaauagccacuuuaacagauuuuuuaaaucccucccaagaacuagggaugaaacugggugauagggcacuuaucuagcacacacaaggcccugggucagucccuaguacugggacagggaaaagugagacccaucugugauaaagggcugagcaugaaguucaguucgcagaguacuucccuaaucgucagagcucugcggguccccagcacugcauaaaucuagggguugcucucucacccccucgggugugcaguuuuaugggagaagacagagcaguagguccaccacagagucugugggacaggcugaguguggaggcuguccugggcuagcugcccacacagcuggcagcugcuuuccagaaagccgccuugcuuucuuccaagcuacauucaucuccaacuuugcuagacaagucacuaaaaugguaccuguuuccuguucccaccucacagccagagggaagagaaagaggcacauggcuccuauuccaggugacugagggagguaggaagcaggugauagguggugccugugguggggggaagggccuaaagccugcccccuccugcugucugcucagguguagccuucaaaccugaacuccuagugauggccacuaccucaacaguggagagcgucaacaaaaccgugucacgauaaagauuaaaugaguaggguggucgggagcuaaaguuuuguguuuuaagugaugcuuuuaagauuaugagaauuacuuaaacuguccuuguggcaggaaagggaagauggagggagacucuagccaagagaucagcuugugaaaccagcuguguaccccaagguagugugacuuuaggcaugucucuucaucucuguguucccccuuuguaagguuuuggggacacugccuaugucucccagauuuguguacagauuuaacagaauugucgacaaagggguugcaagacaccaaugucacuucugcuuccaacccaggcagcaguucagcuccccuccccacuuuguaaaggacccagcuagaacuccagccaguggcugcuugugugugaaaguacugaggagaagagagagaaaagaaucccaggggcagcccucuuagagcuggaucggagacgggaagaggagccacagcugccucugucagguuagcuugacagggcucuucuguaggauuuguuauaauugcagcuggcugcugcuuaucagucucuaucaugacagguaucuugucucuuugguuagacauggcggagaucucaugagaagacuauacccaagagcuugcucaagaaauguaccaagaaagaagccuaguacuagucagggcuggaagauggguacaagagccugggucucugaucugagcaggcuguagagaagucugaggcauugauugcugcauccuucuaaggaagaaggcuucugaguguucuuuuuccuacagcagcugguacuuaguccaggcuuggaacacgucugcugaugaacuaacaggacagaaggacggaccuagggugugaaacuugucaaaccacauggucccagcugaggacuugucccccgccaugaccucuuccguguugaaguuuuuguucuuggaccugggguuuuuacuggguugcuuucucagccuaggcuccugaguaacaaggaccacacagacagacaacacacguucacaaccuguccguucaggaguccuugcguuuaccuguuugaagcaggguuuuacuaaguagcccaaguuggccucacucacacuugaacugaucuuccuaccucagcagccucccagugcuggaauuacaggugugugccaucauagcugacuucauuaacucagcgacccguuagcauuuguuuuuuaucgcucauaguugcagaggcuuggucugggauugcuugcucauuguuucuggccugguuaugaagcaauggcauagcagugugcuggacaguggggaagcuguuuguggccaacaggaagcagauagagauggaucucauagguuuauauacuguuccuuccuguuucugggcauguccugguggucauucaccuguuuguuuacugccauugcauaaccagaugaugucagcaccucagggcagggcauauguuaaaaggcggccccagcaagcaccagugacuggccugaagcauaaaacaacgaugaauaagaagcccugaaagaagaguaggaaaaugugggaggcucuaacucaacuguuucagagacuucauaagcuggccucaggguccugagacagauagggugagaagugaccaucuggguccugccaggugagauucugccuuuugcaaggcugagcucuaaguguguucaccaggaaugcuggagauggcccaaucauuuuacagaauaaaaguaggaugcacugugcucaguaaguaguagcuguuagagagcucggcacuggaggugcaaagccugugucuugguccaucaguaggcaagaaguguuccaggaagaagggagugugcuauguagaagguguauguauuagguguagcguucuuuggagguuaaguuugguuuggaguuauuuuggaggugggggggguugggauggguuucucuguguaaacggcccuggcuguucuggaacucacucuguagaccaggcuagccucaaauucauaagagauucaucugauucugccucccaaguggugggauuaaaggcaugugccaccuuccccccucaggguuuacauacccaaagccuuugccucuagagugcugggauuaaagacuguccuguguuuuguuacuuuguuuugaaugagcagggccuaaaagcaguugcacagcugacagcaaaagagcgggaaggaacugggucgggcuggaaagguaaacugggcaggaaggaggggcuuagugcccuggcuccuuaucuggacucaagacuagugguaguaggaaacaaucagccacggccuagccguaccacacugagaacagaagcuggaaagaggaccgaaagagagcugugaagccaggagugaacucggugguaaucgcuugccuaacaugagcagggcuguggguaaacccucaacacugcaaagacgguggacacgugggcacaggggguuaggccuguucccauccuacacgcaccgugagcuuugaagcauacacagcauacagagagggcugacagaccccauggcccuaguguagcuuggaagcaaucucuccucucccugguagccccuucgguaucucugugucucuggucuguagcugcucuacaggccuaagagugagugacuaguuuuccuaaacagucaaacauuuuccucccugcaccuccuuaaauauaaucugaacuaccaucgccaucccaucccccaauucuccgcauaauuggucacuccuuugcuuagaacucuccuaugggacuggugagaugaacugaggaucaaugacgugauccagagggugaaggugcuaccugccacagaggcuaaggacccacaagaugaggagaggaccaacucccacaagccguucucuaaccucuuugagcacaugaugaacaccugcguacacuuguguguucaugcccacaugggaggcagaggcaggcagaugaauuccaggucagccugauccacagagugaguuccaaaacaccucagcgauacacagaaucccuaucucgaaaaaccaaaauauaaagccaagcacgguggcuuuuuuauuuuuuaaguuuuauuuuauuuauaugaguacacuguagcugucuucagacaccagaagagggcaucagauccuuuuuauagaugguugugagccaccacgugguugcugggauuugaacucaggaccucuggaagagcaaucagugcucuuacaucagugagccaucucuccagcccaagcaugguggcuuuaauccugggaaucagggagaagaagcauuugaggccaccuuggucuacauagugaguuccagaacagccagagcuuuacagugacccugucucaaaaaaaaaaaaaaaaaaaaaaaaaaagaauaacauaaaaaucaguaacuuguauggcucccuguguucauaguaaaacuaaauccucauccuaagaggugaccucugauaaccacacugcgccaagccacacaugucugccuucagccuucucauagggacucuccagccacuuugcaagugugaccucacugucuagccuuggcuuucacagaacuccuauuuagaccaggcuggccuugaacucauagaaauagguacaucugccucugucucuuaagauuucaauugaaaacuauucccuccacccuuccacuggccggcaucuugucugagauguuugcuucugucuuggugucuggaacacuaugagcauuuuguaggucuuuugaaugucguuaacugauaaauaucuuuaacacucuuucuagauauguaacugguucaucaaugcccgucgucgccuucucccugacaugcuucggaaggauggcaaagacccuaaucaguucaccaucucccgucguggggguaaggccucugauguggcucuccccaggggcagcagccccucucugcuggcugugucuguuccagcccccacuaacaugcucuccuugucugugugcuccaugccacuccacucaggccaaggugaaaagccagcagcacccuucccacaaguggagcuggaaucccccaaggcccuggugaccccugcuagcacacucacccugcugacuagggcagaggcuggaagccccacggguggacucuucaauacgccaccacccacacccccagagcaggacaaggaugacuucagcagcuuccaguugcugguggagguggcgcugcagagggcugccgagauggagcuucagaagcagcaagagccagcgccaccuuugcuacacacuccgcugccuuucgucucagaaaacgccaaguaggcaccugcucccggguggcuugagguuccuggcucacugcccuuucaugcagaggguuauccaaguacggaucacugccaagcaucaggaccauucuguccaguccucagcggaugucgcugcgcugcacuguuacggggccuguacucugcugagugccauuccuucaagcguccucuccgaggagaccaaggcaccagagccaggcaugguguugcugcugcuccuccagagagcccugggacaccugcacuccagccugcuuuccuaggcaggcucaggaaagcugccaaguccagacuugagcuggguccaagccgccccuaagcugugccucuuuuggucgagccaggugugcacauuccaaccuauucaaaggacaaaggaaaugcccagcagaugucacagaaccgacuccaguugaauguuuagauuuuugcuaaauuguuuuauuuuccuuuugcugugguuuguguuaaugcaguagguagcccagaagcacagguguggggagagagcaccuuacacgguggguggagcucgguaaguggguaaucuacuucccacaggaugguuguauagggaccagcagauucucugcaguggugcugaguucagacuagagugguuguuuaauucuugguuuggucuucccuauuauaaaagacagaaggaaaauauccacaggugguggguuauuugcaccagacggucauuuagacacagcagagacagaugacaaaaccagaggcacacguguuucuauugucgugguuaagcuagagugaaacagcucuguuuuucucucuguucugaguaacuccccucaccccaccccagcgacccccacccugcaccaccuuuguagcuuguuucggauuuauucuggagcuuggcaagaaugucgugugccagcaucuacuugggaggagugagccaucugcuggucauuaggcccuucggaaagcugcuuguucacagaggcagcuggaaccuuccuggaggagaggcugcugaggcuaccgacuggcccaccucccuucagggugggauugcaagggccugccuaaauuucccggggaaacagaccacacuuggucuuaaucucuccccuuuucccguuuacuuugcuuaguuuucagcaacaguauaccccaucuuuauauccuaagaaacacuaauccuagauuuguauuaaccaaaauacuuguguucugaauaaccagaagaugugaggagcccugacuguggucugagguucacccgggugugagcacagacggggcucuuggauguugacuggcuuggagugccuguuccgaggaaggcagagaccacucuggccuuuccagggagccccugaggcuuagcaggcuuccauaccucuccugagugacuucacccaucccuugcugugcaagugggcgcgagaauggcuauuuguaaggggcugcuucccugggcucugccucaugccucccucuggcuuccuguccuguaggagacccagcaggcucaacucucugucacccugaggcacugcugggaagggaacauggcuucauugacuuugugguuugcccacugcuaccccaccugucugugagaccccaugauggcuguaggaugcuaaggcgggggugauacuaggaugagggauuucuuuuccccccacagugcacugagcaagggaggagggagggagccaugcugcugacauauucuggcauucccccuccugggauaaaacagggcaucagaaagguagagcggucucugcuuagguugccuguaagauaaauguggagaagcacgguugucccauugaacaauauuugagcaaaaaacuacuguaaauaacugguuuuugucuuuugucaaauaaaauuguuuugguuuuguuuauguuuuaaagucaaacugaauuuuuuguuguuucuuuuucaagacaggguuucucuguguagcccuggcuguccuggaacucacuuuguagaccaggcuggccucgaacucagaaaucugccugucucugccucccaagugcugggauuaaaggcgugugccaccacugcccggccaaacugaauucuugauuggaccuaaugugcuuuggaaauaaguguuuugguuuugguuuggcucuuuuuuuuuuuuuuuuuuuuuuuuugagagacaugguuucuuuguaggccuggcuguagaccagacuggccucaaauucugagauccuccuggcucugcccacaggugcugggaucaaaggcgugcacccgucacugaguucuaacccuaccuuaccucugcugcucucccucuagcccccuagguguugugcaagccuuuccuggucugcaucugucccgucaagcacugucuacagggaugcauucccuguaagccuggccaguccacggacuacagguagacuuggagaacugccacuuaggaggugcaguuuugucccccaggugaggagaagcaucauaucaggcggauaugagagacacaccugcuuuagccacagcucaaggcaagaagaccucugcuucucugcguugucagccuguaaauucccauuugauuccauucgcuguggguguauuuugccacaucaugauuauaauuguggcauaaaguacaaacgacagcaguagugaccagcucugcugugugcaugggcagugcucaucugugucuuacacacuuacacagguuacccacacccugagaaaggcaacugagugaggauuuagguaacugaacucagccaguauagguauggauuuaggacuuuuaagugucuugcuucaaggucacugagagacauccaaaacccaguuaaaguagugguaagcgguuuaccacuaacaggcauccaguuaucuuuaacaucaaugugggcuaagcacuuccacaaucaaaucagcuggcugcauuuuuuuuuuaauuuuuuuuuuuuuuagauuuauuucauguguguauuuuacuuguaugccaccacaaguuagaagaggguguuagaugcccuagaauuguaguuagagaaauuacaagccaccaucuggguucugggagccaaacucacguccuuggcagaaggaacaaguguuccaacugcugggccaccuccccagccuucguuugauuugguuugguuugguuugguuugugauaagugucuccuguaugcaucuagucuagccuugaacuccugauccuccuguacucuuucauccggggucuguuaguguccccuacagcucaacaguuaggcccaagacuuacaggaauagguaaacucaaaagagguuugcuuuugcugggcauaguacacagguccaguguucuuggaguagaggcaggaugaugagagacuccaaggcuagccuaggcuacacagcaggauguuaugccaucugaaagguaauauucugugugugguuuggaugugaaaugucucaugaaggcccuacaguuaaaaaaaaaaaaaaaaacuguugcaaacugaugggcuuuugggacuuuuuuuccaggacauaagggcuuuagcugacuagucauuggaugaguuuauaauugaggggugugggaaaguggagacuaagggggcacuaagcaggccacuggaugggugggugugcccuagcagaaccugugaagaucgcauuccuguuucccuccccuucccuguugcugcuguaagcacccuuucuccaccuuaaaccucuaggcaagccuugagcuagcauaaaccuucguuccuuuacauuauuucucaagggauauggucauggugaugaaaaugugacugauacacccugaaaaagagaaguguugugaggguuccacuuuguaaagagaaauggcuucucuaaaugaaacccuaaccuuuucagagaacuaaaacugaaacuaucugccgagagcuaaagcccuagcccuguugacagagugaaugccuggcguucacaaaguccuggcuuugauccuagcaccacucacucaaaugauaaccagacaagccuguaucucagaacucuugaagagcucaguguaugaaugcacugcugcagagcuugauggccugaguucaauucccaggaccccugugacaaaaaagagaagugacuacuacaaauuguccuuuugucuccucauauguagagggguacacacguauccccacaugcacaaauguaacuuaaaaaaacuuuuuuuuuuuuuuaaguucaagauggucuucagcuauauagccaaguuggaggcuaccugagauacauaaggccuggucucaaaaaaaaaacaaaaaaaaaacaaaaaacccucagaagcccuagguugauaauuagcuugaauuuacaugcaagugagacugaugcuucuuguuuuuaggacagagucucaccacguggccuaggcuagccucaaaaucagggcacuuccgcaucaucuccaggucacuccaccugucuguguguguguugggaagaaggguuggggaucaaaccagagacuugccaccuaccagggacacuacaagucagcuagcccccagacucccaaucuuaacaguuacaagaaagaaaaaaggucucggguugggaaagauggcucagcaguuaagagcauuggcucgucuuccagaagaucccaguucaauucucagcacccacauggcagcccacaccugccugcaacuccaguuccagggguccaccacacagacauaugcagguaagacagcaaugcacauaaaauaagaaagaagaaaguucuucccugaaucuugugacuucuuagcccuccugagggucaccuuccugggacuuuccacuguaaucccuacgcucccauuccuggacuccacaucacagacugaaccaaaucugcaugugcuacccaaguacucuucccugucuuuauucaccgaauaacaugggcgguggcuuccccaccguacgucagguugcugcaauccaucaguguguaucugaggccagcuccaacuccacugcaagcagcugucagggacacgggcggucggucuagugggaaggaaauagucuaauggcugaggccauguuugacuugcuaaaauccuaaaaccucacaaagacaaauugugcccuacuuccaaaucugacuccuaccuccaaaccugacuucaucaaguucuuagacuccaucuuagaccacccaagauguuuauuuuaaccagauggaugcccugggauucagccagauucuucacuuccuaagaaagccuuucgagaacucaaaaaggggacaagucagucucccucuuucuaagcuagggcuuacccagcucagcuucaggggaaaccagaagcacagaccggguuuccaguggaucuuaacaucuaaguuguugaucaccgugagcuacacggcaggaucccagacccucccaaccuucauaaacuugccugacuccuaugaaaaaucaaaauuugauaaauuuaagacuuaaaguugaggggcugaagagauggcucagcaauuaaagaacacuaacugcucuuccggaggucuugaguugaauucuuagcaaccacgugguugcucacaaccaucuguaaugggauccgaugcacucuucuggugugucugaagacagcuguaguguacucacacacauacaauuuaaaaaaaaaauuaaaaguugaacuucacaaucuauaacauaaauaguugguggguguuuuucucuccuguaaaagcuacuugcaggaguucugggcugggugggcuggugcaguucuguaauacuugcacugggggcuugcaggcaggaaacccuggguucaaguccuauuacuacauaaaacuaaccaggcaugauagugagaaccuauaauccuggcacuuggaauagagaugugggaggaaccaaaauacaacaucauccuuugguugguugguugguugguugguuuuuugagacaggguuucucuguguagcccuggcuguccuggaacucacucuguagaccaggcuggccucgaacucagaaaucuaccugccucugccuccugagugcugggaucaaaggcgugcgccaccacgcccggcuaugaaaucauuuucaaaaaaaaaaaaaacuacacaguuaugccgggcaguggugguacaugucuucaggaggcaggcagaucugaguucaaggccagccuggcuacaaagugaguuucaggacauccagggccacacagagaaaccccgucucaaaaauacaaaaaaccuacaaaguuacagcgguggcacuggcaugaaaaaagacuccuuuauugacuaauagacagagaacccuaaaauaaaugaacccuuacaugcaugaagauggucagauuauucucaagaagggcccgagggcaauguggaaaagacucuuugggaggggacugggaucuugauaguuguuucaacagauagaguuggaaaacugaaaaucuacaugccaugcaaaagaaugaaucagagcuuucacaaauacacagaaaugaacucuaaauaaaugcgaaacuguggcucaguguuagagggcuugcauagccugggcuacacccugaguuucauuaacaccaagaaaagagcaugcaaauuuuauccccaauuccugaacuccggcggcuaagccguaguggcgcacgccuuuaaucccagcaaucgggaggcagaggcaggcagauuucugaguucgaggccaggcuggucuacagugugaguuccaggacagccagggcuauacagagaaacccugucaccaaaaaaaaaaaaaaagaaacagggucucuuuucuuuauauagcccuggcugucuugaacauauuauguagacuaggcuggccuugaacucacagagauccaccugccucugucgcucaaguacugggauuaaaggcaguuccaccugaaaaacaacugaaugucacucugcagcucaggcuagccuugaauucuugauccuccugacuccaucuuccaaaugccagauuacucaaaauaugauuaaucaguccuaaguacgccacaugagcacaucugcacaugugggcacacacucagucaaaaauauacacauaaauaaauaaaauaaacuugggcgauaugagacagggucucacuauguaguccuggcugucucggaacucgcuguguagaucagccugaccuuaaacucacagagauucaccugcuucuucagucugaugcuggaaccacacuuggcaagauaacuuuuuaagagcauacacaggcuggcauggugaggccugcuuuuaaucucaguacccugaggaaggagacacagcugaaacuguguaaguuucagaucaaccuggccuauauagcaaacuccaggccagccaagggcucuauagugagauccuauuucacacacacacacacacacacacacacacacacacacacacacacacacaccacacacacacacacacacacacacacacacacacacacacacacacacacacacacacacacacacacacacacacacacgacuggagagagauggcacagugcuuacgaauucuggcuuaggaacacacacacacacacacacacacgacuggagagagauggcacagugcuuacgaauucuggcuuaggaauucaguuccgggcuggacagaauuaagagcacugauugcucuuucagagguccugaguucaauucccagcacccacaucauggcucauaaccauauguaaugggauucaaugcccucuuccugugugucugaagacagcaacagcauauauauguacauauguguguguguguguguguguauauauauauacacauauauauuuguguauacacacacacacacacacacacacacauauauauauauauauacacacacauauaaaauaaacuuuuaaaaaagaaaucaauuccaagcaccugaaugacugcgcccaacuaucuguaggagauaugucgcccucuuaggcagcaggcacacaaaguggugcacacacagacacacacacacacacacacacacugcaggcaaaacacccauacuauggaaugaaauaauuauuuuuaaaaagaaaagaacucggauuuagaguaaaauaaacccaacuacuaacucaaugauuccaggcaaauuacuuugccuuuauaaacucacugcauaaaagugauguuccgggcuggagagauggcucauagauuaagaacacuagcugcuccuccagagguucuaaguucaauucccagcaaccacaugguagcucauaaccaucuauaaugugaucugguaaccucucuucuggccugcaggcaaacaugcagccagaacgauguauacauaauaaacaauucuugggggguuuuucuuuucuuuuguuuuuuagugauaucccuuagcauagcacauccuguguggcaccaucuggaggaugggacugauuuugcucauuugucuguuugaggcagcaucucucacucuguaugcuagaccagcuucgcuguguaacccaggucagacggggcacgggaucuuggaauguagccaggccagccuaacauuccuccccggguuuggacugcagacgagucacaguguacaccacaacgugucuuuguacaaguucgcagggggugcugcuccuucuguccuuucaaaacacauccugggaagugcuaacaacacacagugaggacgggguagcuagcccgacaccuacuacuuuucuauucccccuagugggguucuccccugguuucaacuugccucauccuuaggaaagaauuucucucuugggaucucagcuucacauucggaucucagaagagaacgcugagcaagaggagacguuaggguucacagaauuguuuuuuuucccguugagacagguugucgugaccggggacuuaccauccuccagcagguagacaggcuugcaccaucgccaggcgagggaacuuugguuugguuuuuguuuuuguuuuguuuuccauagucaugaacaaagucgugaauaacguguagguuuaggagagaacgcacagaagguaacuccaguggggcagcccagggcuuccggggaccaaggacccggcucgggaggcggagcaggaugcaaggccacuucuucuuugugucgcuccgggggacgagccgcggcucagccggcaaggaaacguacaaucucggcuuuccucggaggggcugugccucagucuucacagcgccuccucgcgcacagaucgccuccgggccgcacuugucccuucucgcucaccguccccuggcguccgccggaagcuucugucacuuccgcccaccggaggggacgcucgcgucgaggcgucgccgagcuucggagccgaccgccgcguggccgccgauuggcugcgugcgcacgucauc

SEQ ID NO: 1224 - RNA, 13898 nt, Mus musculus
cuaguauugaaggcauuuuauuacaugauuuauauuuuuuuuuuuuuaagauuuauuuauuacauguaaguacacuguagcugucuucagacacaccagaagagggcgucagaucucguuacagaugguugugagccaccaugugguugcugggauuugaacucuggaccuucggaagagcagucgggugcucuuacccacugagccaucucaccagcccccacaugauuuauauuuaacuguuaacaaagcacugaacugcaaguuuacccucaguacauauuacuggcuaaauuaggaaacauugccaauguucuauaaaugacacaaaaaacaaagccucucucauaaagcugugaauaagcauaaaccaugcuuggagcucaguaccacugagacaggccaacacaaaccacuggccuagcagcugcuguguagcccagagccugcaacuccugacucuagcuucuacuucuuuagugcugagguccaaguuuucaugcuuuguuuuuuaaacguucuagucauuuuuaaguugaagacaucaaacacauuuuccaucuucaaguuugaacacuuauaaacaaaugugaucggauguaagaaaauggaggaaggcacagucaccuuugaggaugacugagcaaagugagaugaagacauguuccaaagucuaucugcucuugaaacaacagucaguaauaacaucuuugauucucaaauacaggcuuucuuggaagcugucugguuuccuucuucguucuacucuggacaguaucauucuaucuuugauaacuagguguuaacugucugggcuuuucuaugaccaccccaauuuccaaauaaugacauggaggcauaauuauuuauuuaaccaacuuaauccacuuuaucuuuuuguauagaaagacuuauguguagccacagcuggagccuggguccucugaacagaucugguguggguuuucacaaggugaucagugaauuccugauaaggagacuuguugaacaguuucuuuccagaggucaggggucaaguagcuguaggucauggagggggcaucaaagauggccuugacagaguugcccaagcuggcagcgcagccccuggcugaagugcagcagucaucuauauuggccaccaucaggggcuucuucagcacagugcagagacacugcuauugccucugagggcagggaugagacgcaccagcacagagccacagcagccugucaccuagcauggaacaguauacagcuugcaaacacuguugccccaauagccucucugcacaggggugauggagagcuuggccaaaacgauggucccucagauggcaguggcuaccuccuuggaucaccuaaagccaacaccaaugucacgugaccacuguagucuccaauagugacaaaaaccuugagucugguccguuggccagcagagucugcgucugcacuggcaggaucuucagaacuucauccuuuagggaugcgcccaggaaagagucaauaaucuuggauuccuuaaugggcagggagaacaggcagaucuccaaggacuugaucuucaaguucuuaaccaggcggcccugcuuggugauggggauccguuccuugucuucaacuuuaccuccaugauccucaaggucucacagaagccacugcagccucuaauccugagccccuggguuuuccccaagaagcagcuauagugaugcuuuuggccucagcuuaggcuaguuccccagcuagcucuuaacuuauauuagcccauuuauacuauucuacgucugccagauggcuggucaccucuccucaguuugggugagguugacacuuuggguggcaacucuccuguaccugacuccuucccagaguuccucuuucuggauguacuacguuaguauccagccuucugcuacaggcuacaggcuuuuuaucuuaaccagucacaaggugcuuuuuaggaaggcaaggaagggcagagacacacugucacauaguguacacuucaacaacuaggcaaaacuuguaaguuuauuucuaauccagacuuuauguaucugcuugaguucuccaugugguauuccauaugagauaguagcuuucccaccucauuaacuacaguauacucauuuuauuaagucuucaacaacaaacuauaacauuguucuaggcuuuuacucuuuaaacaaauccucacaguguccuuacgacauagauucuaacauccaucuaauguucgagauaagagguuaaauaacucuaucucagccccaggaaaugacaacacacgguuuuuaaauaacacgccauucacuaacagaacuuaaaaaaaauauuaaaaaccccaaaauauggggacuaaaggugcagcuucuugagggugcuucccuagcacccacaaagcucuggggucaauucuuagggaggcagggguaauucccaaaggaaaaaauuaaauuggcacagccuuuucuugucaugaauuuagauuccaggaagucaauucaauauuaaaaacuaaagcacucuacagagauuaggacacuucagaaaaugggcaugcuguaaaguguccacacauacccguuaugugacaacauccuauaauccaccuucagucccacacucacaaacuuuagcgucagucuuuuauggcaacaacccaccuuggccucuaaaacauuuccuugagguugguuuuagaugucucuggauuauuuuaugggaugaaaagcgcugaccaugaggauguuaggagcaacggacgacugguucugaaggccauuuugagcaucgugcacaucccgacaaaaaguguccuuaacacacucuucuggauacauacaugcugucacucggcaacagugaagugcuguagagcugggacauuccagcugacugcugugagguagggucccugacaggauccucaucacugcguggaaggugagcucuggagggggagcuugagcaguuuccgagcaggugaagagucuaauugguccauacuucucuucucugcagaggcaagaggccaaaagauacauuucauuaaauucauacaaaauguauuggacagugugccagacagugaaggguaguaaaugacacaugaagucuuuguccucaaggagauggcagucuagcaggaaagcuagcacggugugacaaauaagacaguggcuggaggaaccacugucccauagccaggaaagcuauaggagagcauccacagcuugacuucauguauccuugaaaacuaaagcuaucaaaaaacacuggguagcuucauggagugcaucuauggaaucuacaucgaggcauuuccugucaucaauauuugacuuccuacgggaaguauaacaagucuaaggacuucugucuggaaaggcaguuugcaucucaaagguuaucuauccaucagauagagccaacccucagccgugguccccucaaaggaugcacuuacugagcuguacugacaccuucuggagguacugaguacucucauccaugagggcuugcagcugcuucacugauccuuggagcucauccaucugcagaggaaaggucagcaugagcagcaguacucucugacuccccgcacuaccaaacaagcuccuguuuuggggcuuguuucagccucaaaugcuuaugccagacauucucucuuggcaccgcugaaacauaccccacacgucuccacccugcucugcaccccaggacacugacccccaaaccucuacccacaagaugccaggcccucuaguuuuguuugacuguaagggcaaagaagcugcuagccacuguaugcaaagcagcaggccugcuccuccuguauucucuacuccuucuacucucuuguuaguaucuaacaucauauauuuacuuuaaaauuuucccgguuuucccaaggaagagagguuaauauccauuuuuuaaaccuccaaagcucaccugcauuuggaguaucccugagggcuacacuuuaaaagguuugguugcugcuacuuaaguguuaccacggugagggaugggccuuuagagggagucuaggaucuguggagucugaccuugaagugacuauuaguuccuucccucuuuuucuuacccaucaccacgaagggaguaauguccucugucacauguucccaacacaaucuacugcaugaccacagguccaaaucaacaggauuuaagcaaccauggacuauaacuagcaaccaaaauaauccauuccuucuuauaagucacuucuggucuugucacaaugucacaaggcuaaaaaagaugacgagucuagaaagcaagguaaucaaccuaagaagccugaagcgccuuaccacuaacuccacguaggcaaagacuugguucugaucuuguacuauucucugguagucuggcuucgugcuaagaacuuccuucugggaagaccugagguaggcugcaggauccaccuugacuucagugauucugguuucaguugauccucuaaaaacaaaacaaaaauaaaagccuuuuccuggaacuuacaaucauuuccuggaaacaacauaagagagccuuugagaggcaaacccuguuccccucaaaaaucauguuccucauagccucuuuacaucacaucuguaauuaggagcucaccuaacauucuuuuaaaaauuuguuuuauggacaugaguacacuguagcuguuuucagacaccccaggaggcggcaucugaucccauuuuagaugguugugagccaccaugugguugcugggaauugaacucaggaccacugguucuuaacagcugagccaucucuccggcccucucaccuuugcaguugagauuuagcuggggagaagcagcuuucaaaugacagcugaaagguguguggcgcugcacuuguaacuccagcauuaggaagccgagacaggacgacugugaauuugaggagcugagacuacccaugacugccuugggagaccguauuuuaaaugaugaacaaaacuaguucagaagcuaaauagacaaaaaucuagugcuuucccaccucccucaacuuaacuaccaaagauggccucucacaccuucuaccucccgggccacuucccucauggcugucuguuuucauuaaggccuuaaccaagggacucuccuagcuacagcucaaaaaccaugugcucacuaaggaauccugaagaccauuguuggcacagaaccaggugaacaggugcaagacggcuaugugcccgucucccugaagaaucugaguggugaccaaaaacacgaccugaaagcaguucuguuugggucccucccuuuccaccaagaacacagacacuuuaaguugacugaaguaugaaaacagauucaacacucaaucuguacgaauggauuugaaagaaauucaaaucaaacuccacaggguaaaaagacagcggcuccuuuccaguucccggaucuaaccugggcaucucuucagguggaaccucguucugguacugcaguaagagccgaucccaggccugacgcucuaaagaaaaccuguggaauucgagaagggaaauucgguuaacuuucggucacauuuguaaucauucagggcagcaguaaguacuuuaggcacauaaucugguuauaaaauucauuaaaaggucguuaaaggauuagaaagcucaacugauucagaggauauuaauuuaaucaaguaauacacaagcuguuaaaaucaaauuaacacccuuauuuccuagacuccacccuaucaaacuguccaucagggcuggugauaagccuugucacuucuaaagcagacacacaagugcugcccaccaugugcaccaggcaugcucuccaggcucggucauuuccuuuccacuuacuuuguuauauauucuuucaccucagcuacugaugcuuccagugaaaaaucugcugcuuuucuggaauauagaugauauuuugagauuaauaugaauucucuaucaaucacucgcuuuucaugaguuacauaauuuuaguagcacuaaaauauauucauaguuuuuuauuguucagaaaauguucgaugggcagugguggcgcacgccuuuaaucccagcacucgagaggcagaggcaagaggauuucugaguucgaggccagccuggucuacagagugaguuccaggacagccaggacugcagagaaacccugucucaaaaaaccaaagaaaauguucuugggggaggggggaauaauacaauaucuacucugcacucaaaauagcuaaauaguuuuuaaaucuguuuuuuucaccaauucccauucaaaucauggagauuaaucuuucucaaaauaguucuuuacucuuccuuccuaacuuuaaaaguccaugacuacugcaaagagaauuaaaggcaaaccuauuaacuugguuuuuaagacuguguuccgguuccucacaauguagcaaucucucauggcucagcucaauuagaugaugaucucuaacaggaaagaagcaggacugaaacugccgaacuguggaagacauacgcggcuuagacaggguaacuccugucugucuaccaaggcaugugcacagggucucuagcaaggaggcagcagccugugcuuauuaucuacauaaagagauguuguugggcuaaaauaucucaugucugauuagaaaugucacucucaagaacuuguggaagggggaucuugcaggaauuccaaauucagauccagugcgugauuuguuccaggguggaguuagaaguugugacagcagccucacccuugaaggacuaccaaggggaugguacccuauuaacauaaacucuacuuauuauuacuaauguuuaugugugcacaugcacacguguacgugugcacaugauacaguguauguagaaguaagacgucaacuuucaacgauaaauuaauuuccuuccacaagggaggcauaguuaaaaaugaggucaacagcuugugcaaugagagcgcuuuccuauccccacugagccauccugccagcccauucugcuaauauucuugcuugcaaagagcauuagaauaugagcuacccucugcauggcaaucagagaccugaggaaugguccccucaaucuuuccacagcugucacuuuucacuccccaggucuuuuguguuucaguccuagagugaaaucauuaggguccucuuucaacccucugucauuauccuaccugcugacuuccuggaguaucacuagcugagacugaauuuucuguguuauuuccucuaauacaaauaugacaaaaggacuugacuucuuaucucuauaucuccuuccucaucaucuagaagagccugguacaagccaagcauggcaguuuauaccucuaaucccaacacgugggauguagauguagaaggauuaccuaaauguuaaggccagucuagacuacagagacccgaucucaggaaagcaaaaauaaaaaauuacagagcaugguggaacaugggugcuggacaaacuuauguaagcaauggguuaacuauaaucaagcuguaacucaguuauacuuaaggacagaaggggaacugcucuuacucuuuugaaucuucaacaaaacauuuuugcaguguuccaucauuucccagccugucuguaaaauguuucaauucuucagagagagaagaugcuagagaaaauaaauuuauguuauaaaauagaaaggccacaaauguucacaacaaacagaugacaaagauauuaagggguuuccuagucuagggucucugaucccauucuggcccucuuucagacaaaacagucacguaaguaugcaaagacuuuauuugggggguuggaaguuuagcuccauggcggagaacuuuccuagcaaguucaaggucuuggguguggcacccagcaccaggcaugguuaugauggauuaauuaguaauggccccaugggcuccuauguuugaauaucugguccauguugguggaacauuuuuggaaugauuggggggcuguggucuuguugaaggaggugugucugugaggguggguuuugagggccaugauguuuuaucacaguaauagaaaaguaacuauaugugcauggcgggugggagggggcaggggagacacaaauacaaaaaaaaacuauccuuuucucuggguagagagcuaaaugggcggcaacuguauuaaguguuuuuaauacucuacucaugaagaagcaguuaaacauaagauagcuauacaauuuuacuuuuuccaaaaaugugaaugcuaucacuguagagaaagcaucacagaagucaggcaacagugaagaauguagugauaaggagcaauuuuuaaugagguggagagccugguuuuaacaucauggcugucuccaaaggaaggaauggaaaggucagagaccugucuaacuuagcaacucaccuuucgcucuaaaacauucaaggcugaaguccuuaguguucuuuaagaaagguucaaguuuuucaacagagaacuaaguauuaaaaaaaaaaaaagcacuuuuaguaaaaccaaagucucccaaguaagcucucuguggcuucaugcuacuaugaacuuuaugauaaaaacuacagagccggggcggggggcagggggggggggccgcgagugcacgccuuuaaucccaccgcuugggaggcagaggcagggcuauacagagaaacccugucucgaaaaaccaaaaccaaaaacaaacuacagcaccuaacuuuuucauccaacacuguuuauacagauaaguauaucaagaaaaauucucuguugcucacucuauauaguuuuaaaauauauuuauauacaauuguuuuuauuuacauauuacauacuuguauguuuauacacauacacacacacacacacacacacacacacacacacacacacacacacacguaugauauacuuuuuuguuuguuuguuucuuggagacaggguuucuuuguguagcccaggcuguccuugaacucagauccaccuguaaggcaugcaccaccacaccugacuuauguuuugauuuuuaacuuagggaaaacaauggucauuuaauucacacaaaucacuugcucacccaaacaguccaaagcaccaaugccagaaaacaacuuaaaaaacacuggucuaccauguagcuagccuucaaaugucuacagcaauagaucuugaccucucacucugaauucccaccacuugcugccaaugaggaaaugguacuggggagccucucagcugcuccgcuggcagcagcagagcucagugcaaaggccacucagcugcccaggagagaacugccagcgcgggaaggcaucuuaucccagguucaucacucagucugacaucucucugaaguugugacaauuacagacaacaccaaaugaaaacacuuaaugaucccugaaacucuuaccuggaagcuggagagcaggagggcgcccagccguuggcucugggcuaacuucacacugauggaccugcagagcucugacauagaacagcacguuuacugaucaucaaaguuagucagcaaaacaagacugaaaaaucucccucuccauguaacccagcuuaaggcaagcugccuucugaguaagaacagaauucuaauuuuuccaggcucacugaggaaugaaguucacacuuucauguacccaaauuuucaagucuuuucaaguauuacauuaaaaucuuauuuaacaaagugguugacaauaucguagugaaaccuauugcuuugaaugucaauuaaaaaacaaaguagagccgggcaugguggcgcacgccuuuauucucagcacuugggaggcagaggcaggcggauuucugaguuugaggccagccuggucuacagagugaguuccaggacagucagggcuacacagagaaaccuugucucgaaaaaccacaaaaaaaaaaaaaaacaaaaacaaaaacccaaaguagauaaaaauaauuuaggccaauggugguggugcacgccuuuaaucccagcacuugagaggcagaggcagguggaucucugugaauucaaggccagccuuaucuaaagagcaaguucuaggacagggcuacacagagaaaccuuuucuuagaaggcauuuguauagcaggcacggcaaugugcuuuaauacauaauccaaaagagcuauuuucugggguuggggcuguugcucaaugguugaaaccucgccuugauuguacguagacugaaucugacccucagcacugaaaaguaaaaaccauuucauauaaacaacauaaguuccacuuuacaauugaagaaauucaaucaaguaaggaaaguaagacugucugaagacaggcugaagaagccaugcuucaaacccaaguaugucagcaggguugguagcaagcugccuguggggagcuaacauuaauagccaguaccagcucaacaccugcuguauaacagacauuuuucuuuccugcuaggcacaucucacuaaaauuuuaaggcaaauaucuuuuauuuaauugggcuuuuuuuuuuaaacacagucuugaaauauaguccaggcuggucuuaaacuccuggcaauccuccugcauuggacuccaaagugcugagaucacaggcaagaagggccacgccugguauggauucuguuuugcuaacagaugguuaacacuggggcauggcccacaggcugcuuagacucuuugcccaagguuguacagcaggucuugcgcgaauggacugggaggugcuuuacaugaucgugugaccgacccagacaacuggaagauggaccugcucuuuucucaaugacauccacuuaaaaaacaauugucagauaguaggaaguuggcuuuaagaauucuugcccuucagcugaucgucuuucuggccauaagcaaggaagucuggcggguagccagggauuaccaggaaaauuauucaucuuauuaccugggugaucugaugcucugaaaugggagugaagguagagcuaguaauggacaagccagcacucuccuggcacagcuggccaauagagcgcauaacacuacaggagcagguuuuggacuuggcuauuuuaacucagauccccuccagauaugcagccacccgaaaggacagugauucguaaagagaaaucccaauggcuuuaacgcuugagggucugcuagcugccaagggugcgaguacuggggcuuauugccccagcuuacugaggacuuaauacaaaggacaugaagcccaggcucaaacuagacuuucuacacuaauauccuguacuuugauccugacauaucaagugauuacaaaguuagaaaaaagucacaaauuacauucaaauauggcaucccuaaaaaccauuuuacuguuucuuuuuuuuuuuaguuuuggggacuaaauguggggccuugggcaugagagauacguaccucaccacugaacuacauaaccuauccccauuuaauguauuuuuaugugcaucuuccuucugagucauuucuaguuaaaaaggcuagaaucaagcagguuaucaaccccacuggccuucugucccaucuuagggaugagacacagagggaacucaaaucccuagcauccuagauaggaugacguguuaaauaacuagcaaccaggauuucuguucauggcagcuaauauguaaacagcaguuaauacugaacacgcauucgguguguggcacugggauuuauaaacaagaauguucccacagagucaucuccauuuuauagguaaggaacugaggcacaagaaggugauguguucaaagcugcaggacuaaaacguagccaagugcugucuaccugcuacacucucugacauucaugucuugcugccucuuagaugggcuagaaauccauccaucgcuuuaugaacgcagcaucccaccugugaugccuggguggaagggagccaaugacuuccgccgguuuacuucuuucaugcuugcucgucuccaggacugccuucugucuugaggacggauagacuguucuugaggggacaaaugaaaggaccucaacugagaucccuccugguggucggcaccacaacuuucccccucuccaggguucgagccaaggugguuuuuuuccucugaaacgccuugcgucaucauuuccugguaggcagaggauugaggcaaugcuuccaaaggcuugagacuuggcugcaauggacgauccugagucucggacaucguggguuccuggucuagcauuuguuauagaaaagucaaaauauaaaaucaaagcuaccucagauacaaaccucaguaaguauccaagccaagggugacaacagaaaaugcacacgcccacuuuuuaacugcagcaacuuuaauauauaagaugguauacaguugaaggaccagcuuccuaggagccuaggcagaagggaaggaggacggagggaaaccuauuucccuggugauggaaaccuagagaaggccuuuuuguaaacccacacacgugugauuccaaaggcaccaggagccaaggaggauucugggauaguucaggagccugauucccaaagcaagaggcauugaauuucacuguaaaacucaccuucugaucuggucacugacgucauccuggaugaaggaggaaaacaggaaaaugaggagauccguucgagcuccagucucacaggggccucacuaucccauaauaggucucaugcuucaggugcccucacuugccuccuccgagauucucagcagcaagauuacuaucacugacugcugucuucaagaacucggucuacagaaccuaucuuagcuccucacuuugugaggcacuagcccccaguuccguggaaggucuuaggaucuuuguuuuccaaacgagaaaacaaacaaacaaaccccgcaucacuucuuacucucuccagauuuugccauggcuggaaauccuacuuuuuaaucucugcccacaucuguccuucuacccauaaaacagagucauccuccucccuaacucugcuuaaauacgcagucacuucucuuuggcagauuuggaggccacacaucuuuccucuauagaacugguuggagaucgcaccacauccccauuuccagcaccugucacagaaaacagacagagaggcaaggucgaguauccaucccgccaccuugcaucuaagucucccucccaaaagaccgcugaauguggaggacgcuugguaaaagcgaauggaggcugagggaccauacugaaaggacaaagacucuaaagaucuaaaucaccacaauccucgugggugaucacacagacuccagcuuggauaacagacauugaagcgcuucugaggcuguacacgugacagccuucugacgucauuaucccaaucaacaacaggucccacaacucugaguaagggacucuuucgggagacccagguucccggggcacagcaguguaaccccggcugccaccccagcccuccgaccugucccaggccacuaucuggagucaaggacgccagcagugcccgggagcgaggaguggccuucuuucaggcguccugucaggagaaagucucugagcccccggggcccugcggcugggagcggccggugggccgggcagaggcgggucaggggagaaccacauccgggucccgaaccccagcgugacgccggucuagcccagcuccccuccccgcguuccugaaccaguaagcccaaggucaccucugcaaacucggcgucgccgcagaagguccucucccgcgucaguccgguucgggguuccccgcugccuccgcuacuuacgaaacucccgccgaacaacugcgcgugcgcagccuccgccuuccgcgcuggcucgcgcaacccgugccuccggcggagcgccugcguacuccgggauuua

SEQ ID NO: 1225 - RNA, 37739 nt, Mus musculus
ggcgcgagcgccccggggaggccacgcucccagggcugauguccggggcgccugcgcaguaggccuggaggcuggcaaaacugaauggacucacuuuugggguguggugucagugcggcugcgcgcgagccggugccgcgguacuuaacuucgcagccccgggugucggagguagccaugcagagcgcacccuuggagcagccagcuaagcgaccccgcugcgauggcagcccaaggacgccaccgagcacuccuccugcaacagcuaaucugucugcagacgacgacuuccaaaacaccgaccuccgaaccugggaaccggaggacgugugcuccuucuuagagaaucgugguuuccgagagaagaaagugcuggacaucuucagagguagcgggccugagggacgaaggauggccaccguggggccgagcagggagaguccacaugggaggcauccuaagggggaggucucugggggaagcggcuggcgggaacccgccgcuggagaaggaggcgcccugucgggaugcgaacacacgggcuacccgaggugggcacaggugaagugcaagcccaucgguucacucugggcggcgaaccuaguagaggcccagggagguuugguagaagggucuuuucgggaacuugucacuucugccaggagcgauccccgcccuucuuagaagauuuuaccccagaccuccggcuguggcuugcggucuuucaggcucaccuggcuugggagacccuuuugugcuaaccgcagcucccggaacacuuggccccaugagagauuuugagcgcuuuuaaguuuaacucugaagcuggucccggaauuugggguuuuccuuaaaggggagggaaggugcuuaaucucuggauucucacugacuaucauaauagccuaguaggguucaguaugugcucauuguauuugcagagugcuacuaagggaauuucucuuccaacauaagagcaaguuauucacugaaaccccaacauuccacaacuuggccacucaagaauuuuaagaauuuuaagggaugcuucugguucuuggucuugcucccgucaacacuuugaaucugcucaacuuuuuuuuuuuuuuuuuuuuuuuuuuuucuugguugguggcugugaagcuuaaccccuugcaugaucgauccccggagguguucgcuuggaaaguggccccuccgugguuaugauuuucaaauucagugaacuuuacuucuugugggguggagccccuugugccuaacugaaggacugacuuuaagaaagcuuuaaaagggguugcggauuuagcucagugguagagugcuuagcaagcgcaaggcccugggugcgguccucagcucugggggaaaaaaaaaaaagaaagaaagcuuaaaaauaggaacucacguuucucuuuuucucucccucuacagaagaguaacuuugggggugggggugggguaagacagggccugucuuauguagucucuauagaccagccuagccucgaacucagagauccaccugccucugacuccugaguacugggauuaaaaguguaggccaccacaccuggcaagauuucauuuuaacuauauauauauaguuauauauauaguuauauauauauaguuauauauauauauauauauauauauauauagugcugggguccuugaggccagacuggagugacuccaugauggaguugcugccacaggggugcugagaacugaagcugagccuucugcaagagcagugagugcucuuaaccauggaaccaucucuucuggcucuguuuuuauuuuuaguuauguuuuuauggggguguugguaggggguauguguaugaugaguacagugucugucacagugucugucgaagcuguaagagggcagccaacccucuggagcuggagcucaggagcugugacuggccuaacuaaagugaguguugagggcugaccucacuccuccccaagaacagugugugcccuuugcugaucagccaucucucuagccccagaugauguuuugauaaccaagauguuaaguaacuuuccaaagucacauuauuagacaaaaaaaaaaaaaaaaaaaaaaugcagaguuggauuuuuuaaagguuaagucuuuggauucccgaauucauuccaguuauuucugaaaugguguucugacuaaaaccuucuugggaggcugaggcaagacaggcaagacuucagguuccagucucaggucuucagcuguccuagacuagauaaugagaucuuaucucaaaacaaaacaccauuggagaacaacauagccaaaauuagaaaaucaacuaaggcaagagaaaaacaucuagucaguagaaaacgaaguggggcuggagagauggcucagcagcuaagagcacugacugcucuuccagagguucugaguucaguucugaguucaugguggcucacagccaucuguaaugagaacugaggcccucuucuguugugucugaagagagcaaugguguacucauaugcauuaaauaaauaaaucuuaaacaaauaauaaguaaaaaagcaagagaccauugacaaacaaccacugcaauacuaauuuuuaaaauacuggguuauaauuuaauaauuagaaaaaaaauguuagaugaaauauguauaaccaguaagguugauagaagugcccguuaggucaacuaugggcuguuuggcaaugcuuuuugacuuacagugaauacuuauggcugacauuuauuaugucuguacuuuguaugaaggacugcuauacacaucuauaagccauuuagggagggguaggcuuuuuuguguguguguuuauauggaggaucagacccagggcuuuguucauguucuguguggacugugccacugagucacaccccccaaucagucaguaaccaugcaagcaugaggaaugguguucugaauucuaccacccacacaaaaaguuggguguaguggugcauacugauaaucccagaggugagggggcaggagaaagaaaguuccugaggugcuggccaagcacugucucugaaauguauacauaaacucacauggguacacguacacaugaauaaaaggugaauaaaucuuagaaaaauacuggguagaggaggaaggaaggaagacaccugacauugacccccagcucccaacaagcagaugcacagaugugcaaaugcacccguacacaagcgcgcgcacccccccccccccaaauggauuccgauugguauauauuguagaauacaaaguaucuacuaagaaagauacaggcuuucaucacugagaacuaaguuuaggcuauugggugggaaaaauugguuauaugacaaucuuucuuauauaaauuugcaucauuguauagagauacaacuguuaccucacaguguuaagcaguagguaucaguuugcacuuaugugaauugguauuugcuacgugcguaauauuauuuggacuuuuuaccuuggguaacuuuuucaugauagaaaaaaaauacaaaaguacuguuuucacuccaacuuugauuuuucagaagaacacugccucguuuuuucuuguuaauuuaaaaaagaagguuuuuguuuaugugaaaauagaguccagaguuguagaaucugaauuccagaagagguagaauuaauuaacuguuuggaaagauaaaaaaaaguacauguauguauauauaauucuuuccaaacacaggggauuguuugcuuucaaaggaguuuuagaacuaaaacucuggguacuuuucuucugguuugaaguggaugguucuaagaacaauugauuuaaauguccuucucuagcccugcugccagcccuggcuuuaaaaacaggaagcugcugauuuggcagaacucacaaauauaauuagguuuuacuuucgguuucccguagcuuuugacacaaauaagucaccuagauaagauuuuaaaaguauuguauggaaaguaugguauaggcuggguuuggcagguuaccugccuaguauguacaaagaccuggguuuaauccuuaguaacuuuuuuuuuuuuuuuuuuugauuuucaagacaggguguagcccuggcugucccggaacucacucuguagaccaggcuggcuuugaacugagaaauccaccugucucugccucccaagugcugggauuaaagauaugcgcaaccacuacccggccuuaguuaacuuuuuaaguuuugaccucuggaggccaaccuagcuaugaggcaaaauucucacgcacgcaugcacacacgcacacacauguaugcccaggcauaaugguacaucccuuuauuccuagcacuuaggagacagaggcaaguugauuucuguugaguuugaggccagccugcucugcauggauuucaggauagcuagaacaacauagugagacccuguuuuauaaaccuaaacaaacaacuacauaagggagggagggagggagggagggagggagggagggagggagggagggagggagggagggagggaggacuggagagagaguucuuuguguaggaaugauuacuccaaucuggaguuuagaucacaguacccacauaacaagaugagugucaccuuuaaacacuaguagucccuucugaggugggauguugacaggaagggaucgcuggcaauuacuggcuuccaaccuagacaaaugcaagccccagguucagcaaagagaccuugucucagagugucaggcagauugugguaaagacacucgaugccuuccauguguccaguccuggugcacacauacaacacacauacaaauuaaauauauauuuaguauauuuuagaugauuugugauuuauacuuuauaaauauauacaauaucaaauauaugugucuguauuuuuaaaauggugcauuuguguccuaauaccugaaaaacauuuguucuaagacccaagcauguaacuaaaaucugaugcuuaaguccauuacauaaaaugacaguuugcaucuaaccucuguacacccacaucuguaaacuauacaucaucucugcauuacuuauaauaccacaugaaauguaaauaguuguuguacuguauuuuuacauguuaucuacaguaauguacagaaguguuuacauguucaguacagauguacuuuuuuuuuucugacuauuuuccauuaauaccauaaaugaggaacugguagcuguacaaggcuggcuauagaucacaugguucacuacaguagguucuuaguccguacaagcugagcaaauucugauagauucaaacugaaaggcacaggaaaauacaugcuauaaauaucuuguuuaccuuuuccuuuuccaagacaauaaaaucgccggcucguuucugcccuuuuuggaugaggaucgucuggaagaucugggaguaagguaaggauaaggagacgcauagugaggccagacgcacuuccuucacuguucggaaacaaagcccaagagcuugggguucacccgugcucauuucaguacugcggcaggcuuuaaaacaaucccuugcuugcuguuucugcugugcggggcuugggguuaguuucuauuucaaagagcuuugccaacaagaguucaugaaguuuguagugaccaauuuuuuacucucaaauucagacuaauugaauuauaugcacuagaaauguauaggaaugagcagggaaaacauuagcaagaaaagucaaaguuaccgcccucuuuguaggucuuaagacugucugaggacuggggugugucuuuguguauaaacuguuaaagaacauaauugucccaugauagcuuuguacacacacauauguauauauuucuguauguggcuggagguucuggggucugagguagagaugucauucuuuuaaagaucuuagcugaguguucaguguuuacgugugcuuuaaacguggucuuuucucucuuucauaauugacugcaguuaguuccguguuuguggugaccgugaacuaaggguaaaaccaaagacucauccugaguucugucagauccugugcuuuagaacuuugagaguggaagcagcaucaguagagggucuucacugccuuagaaacuugccugggucacagaguucagggcuuuuacuuggccuuuuucuaacccaucuuaccugucucagucacccaucaauaaccuuauuaccugugaacugguggacuuucuucuuuuuuccucaaagacccaaacaccauugauuuguuuagcgauguuuaugggaaguacauuugguucuaggcacucuucugggaguuaacaagagaggcgaauccaaaaggaacacuacuuacuguacaguggguuucuuguacccugccuucugccucugagauggaguccauggggcuuuuuagacuuguguuagccuguacuguagccaccuguuguuuguuuaaguuaucuaaaauuagauuaagugagggccagagauguggcucggagguuaggagcacuuccuguccuagaggauccccaggucaguucccagcauccacaucagucuccuuggcagcccguguguguaacucugucuagcucuaugccuaacacccaccucuggccuccacagaggccacucaugggcucagacccacacgcagacacauaauugaaaucuucucauugugaugaauuuaaaauguuuaguucuggggcuggagagauggcucagccguuaagagcacugacugcucuucgaagguccugacuucaaauaccaguaaccagcaaccacauguuggcuuacaaccauccauaaggagaucugaugccuuuuucugggaugucugaagauagcaacaguguacuuacauauaauaaauaaaucuuuaaaaaaauguuuaguuuuuaugauacuaucuacauaucuacauaugcauaggcaugcgugcugucgaccucacacaaggcugagcaagacccaccugccucucugccucccaaguacugggaugaaagcccuuugcugccaccgccuggcuuauuucuucuuucaucuuucccagucccccaacugcuguuuccaggcucuaugcucccaaauaaauuuccuguaucuaagcucuugcucuggacucugaguuuuauguggcauccuguuuagacaaacacuuuuuguauuucuucaauuuuugauuaaaugccgauuucugaagguuuuuccagaaaguaaacauuguuauauuaaaaaugcauaugaugauggcucauccuguaauccugguacuugggaggacggugugaguuccaggucagccugagcuacacacuaaguucugggccagcuuaggcuauggggaucgcacacacgcacacgcgcacacacacacacuuucuaagguguauuaauuuuguuccuuuuuaauuuaucugcuuaauaaugucucuguacauucugaaaaaaaucccuccuagauuuuguuauugcuguggauuucaguacaacagaggccaauugugauacuucagucuucagucaccuaagacuuuuagcaaaaguuuuuuucaaccggauuacauaguagcucagucagggauacuaaugccuuccuccugcuguuuguguuaacauuucagacagguguguuuauuaugcuugaccaaugagcaguuacaaauggagccggauguuauaagauucugagggguccaaguccaauuuccaugagauuaugucccgagcuguaacauuguagauaguggaaggugaaguacuaaguuaacccuuccuagauacuaguucaugcuugggugauaacucagcagaagccuggguggaccuucuugguucagaaggaacuucuugcaagcaggugcaacaaagcaccaaacuagaucacuccagagguaggaagacaguuuacugggggacagauugcugggcugcgucugagaggagagagcagcaggcagccuggcaggaaagcgaguggguuucauaugagcgucugaagggcgugguccuugagcugaugcagaccucuucugcuuuagugggaacuagacacacuuugcccccaucagcugaccaucagagacagagauggaaaguagugacucucaugacaaacagaaacccacacugagaauucugaggaauguggaguugagcuuucuuuuuaagaaucuggccugggccaucauucuaggacuuugucagcagcauugacauuucggggccuucuucgugaccuagcacuccuuaugggaacaaagaaaguuucuaggagugcguuugaguuccugacugauuguuccuucuaagcugcucuuucuuuuuauuggugcagcugcuuuagaacugcccaugugcucccaggacaccugggauacuuauuuaucaaggauugauauaucuauuuacauuguuucaauuuuaguuccuuggaggagaggaagaagaugauagaauguauccagcagcugagucagucucggauugaucuaaugaaggugaggagugaguguaugaacgcauuuacuguacauaauguaaugagggugcgaggaaucuauaugaacagcauuugcgugguauaaacgggagaugauacuguauuguaacugaaaacuuugauuugauugcagucucuaacacucugaaacuuccagaccccaguuaauugcuuucuuuuaucgguugccuuugucauagcaauagaacaguaauuaggacaaacuccagcagucagguguacuguuauauaccuuuagucccagcauuuggaaggcagaacuggguagaucuuugaauuugaggccagccuggucuacagagagaguucuaggacaaggcuacacagagaaaccugugucuuagggugucauugcugugaagagacaccaugaccaugguaacucuuauaaaggaagcauuuacuuggagcuggccuacaguuuccaagguuuaguccauuauugucaugggggaugguaugcaggcaaacagggugcuggagagggaguugagaguucuacaccuugacccuugacagcagaaggagacugugugucauacugccuauagcuugagcauaugugagaccucaaaauccacccucauaguaacacgcuuccuccaccaaaguuacaccuacuucauuaaggccacaccuauuagugccagucccuaugggccaagcauuucaacacaugagucuauggagaccauuucuauucaaacuacauccugucucaaaacaaacaaacaaaacuuugauuuaugauaccauguaaaguuugugccugugugugugugugugugugugugugugugcacauguauguacaaguacaauagcccaaguguggucacaagacaaguuuugggagucaguuuucucccuccacuauguagaugcuagaaauagaacuuaggucaugaggcuuggcuuuaaaugucuuuacccacugagccugaaguuugcuguguagaccaugcuggccuccagcucacagagauccacgugacucugccucccaagugcagggauuaaagacacauaccacacauccagcaaguuuucauuucauuaauuaaauguuuuuaaguguuuugccuacaugcauaucuguugaccaguuuuauacaggaugcccagggaggccagaagaaggcaucagauccucugggaccguaguuagagaugguugugagcucauguggcugcugggaauucuuucucugcuuuguuccucuuaccgguuccugacucuuacccauucugcuugguguauacaguagacccugaacaguaauggagcuguauuaucuugguggcugauaacagacuaggaugucauacagcugccacgagucauaaauggaccaugugacugugaaaggagucauaucaaguaauaauaguaaaauaaaaaugaccaccaguuaauacucaacauuaaaggaguacaguuuuuguuuguuguuguuguuuuaguuauuguuuguuauguguauagccuucugccugcacauuugccuccaagccagaaaaggagaccaaaugucauuauagauguuuacaagccaccaugugguugcugggaauugaacucagaaccucuggaggagcagagccugcucuuaaccucugagccaucucuccagcccccaagaaguaguuuuuaaacaacauucaucagggugcaugagcuagcucaauggcuuuggguacuugccaccaagccugacauccugaguucaacucgaggacccacaugguaggagugagccaauucacagguuguccucuagccaccgcuuauacaugacagauacacacacauacacagacccacagacacacauacacacccacacacacauacacacauaugcacacacacacacacacacacacaaaguaaauaaauaaaaagauguuucugaacaaauauuaagagcauuaacuucucuuuaggugagagucuuagcacacacuugguagcucacagcugcgaaacucuagccuuaggcgauccgauggucuuuuuuggccucugcaguuaugcacgcgugcacacacacaaggugcgcagacgugaucaggcaaacauugacacacacacacaaauaggaucucucucucucucuuuuuuuuuuuuuugguuuuucgagacaggguuuuccuguguagccuggcuguccuggaacucacucuguagaccaggguggccucgaacucagaaauccaccugcaucugccucccgagugcugggauuaaaggcuaccaccacugcccggcuaggaucucaauuuuuuaaaaauucuagcugugaaugaaauaaagccauuaaaaugauuauuauauaagaguauaaaguguucucuguucauuuugaucuuaaaaggagacuguauguauuauaauauuaaccauuaaagguaguuuuauuguuuuuguguuuguugauggaggggcacggaugggcuggcguggguguguggaggucagagugcagcuccaugcaguugguucucucucuacuguguguccugggaacugagcucggcaaugcuuacccagcgauuucuucugucugccaaccuaacucaaaagauagcuuuugcugagcucauuuuugaaaaguagcuuaaauuuauuuuguuuuuaauggauuuaggaugacauaaagaaauugacaguaaagguguuucaggcuuaaauggacuaaaaguaggcugucuaauuacuuugacagucuuuaguaauaaaauguguucucacuugcccgugguggucagguggaccuuccauugggaggaauaaguucgcuugugauuaaauaucuagaggucacugagcuugacuauuaauaacuuguaaaaaaggauauccagaggacuucauuuugauauucucaguuccuucucuuccucaggacgguccucaucaccauucccugaguauuaauggugaugaacuugguaugguuaacaaucuucaaauggcuuuauggaggaugaacggcguuacuguuccccaagcaccuaugguguaaaacacaggcaaacaccauuagcguaucaacuuuuucuaauuuuaauuaacuuucauuaauguaauuaagucacuaaagugauuaucauauaaaaauacaaaacacuguugauuuugauauaaaaaggaaacuguauuacaauguuaacuguuaaagguaguuucuaaaauuguauuuacugucucuguguaugagugauggagacaugcaugugccagugugagcauacagaggagggcagaggacaacuuuuuaaacuuaauuuuccagguauuuaaugaucccauucauggccacauugaguuccacccucuccuuaucagaaucaucgacacaccucaguuccagcgacuucgcuauaucaagcagcuggggggcggcuacuauguuuucccuggagcgucccacaaucgcuucgaacacagucucggguaagggggaagggcagcucauuuaaucucuuagcgaguacuuuuucaagugcucauugugccgucuucauuguguugaugggaaaaucgagacuugggauucccguugaccauauuuuguuuauuuuaugugugugugugugugugugcgcuuuuaaacuaccucauauccuuccgaaaaccugaugucuguugauacaucaguuggauuaaauacuuacauugaauagggcugguugcugguaugacugaguguuaaguuucauuaguuuuccuuuagucccuauguagucauuucauuucuuuggggacaggggcucccagugggggcugaccucaaacucagugucuaaucuccugagaaccaagauucuggacaccaugccuggcuccuuuuuauuguauagaguuaccuuuuuaaacaaaguaauuaugucaggaaauuuagagaaaugcucaucagcuccgagagggucgucugcugugugcaaugaggcuaagacuucggucugauuuuccauuauguguguaaggcugggagaagugggagagaauaauugagaguucaguauuuggguuuuuuaaagauuuauuuguuuuacguauaugaguacaccguauaccagaagaaggcauccgaucccauuacagaugguugugagccaccaugugguugcugggaauugaacucugaacuucgagaagagcagucagugcucuuaacuacugagccaucucuccagccccaguauuugauuuuuuauuuacuuugugguuuucgcuuguuaucuaggcuuuuccuuuucuuucuuuguuuuguuuaggguuucauuaaauagccuagacuggccucaaacucccaaucccucugccuuagcucgcagaugcacagauuacagugugugccacacuguccagguccaguagacaagaugcguguaccuguacucaaguuauaagcaauauuuauugaacacuuucuagacccuuccaaggcacgaacaaguugucugccuuccuaaagcugaguuacagcaacggaaaaaauauauuucuucuuuuuaggaauuccuuucugggagaagugcgugaaagugcauuuaacauuuuuuaugccguuuguuuauuuuguuuuugugugcuuugcuggggauuagacccagggucuuguacauacuaguugggccuucuacagagccacucccucagcccccgcuaagcccucaucuucagucuguguuggaacaucaaggagacacuucucagaaaucaaaguuucaaguucuaaagguagcuuucaucuuucaaaccucagugugacguuuggucuucuucucugcagagugggguaccuagcaggcugccuggugcgagcacuugccgaaaaacagccagagcuacagaucagugagcgagauauacucuguguucagauugcggggcucugccacgaccuagguaagauccuaacaaugucucucgucucagcauucaaaagucaagucuaaccaaaggaaauguagaaguauuuuucauuuuucuuuucuuucuuuuuuuuuuacccccuuugguuuuuuaagacaggguuucuucauguagcccugccuauccuggaacuuacuuuguagacaaggcuggccucaaacucagagauccgccugccucucccucuagaguuaaaguugugugccaccaccacauggcaguauuuuaauuuuucauuaaucacgguacuuccuaauauugaugaggauaaaacauugcugugacucgugaauuuucuguauuaagcaucuuuaccaugucacacaaaaggcauuauucauuuauuaauuaauuuaugagauaggguucuuacucuguaacccaagcuggucuagaacucgcccaggcuagccuccaacucuugacaguccuccugcuuccaccuccugcgugcugagauugcaagcuugagccagugcugggcuagaagggccuugugccccgaguuucucuuauucugucuuuaggauaaugggaugugauucaccuuuuauccugucguugacuaaaguggcuuuuccuugaguuucuuuguuaaguccaccucuucucacuauuagcacggguuuaaaacaauguucuuccccgauucauaggaggucuuaggccaauuaaacccugguagaagaauuucaucuuaagaaagaaagaugacugccugaccugauuagugacaggagagugcgugugccugugcuuccauggucagagccugaaggagccgaguguagaacacggucuuucugucagccccgagggugcaggaggcuugguggcccuucuuagaagaugcuugguucuuguaugcuuuucgguuuuggcgaucagacucaacuguaggaccuguauguacuaggcauuggcucucccacugagccgcaaccccagcccaaaauaaaugaaccuugacuauuuuacgaaaaacucuuuagcauuccuugucauuaauacaaaacuggagaccaauccaagcaguguuaacuuuccaauauggccuugccucuuagucuguugauuuggaaaauugaaaggucagguguguucuguuuuuauuauuacuaauuauuauuauuaauguauacauuauuaacaguagcuguugauauucaaaguaaacaaaaauuuuuuaacuuuucaguuuuuaccaauuuauaaauauuuuuuuuauuugaagacugcuuuuguuuuuaggucaugggccauuuucucauauguuugauggaagguuuaucccacgggcucgcccagagaaaaaguggaagguauguauugaugugucgcaaaguccauagaaagaaguaguauuuuaucuaguuauucaacuaagaucuguuuccuucuguguguuguagcauccuucccugggacagcauucagggugcuucuguucaugggucuguguuucagcccucacaguagccuguggagaaaggaccuuaucuucuguucagagcccucagaagcauagagaugugccugacuucacagggucauggagugguggaccagcccuggagagccagcuccccucuuucaaugcaguguccguucuacucugucagauuacuguagacuuuguuuucuuuuaaagauuuauuuauuuguucauucauuuguuauauauacaauauucugccugcagaaucagaacucuuaggcaucagcucucauuuuagaucguuaugagccaccacguggcugcugggaauugaacucaggaccucuagaggaguagacacuacucuuaaacucugagccaucucggcaaccccuaggguuuguuuuuaaagcccagcuucagcuuucauuuugguaauagccgugaacuuaaguaucgucggucucaguaacugagcguuuguuuuaacacggggucuuccuauauaguucagggugacuuuguccucuguucugccucagccuccccaaugcugagcguaugguacacccucacuucaggcuuuaagcgaacccuuuauaauuacacauuuacuggagaugaaccuguacauuuugaagcaguuucugagaaaugagauuggcuucccaguuucuacuacccuuggcauagaaaagcgcagggacgcaagacgaaagcuccuuacacgccaagcccuuuguucucugcccucuuuuuuuuuuuuuuuagguauaauuugcauucaauaaauuaugcagauauauguuguguuguuuuuauucuaggacaaggucucacuguggagaccaagcuggccuugaaacuguugccugcuucuguuucuguagagcuaggauuaaaggcgugugcuaucuauccaucccuccuggcugaaacugugcagagcugaucugaguuuggcaaguggggauguggaccauuuucaucauuuggaaauuucccuugugucaggcuuguuuucugugaugcuggcgaucagacccacagcagugcacacacacacacacacacacacacacacacagcuucaccucucuccucuuagaugugguaucuugguuucccuuauacuaucaaagcuguugcaaauaugauuuccuguuguuugcacuucgugggggggggggcuuaggggggcuuccucuaauguuuaaccauuuaaaaaguugauaagugggcuaagagcaaagguuagugggagaucccuugacaacaauugacuuguuagguuugcuccccggcacaguacagucauaagugaaugcucuuuugugccguauaaugauuuuaagauuccugcacguugauggcuucuuacugcuaagauuguauccuaguguaugagccacaguuuguccuugcuucuuuggaugaacuucauguuguuuuggauuugagcuacuacaucucagguugcugugggugaugcuguauaacagcucuguggaaauaucuucuccugucuccugacugaauaccugaaguagaauuacugagucauaugccagauguuuacuuaacuggguuuuccagugugcucuacuuuacccgcucacaagcagcgugugaaaaucccagaugcuaguccacaaccucacccugugugaauagauagcucuuggcccguccccuccuacuuuuccucccuuuuaacaccugcuugcuuuuggccgaugaacaguuagggaguuaguuguccaggguuuauaauuucuuucucaagcaggacugaucuaauaggaucuaggagcuacucugccguuauuguaugugugccauguguguauauuugucucucucucucugugugcuauauguguguuugugugugcgcgugccugaugugugugcgcuaggggucaaauacauauguuauacaugugauagguaagugcuguacaacuaagcuguaucuccagccuuuagaaaauauauuuaggggcuggugagauggcucaguggguaaaagcacccgacugcucuuccgaagguccggaguucaaaucccagcaaccacaugguggcucacagccauccauaaugagaucugacucccucuucuggagugucugaagacagcuacaauguacuuacauauaauaaaaaaauaaauaaaucuuuaaaaaaauauauauuuacuuuuuucauuucauacuugaccucauguggaauuaauucuucuauacaaauaguacaaauacaaucuucccuuuauuuauaagaauacuuuuuuuuucuuuuaacugucuuaucugcaguuauagccccagcuuaauaaggauaauguuuuugaauaguagucaauccuuuucucauagaucuaaauuuauuaacacuuucaaacuucccauauauaaugaaucuuccuagauucuguuucacacuuuuuaagaaaauuauuucccagauccaauuucacaggauuuuuaaaauuauguauuuuauuuucuauaaguguugccugaaugcacaugugugugaucacuuucgugccugguacagaggugagaauaagccauuggauacccuggaucugcacuaacggauggugugagucaccaugcuggugcuggagcccaaacccagguccucggcguggauagcagguuuucuuaaccucuaagccacuucuccaaccccaugucucacgcuucccuaauuacuauuauuggauaauaugauuuuguacuucaaacagugauugugugccugaauucacacagugugauccagcauucuccaguaauuacuccagaggccacaaggagucaauugcaagcuccaggccacgcuguguagugaguuuaggucaaugugggucauguaaugagaccuuuacucaaaacagaaaacauaucaucaagauaacauacguugauaagauaucuguuaauuaugaacagauaucuguucauaguugagccaauucaaaauaguuauaggaucauuucagguuuguuuucauuuugagucaguuuuguuaaaaugcacaauagggcggaugucucuggggucauuugaucuuugcagugauugugaugagugagcagagaugggagcaaggaggugagcaaagaggugacagaucugagaauucaguucagaucuugacgccagagcugggauuuugaguuccuagcagugcaauauccuaguagaccacaagguggaagcacuaacaaacagcuuaucacuucaaauguucuguugauggggggaaaaaaacccuaaauuuuagaaugauagucauucuaccgauaugaucugguaauaaucuccuugguaaugugaauuauuauauuuuauaaaguguuauucauuguauuuauggaauaauaaacugguauauaauggugguguagagcgggggggucaguaagagagaaucugagagcgcuucagugagacuccucccguugugcauuuuaaagacuaauaaaaguuguuugugacagggcgugaugaugcaccccuuuaauuccagcacucagaaggcagagacagguggaucucugugaguucaaggccagccuugucuauauagcaaguuccuggccaaccagagcuacauagugagacucugucucaaaaaaacagccaaccaaaugaaaauuuuuuguagacaaguaaaauauugacuaacuuaaaagcuguaacaauguuguuggaaacuggauaguuagcauguggugggacuucaccugagcaggaccuagaauccagaacagccuguuucauuagagcccccgguggcugagaaccuguacuaagccguauucuacugacuucccccagcacgaacagggcuccauugagauguuugagcaucuggucaauucuaaugaacucaaacuugucaugaagaacuauggucucgucccugaagaagacauuaccuuuaucaaggaacaaauuaugggaccaccuauaacaccagucaaagauuccuugguaaguuuuuauuuguguuaaucaaagccagcugguauuuccuaucugaugucgucuggauucuuucagagcuauacauucagugcuaagugucaagauguaaguuucgugcauuugccuucuuauauaaccgagugacguauuuuucccuaaucuugaguccguuagacauuauuuaccccaaacgauaguuaguguacuugggaugcagaagcaagaggaucaaaaugugaauguaugcaccgugggccggagagacggcucaguagugagagggcucgcugugcaagcaucagaauucagaucucucacauccaugucacaagccacacuugguaacagacaccuuuaguuccaccacucaaggggcagaggccaaccuggucuacauagacaguuccaggacacccagcccuucauagggggaaccugucucaaguaaacaaaauaacacaaccacaacaauuuaaaaaaaaaaaaagcauugcuggacacaggcuuguaaccccaacacugugagaggcagaagacacucaauugaccucuggugcaucuuguaugugcacacacacacaaacacacaggagcuagauugaggaacaauuaucucauuucuaaaacaaaaauuuaguuucaaacaugcuuugaaugucuugucuugagaguagcugugcagcuguuuuaaaacccagcuguuuuauaacccagcuaugcuggcacauggcuguugcagucugucccgagaggagggagagaggugaagguagggucuuccucaccuauaaaaugaauucaaggugagacuggguuacaaaagaaaaaaaggggggggagcuggguguggaucucugaguucaagggcagccugaucuauagagugagcuccaggacagccugggcuacagaaugaaaacaacagcagcaaaaucgggaaggagggaacuaagagaaaucuauuaguauauacauacauuacauacauacauauauacacacauacauaaauacauacauauaugugcacacagaaagagggauuucuuuuuuuguuuuucccugggggagggcaggagagagaagucuugcuuuauaggcccugcugacuuugaaguuauaauccugccucagucuucugagugcugagguuauagaguccccacacuuagugaaagacauuauuauuuuaauauauacauucaagguuuaacauuuaaggaacuuuuuuuuacuaguuuguaauuaaauaaacauauuguugguuuggggaaauguauuaguaguguccuuucgauggcaccggaagaccuaacauuuuauuuauauacuuguaaaaaacuuuuuuuuaaagauuuauuuauuauuauaucuaaguacacuguagcugucuucagaugcaccagaagagggcaccagaucucauuacggaugguugugagccaccaugugguugcugggauuugaacacaggaccuccggaagagcagucagugcucuuaaccacugagccaucucuccagccccacuuguaaaaauuuuaaguuacauuuuuacuuaucuguguguguguuguggagaggcggggcgggggggcuacauguggaagucacggacaguuuguuggaguccguuuuaaaaucuccuuccaccuuguggguccuggggauagaacucagguagucagguugggagcaaaagcccuuacuugcuaagccaucccaccaauccuucacaaacuugguauuuauucauuuauuuucacagugccugccauucagguccaggcccucacugauaccugccucuaccuuggagcugcaucccuggcuggaaggcuugguggugauagcacagcacagcacagcacauacuucaccguuucuucuccuucuacuucauuagaagugagaaggagauagaaagaugaucaucuucuaacuugagcgucuuguuuauaauuugcagaucgauacgguugcuuauaaauaggucugucuaccuaaaucuuccaugagauucucuuguuuuccaguggccguauaaaggccgcccugccacgaagagcuuccuuuacgagauagugucuaacaagaggaauggcaucgacguagacaaaugggauuauuuugccagguacgcacugaagacucccagaagcggugguaagaagcuuuguauaaauguagcaguagggccuacacugccuggcccgaagcugggcucugugguccuggcauggacugacacuggcuucaugggcacugugggaggcaaacugccuucccuucagccugaggacgcggggcuccuuccaccccucuuccuacgccacagucacucuuucuucugggugucgggguagcucccaggcuggggucaagguagaagacuaucauuuugaacuaggaaaaauccccuuuuucucucugucugcuuucaucuucaugaucaagacuuuguucuuaaacuuacugaaagauuuuaguaauaagugagaacaaaugccgaccuucuaggagcucaugccucaaguugcugugaacgucaguaccugaucagucuuuuguuuguuuguugaugcauugucucagcauguggcuuggcuggccuugaacucacuacguagaccagguuguccuuagacucauaaaaauccaccugccaccacugccuggcucacaugccuagucuuuuuguuuguuuguuuauucugcacuuacaauuuuauuaugguuuugagacaaggucucacugugcagaccagugaucugccugucuucgccaccugagagaucucccaucaucuuaaaguaaaucucagacuacauagcaucucaucgaaaaaccuaucuguguggcucuguaaauaaagugucucuguuaaaccuaaaagcacucugcaauugcuugaagauuuuuuuuuuuuuuuuuuuuuuuuuuuuuuuuuuugagacagaguuucacuuuguaguccuugcugucuggaucuugcuguguaauucagaccggucucaaacucagagaucuuccugccucugccucuggagugaugggauuaaagguguguuccaucauuccugacuaagauaggacuuaauacauggucaggauuuaaaauccccuagcuguuugauaacugccuuguugcuguuaguuuacaguucauaacccagcacccacacugucccuggugauggcucuccaguccuuuauucucuagccacuccccucacauucuuccaggacauuucccacugacuugccuggcucaguuacacccccuguguccuucaguauauccuccaggcccugaccagccuucugcaagcugguagauccaaagccuguaguguuuguauuuaaggcagcuuccucguugaaaaguuuccuaucucugcuuuggaacuuucuagagacugucaccaucuuggaauccaaaauaauuuugauuacaagcgcuucauuaaguuugcccguaucugugaaguggaguacaaggucaaggaggacaagaccuacauccguaaggugaagcacauuuguucgagagaaaagguaagagcgcauccccagaaaauaaaaaugcaguucucgaucuggaacgugaagaugagcauccagccagcugggaaauuccagaagccaucuuucuuuucuuucauuuccuuccuccucgcaauucucuauuucucaugaaugacuuuuuuagaucaugugcauguguguggucuguguguguguaugcuugcucugcacuccugcgugagugaaugcgugcgaggcugcacucuugcagcgcucucugccuuaccccucacauccaggucucucccuaccccucauguguguuuccuagucaucuucuguuucugucucccucgaccacacccagcguauuccauaggugcugggaucagaacccagguccugaugguugugcagcaaggacucuuaacuagugacauuucucuagcuagccccacauacucuuuauuuauuuauuuuuuuaaagauuuauuuauuuauuauauguaaguacauuguagcugucuucagacauuccagaagagggagucagaucucguuacggaugguugugagccaccaugugguugcugggauuugaacucuggaccuuuggaagagcagucgggugcucuuacccacugagccaucucaccagccccacauacucuuuaaaacaacagcaacaacaacaacagacauauuaucauuuguaguuauguguauaugugucugcaugcguguguaugaacaugagugcagguuccucuagaggccugaagaaggcaucacaugcccuggagcuggaguuacaggcagcuuuacaugccuaacauggaagaguaccaccgguggguucuaccugcuaagccaucucuauagcucuucacaccucuuuuaaugcuuagcaucuaacugucguaacacuuuuuuccucuauuauauuuuucuuuuauuuuuuaaaaguucugucauguuuuaaauuuauugauguaugugaauacacuguuacugucuucagaugcaccagaagaggguaucagaucccauuacagauggugguaagacaccaugugguugcugggaauugaacucaggaccucugaaagagcagucagugcucuuaaccgcugagccaucucuccagcccccucuauuacauuguuaaacaauaacaauaguaauaauaaaauuaaaccccacaguuauugagucuuauucuagguagguuuuaagugcuuuugauaggucaacucaauucuuauuacccuacgaguuaguauuacuauuucguuuguuucagucuguguucuguugcuauaacaauaccugcaccuguguaauuuaugaagaaaagggguuuaucuacuuuguaguucuacaggaaguuuaagagcgugcuaguagcaucugcucuacuuuugguauggaucccaugcuguuccaugcauggcgagagcuggaagugcaaacaagaaugguccugaggagagguagggcaguuccagucuggcuuuauaacagccugcuuccacaaacuaaccuagucacuucaugagaucagagcugugauacccuaauccacucuuaaagggccuaccacucccuuacugcuguuacuuuagggacuaaauugggauaugaguuuugguaggacaaaccauccuuucuauuuaccaggugaacacagugagguauguggaagggucuaguuaaauaauuaacacaacugaaauuucaacccuguuagguccuuacuggaugauacucaucuaacuuaagaagugguauggagggcuggagagauggcucagcgguuaagagcacugacugcucuuccagagguccugaguucaaauccuagcaaccacaugguggcucacaaccaucuguaaugagaucugaugcccucuuuggugugucuaaagacagcuacaguguacuuauauauaauaaauaaaucuuuaaaaaaauggaagugguauggaauuaugcuauaggaaagucuuucuguuugcuggcccuuuuuaaagcucugucauuuuuuauauuuauuuauguauugugccuucagcacucaggaggcagaggcagauagaugucucugaguucuaggaugucugugagauccuuucccaaacaaagguagacaccaucugacccugcaguccuguuucuguucccuuacaggagguuggaaaucuguaugacauguuccacacucgcaacugcuuacaccgaagagcuuaccaacacaagaucagcaaccucaucgacauaauguaaggaugucagugguccuucacugugaaaguuugcagggugcuuugccacauuagcauccccagugcacgcuguauaguagaaaaagguauacuuaaaagaagccuagcauaaaccaggcaugguaucgcacaccuuuggucccagcaucuggaggcagagguuggcagauaugugugaguucaaggccagccuggucuacaaagugaguucuaggauagacagggcuauguagaaaaacccugucaaaaaaggggaaaaaacauguaaagauuaaugugguaguacaggucugugaugccagagagagagagagagagagagagagcgcuagagcucaaggucauuucagcguuucagguauguagcaacuuuaaaggcagucugagacauugucucaagaggagaaaagagcuuaaguaauuuuguuuucaguucagagucagggagagccuuugguucaugguuuaauacacuucuccugaacuuguuuaaaggaaaaucauguuauuucugcacccauaaaauugaggcugaguauccuuauuauuggaaaaaccaaauaacauaaaggccucuaaagcucugcuguccugccuggagcacaguaggugugcaacucaaggccucuaaagcucugcuguccugccuggagcacaguaggugugcaacucaaggccucuaaagcucugcuguucugccugaagcacaguaggugugcaacucaaggccucaaaagcucugcuguccugccuggagcacaguaggugugcaacucaaggccucuaaagcucugcuguccugccuggagcacaguaggugugcaacucaaggccucuaaagcucugcuguccugccuggagcacaguaggugugcaacucacggucauacacaguagucuuucaaacauugaccguaccuuauauguuuucuuaaacuagaaggauccuugugugcacgaugcaaagcaaaucuucaaaauuuccuucuauguuuuuacaaaaugaccucaggauuacagaugccuuccucaaagcagaccccuacguggagauuacagggacugccgggaagaaguuccgcauuuccacagccauugaugacauggaagccuucacuaaguugacggguaagcacucaagacacaauauuuguugcuaccuaauacaacuagauuaauacuaaaaauuuuaaacuaaaauuaaaaaaaaacaaacaaacaaccuugucagcacugagcgcuaagucaaaggcugaaagguugcuaggguaucauacagacucaaacccagcaggucguuaauuaagggcugaugguagauaggaaugccauaugaggcccuggguccaguccacagcaccacacucccccaaaaaaguuuauaguggagaaaucugaggacuaucaccuuaaucaccugaucagguucaacagugcaucguggcagcagcauaggcaggauggcucccugaucugcccuaaaggccagcauuccggcaaggaacuggucuagcucuagauuuucaaagacuaaaagcaugugaccauuaguuuaucuacauauuugcuugguuucacuguuacuaauggugaaaagcuuaaguuacauuauuaagacauguuaacaauuuuuaaaaauaucacuguuaaauuucuuggcucauuuauuuauguuuuaaaaaguaaauguuccuguucuugggagauacauacugcaguguucaaauguuucauuuaaaaaaaaaaugguauucacacagccagaugcaguggcucacacuguccagccggaugcaguggcucacacuguccagccggaugcaguggcucacacuguccagccggaugcaguggcucacacuguuuguuguggauagauuggucuuguauuugaugcuaauuccauuuuccugggaggagcuccaggcagggagugaaucccauccacaggugacuugugagccuucuccccaccuuaacugguaaaauaaaggcuagagcuggugauugggcaguagaaaggaagguggagcugaaaaguuugggggaggaagagagagaggaugacagaggggagggaggaggaggaaggacaauggagcagaagcacgugggcuggaggaaccacaaguuccuccuagcuggggaguacaguagcauagcgguagaucugcccaaucuagucguguagcuuguauucauauuaauugaauuaugauuucuuugcccaggcuuuuugggguuggagauuuaccguaacauuauaccuuuaaacccacuacucagggggauugccacaaguggagaccagccugagcuccaucgugaguucaagcuucucuaagaaugagaccuucucucaaaaaagaaacacaaagcaagaaaauuguauacacauacagcgcuuguguggaaagcgaggaucauaaacucgguugaaggauaucugaauuagaaaaguuguaaagaaaauugaaagaagagauuuuuuccccgucuauugugaucauagaauaaaauauuuuaaaacuuaaaaaagaaccuuuaauuaggucaguuuacaaacuuacauguacuggucacuuagcuucaacuguuacugcacagaaguuuuccccacguaccucuuucugcagacauugggccauuuuaaguagaucauagacaucauuuuguuuguaaauguuuaaggccaucugggacuaaguagcaagauuugucucauuuacaaaaaugaaggccccacaguaauacguuaggcucuguguacugccugcgccagcucgauccguugguuccaaugcacucucaguucaucucacccccuucugcccgugccuucucccucucuugcugccaucuucuuugacucagacaucauaauguuccugccuuauugagaccauuucaggaccccaguggagugucuuuaaauccugccaucguuuuaacgugaaugaaauuucaucacauugacagauaacauuuuucuggagguuuuacacucuacugauccacaguugucugaggcccaaaguauuuuaaggaacauugaaugccgcaaucuauacaaguauuugggugagacccagccaaagcgugagaagauuaggaagguaaguugaaucaccagcaacccuguuguuaguggaggguugaucgaaccacuguucucaagagcaagccauuagucuaucacagcaaccacgucuccuguuuauucucauuuagucuucucaauauucuuagacccauuuaccagauaagaaacugaggcugagcaauagucaauaaauuguucaugaaaggagucagguaggacccaaaggcaggucuagacaacuguaaauaugcccucucaaauucaauaagggccucaaauuuuagauagauccaaccacuggaaaauggauaucuaaggcagaaaucccucaaaauaagacccgugcaaacgccacuaagacucugagaaggcgggguuuuuuugucuauuguugacccuuaagcaaugcugauuagggacacuugacaccaugcagucaaaaauugaccuuuaacuuuuuuuuaaagguauuugagacuuuuuuuuuuaaagaauuuauuuauuauauguaaguacauuguagcugucuuuagacaccagaagagggugucauauguuacuacggaugguugugagccaccaugugguugcugagauuugaacucaggaccuccugaagagcaguuagugcucuuacccgcugagccaucucaccagccccaaccuuuaacuuuugacuguccgaaaacuuaacuacuaaaagucugucauugcucaggaacuggaccagcacugugacagucggcuccuuagauuuugcaugucguuuguauuguauguggccagaaauacagaaggccugggaaaggcgagcuugcugcucuaagcagauuucuggggagaugcugggagagggucacaggggcugcgugcaacacuagucacugcaaaaacagcaggagguagccauagauagauaaaugcaacguucuuucugaacugugaugguugguuuuguuuguuuuuuaaugaagagugcccuguucauuucgaagccagcaggcaguggagcugucuugucgggguaucuauguuuuccuuugccgaagaagagaaguaacgugguauaagugcuuaaugacaaacuggauccuaauugggggucuuaucucuucuaggaagaauaugaacggcuuccccaagaaguugcuaaagccaaaccugaaaaagccccggauguugaacugaaggccgaagauuucauaguugauguaagaagugggcccaagaauagacucaaugaaaauuuguguuuuaaaaaaaugccugccgggugugguggugcaugccuuuaaucccagcacucgggaggcagaggcaggcgaauuucugaguucaaggccagccuggucuacaaagugaguuccaggacagccagggcuacacagagaaacccugucucggaaaaaaaaaagaaagaaagaaaagaaaagaaaaagaaaaaggaaaaaaaugccuucccuucagggaggugggugggcaggauggugcaugccuuuaauuccagcacuuggguagcaaagguaggcugaucucugaguucaaggccagccuagucaguguauguggcuaaugcccacccugcuugacacugcaccugaggagcccguucugcauucaugucuucuguaagccaacaccgccaguccugucccuccuccuauagacuuucccuuuagcaguuagacagucuuucaucugaaaaaaaaaaaaaaacaaaaaacaaaaaaaaacacuacauccaucuugcugccuuuuuucuccuuugggggcaaacucaaggaaaugccuucugaauucugaauucuuagauuccuaccuggcucuuuccugcucacuuauauuucuacugccacguuagccugaggaccugaguucugucugcagaauccgcuuaaaaaaauucacacagacacacacacucacacauagacaauacacgcacacauacacacacacacacacacacacacacacacacacacacacacagagagagagagagagagagagagagagagagagagagagagagagagaaaggauggcagcacacacuuuucaggccagaacuagggauggaaagaccagaggacccugcggcucccuggaccuccggccuaagugacuggaugagcucccagccagugagagagccugucucagaaaaaugaagugcaugacaccuaaagagugccagccaaagccaacaccuggccugcucuuguucauacccaugcguacacagacguugucuacuaucucuuggugucuaucacaugugaggcaaugccuuuguacccugcuuaggugaauacucauagacccuucccccuccacccagguuccuagaccaaauccccagagguggucaugugccaguuauuuuuaucccauguaugaugauguccauuaucccuacuucugagcccccagaggacucaguucauuucucacgucucgcgucauuaugugauugcuuacuugucuguuguuuuaauuaagguuaucaauguggauuaugggauggaagacaagaauccaaucgaucguguucacuucuauuguaagagcaacagcaagcaagcggucaggaucaauaaagagcagguaauggucacguaagaaagguccgcucuagagguauguguuuggcaagucuuaaagucaguuuguguucugcauacuaaucagguuguaaaguuaguguguacuguuaaaaauaaacagagagugcagcccacugagucagcuaagcagggcucacacaggcuuucagacaccgagguggcaagcacugggccuccuggcucugcaccacgcucucugcaugugugcuguggcuguuagcuuggugcuucccugggacuccuaacugugggaacggcgugucucugacucuugccuguucuugggacucuuuuccucuugucacguugauugaugcagcuucgaugugagggcuuuugccuugucugauuguguuuuguuuugucauguuugguugucucugggaggcccgcucuuuucugaugggagauggaggagggggagugguucuggggaggggguggggagcugagaggaucggaggaggagaaacuggucagcauguguugcaugacagaaaaaucuauuuucaccuguaaaaaggcauggcuagagaaauggcucagugauuaugaguacuuacagcucugggagagaacacugguuugauuucuagcauguaugugguaugcauacauauauacacacauacauacuacagguaaaacacacacacauaaaauaaaacuaaugaauuuguuuuuauaaguaaagcauaagccagggaugcuaguacauacuuguaauccccacauuugggaagcuaagagucaggaguugaaggccagccugggguacacaagacucucucaagauaaaacaaacagcaauauuaaauaacugugucuagcugggcaugguaguauacaccuuugauccuagcaguccagagucauagucagguggaugucugugaggcagccuggucuauauagugaguuccaggccacccacagcaacaguaguaagacccuuccucaaaaaaaaaaaagaaaaucgggcuggugagauggcucagcagguaagagcacccgacugcucuuccaaagguccugaguucaaaucccagcaaccacaugguggcucacaaccauccguaacaagaucugacucccucuucugguguaucugaagacagcuacaguguacuuacauauaaucaauaaauaaaucuuuaaaaaaaaaaaaaaaaagaaaagaaaaagaaaaucuaacuaggcagugguggcgcacgccuuuaauccuaguacuugggaggcaaagacaugugaaucucugaguucgaggccagccagaaaaucuauauauaaagaaauagaccuauauauacauaugugucuggauauagugguacaggccuugauaccaagagccuaagacauuuucucaaaauaggaaggggaggaaaaagagagguaggaacagaacucaguugugagaaauauucaccuugcauacccugaggccuuggguucaaucccugauccacaaaaaaaaaaaaaaaaaaaaaaaaacuuuuuuaaauaaagugcuagauacaccuagaacaugggauccuuaguucaagguaagcccaggcuacaaucaugagacuuuaucucaaaaaaagagguauaauaacaggcaauuuccagugucuccugguugcugaauaucauuuaaagugcaguguuuggucuuaagugucagcuacaacaucuaguggaccauggcugaaguuauacaaguuaaaugggcuuaucuguauaucuuacaugagagucugugguauguauauaauuuauguccuguaucuuucaggcuuuuaagccacugaccccacacggcgggugguggacaaggggcagccccagguaccagguucucagccuccggcaucccacacuggacacggcagaggagcugagaacagaauaggggccccgggcgacacuuggcccuggagauaagggacaagagggcagggggagagggggucacugggugguuccuacacaggcgagaguucuuaguccguuccuuggcugcagcauaggaaggccuucuggcgggagguuagagcggcucguuaggaaaaagccuaucccaauuuucaagcaugguggaccuugguggucagagacagucuaugguuuuagagcuuuauuguagaaaggcagggagaaagaaagaagguagaaagagagagggagagaaggggggaagagagagagaaggaaggcuagagaguaugagagguaaaagcuuagagagaaagagagagagagguagggccaagcagccccucuuauagugggcuaggcuaucuugcuguugcuagguaacuguagggaggcguuuagccagaauaccagaagcuuaggacauugucuacgugacugaaagccacaugccucuccugugggugcaguaacuucuucaggagccagggguccaggagacaugauugaaugccuuccaucccuuguagguggaaauuaacacccaucuggucccaccaggggagaccaggcugucugugcaaagcccauugcuccauaguaauuaacauaaaauucugaggcauuuugcaguaaauaaguauuuucuccuuugaauuauaauuggaauaaaacaggagagcagcgcagugcuuuuaacucaacauuaaaaaugguuccucaggggcuggagagauggcucagcggauaagagcacugacugcucuuccaaagguccugaguucaaaucccagcaaccacaugguggcucacaaccauccguaacaaaaucugaugcccucuucuggagugucugaagacagcuacaguguacuuacauaaauauauuaaaaaaaaaaaaaguaggagcuaguuuuaaaaaaaaaaaaaaaaaaaaaaaaugguuccucagaaccugggaggcagcugaguaguucuuggcagagugaacucaaagcuaaaauaaaaucuuuucuuuuuauaaaaaaaaaaggugucacaacugcugccagagaaauuugcagagcagcucauucggguguacuguaagaagaaagacgggaagagccuggacgccgccgggaagcacuuuguucaguggugugcgcucagggacuucaccaagccacaggugggggacgcucgcucauccucguacauuaaaaaagaaaaagaaaaaaaaaaaagaaaccuggaguuggggugagacaggguccuauguagcucagauuggucucaacuuugcuguguagccgagguuggccuugaguuucagguccccugccucgcuucccaagaugcgaguguagggaugcagccacagaggugccugguguacuuuucaaucuuuaaggaaagcccgaaagugauccuucuuauccacugagaaguucucauuuaaauuguagcaauguggggcuggagagauggcugaggacccugauucaauucccagcacccagcagccacaugcggcucacaaccagcuguaacuccaguuccagaggaucugaugcccucuucuggccuccguggguaccauacucauaaaauaagaaaugccgagggaaaauucuaaaagagguugaggaguuugugccugcacagucaagauugcccgcacacacacaagacacauauacacccccugcacauacacauauagauagacacaauacacauauaucacacucagcacacacacacuacacauauacaucacacacauaccacauauauaccacauacauagacagaauacacauauaucauacacaacacacauaccacacacacacacacauacauaccuuagacacacacaacauacacacacuuuuauuuuuuaaaggaaaacagaaauagaaugugugugugguaagugccuuagaccauggucuauuucuugucaggcccuguguuaggaaccacgaugaagccaguaccuaagagggucauaguuccuuagugccugugucucauucuaaguguguaccacagacauacaagugaaaagcaauuguguaguguuacgugcuuuggggugcaaaggagaucuugccagacuuggcuagaugagaaaagccugcaucaggagaagcuuacaggccagcuccuaaaggaggagagagaucagcggcuguuuccagggccagcagcagggccauuaggcgggcauugagacggaaacagcacggggaaagcugaaaagcuaacagagaccaugagcccuuucaggagcagcaucgagugguggaugcccccugccauccgugugccaggggcagccugaagccauugaacuggagcaagugaaaucuuucaguucgcauucuuaacaccugcuggagcugaaguccgaaggugugauguaagcgcuuuacaacgcggcugccuuugagaggagcagcagcucccaggagcucuguccagucagauccggugugcucagcagaagacauuuaacauccggacguuaccaaaguaaccgaaggaacaaauggaacagugacucagugcccgggugaucuuacuguaguuuaggacaggcugagggagcaggugggcguccaggagcugaggccccuuccagcagcuggaaccauagaguggugacgcccugaagcccaugccagaggagaugggagggaaacuacucaggcugcacugcccucuucaucuccagacuaugacuccacccaagggcuagaaaggagacgagaguggcggguuugaguggcggguuaagaggugcugaguaccugagacgaauggucagaggcagcccggccuuguuccaggaggcgugcacggccaggggccuuggugcucaugcuuccuccucucgggucauugugugacccuuggguggaagggugcauguggcuggagcuguguuaauggggccaaaguuaagagguuuauuuaaagaaaaaggucccaggguucugggugucauuugucccuguccuccucuguguccucccccauuugcagaccuggcucauuuguuuucgaggagacuagagaaaagagaagcaagccugcaguauagcuucugucuccccgugagccccaugcagggugugaacucaggcagcucugggcagcuguguccugugacucagccaguuucccaugagaccucugucugcuuaggacuaugguguuuucuaguuuauagucacaggacauguacagcuuugaauuucucaagaggaaguguauguagaagcaaucuauguucaggacagaggugugugugucugagacacagcccagauacaaugauggaaacuggcuuuucuuuguguccugacucucuuuucucucucucucucucuaauaggauggugacauuauagcuccacucauaacaccucugaaauggaauaauaagacuucaucuugccuccaagaaguauccaaaguaaaaacaugucuaaaauuuuaagugaauaucugcgguuaguucuuuucaaaaaccucuuucccucuucacaauuaaguuaggaaauauaauccgggcccaccaaugaccuuuauuuaguaucuggaauguauucucgugcuggggugggggggucucguuuucauucaaaaugaaaaaugguaacauuaacaaauuuuuccuaucuagccuguggugguuugacuaagaauggucccauaaggucauauaauucaaugccuggucaccagggaguggaacuguuugaaaggauuacaaggaucgagacaguguggccuugcuauaggaagugugucacagaagaugugcaugcucuuguacucucucucucucucucucucucucucucucucucucccucccucccucccucccucccucccucccucccuccuguccaucagcuaccacacagcgccuguuccucgccaugaugguggauuaacccucugaagcuguaagcacacccccaguuaaccgcuuuccuuuauaagaguugccuuggccguggugucucuugacugagacagaugcuguaagaagcauuaucugguguauuuuuagcacugacugaaaccuuucuccuuuagcaaccuauuucccaggauaacucucccaucuauccugaacucuugggacaaaggauugccuuuuguuuuuaaaucaggaauugagacaaggguacaaacuagaauggaaauugugaugcgccguguaguuaaaaaaaaaaccaaaaucccagcccacugaagaggugcccggcacccugcuccccccacaacaccccaccacuuccaucccuguuaagugccaggcauggggggcaucgggagcaguucuuuccucagaggagcugaggugugucaggcggguacucuaccgaugaccucagcuccaucucugucuuccugguacaacucccccuguccccugcuuuaggagaggcuagguucagaggacaccucauaccaggcuacuccugagucugucgugacuccagacaaaaucagaguuuuaaagcaccugcaaccccuccagccccaggggacucacugcugccagccuggggacaggucuucgcccaucucuucugagcugaacuggucagcugaccaccgaccccacccucuggcugcucucuccggcaccacuguugcugcaguguguuuacggguuuuagaacauucuggacugccuuugugagcuuagcagacugcgcagugagucucagguucucuuuguagcuugcuguuccuaccagugccgagccgcugugguucucccugcugccccccucacccccacuuugcacagcuuuaccaggaauugaguccaauuggagccaacaguggucaacagaaaugcuagagaugcaggcaguggggacagaggcaggagcuggaggcgacaucuuagugaugaugcucucccgggcgagcagccuugugcugccucucuccuccggguagccacguucugucuuguccacucaugggugaagaguauuuggugugucugccacuauggggucauaaaugcacacgggaggugcuagcucccccacuagccacggugccucuguagauccacgagacagcuaggggucccccuccccuuugugugcccagacucaagguuaagaaguggaaaguuuucugcgaauauuuuuguauuuuugccagucuauauuuuuuaaaucauuaugguuuauuguggaguuuuguaguccuaauuuuguaccaugguaugugggaaacaaaucugacccauuuucugccuuugaugcuguuuuccuugugaguaccugugucguuuacgagacugcauuaaaaauggagauuuuaacagcuuag

SEQ ID NO: 1226 - RNA, 2513 nt, Mus musculus
ugccauuuacugaacuaccucagauguuaggaauguuuuaauauuaaauuuucuuacagaaaaaguaaugaugggauaaucuugagauaauguacaguagacuauuccaguauuauguuuagaagaacagaauggggaaacccaaccuuauuucccauucacauguuuuuguuuuuaaaagcuuaucugguuauguauuuuagcuuauguauaucaguguuuugcagcauguauguguguacucuauguuuguggcugguaacugcugagacuugaagaagguaucugaucuucuggaacugauguuaugaauggcugccagcugcccugucaguggugggaacugaacccacaucaccuugaagagcagcaagcgcuuguuuauuaucugcuaagccaucucuucagcucccaucauuuccaaugucacuggaaccucucaccacuccuaacucagucgcucagaaauaccuaguacauuugguccugucugcuuucucuucaccuuccaggccucuccauucuguuucaugagugagcaggucuggcuuaucauugagcuaaggcuguaagaaaaagauucuucagacacacuuggauuucuaccacaguaggcucuguaaauaaagacaaaaaauaaauaaauagauuucuacaaaagauccuccaaacuccguagggagauuuuucagcuagugcacgcagggagcuccaaggaugcagcuuuugcaauugucaccccggacagaaugcgcuuuuugaugaugcaaugccuuugagucaccccugcuacuccucuauguaaccccaguaaacuaauucaccgucucacuaaagcuagaugaggcuggagcuauuucuuuggucuguugucauuugccuauuagggauuuagagagcuuuccaucucccuauaucaggacucuuccuugagcaguacaccuuuguauuuuaauucaacgauuccuuccgauacgucauguaagacaacacucuacuaccuccaaacuugguagucuccacgaggccauacccgcagcaguggauuuuguccaaaacaaauuaaucaucauuaacauguuaaaaucucugcuuugaguauaccaugaggcuuuaguggggcauaggaacuccuucauaacuugccuugacgucccuguuuucuucucuagugacuccuucauccaaacaaggacuacucuguaauuuucaaacacacugccccaaguccuuaguguagaagagaaauaauccaaaucagggaauacagugaaggcaaacgauucuauccuaccauccaacucucuuggaagagcugaucaauaaguaugacaauuucagauaagguacaauggagacgaugaaauagaaguuaggugucagcuuauagauguacugcucaguaauggccugagaagguuaaaauuagacuuaaaugaugaagagcaagguaugcaaagauaugcacaauagcauuuucacacacggagaaaagccuccugcgacugagaacuagcuugauauucccaagguuacgaguuaccuggugcaucugaaugcuauuauuuuucuguauuuuaaagacaaaaaaugaucucgugcaggauucugagugaaaacgaucagguucuaguuuagguuuuaaaaacaccuuucagguaagcgcgaggaccaucucuauuccugaaacgacuauuuacugggacaguuuccagaauccugggagugaggcugagacccgucaccccaaacccuugucccugcaucccuuucuggcgagauuugggagucucugacguggcgcuucuacgugaagaagccacuuucggcagcucccgccuccaccuccaucgagggucaaagcucagugagagcgggcuggaggcgcgccggggagcugacaaaccuaggguccacaggacagugucauggagaaggcuucccacuagcgugaacggacucgcagucccaagucacccacaccagggaacccgcgguggagagcgcggggcgcgagcuacagucccggcagccucagcaccggcucggauccuuccgccccgcucucucacguccguccccgcggcccggagccccgcagcugcccacccagggcccgagcuagaucuccguuagaguccgagguccaucuucuuaucccauuccgggagacgggcugcugcgggcuccagaggagaaagggacuuuuugagaagaaaagcggaggcagacgaugaagggaaggcgagcucaagaaggcgauuuucgcgcgcuuugucgcgggggguuguggguagcucgccgggagggaaaagaaaaccccgaagccggucgcgccgcccgucgggccggagggggauauguucgaggacgagccccacgccgagggggcggcggcggucgccgcggccagggaggcgcugcaggcccugugccaggaacugaaccuggacgagggaagcgcggccgaagcccuggaugacuucacggccauccgcggcaacuacagccua

SEQ ID NO: 1227 - RNA, 30141 nt, Mus musculus
cauggucacucauacaucuuuaacgccaguccaaggcagaggagaggagaggauggauacgggaucccugcggcuuucccuaucucaagggaauaagguggacuauaauagagcaagacacgugauauacucuggccucagcagccauagguacaugcaugugagugcauaugccacacccguacccacaccaauacccacccguggcacacauaauuaaaggauuuaggggucagggccacaucagcugaccuagagauaguuuaucuggcugccaagcugaguucguuggcuggaggcuugauaacugcccacgugaaucucacucugcgggacuucccaggaaugaucaagagcgaggaaagaggaagucacaauguuuuucugucuuaaucucggaacucaagcucaguauuuccccaaaauucuaugggucacauuggucagcgugggagacugugaaggcuugacuaucaggcaccaaucacaucacugcccauuaaacuccauuccuaacuggucugccgcacuuauuucaaugcugauuuuugccuuccaaacauuuaucgcauuaaggauucccuaucuauuaugugacuuacugacuauaaacuccauggaagcagagauguucacuggucucuuuuuaauuuauuauggugauuuguuuuugucugaauuauagcaugguaauguuuguccuaccccuuauauuguagauuucuggcucagacuuagaacugaguucuaaacuggggggagaccggcuguaaucaggagaauugcccccaguucgaggccagucagagcuacacuguugagacccugucucaaaucaaauaaaaaauucauuaaagcuucaaccuucggugucuaauuaggggagagcaggaggaagacggcgaggaagcgguggaccugguaaaacccgcugagcggaaucugcugcugcucccagcacaucgcuuccgggucacgagggaucacuuccggugcggcggcgcggcguuccgggagguaaguauugaggcucggauaacccggccgaggcuucccggcgggcgggaucggggcggcguugcggguuacagcggcuuccgggguugcggagggcaguuaucuguaaaggcagucugcguuccgaggagacuggggcccucgcgaggguugugcagggccagggcccagccugcccugcgccgggaccagccggggcuuggcuugucgggugugcccuggauggcuguguuaccucgggcaucucgaucuuccucucccggucacuuuccuuccccgcagaaggcucccuugggccugugcggaggaugcgaaggccgggagcguaucagugcuuaguugcagugugugcuugagagaaaacugccagagaaagggauggggaaugcgauagccuccccggugucugcgguuccagugaccugacaccuggaaauagaaaguggaagacuccagaaacaaaccgcgcauggcuuugaauuuguguguuuugaguagcucaguaguggagacucacccagcgugcuugagucccauguucagaccccagaacuguucuucccggcccuaagauaguagcacgaugaaguuuuaccucuuccugcuuuacacguaggucaucgucuugcuuggcguaucccucuguauacgcuacccccucauuagucacguaggacagcugccuguguaacccucauaucagcacaagaguaguaaugauagccuuugggguuugcugaaaaaggugcuauuuuaaacagccuuuuuuuuuuuuuuaaaggaagauucuuaggcuaaaguugcuaagcuauuuggugagaacaaaauuuuuguuguuuuuccaagacaggguuucucugugcagcccuggccauccuggaggagcucuguggguuggaggcuagccuggucuacagaauaaguuccaagucaaccaaagcuacacagagaaacccugucucgaaaaaaaaaaaaucaaaauuaaaaaucagagcuggugauauggcugaguuggaagagggcuuacccagcguguaaaagccuugguuuuuaucccuugcauccuaagucuggggguggggcagagcaugccuauacuguucugggcugcauagcaaauuugagggcuccaugggaacuuugcugaaacaucaauaagugguaguuuuguuuuugaaccucacauugccaagguuacagccauaguguguaguaaauguuuacuuaguuaggauagagauggcaucgaauuugugaguagaaacggacaaagacugccuuacgcuaugugaaggcuucagccaggccuccccugaaacaagagcacaaagccacuuccugggaauaagggauggucacacagguuagggauggauucguucugaaaccaaaaucuccauagcggacgucacugccaguguggaggucucugcuauagucccagcagaagaacacaugaaggcaguuuugaagugccagcaaguggggaauuggaaggcaugugaugaugcagcgccagcaguguggacgucaucaaauguugccaguguguuucaaauucuaugugccccaaaggacaccauuauuaacuaugauacugggauggaacagagcauuaaagccacccaugugaucccuuaaggaccauauucccugcaaucauuauugauagaauuaauaacuucagauuaauaugccauuaaaauauuucuuuauuuuuagacaggguuucaguuuuggcuggccuggaauucagcauacagaccagacugguuuagaacucaaagagaucugucugucucccuaguguugggauagaaacuguauucugucccaagcaacugcagcgucuucuugaaagguuuuauuaacugaaguuuuuaggguaaaagacuuggcucugacagugccaacgagcuagauuuggcuacugauugcuaauauuuuaguuaaugagauaacuagcagugaagaucagaaaagagauguauucggugugcccgcauuggaaaaaggaacaaauaauaggauccucuggcuuccaagucccuccccaagauucugucauggaguuuaggcuugaauagagguggagguaugcauagcuaagcaggucuggcaggaugagguccugccugucauugauccacacugguccuccuuccagucugcccagcaagguggucugauacuuuguaaaaacuguaugaaaucuuucuacacuugcauagaaagugacuugcauaagggcuucauccuuucucuuuccccaggagucuuugauucuagcacuagggaagcagaggcagagggaacucugggaguccaaggccuuagaggucuacaugucuuguuucauagugagacucugucacaaacaaacagaauaucuccuuuucuaguguugguggguggguacaggaacuuuuuuuuguuuuuuuguuuguuuguuuguuuguuuuguuuuuuugguuuuucgagacaggguuucucuguguagcccuggcuguccugggacucacucuguagaccaggcugggcucaaacucagaaauuuuccugccucugccucccaagugcugggauuaaaggcgugcacuaccacguccggcucaggaacuuuuuuuuuuaaguccuuagcuguuacagauuccccaaaccacuauuccccucugccccugacacccagccgcccccaacauaacuguggcuugaaugccccucacacacaccccugucauguauugucagaagguccaaggcagccuauugaugcaucacaaauuccacacgucaguucaucaggcaggcacuauggcuuccacucagcacaaccggaugaguuugauuccagggaccuagacuguauccuuuaucacagguauguguggagagaggaaaucgauauauuaggguucaguacugggcauagcaucuggcauccacuggguaaggcagaacaacucuguggcaucucauaggguuuuuugguuuguuuuguuuuaauauuuauguaugugaguacacuguagcugucuucagacacaccugaagagggcauuggaucaugguacagaugauugugagccaccauguggguacugggaaugagcucaggaccucuaauagagcaguccgugcucuuaacugcuaagcuaucuugccagccccugcaucucacacuuuaagugacaguaaauggaccaguagucauauuuugcaagaugucugcacagcaauuucaguccaccaacuaccaacucuauguguguguauaauuuauuuuaauuuuauuuucacuggugucuugccuauauggcugucugugugagggcgucagaagccugggaacuggaguuacagacagguugagcugccaugugguugcugggacuugaaccagguccuuuggaagagcugucuuaaccaccgagcuauccaucucuccagcacucugccucuuuuuuguuguuguuguuuuuguuuuuuuguuuuuuugagacaggguuucucugugcaguccuggcuguccuggaacucacuuuguagaccaggcuggccucgaacucagaaauccaccugccucugucucccaagugcuaggauuacaggcgugcgccaccaccacccggcucugccucuuuuuaguugaggucucagaacagcuuugaaacucucaucaggaggcagggaucccaguccagagucuguacagcacuggggagcaauugggagaucccaaaacaucugccaauuugaugucuacguuuuuagaauuaguacuugauaagucuugcaaucucuaaauacaccuauaguuacuuauuuugaaauguuggugguuuaacauuuuaggccugggaaugagugcagaugaaagggcuugccuagcaugugugaugguuuaucuggguucaguccucagcacuucgugaauugugauugacaguucacauggugaccccagcgcugaggaaguagagugggugguucaggaucaccuuuugauaccuacuguguucgaggccggccuagaaugugugagacugguucaaaaaauauuuuaaaacaauuuuagcuuuauggcuauuuugagguacuauugaguuucuggaaagaacauuugccauaauuacugagccugugucaguacagcaccauuaacuggaauuucuauguccggaucuccaguuuccuucuaacacuguccaggcuagcacaguccagcagcgucuccgggggcuccucccacuuucggggaugguuucucagacucagcuguuucagaugaggguuuugaggauugcuuuucagcuauuuugcugauggaucuuuuuuugugugugugugagcagacucauccaaaggcuucaagagggaaggccgucagaggagccuguugugggucaaagugacaguguugauguuccccagggucgcccagcuucagggagcagucaagugucucgccggcuuuuacacuguacuucuaggaagaagucaugaugugcagcauacguuugagauuguggaggucuaaccuugcacacacacaggcacagugacaacauaaauagaugugauucgugugaaagaugugucuguucucugccaucggcuuaucugucugucuuauugguauuuauuuuauaccccgaauuucucauucuugugucccaacuuaagcugcuaaauccccacucuugacaacucccuggcaauguuugguuuugcuuuuucuguuuuuaaagcacuugcaugcuuucugccccaggcgcauccuguuuauuucuguuuaauucuguguagaacacuucuguaaggaguccugguuucuuuuauggaaaaaaugacccagagauugcuccugggacacucuaguuucuguguccucucaguggccagaguaugauaucuguguguacacagcuauaauuauuucuguaugugucuauauuaagcuaaguacccuaugcugaugucucuaacccuugaucauuaucguguggaugauggauuguagcuuccuuuucuuaucuggaaccuccuccccacugcaauagauccauuucuccuucuauucacuuacagucaguucuggcgugcguuugcgugugagugugugugugugcuagagagugaguucaggggcuugcauauaccugaauuaccucugcaauccuuugcuuucuugccuuggcagaaaugucacguucuuagcccuucucugaccaccccacauaaaauaacaagccauuccuccuccuuuugaguuuucagauuuuuagcuuugccauuguacugugugugucuauaagcacucccuagaauggaagcuucaugacagaccacaauagcaccaguucacagcuauccucugcaagugccugccuuggucuuuagccggugacauuggucuagacggggcaguagucacgcuggugauacaguuguuucuuuuucucaggaucacauugccagaccucucccuggccugaccacaguguuuauaugcccggugugccguccuuucagugaagucccgaggugcccgugaugcaccagcuccuugccugccacacacuuccugccuucccauguuaggaauggugcugccaagacugcuuuuguaccuggaggcccuuucuuuuuaauuauuuccuuaaucuaaauucuaggaaguaaguuauucacacaaaggauauaauccauuuuaugacuuuuuauacgcuggccuaaugaccgcuuaaggaagaaaagaggccuaaguauauuauggcuuugggaacuuuuuugaugggcucaaagugacaucagcucucuaagaagucaagagauaagcuacaguguagcuagaugcccauagucacucccccagaguccugacuccugaaguuucugucacaguauccagucuucauaauaacuucguuagacugaguaucgaugcccucaguagacuucacagauuugagcaugaagccuggucaggggcaguaaguuaugaggugccacuggaggagugacgcuuucuucagccuuagcacagggcugcugcccuggagagccuugucagcuccccucacccuggagcugggcugggcugccuuggaauucacuucagagccagcuaaggagcugcuccaagcagucugccugccuccaagccucgcaccuugugcaugaccaaagauggaauccuugagccccaugccccaccugacucacuguauuggaaccagccacacugggcucucuccagaagccagcuccuucuccggaggaggaaguucugccagcucugaggauggggggcgggacagugagugaggaguggcuccugcuuugaaaggcuucuagagucagcugaacugaugugagaccuggcuauccugcuggccaagcacaugagcuuccagagggaccaggucaacaggaaaacgaaaacauuugugugagacccacucuguuugcaugguuggccaucuuguaacccuuguguguuuuucacguugugaaagucauuuaaaguagaggagcagcagggcuaagauggaagaaagaaauggacagucucugguggacagggcuuacccauagaaccgaguaaugcaugcuuaguuaguuacauuuaaaguauaagacgcagggaagccaggcaugaugguacaggccuguaaucucaggguucuggaguugaagacagcaagaucaggaguucaaggccagcauaggcuacaugagaaccaaugucaaaaaguaaaaucaaauacauaguaaauagaaaaaaaagugaaauuuuguuuuguguuaaaauaaagaaugaauugugucauuagccacuuuguaucacuauuaucaguacuucgggaacuucuucacacuccuagacaagaacuccgcauccuaccugguuucuacagcugcucugccagcuuaugcccccaucagcagcugugggggucuggaggagaguggcucauguuugaaagccuggucccuagucggugaacuugaaagacccacaacgugaggacucccccacauucugacucaggagaggcgacaccccaaaaucaccaacgagaaaacggucuugcugcaaauugcaagaggauuuuuauucaagagcgcucucgggcccacggucauacaccacgcagggguagaggacuguggcgccccgaguagcugaguaaggggguauuuaaaggaaagaaccacaacucaaggaggugggaagggcguuguuggaaaauaccaaaaauaccaguuaagagucacaaggaaguacaaagucacaagugucagguuaucucucaagacaguuucuaagagccccuaacaaucuaagagccccuagcaauagcaccuuugcauaguggguuccaguaguggucagggugggucagggugacuuucuuugaaugaacacucuuugaacccaggaagcggguggguggaggaaggaauguugcuaucugcuuuaugauuagcauaccuuggagcauugaguuuauuacucuuucaaacuguuugagaaggauuuugaaguguggccccuuuggaggaggugaggcacugugagggggacuuugagguuuugaaaguccacacuaggcccagacucucugccugcugacugugggucaggaucuaaauaaagcucgcagcuacugccucgaugccaugccugucugcaugcugcugcgaugaucaaggaccagccguccgaaccuguaagcgggcccucaauuaaauaguuuguuuugagaguugccuuggucguggugugucuucacagaauagagcaguaacuaagacagcaaugcacacagcuuccaguuucuccacaguuuuacugaugcuuggugcccaccugugcuucuugguauacuuuuuuuuucuucauuuuaaaccccacucugugugugugugugugugugugugugugugagagagagagagagagagagagagagagagagagagagaaagagagagagagagagagagagagagagagaaacuuggggcaguugguucugggcuuccaucaagucuauccaagaucaaaaucaggccccacggagacuugucaccaaccucacccuccugguuuugcccacacuggcaguuuguguagcacaggcugacugugagcucaucuucuagcugacuacugggauugcagacuugaacugacugccccuccccccacuuauuuaguuuguuuuuaugcugauuuuuaggggucagaggcacacuugcuguugguagucuaaacauccccacaguuccuaaaagcagccagguacgcuccuccccacaguuaccuggcaagagccagguaggccuggcccacuauaaaaggggcugcuuggccccuccuccucucucuccuacucuugcuucccgcuugccuccccccaccccccacccccuuucucccucucuccagguggucaugguaaccucuaauucucuccucucugccuuucucugccucuacuauucuguuaauuccccuccccauacccuaaauaaacucuguucuauaccaguggcuggucucuuagggggcgaggaugccuccucauaggcccgccagggcacccccuucccccacacccagauagaacauauucuuauagcucuuucuccuuuuaugaucacaacacucgcuacggcauguaccugauggucagaagacagcuuucgggagucugaucuuuccuuccaucaugcggucccagggaucaaauucagguugugaggcuuggagguggcaggugccuuagccagcugaacccucucuccacccaugcucuguuauauuguugccgcguggaaguucuuugucuaucggaaugccagaccuuuacugucaguaugacucacgaaugucuccauccauucucugggcugccuuucacucuccgaggaauguccucugugaacaaaaggucuugaucuuuuuguggaguuuaauugacuccuuucuuuuguaacuugugccuuugaugucacaucccggaaaccacugccaaacccaguaccauagagauuucccccaagagaguccuaaugguuuuauaguuuggacucugaaauuuagaucuugggccgguuugaauuaaucuuuguaugaaguacaaguugguuuguguuuguguguggacacuguuucuugguagcacuuguuuaaagucuguccucuccugccugugaauguuuauuuggagcucucugucugucugucuguccgucuguccucaugucaguagcucugcuuugauuaccuuaguuuucuaguaaauuuugacaacaugaaauaaguucuccaacuuuuuuucaaauuaaguuaaauuaguuuuaguaauuugacagcaugccacuucaucauauaaucaacauaaacguuguugaugagguuguuuacauucguucauaauaaggcuugaaauuugucuguauuuaaauuaauuuaacugucauucaguucagacuagccacaccuggggccacauguggaucaugagcacugcauuguguggcucagaguucccuggggagugcacgggauggcagucugugacaucugugacaaccaauaccacagugcauuugucccuuuaauguugggguggcaaaaggaagccauuuguaggugccucaauaaagaggcaaagggggaggaugacacaaaggccugauggggagggugacccuugugcucaggcuuggaguuagaauaggguuuugaacagcaggcauggguggaaggcugcucuggacagaucgcagcuucauggaggacucaggauucuuggagagccauaggcaguucuuccagcgucaccagggucuuaagaguggaagaggauggggcuggagagauaccuuaguaguuaagagcacaggcuguucuuccagaggaccaggguucaacucacacuugucuauaacuccacuuacaggggaucugacagacauauaugcagacaaaacaccaaugcacauaaaauaaaaauaaaucuuuuuuuuuuuuuaaaguggaauaggagccagguggugggggcaaaagccuuuaaucccagcacucagcaggcagaucuaggcuagccuggucuacugaggaaguucugggauagccagggcuacacagagaaaccuugucuuuaaaaaagagacuaggagagggcuggugagaggagaggugagcugaggcuggcuggucucccuguuaccuaucucucagcuuuccacuuaugggcugggcuuucccuuaucacugugucucuccauucagaccuguaguuuagaguccgguaaggcacaucugcaugccaucaugugggagucacagucaggaagggagccagaucucugaguuccaggauagccagggcugcuuaaagggacugucuuggaaaacaaaacaaaaaaccaaaauguaaauaaauaaauaaauaaaauaacagcaacaaugagcaauuuagaacuuagcgcuuuucucugcuuuacuuuuuacuuggucaaguuaaacggggcugggucuuccaagguuuguuuauguuccaucccaucuccgcaucuuccaguuucccuuccuggccaugugggucccuuucccacccuggagucugcuuuucuuucuaucuagaauauucuucccucagauuacaagugugagucacucuacuucugcccuguucccaucucuguuuacuuuuauaagaccuguggcauccacagaggucuccccucccaccccauaugagaucaaccgucucccgaacaguuucucucccccugcagccuggcucuguggucugcugucugccugcauucggagcagagcuuugagagcaggcauuagccugucucuuuuucuucagccuuugguaucccuaaguguuacaucacgaagugaaugaauagacagagucagccagguagucgguguuccugagcugguagggugcuugcucagcauucgugaggcccuggguuccagccccacacuuagggcagaagcagaucagaaacucauggccauccuagcauaauagcaagcucuaggccagccugagaugagugagacacuaucucacaagcaaaacagagcaaaauacagagaugugcaggucuuuauaagaacguugggagauuuuugcauuugcuuauuuauuuuuacuggcuuuauauucagagaacaucaaacauuuacaaaguugaauggaugguuuauugugcacauauucuccaauuagauucaaggauguuucugccucucucaaguugcuuccugaucuugcgugugugugccuauagcauaugcauguacacaagugggaccucucaaagaucacauggagaaaccugacauucacucucucccuuagaaguuggugcuggagaguggugaaucucgaggugccuggcaguggugccuugggccauggccuccgaccugggcuucucaccucccgaggugccugagcccaccuuccuggagaaccugcugcgguauggacucuuccugggagccaucuuccagcucaucuguguccuggccaucaucguacccauucccaagucccaugaggcgguaaguccuucccugggaccucagcuuucuagauggcaggcuggauggauuccuguggcaggagaaucgccacagacaagaugggcaggggcugugugaccccugucaaguuaacuugcuuccuggaagaccaccugauggaugaggucacagacgcaccagaagaaggcgucagaucucguuauggaugguugugagccaccaugugguugcugggauuugaacuccagaccuuuggaagagcagucgggugcucuuacccacugagccaucucaccagccccacugaguacucuuaaccagugagcacccucuauuugauaaacaucaacuuauaaaaauuugagcaaaaauuuaaauauuuuucauuuucacauuauauguaugaauauuuugcuugcgcauguucagaugccaucugugauuuugagagccaccaugugguugcuggggagugaacccagguccucugcaauagcaacaaguacucugaacugcuaggccaucucuuuagucccguuuuaguuucuaaguuacacuuauuuauuuguuuguuuguucaugggagagagagagagagggagggggggguaagcuuguguggaagucagagagaacuuuggggaguugguucucuccuuccaccguggggguuccagggauagaacucaguuugucagucuuggcagcagucaccuuuacggugugaaccauuccacugaccuggguuuuauucuuuguuuugauacuugagauagggucuccuuugaagcccaaacuguccuugaacucacucuucucccacuucagccccccaaugcugcaauagcaagugugugccaacacacucagccacaaaacauuuuuuuaaaaagaaguugcaccagguguaauagcucacaccuacaauuacagcacgcaggaagcuaaagcagggggauugcuguaaguuugagggcagccuagacuccaguaaauugcaggccaauuugggcuacagugagacucuaucucaguggaauucauacuggguauuuaaauuagaauucauacuggguauuuaaauucaaacugaagacucagguguuuuucacacuuguuuguuugaguugguuggugugugagugaguguguuugccacuguguauggaggucagaggacaaccgucaggaguuggaccacgagggucccugggacugaacucaggucguuaggauggcugcaagcgcccuugcccacugagauaucuugccagcucuaaaguuauaucuuuggcuuauauuggcagucuuauuuuauagaaagauuaacaaaaugacuaauuuguucuguccugcuauguuggaggucaccaaagccaccucacaauugugguuaccacagugaaaggcuauagagaaggcacaggauaaagcuguagagaaacugacccaaguccaaaagugcccugacuggagccacacagauguccagcuccaacagcaaggagucaauagaucauuaagcacugucuagcuagggacgccuuagagacucuauguccaggcuguguaugcauuucgguuguuuaagacaguaacggauaugggcuggugagauggcucaguggguaagagcacccgacugcucuuccgaagguccagaguucaaaucccagcaaccacaugguggcucacaaccaucuguaacaagaucugacucccucuucuggagugucugaagacagcuacaguguacuuacauauaauaaauaaauaaaucuuaaaaaaaaaaaaaagacaguaucggauagcagaaguuggccuuaaauuccugcucuuccugacucuguauuccuaaugauggaauuuuagacauguauaccacaccuaguuuaugggguguuuggaacuaaacccagggcuucaagcaugguaggcaagcccuuuaccaaaugaguaacauccgcagccuauaaguauggccauaagcuaaccguuuuccuuaucugugacaguaucgggcauuugaucuagggcaucacuuacugagaggcaaguguucuacacacaggcuauagcccuagccuaugaggcuuuuuauuagggauugguuauauaagcacuuuuuacuuacuauacacuccaguuucagacuugcagagagcagguguccagcauaagccauguugcuuaauggguuaggcacagugcacucucaggagccaugggaugaggggcgcuguuagagaucccagugcccagugcuggcaugccagcagggaccguccacgcgggcagguaacacaccuaaguguuugauuagcucugaccgagacucaggcaggaaggugaggguuuguuuugaccuuggguugcauuccugcagggagauuguccugagaauguugcucucagucucuucucuguggcucacuccacucuggaaaacauuagguacauuugcuacaacuuguuuuuaauuucuaggaauucuucuuacuaauuuguuuuugaaaucuuauaaaauguuuauauauaaugcuuccaaccuguauaauaagguacauucauagaaguuuccuuuaaucucauuaugcccccaccacucccugcuuccucccauagggaaccauuuuuauuacuaagauucaucuuuaucauuucgauucauuguuguuuuuuaacccaaauaaaugcuugaguguuguauauauaugaauauacgcauguuuguaguccuguggucugucucuguugagugcugggauuaaaggccggcuguuucuuaaugcacagcacaugguggaggcugcacaucucaaggcuugucgugucugaagcuccugcuuacgcaguggguccuggugcaguggggaacuaagugagaggagcagguguggcauggggccaggggaagaggaacaccagguuucaaguuuuaaaaaagugccauuaagggguuggagagauggcucagggagcacuggcugcucucucagaggacccggguucaauuccuaacacccacauggcagcucacaccugucuguaauuccaguuccaggguuucuacuauagucacacagacggacaaaacaccaaugaacauaauacaaaauaaauuacauauuuuaaaaggugccuucaagacaacuuggguggucugucaagucaacagguggaucuucaugucuguagaaagaggagacugugggcaaacaguugacgacguuagggcaugugucacugaagucgugggagagcguggagagcaugaagucucccagggagacgcagaagugagagaugguccucuggcacacaccugugaucccagcaaauucagggccgauuugggcugcguagacacugucugcaggagggauaugggaauggccuagugguaaagugcuugcugugcagcaugaggaccucaauuuggguccuuagcauccacauggcuaagcgcacgucacccagcccugggugggugagacaggcagaauacuaggguuugucugccacugacccagcugaacaauagcaagcuccugguuuggugucucuucuagucucugcacauggacauggaugcacauacauaccacauaccacauaccacauaccaaauacauaugugcacauucucacgcacacauaaacaggacaaagggcggagcuuggggggggcuccagcaugggcaagccguggccugugcugguuccguccaccgugcauuugggcuauuuuguggaugucaccauaggacuucuucugccuguagucacagcacacuuuaagagcacagugccugaccccaguccucgccagggcaugcuguggguaucauaagugacaaacuuauugucaucagcugccccugcugaggcugcguuggauccccagaaaggggaugauaacuuguuuuauuuggagagcuagguagagcuaggagaggaagccggguuccgcuuauuguucuuaacccuuugaagugagcagaggcuuggagcuaucccacaggcucucagggaagacccgggcaggcuaagguccuuugaauaaggaguugacaaagggcucauaaaucagcuccccaaagugaacugaaagcuccccucugaccuccacugugacaaacacccccucccccaaugacauuuuuaaaaaauuuuaauaccugucuccuaaaaaccggccaaaaauuuuuuuugaguacaguccucuuaaaucacccaacaagcaaggagccuuaacuuagcucgucuuuuaaaauauaaacagguugcagcaaaggguugcugcuuucuuguaguucccagggcauggagcacagggagcugccuuccuaacugaugguuacuguguuaacuuggcuuuguucuguuuugcugagacaagcuuucacacuguggcccaugcuggucucaaacugagaauaguagcccuccugccucaguuucccaggugcugcagucgccacaggcgugugccaccacacagagcuguucuagcugucuuugugaaugcaugugugucuggguagaggucagagggugacucacagggauggguucucucuacuguguggacucuggggaucaaacccugagcgaccagcagcccaguggcaggucauuucaccgacugagccaucucacuggcgccaguguuagcuggucuggaacucacacucagagaucugcccaccucucucucuccuaaguucuaggaugaaaagagugcaccauuauauuccacccuuuuccuuuuaagaagagcuugcuaggggccuggagagaugguucaguuaggguggcuacuauuccugcagaacaccuaggcuuggcuuccagcacccacacugggcagcucacagcacuuacaacuuaggcuccagaggauccaccacccuccucuggccucuguaggcaccguauaaacaauacauacacauaaauacagauaaaguaaaucuuaaacaacaaaaaacuggggcuggagacgcggcucagcuguuaagagcacuggcugcucuugcagaggaccuggguuugguuccuagcaccuacaugguggcucacagccaacuccaguuccagcagauccagcaaccucuuccggccugaucucccaucucuguggguaccaggcaugcacaugguauucauuuaaacaaggagacaaaucauuguacacauaaaauaaaauauauacaucuuuuauuauuuauuuauuuauuuuuguuuuucaagacaggguuucucuguguagaucaggcuguccuggaacucagaaaucugccugccucugccucucaagugcugugauuaaagguguguaccaccacugcccggcuuaucuuuuaaauauuaaaaacaaacaaccaaacaaaaccuuuucaguagguguuagggauggugaugaugaugauggugauaaaauaaaguacugugagcccauuuacugccuuagacuagcauauggucccugggacuagggauucugcuaccaacauucuucuguaugcugccaugagacagccuccacucccucccacaacucguaacuacucacauggaaaggagaggagcugugugcaagaacuagagagcgcaguggugagugucagggcaauggugagugucagggcuaggcggauguggaugugugugugucagacagccagccuuugggggggaggaagggggcuuuaacugagggacacaggaggucuaagggaggaagggagccugggaaaguaggggcagcuuguagaggcuccuuacagccugagggcagcagaggggugcuuggaugcuacagagguggggaggagcagaguggggugaagggcugcucugugcugguugcuuaaggcaaaacgauccucuugcgacauauagacacaagguuuauuaggggcuuuuugggucagaagauaauauuuuuggcuccagaugaugggaaagccuuuaaaaagcaaaagaaugucuuugcuguuuuccaauaagcugauuucuuacaaugguuuaugccuucagcgcuucaauacuuaagagauuaucugaaagcucuuuggaggcuaaucaggagagagaaaaagaacacauauaaaugcuucccacaccaccccccuuccuuuucagaggagagacaagaauccauuggccaaugcaagccaggccucuggaauccuaagccagauggaaagguuuucccauuggcacccuauuaagcuaagaccuaagaaaacauuuauuugcuccugacuaaggccaaggccacacaaccugaguauuuuacugaaggcugaauuaaaaaaaugugaguuaacagguccuuagacucagacaagacagcaaacgcaggccaaguuugguuauauggagcaugguaaaaaaggacccgagggacacuggugaccaguguguaaagaccccacgccuuugccaguuccagaaccuauggugcaagaagagaagugacuccauaauguugucccugaccuucacaaugucacauguguacacacacacacacacacacacacacacacacacacacuaaauaaagguaauaagauuuaggcugcacaugguggcccacgccuuuaaucagcacucugagagcagaggcaggugaucuccgaguucaaggccagccuggucuauguggccagcuacagguauguggugagacccuaucucaaaaggaaaauaaaauaaaaaggauucugagauagcuucuaggcucuagagggaagagauugauugucgauguuugcacaugagccagggacugggaguguccuugcucugugguucuguaccuggcugggccaucuggggaauuuuuguagcccuuaacugacugccugagaccgagacacugagucucuucuucagagucuuagaucaauguuugcaacaugcccaaaugaaacuaauagguaucauuugucuagcccuucgauucccugaagaggaggacagguuaaguuugaaaugauagcuugauaucacaaguugugaagggagcuaagugaugguaguguaugauuuuaaucccagcacccaggaggaaaaguaggcagaucucuaaguucaaggcccgccuggucuauagagcuaguucuggauagccagggcuacauggagaaacccucucuggaaaaaaaauaacaacaacaaaacccaaccaaccaaguugggaaaggaaaagcuagaagaaguuagaauaaagaccuuggaguaauggagagugugcaugcaugugugugugagugcguugggaagucacuguuuugaaacuggcacuacucuccuguagccccgacuggcccucgcccaccuggcccugaacuugcuguguauccaaggaugacuuuguacugugauccuccuucugccuuugccucccucagcagcaggauucucagugugucccaccacacccagcuucuauuagcacgcuuacuugaaacuuaggaguugcugggcucugcaaagaaauuaagauuccagcaaggccugaccuugcccuuccuuaccuacugugcuugacauuuaugugcacuguagauugacugauauguggucgcugcuggggugggaaccuggaacuccuaaggugcccucugccuccccuuuacuccucugucccucugucuuccaaggcucucaccagggccugcuuccucugcuccaugacccuguggugagaugacagcucccaggauucaucucuuucagcuacagcaucccaaggaggcugucuuccugcuuggucugguugaaaggccucuggaaggaacuguauggcuggccugcuggggacagcagugggcaggggauuggcgcugcagagugauggcugggauugaggaguggagaucucuuccuccaaaagcuggaaauccccagaaacuagaggcaaucggguucugcucgccaucucugccaggcccaagccucccucuucagagggguucuagcagagcugacuuaggcuucuggggccugugaugacaucuguaagcucccuggguguugcucuggggaggucuguguagguuuuucuaggugagaugcagcaccuuaacgggcagugagccagacauccuggggcagagacacuuagaugcuggggcacaucuuuccuguacuucaaggcagaacacuuacauccugugagugugaggcuagccugguguacauagcaacuuccaggauugcacaaugggacuccgucuuaaagaagaauagugaaggugugugggaggcugcucccucugcccucucugaccagagcuugcccccccacccccaccccaagacgucuuuuggaucagcuucugcacagaauguagaaucaguuggucuugagucaguaggugcuggcucuguucagugacuuguggagcagacaauaagagcgcaucuggcagcucaccaugaguuuaaauguuggcugagcuaaucuugacuauuccugugucaucucagcaacuagcuagcugccaacaccuagaaggugaacgacuuugcauacuuacauacaucucuguccaggucuguuguguugaugagaacccagcggccuguagcuuccccacacagacaugguauuggcucauuagcuuggggaacuggggaucucaggccuaguggacuuggaagcuugaagucuuuggaacugucugucucuccugcuuuugcuuuucccaggguacuggcuuccuucgcaugcccugugcugagcaaggaagauaguuacugucagcaucccugucaccaggguuuauagcucagagccauucccuugucaggucacuuuacaaaucucacagaggcucuacuugaccacaugcuccccuagggaacucaccuuuguauagugaauuugguggcauuuaauguacagaaccugaagccuguaguguuuggagaccuaaaagcccuucccugagcucuggaucaauggucuagagugccagagccccgugaaaaguucugugugggggccuugcauuuccaugcccaucagggccaccauaacuauauaguuaacuugaacacacauguccccgguccuggcauccagggacuggcucacagaaccaccucugguucuacugucaugggguugcagcuugggaggagcuggcuuggaggcaggugugcuuuacuuaaugaccuguuccugagaugcuguguagugagcagagcgaaggcgucauacaugcucccacaaccaccaggaucgagugcggaccagcucauagggaggcuagaugcacggcagccacagacuaaccagugggagagaccuagagaguguugucaaagugugucuagaaugagcuucugaggcuguuuuguggugugcaugcguccaugcguguguacacacucaugaggcucugcagguagaagcccagguuaaugucgguugucuuucucaacuguucaucauguuuugauuuucuuaacuaguuuuuaucuugguuuuuuuuuuuuuuuuuaauguauaagagaugugggaagccacaugugccguugcagaguggcacugacuacugcuggccaccacgcauaaguuuggauaaacaaccaauguguacauaugcaguaaagcuuuuugccaagucacugccuggcccgggcaugauaaugaggcuuugagaguauaaccaaucagaugugagacaugcaaaugagguaugauaaugaggcucugugagguacagagagagaaagagagagagaguagccaaucagaugaggaacaugcaaaugaggcguaguacauaaccaauccgggugugagacacgccucuccuaggccuauauaagcagcaccaggcuugggggucucuucgccucuaccaucaagcucucccaauaaacgugugcagaaggauccuguugcagcgucguuacugcuggccagucuggcgcgugcaagaaagaaugucuugucuuuguauaugucugcacaccauauguguacaguguucauacaggcuagaagaaaacaucagaucuccuagaauggguuacagacaaugagugcugggaacccagcccagguccucuguggagaucagcucuuggccaacugaggcuucucccaguuguguuuucgagaugaguccucucacugauccuggagcccagcaguucagcuacccgagacaucuugucuuugccucccuaagccaggauagcaggugugugcugccacgccccacuccuuacauggguacuggggauaugaacucaggucuuuaugcuauuacagaaagcacuuuacuagcugagcugucuccccaggugccccgcccaggugguuuuuucuaacacaauuccacuuaccugccaagugucuuagaugcugugucucuguuggcguaguuaagcccuguggacagccucccccacccccauuucaucugguggguuguccagugcccugcuccaucucuaucuacaaggacauuuuagccccuguccugccuggguccuugggcaggaaugacccagugggaagggacagagcuccagcgugaggcagacugguccugugcaguccuaaucucggcagagccauaggaggaagcucccugcggggcuaaugagccgguuccuuggcgguuccuuggugguuccuaggcugcgccugagcauaguacugcuuuugcuucccuggacuguuucaagggaggaauggcaguguugaauagggugcacagccauguagagccgcacacuggagacagcuagcuuaauccuucucucggacacuggcagacucuguucccugagccuggccaauagcagcaaucgucugaccuggugaucugcucucuugccaccucauuauggauaggguuguguccacaagagacaucuccaugaacccaggaaacuccuggcaacggaggccucuucuuuuucucaauugcuucagacuugaggugucugggugcuguucccuguguuuauagccugaggcccauccuggcacuuugucuagaugaguggcacagggccugacuugcuaacuaccagcaguaggacccccagacugaaaggugaggcugauagggguguagucugcaguucccuggccugucccaggcaugcacauuaagucacucacuugcucaguaacuccugucagcugagaggaaaaaccaucccugugcugcucggacccgaggacccaggucacacugugacgcagaaggucucagugucagagcuuuggcuuccuugcccgucagugacacuccuguggcuuccuuaucaucacaaggcccagugaacaaaugacuggagugcacuggcccuucugcagccccuguggugagcacagagcuucuuauacugggcacacaugaauaaacagaggacccuguacaacaggugaaugucagcaagcagugccaguggcugagugagaggaacaggccaaggcuggaauugacugccucccagaaaccaaacggggucuuuuaaaauccaucuuauacaaaagacgaguaacauuuuaaaaucugaaaacaggcccagucaugacuguugucaucguuuuaggaaaagaaacuacugcuaguguggaggaugaggagaagaaaggauucgagaggaugcagaacgcccaguggccaagcugcuguagguccaugugggcaguggacuguauaugugguugggaugagcaaaucuagaagcaacaauauaaacaggccucgggagcagauggguguggggccgugagggaucagggagagcuuagaaaugaacuugggcagcacauggggggcagugccaaaagcugagguauggcaggguuagggcgaggaggagacagcaaaugcaucgggaggcaugaugaccgugguguguacacacccacagaggacggcuuccacugcauagagcaaacaugacugcacuguuaaccgcacuucugacuccuccaggaccacuggucacaagaaggggacagacagaaucuucucauucuugcaugcgacucuggggggcugcuaaguauagaaaauagauuucauaguuaauaaugaagcagugagagacacagauucuagcucugcugcucaucaacugagcucucaaaccagcccugguccuuucugggugcuguucccuguguuuacagccugaggcccauccuggcacuuugucuagaugaguggcacagggccugacuugcuaacuaccagcaguguuagggcuacuauggcaggggugugacugcugugucugcuguggugugacugccguggugugacugcugugucugccuuguuggugugacugcuguggccuguguggccguggugugacugguagcaacacuggaagcuguagguauuggaugugaaaauugcugggcccugagcucauaggaaccaagaggcccugccgcucuuucaccgcauucgcucacucguucacggagccacugcccugcagauggcuagcugggugagacagacaugagaacaugucaccuuaaaggugacaugcaauaaaggaagacauccagcaucagccucuggccuccacacacauguguacacacauaccuacguacauacgcaugcacaugaaugcaugcacaugcguacaccauacacacagcacacgugucugugguagaguguuggugguguuauaaaguagcugggcacuuccguaaaggaacacagcagagaaggaaggcugggcagucuuuagaagcagacuuuguuguuauuuuuuuagcuuucuguguuggcaugaagcuaaguguacccuucagaccagaaaaggguaucagauccccuagaacuggaguuacauacaaaugauugugagcuaccacaugggugcugggaacuggaccuggguucacuguaagagcagcaagugcucuuaaccacugaacuccaaccccaggaguauguucuuaagaguagccaagccacaggguggggagcugggcagggacagagggugcuccugggaagcccugcugucugaccuuggugcuauuaggcugcucagcugccuucuuagguauggggcaugaggcaguagaugguaggaagcccuggggaggcuuaggguggagagaccugcaccugggaagcauccuuugucagguacaggagugagcagaggcggagguagggcagggacaggcagaaugggaagggguggggcucagaugcuagagaguggcugagucaagacagagaguagguugggucagcaagcucugagaccuguugcagaauaguggaaggugaaccauugggaucccggucacccuuccugcuggaggaaggcugggccucuaggaaagaugccauguggccugggaugguugaguuggaaggaauugggacaggacaugcccauacuaguuaucugguguguaguugaauagggguggagucucagagccaaaagggacaaggcagcaggaagaaccucuguagcaugaagcagcacaggacagccacuaggccacuguaccagcucccauugccacaggcuugagcacagaguaucagcuccauccugaagaccuggacaggccucaguaagcucuuugguguauguuuuaauucugcccagggcacguagaggcagccggcuuccacgaugugugcaggugcuauaaggagcagcucucugcuccaaggcccucagugacauagacaucauauccugcuggguuugccuuaaucaugagccugcccaauggacucuacagggaugugcaguugacagccucucuucugaggcuugguuuuguuguuuuguuuuguuuuguuuuguuuuguuuuguuuucuuggucaaguugcauaauaguguugggggacuuuggacaccauugacuuauggcaggaggcggcucagcagcuugggggcugugagcuccaguccugaaacuuuauaacacccacaaggccguucccugagcugcaguuccuccccugcaggaaggaggcugggcccuggugucucagguaaugccaggaaauaaaaugagcuagaaccugggcucacugaguucaacacagaugucuuaguuaggguucuacuguugugaacagacaccaugacuaaggcaaccuuauaaggacaacguuuuuuuuuuuucccgagacaggguuucucuguguagcuagcccuagcuguccuagaacucacuuuguagaccaggcuggccucaaacucagaaaucugccugccgcugccucccaagugcugggauuaaaggcgugcgccaccaccgcccggcauaaggacaacauuuuaucggggcuggcuuacagguucacaaggcaggaacauggugguguccaggcaggaacggugcaggaugagcugagaguucuacaucuucaucugaaggcuacuaggagaagacuggcuucuaggcagcuaaagcccaagcccacagugacacacuuauuccaacuaggccacaccuacuaguagggccacuccccaggccaagcauauucaaaccaccacaacagaggaaccucuuugucuuccagagcuaggagguagcuuuagucugcuuuuuaauuuuucuacuuuaaauaaagaucaagagauuuaaaggcuggagagauagcucaucacuggagaguacuugcuuugccugcagaggaccuggguucaguucccagcacccacauggcggcucuuggcuaucuguagcaccaguuccaggggcuccaauaccuuuuucugaccucuggauagugagaacacauaugauagacauacauacauacgacauacauacauaccggcaacacacacacaaaacgaaauuaauaaaucucauaacaauuugaaaaauauaucaagaggcaaaacaagcagcaaccuuucucauauuaagucucagccaaggcuacccaguaagaccuuguaucaggagucggaggcagguagaccuuccccaaugcugugcuaguaccuugggguguuggcccugaacagugcuguugagucauagcacuacaaggggacacagagcugccaucacuguauaugcaaagaacccaggaggagccaggaguccacaguucaugggaggucacccagcuggcauggaucuugaauauuuuaaaacuuuauuuuuguguguuuuuguaaacaguguauguaugucugaacauguguuauguaugagacuguguguguguuauguaugugagucugcaugggagaguguguguguuucuguuuguguauguguauacagguguguaugagugugugcagguguuuauguaggugugugagugugugugugguguuaugcuuguguguguuucugagugcaguuguauaaguguuuuguguuugagugaauaugugugugugaugugugaagcgcauaggagccacagagcacguggggaagucagaggacgaucauggaguuagguuuuccuucugccuucauggagacucuggaaacugaacugcacgccgaaugcuguuuacuccugagccaucucaccagccuggcgugcauuguuuuaauuucauuuguuuguuuguuuuauuuauugcauuuguuuauauguuuauuguugcauggggucaugcgugccacaagcacuugguggucagaggacaacacaguuuuaggagucaguucucuguucucuccuacuacgugagaccuuugggcuugcuacaccuuucccagcugagccaacaugccucaccccacacccccacccugacauggaauuuuaagaguaaacacugcagaccaagugcagcuuaaagacaaagcccagguugugucuggcguccccuggacuaaccugcuuuuggcguccuuuggggccacaauacucuucagguuaucaccagaugagaggaaaaccacacaggagcugccauuccagauccugcccugcugugagcagaguggccucaguggccugggguggccugcgccuuccgggggcucagcuuauuuaucuccuggugaggacagacccagaucugcagcuuugaacuuucuuuuuucagcagcaaaaccuuuguuccaaccaaauuuuaugagagcgcaucccgggguaugaaacagagcagagcugucccaguugcugagaaccugggauucuugcccaaggcugccucugaccucccccagggcaccaccaccagccgcuguagcacacagugauaacccaccugcccacugccuucuccacccccagcucaaaacgugaggaugaacaaucaccaggagugccagccacaguaacgggcccacagccaagccucacuaauacuguccuagcuugagacauccugacagccacugggagccaccagcccugugacuucacacacacacacacacacacacacacacacugcucccaggugucugucaccguccccaucuuacacauaaagcaugggacugaagucccacaagccacuagacuggaagguaaaggagcccagauggcacccagugccauguagcuggucuggguacugauccuucucugugucucucuggcgugcgucaguugacagcaucccguuggucaagcuggaguccucuaaacaguacucuguuuuuuuaaucaccccacaggaggcagaacaggcugagcccagaagugcagaggggccaaagaagcccaagguugccaucgcuuccaccaacaagaggccgaagaaggagacgaagaagaagcgauagaauccuagaauccgaggccgaggagcccaaggcugcagccucggggacagcccuccugggaaccagcauccuguuugcucucacagacugucucuguccucggcucagagucugagaggauugaaacucccucugacuacagagcucugaacaguccuuaggcuccagcugugcagaccaccacuuccucuucuuucucucuguggugcacgggagauucucaagagcaaacacugccccgaggguuccgagucaggucaggcucacagggcaacguauucacauuaguccuggaguccagugggcucgagaccugagccucacuaacagcauggaauuguugccuaaggcugcaggcauacccucucccugugcuugggccacauuugucuuuugugagcacagaacuucacacguguucaggucaggaugcauggccgugcagugugagccagccagguccugaagauguuggggguuggggggugaggggggcggacaguagaaggccugggcccaguggugccugcaggggaagguacagcugaaugaggccagauuuccugggcacagacuuuguaagccuuugaagcaggcuugucccuuucacaccaaccuccuuuuaacccaguuaacauucaaagugccuuugacuucaaccaguccuccccacaucucguauucccugaccagugaaggaaaaugauguggagaagucaaaguaaauaaaguguccugcaugcugag

SEQ ID NO: 1228 - RNA, 17555 nt, Mus musculus
uagaaguuggugcuggagaguggugaaucucgaggugccuggcaguggugccuugggccauggccuccgaccugggcuucucaccucccgaggugccugagcccaccuuccuggagaaccugcugcgguauggacucuuccugggagccaucuuccagcucaucuguguccuggccaucaucguacccauucccaagucccaugaggcgguaaguccuucccugggaccucagcuuucuagauggcaggcuggauggauuccuguggcaggagaaucgccacagacaagaugggcaggggcugugugaccccugucaaguuaacuugcuuccuggaagaccaccugauggaugaggucacagacgcaccagaagaaggcgucagaucucguuauggaugguugugagccaccaugugguugcugggauuugaacuccagaccuuuggaagagcagucgggugcucuuacccacugagccaucucaccagccccacugaguacucuuaaccagugagcacccucuauuugauaaacaucaacuuauaaaaauuugagcaaaaauuuaaauauuuuucauuuucacauuauauguaugaauauuuugcuugcgcauguucagaugccaucugugauuuugagagccaccaugugguugcuggggagugaacccagguccucugcaauagcaacaaguacucugaacugcuaggccaucucuuuagucccguuuuaguuucuaaguuacacuuauuuauuuguuuguuuguucaugggagagagagagagagggagggggggguaagcuuguguggaagucagagagaacuuuggggaguugguucucuccuuccaccguggggguuccagggauagaacucaguuugucagucuuggcagcagucaccuuuacggugugaaccauuccacugaccuggguuuuauucuuuguuuugauacuugagauagggucuccuuugaagcccaaacuguccuugaacucacucuucucccacuucagccccccaaugcugcaauagcaagugugugccaacacacucagccacaaaacauuuuuuuaaaaagaaguugcaccagguguaauagcucacaccuacaauuacagcacgcaggaagcuaaagcagggggauugcuguaaguuugagggcagccuagacuccaguaaauugcaggccaauuugggcuacagugagacucuaucucaguggaauucauacuggguauuuaaauuagaauucauacuggguauuuaaauucaaacugaagacucagguguuuuucacacuuguuuguuugaguugguuggugugugagugaguguguuugccacuguguauggaggucagaggacaaccgucaggaguuggaccacgagggucccugggacugaacucaggucguuaggauggcugcaagcgcccuugcccacugagauaucuugccagcucuaaaguuauaucuuuggcuuauauuggcagucuuauuuuauagaaagauuaacaaaaugacuaauuuguucuguccugcuauguuggaggucaccaaagccaccucacaauugugguuaccacagugaaaggcuauagagaaggcacaggauaaagcuguagagaaacugacccaaguccaaaagugcccugacuggagccacacagauguccagcuccaacagcaaggagucaauagaucauuaagcacugucuagcuagggacgccuuagagacucuauguccaggcuguguaugcauuucgguuguuuaagacaguaacggauaugggcuggugagauggcucaguggguaagagcacccgacugcucuuccgaagguccagaguucaaaucccagcaaccacaugguggcucacaaccaucuguaacaagaucugacucccucuucuggagugucugaagacagcuacaguguacuuacauauaauaaauaaauaaaucuuaaaaaaaaaaaaaagacaguaucggauagcagaaguuggccuuaaauuccugcucuuccugacucuguauuccuaaugauggaauuuuagacauguauaccacaccuaguuuaugggguguuuggaacuaaacccagggcuucaagcaugguaggcaagcccuuuaccaaaugaguaacauccgcagccuauaaguauggccauaagcuaaccguuuuccuuaucugugacaguaucgggcauuugaucuagggcaucacuuacugagaggcaaguguucuacacacaggcuauagcccuagccuaugaggcuuuuuauuagggauugguuauauaagcacuuuuuacuuacuauacacuccaguuucagacuugcagagagcagguguccagcauaagccauguugcuuaauggguuaggcacagugcacucucaggagccaugggaugaggggcgcuguuagagaucccagugcccagugcuggcaugccagcagggaccguccacgcgggcagguaacacaccuaaguguuugauuagcucugaccgagacucaggcaggaaggugaggguuuguuuugaccuuggguugcauuccugcagggagauuguccugagaauguugcucucagucucuucucuguggcucacuccacucuggaaaacauuagguacauuugcuacaacuuguuuuuaauuucuaggaauucuucuuacuaauuuguuuuugaaaucuuauaaaauguuuauauauaaugcuuccaaccuguauaauaagguacauucauagaaguuuccuuuaaucucauuaugcccccaccacucccugcuuccucccauagggaaccauuuuuauuacuaagauucaucuuuaucauuucgauucauuguuguuuuuuaacccaaauaaaugcuugaguguuguauauauaugaauauacgcauguuuguaguccuguggucugucucuguugagugcugggauuaaaggccggcuguuucuuaaugcacagcacaugguggaggcugcacaucucaaggcuugucgugucugaagcuccugcuuacgcaguggguccuggugcaguggggaacuaagugagaggagcagguguggcauggggccaggggaagaggaacaccagguuucaaguuuuaaaaaagugccauuaagggguuggagagauggcucagggagcacuggcugcucucucagaggacccggguucaauuccuaacacccacauggcagcucacaccugucuguaauuccaguuccaggguuucuacuauagucacacagacggacaaaacaccaaugaacauaauacaaaauaaauuacauauuuuaaaaggugccuucaagacaacuuggguggucugucaagucaacagguggaucuucaugucuguagaaagaggagacugugggcaaacaguugacgacguuagggcaugugucacugaagucgugggagagcguggagagcaugaagucucccagggagacgcagaagugagagaugguccucuggcacacaccugugaucccagcaaauucagggccgauuugggcugcguagacacugucugcaggagggauaugggaauggccuagugguaaagugcuugcugugcagcaugaggaccucaauuuggguccuuagcauccacauggcuaagcgcacgucacccagcccugggugggugagacaggcagaauacuaggguuugucugccacugacccagcugaacaauagcaagcuccugguuuggugucucuucuagucucugcacauggacauggaugcacauacauaccacauaccacauaccacauaccaaauacauaugugcacauucucacgcacacauaaacaggacaaagggcggagcuuggggggggcuccagcaugggcaagccguggccugugcugguuccguccaccgugcauuugggcuauuuuguggaugucaccauaggacuucuucugccuguagucacagcacacuuuaagagcacagugccugaccccaguccucgccagggcaugcuguggguaucauaagugacaaacuuauugucaucagcugccccugcugaggcugcguuggauccccagaaaggggaugauaacuuguuuuauuuggagagcuagguagagcuaggagaggaagccggguuccgcuuauuguucuuaacccuuugaagugagcagaggcuuggagcuaucccacaggcucucagggaagacccgggcaggcuaagguccuuugaauaaggaguugacaaagggcucauaaaucagcuccccaaagugaacugaaagcuccccucugaccuccacugugacaaacacccccucccccaaugacauuuuuaaaaaauuuuaauaccugucuccuaaaaaccggccaaaaauuuuuuuugaguacaguccucuuaaaucacccaacaagcaaggagccuuaacuuagcucgucuuuuaaaauauaaacagguugcagcaaaggguugcugcuuucuuguaguucccagggcauggagcacagggagcugccuuccuaacugaugguuacuguguuaacuuggcuuuguucuguuuugcugagacaagcuuucacacuguggcccaugcuggucucaaacugagaauaguagcccuccugccucaguuucccaggugcugcagucgccacaggcgugugccaccacacagagcuguucuagcugucuuugugaaugcaugugugucuggguagaggucagagggugacucacagggauggguucucucuacuguguggacucuggggaucaaacccugagcgaccagcagcccaguggcaggucauuucaccgacugagccaucucacuggcgccaguguuagcuggucuggaacucacacucagagaucugcccaccucucucucuccuaaguucuaggaugaaaagagugcaccauuauauuccacccuuuuccuuuuaagaagagcuugcuaggggccuggagagaugguucaguuaggguggcuacuauuccugcagaacaccuaggcuuggcuuccagcacccacacugggcagcucacagcacuuacaacuuaggcuccagaggauccaccacccuccucuggccucuguaggcaccguauaaacaauacauacacauaaauacagauaaaguaaaucuuaaacaacaaaaaacuggggcuggagacgcggcucagcuguuaagagcacuggcugcucuugcagaggaccuggguuugguuccuagcaccuacaugguggcucacagccaacuccaguuccagcagauccagcaaccucuuccggccugaucucccaucucuguggguaccaggcaugcacaugguauucauuuaaacaaggagacaaaucauuguacacauaaaauaaaauauauacaucuuuuauuauuuauuuauuuauuuuuguuuuucaagacaggguuucucuguguagaucaggcuguccuggaacucagaaaucugccugccucugccucucaagugcugugauuaaagguguguaccaccacugcccggcuuaucuuuuaaauauuaaaaacaaacaaccaaacaaaaccuuuucaguagguguuagggauggugaugaugaugauggugauaaaauaaaguacugugagcccauuuacugccuuagacuagcauauggucccugggacuagggauucugcuaccaacauucuucuguaugcugccaugagacagccuccacucccucccacaacucguaacuacucacauggaaaggagaggagcugugugcaagaacuagagagcgcaguggugagugucagggcaauggugagugucagggcuaggcggauguggaugugugugugucagacagccagccuuugggggggaggaagggggcuuuaacugagggacacaggaggucuaagggaggaagggagccugggaaaguaggggcagcuuguagaggcuccuuacagccugagggcagcagaggggugcuuggaugcuacagagguggggaggagcagaguggggugaagggcugcucugugcugguugcuuaaggcaaaacgauccucuugcgacauauagacacaagguuuauuaggggcuuuuugggucagaagauaauauuuuuggcuccagaugaugggaaagccuuuaaaaagcaaaagaaugucuuugcuguuuuccaauaagcugauuucuuacaaugguuuaugccuucagcgcuucaauacuuaagagauuaucugaaagcucuuuggaggcuaaucaggagagagaaaaagaacacauauaaaugcuucccacaccaccccccuuccuuuucagaggagagacaagaauccauuggccaaugcaagccaggccucuggaauccuaagccagauggaaagguuuucccauuggcacccuauuaagcuaagaccuaagaaaacauuuauuugcuccugacuaaggccaaggccacacaaccugaguauuuuacugaaggcugaauuaaaaaaaugugaguuaacagguccuuagacucagacaagacagcaaacgcaggccaaguuugguuauauggagcaugguaaaaaaggacccgagggacacuggugaccaguguguaaagaccccacgccuuugccaguuccagaaccuauggugcaagaagagaagugacuccauaauguugucccugaccuucacaaugucacauguguacacacacacacacacacacacacacacacacacacacuaaauaaagguaauaagauuuaggcugcacaugguggcccacgccuuuaaucagcacucugagagcagaggcaggugaucuccgaguucaaggccagccuggucuauguggccagcuacagguauguggugagacccuaucucaaaaggaaaauaaaauaaaaaggauucugagauagcuucuaggcucuagagggaagagauugauugucgauguuugcacaugagccagggacugggaguguccuugcucugugguucuguaccuggcugggccaucuggggaauuuuuguagcccuuaacugacugccugagaccgagacacugagucucuucuucagagucuuagaucaauguuugcaacaugcccaaaugaaacuaauagguaucauuugucuagcccuucgauucccugaagaggaggacagguuaaguuugaaaugauagcuugauaucacaaguugugaagggagcuaagugaugguaguguaugauuuuaaucccagcacccaggaggaaaaguaggcagaucucuaaguucaaggcccgccuggucuauagagcuaguucuggauagccagggcuacauggagaaacccucucuggaaaaaaaauaacaacaacaaaacccaaccaaccaaguugggaaaggaaaagcuagaagaaguuagaauaaagaccuuggaguaauggagagugugcaugcaugugugugugagugcguugggaagucacuguuuugaaacuggcacuacucuccuguagccccgacuggcccucgcccaccuggcccugaacuugcuguguauccaaggaugacuuuguacugugauccuccuucugccuuugccucccucagcagcaggauucucagugugucccaccacacccagcuucuauuagcacgcuuacuugaaacuuaggaguugcugggcucugcaaagaaauuaagauuccagcaaggccugaccuugcccuuccuuaccuacugugcuugacauuuaugugcacuguagauugacugauauguggucgcugcuggggugggaaccuggaacuccuaaggugcccucugccuccccuuuacuccucugucccucugucuuccaaggcucucaccagggccugcuuccucugcuccaugacccuguggugagaugacagcucccaggauucaucucuuucagcuacagcaucccaaggaggcugucuuccugcuuggucugguugaaaggccucuggaaggaacuguauggcuggccugcuggggacagcagugggcaggggauuggcgcugcagagugauggcugggauugaggaguggagaucucuuccuccaaaagcuggaaauccccagaaacuagaggcaaucggguucugcucgccaucucugccaggcccaagccucccucuucagagggguucuagcagagcugacuuaggcuucuggggccugugaugacaucuguaagcucccuggguguugcucuggggaggucuguguagguuuuucuaggugagaugcagcaccuuaacgggcagugagccagacauccuggggcagagacacuuagaugcuggggcacaucuuuccuguacuucaaggcagaacacuuacauccugugagugugaggcuagccugguguacauagcaacuuccaggauugcacaaugggacuccgucuuaaagaagaauagugaaggugugugggaggcugcucccucugcccucucugaccagagcuugcccccccacccccaccccaagacgucuuuuggaucagcuucugcacagaauguagaaucaguuggucuugagucaguaggugcuggcucuguucagugacuuguggagcagacaauaagagcgcaucuggcagcucaccaugaguuuaaauguuggcugagcuaaucuugacuauuccugugucaucucagcaacuagcuagcugccaacaccuagaaggugaacgacuuugcauacuuacauacaucucuguccaggucuguuguguugaugagaacccagcggccuguagcuuccccacacagacaugguauuggcucauuagcuuggggaacuggggaucucaggccuaguggacuuggaagcuugaagucuuuggaacugucugucucuccugcuuuugcuuuucccaggguacuggcuuccuucgcaugcccugugcugagcaaggaagauaguuacugucagcaucccugucaccaggguuuauagcucagagccauucccuugucaggucacuuuacaaaucucacagaggcucuacuugaccacaugcuccccuagggaacucaccuuuguauagugaauuugguggcauuuaauguacagaaccugaagccuguaguguuuggagaccuaaaagcccuucccugagcucuggaucaauggucuagagugccagagccccgugaaaaguucugugugggggccuugcauuuccaugcccaucagggccaccauaacuauauaguuaacuugaacacacauguccccgguccuggcauccagggacuggcucacagaaccaccucugguucuacugucaugggguugcagcuugggaggagcuggcuuggaggcaggugugcuuuacuuaaugaccuguuccugagaugcuguguagugagcagagcgaaggcgucauacaugcucccacaaccaccaggaucgagugcggaccagcucauagggaggcuagaugcacggcagccacagacuaaccagugggagagaccuagagaguguugucaaagugugucuagaaugagcuucugaggcuguuuuguggugugcaugcguccaugcguguguacacacucaugaggcucugcagguagaagcccagguuaaugucgguugucuuucucaacuguucaucauguuuugauuuucuuaacuaguuuuuaucuugguuuuuuuuuuuuuuuuuaauguauaagagaugugggaagccacaugugccguugcagaguggcacugacuacugcuggccaccacgcauaaguuuggauaaacaaccaauguguacauaugcaguaaagcuuuuugccaagucacugccuggcccgggcaugauaaugaggcuuugagaguauaaccaaucagaugugagacaugcaaaugagguaugauaaugaggcucugugagguacagagagagaaagagagagagaguagccaaucagaugaggaacaugcaaaugaggcguaguacauaaccaauccgggugugagacacgccucuccuaggccuauauaagcagcaccaggcuugggggucucuucgccucuaccaucaagcucucccaauaaacgugugcagaaggauccuguugcagcgucguuacugcuggccagucuggcgcgugcaagaaagaaugucuugucuuuguauaugucugcacaccauauguguacaguguucauacaggcuagaagaaaacaucagaucuccuagaauggguuacagacaaugagugcugggaacccagcccagguccucuguggagaucagcucuuggccaacugaggcuucucccaguuguguuuucgagaugaguccucucacugauccuggagcccagcaguucagcuacccgagacaucuugucuuugccucccuaagccaggauagcaggugugugcugccacgccccacuccuuacauggguacuggggauaugaacucaggucuuuaugcuauuacagaaagcacuuuacuagcugagcugucuccccaggugccccgcccaggugguuuuuucuaacacaauuccacuuaccugccaagugucuuagaugcugugucucuguuggcguaguuaagcccuguggacagccucccccacccccauuucaucugguggguuguccagugcccugcuccaucucuaucuacaaggacauuuuagccccuguccugccuggguccuugggcaggaaugacccagugggaagggacagagcuccagcgugaggcagacugguccugugcaguccuaaucucggcagagccauaggaggaagcucccugcggggcuaaugagccgguuccuuggcgguuccuuggugguuccuaggcugcgccugagcauaguacugcuuuugcuucccuggacuguuucaagggaggaauggcaguguugaauagggugcacagccauguagagccgcacacuggagacagcuagcuuaauccuucucucggacacuggcagacucuguucccugagccuggccaauagcagcaaucgucugaccuggugaucugcucucuugccaccucauuauggauaggguuguguccacaagagacaucuccaugaacccaggaaacuccuggcaacggaggccucuucuuuuucucaauugcuucagacuugaggugucugggugcuguucccuguguuuauagccugaggcccauccuggcacuuugucuagaugaguggcacagggccugacuugcuaacuaccagcaguaggacccccagacugaaaggugaggcugauagggguguagucugcaguucccuggccugucccaggcaugcacauuaagucacucacuugcucaguaacuccugucagcugagaggaaaaaccaucccugugcugcucggacccgaggacccaggucacacugugacgcagaaggucucagugucagagcuuuggcuuccuugcccgucagugacacuccuguggcuuccuuaucaucacaaggcccagugaacaaaugacuggagugcacuggcccuucugcagccccuguggugagcacagagcuucuuauacugggcacacaugaauaaacagaggacccuguacaacaggugaaugucagcaagcagugccaguggcugagugagaggaacaggccaaggcuggaauugacugccucccagaaaccaaacggggucuuuuaaaauccaucuuauacaaaagacgaguaacauuuuaaaaucugaaaacaggcccagucaugacuguugucaucguuuuaggaaaagaaacuacugcuaguguggaggaugaggagaagaaaggauucgagaggaugcagaacgcccaguggccaagcugcuguagguccaugugggcaguggacuguauaugugguugggaugagcaaaucuagaagcaacaauauaaacaggccucgggagcagauggguguggggccgugagggaucagggagagcuuagaaaugaacuugggcagcacauggggggcagugccaaaagcugagguauggcaggguuagggcgaggaggagacagcaaaugcaucgggaggcaugaugaccgugguguguacacacccacagaggacggcuuccacugcauagagcaaacaugacugcacuguuaaccgcacuucugacuccuccaggaccacuggucacaagaaggggacagacagaaucuucucauucuugcaugcgacucuggggggcugcuaaguauagaaaauagauuucauaguuaauaaugaagcagugagagacacagauucuagcucugcugcucaucaacugagcucucaaaccagcccugguccuuucugggugcuguucccuguguuuacagccugaggcccauccuggcacuuugucuagaugaguggcacagggccugacuugcuaacuaccagcaguguuagggcuacuauggcaggggugugacugcugugucugcuguggugugacugccguggugugacugcugugucugccuuguuggugugacugcuguggccuguguggccguggugugacugguagcaacacuggaagcuguagguauuggaugugaaaauugcugggcccugagcucauaggaaccaagaggcccugccgcucuuucaccgcauucgcucacucguucacggagccacugcccugcagauggcuagcugggugagacagacaugagaacaugucaccuuaaaggugacaugcaauaaaggaagacauccagcaucagccucuggccuccacacacauguguacacacauaccuacguacauacgcaugcacaugaaugcaugcacaugcguacaccauacacacagcacacgugucugugguagaguguuggugguguuauaaaguagcugggcacuuccguaaaggaacacagcagagaaggaaggcugggcagucuuuagaagcagacuuuguuguuauuuuuuuagcuuucuguguuggcaugaagcuaaguguacccuucagaccagaaaaggguaucagauccccuagaacuggaguuacauacaaaugauugugagcuaccacaugggugcugggaacuggaccuggguucacuguaagagcagcaagugcucuuaaccacugaacuccaaccccaggaguauguucuuaagaguagccaagccacaggguggggagcugggcagggacagagggugcuccugggaagcccugcugucugaccuuggugcuauuaggcugcucagcugccuucuuagguauggggcaugaggcaguagaugguaggaagcccuggggaggcuuaggguggagagaccugcaccugggaagcauccuuugucagguacaggagugagcagaggcggagguagggcagggacaggcagaaugggaagggguggggcucagaugcuagagaguggcugagucaagacagagaguagguugggucagcaagcucugagaccuguugcagaauaguggaaggugaaccauugggaucccggucacccuuccugcuggaggaaggcugggccucuaggaaagaugccauguggccugggaugguugaguuggaaggaauugggacaggacaugcccauacuaguuaucugguguguaguugaauagggguggagucucagagccaaaagggacaaggcagcaggaagaaccucuguagcaugaagcagcacaggacagccacuaggccacuguaccagcucccauugccacaggcuugagcacagaguaucagcuccauccugaagaccuggacaggccucaguaagcucuuugguguauguuuuaauucugcccagggcacguagaggcagccggcuuccacgaugugugcaggugcuauaaggagcagcucucugcuccaaggcccucagugacauagacaucauauccugcuggguuugccuuaaucaugagccugcccaauggacucuacagggaugugcaguugacagccucucuucugaggcuugguuuuguuguuuuguuuuguuuuguuuuguuuuguuuuguuuucuuggucaaguugcauaauaguguugggggacuuuggacaccauugacuuauggcaggaggcggcucagcagcuugggggcugugagcuccaguccugaaacuuuauaacacccacaaggccguucccugagcugcaguuccuccccugcaggaaggaggcugggcccuggugucucagguaaugccaggaaauaaaaugagcuagaaccugggcucacugaguucaacacagaugucuuaguuaggguucuacuguugugaacagacaccaugacuaaggcaaccuuauaaggacaacguuuuuuuuuuuucccgagacaggguuucucuguguagcuagcccuagcuguccuagaacucacuuuguagaccaggcuggccucaaacucagaaaucugccugccgcugccucccaagugcugggauuaaaggcgugcgccaccaccgcccggcauaaggacaacauuuuaucggggcuggcuuacagguucacaaggcaggaacauggugguguccaggcaggaacggugcaggaugagcugagaguucuacaucuucaucugaaggcuacuaggagaagacuggcuucuaggcagcuaaagcccaagcccacagugacacacuuauuccaacuaggccacaccuacuaguagggccacuccccaggccaagcauauucaaaccaccacaacagaggaaccucuuugucuuccagagcuaggagguagcuuuagucugcuuuuuaauuuuucuacuuuaaauaaagaucaagagauuuaaaggcuggagagauagcucaucacuggagaguacuugcuuugccugcagaggaccuggguucaguucccagcacccacauggcggcucuuggcuaucuguagcaccaguuccaggggcuccaauaccuuuuucugaccucuggauagugagaacacauaugauagacauacauacauacgacauacauacauaccggcaacacacacacaaaacgaaauuaauaaaucucauaacaauuugaaaaauauaucaagaggcaaaacaagcagcaaccuuucucauauuaagucucagccaaggcuacccaguaagaccuuguaucaggagucggaggcagguagaccuuccccaaugcugugcuaguaccuugggguguuggcccugaacagugcuguugagucauagcacuacaaggggacacagagcugccaucacuguauaugcaaagaacccaggaggagccaggaguccacaguucaugggaggucacccagcuggcauggaucuugaauauuuuaaaacuuuauuuuuguguguuuuuguaaacaguguauguaugucugaacauguguuauguaugagacuguguguguguuauguaugugagucugcaugggagaguguguguguuucuguuuguguauguguauacagguguguaugagugugugcagguguuuauguaggugugugagugugugugugguguuaugcuuguguguguuucugagugcaguuguauaaguguuuuguguuugagugaauaugugugugugaugugugaagcgcauaggagccacagagcacguggggaagucagaggacgaucauggaguuagguuuuccuucugccuucauggagacucuggaaacugaacugcacgccgaaugcuguuuacuccugagccaucucaccagccuggcgugcauuguuuuaauuucauuuguuuguuuguuuuauuuauugcauuuguuuauauguuuauuguugcauggggucaugcgugccacaagcacuugguggucagaggacaacacaguuuuaggagucaguucucuguucucuccuacuacgugagaccuuugggcuugcuacaccuuucccagcugagccaacaugccucaccccacacccccacccugacauggaauuuuaagaguaaacacugcagaccaagugcagcuuaaagacaaagcccagguugugucuggcguccccuggacuaaccugcuuuuggcguccuuuggggccacaauacucuucagguuaucaccagaugagaggaaaaccacacaggagcugccauuccagauccugcccugcugugagcagaguggccucaguggccugggguggccugcgccuuccgggggcucagcuuauuuaucuccuggugaggacagacccagaucugcagcuuugaacuuucuuuuuucagcagcaaaaccuuuguuccaaccaaauuuuaugagagcgcaucccgggguaugaaacagagcagagcugucccaguugcugagaaccugggauucuugcccaaggcugccucugaccucccccagggcaccaccaccagccgcuguagcacacagugauaacccaccugcccacugccuucuccacccccagcucaaaacgugaggaugaacaaucaccaggagugccagccacaguaacgggcccacagccaagccucacuaauacuguccuagcuugagacauccugacagccacugggagccaccagcccugugacuucacacacacacacacacacacacacacacacugcucccaggugucugucaccguccccaucuuacacauaaagcaugggacugaagucccacaagccacuagacuggaagguaaaggagcccagauggcacccagugccauguagcuggucuggguacugauccuucucugugucucucuggcgugcgucaguugacagcaucccguuggucaagcuggaguccucuaaacaguacucuguuuuuuuaaucaccccacaggaggcagaacaggcugagcccagaagugcagaggggccaaagaagcccaagguugccaucgcuuccaccaacaagaggccgaagaaggagacgaagaagaagcgauagaauccuagaauccgaggccgaggagcccaaggcugcagccucggggacagcccuccugggaaccagcauccuguuugcucucacagacugucucuguccucggcucagagucugagaggauugaaacucccucugacuacagagcucugaacaguccuuaggcuccagcugugcagaccaccacuuccucuucuuucucucuguggugcacgggagauucucaagagcaaacacugccccgaggguuccgagucaggucaggcucacagggcaacguauucacauuaguccuggaguccagugggcucgagaccugagccucacuaacagcauggaauuguugccuaaggcugcaggcauacccucucccugugcuugggccacauuugucuuuugugagcacagaacuucacacguguucaggucaggaugcauggccgugcagugugagccagccagguccugaagauguuggggguuggggggugaggggggcggacaguagaaggccugggcccaguggugccugcaggggaagguacagcugaaugaggccagauuuccugggcacagacuuuguaag

SEQ ID NO: 1229 - RNA, 1206 nt, Mus musculus
gucaccaaaggcaucucaacugucagucgacaggacacagcuaagacagaaggcuguguguggccagccaagugcagcacuggagugggcgcagaugcagacagccacucgaggccaguccugugggccacaaggcucaguggcacuuccaguguggacaccaucuaccuaugcagacagacaaaacaaaaggacagagacauguuggaaagggcacaggcaaacacuagaccagaggagcacucaggucagcuccugcccacuguagauacaaggauccgaggcagaggcuagggccaaguagggaugccccaucuguacuguggucuguaauuaagagaaaauguauucauguuuuacuuguauaauugaaauuuaauucaaacauucaaauucauuccuugccaauuagcucagcuuugcacgugugcuguguucucauucgaccguccagggacaaagcacguuugcucacugugugucucugaaugcagcacagugauaagcaaauugauuaaaauguggaaacugaaaugaaaaaccagcaaaguuucucuguucacgaaagcaacaaaacuaacaagguguucaggggucaagccauuaagaaauguggagaacgccugcgaccugcggggccagcuuuuauuagaaggcauuaaaaagcaaagcaaaaccaaaccaaacaagggagacugaccacgggagacgggcgccgugguuguugauaggagaugcugauggcauccuaaugauguuauuuuucccuccaaugcagucucacuuaauaagauuuuuuuucccauggaacuuugacaagcuaauuauaagauauacaaaaguaaaccagcaauauaacaagguuuuuuuuuuuuuuuaagaauagagggcagaguaaggguacuuaccguaacagguauuaagacacuauucaaaacuuugcucauuaaaauacagccuuggcucacaaagacagacagagaucagcagaaugaagguaccauacacaggaucugggaggaaagaaggggcaggcugugaggugcucagcaggguugcugucugccagacuccauuucugucacaucacacacaaugugccucagauggagugaguccaucugaguaggcacaaaaccauagcaaacaccagaguuugggugcaaauacagacugucuggcccagggugaggauccugucuccag

SEQ ID NO: 1230 - RNA, 15025 nt, Mus musculus
aagguacucuggcgccaaggacucagcccugugugcuucacccugccccccaccaacucagaaauccaacaccaugacccaaauggacugcagccacauaaaaccacaaaguaaaguuuauaaagcuuuauuaaacauuucaaacagcuguggaacgaacacaccagaaauaaaagcuuuacaacagcaguccgaguguuucacaaguguggccucuaagucccacuccccagaagccugcuuccagcucuguccuaugccugccccccccccccacuugcacacaagagggggaaaggagggggguacauuuccgacuggaagaacaaccaugcugauccccaguggguaggggccaggagaaagucucauuugcaaacacuuguuucugaagcgcagagaaaagcaaacaaguaccaagucaccaaaucuuucuuccuguguuuucuucauaguguacagucuacgugcgcagcaaugaggaagcuccuggugggaggaugauggcgacugcuccccugggucuugucugaaccaccuuggaguccacugugcuggucgcucugcaauccccaugcuaaauaaaaacugcagcaggaccuacuacagcuagcuacuacuacuaaaccucaaaaucagaacauauucaauaaagcuucuucaaaaggaauauacacauguauugguauguaaacacacacacaacacacauucacacauacguguguacauacacgcugacacuagugcacacauacauacagggcacaucaaaaauauccaaacaccuaccaagggaaucauggcugcuaugaaaaauguaauacuuucucauucacucagccagggaccacugggucuacgagaauacugcacaucucccuccugaagagcaugcacuggagacaugagguggccccuuuaggucagcugagagagacaggaggaagagcaaagggagagaggcugggcuggaaggcaggagcccagauacccaggccaaagagcaaugucuccccaucgcuucuuucuuaaaaaugaggcagaggaaauacuggaggucugcagacaacgagcaguugagacaugauuccgucucaccuucucaaaagggaacgaaggaugaaaaagcgaggcucucgggcaucagcaaucucuucaaauuugagauaagugcaaaaacaagcccugucuuggacaggugcuccccaaaaaaggaaagggguuggaagugaaccaaggggaaaacggggaaaggggacgaggagggaacgaggaaggucuugacgaggaaggguuauggaggugacauugagacuacacuguauccacacaggucauaucaaggguauagauuccccaaaucaaugagcaagggggugggccaauccgucagccgggacccagauggugacagaacacacaaccauaagaccacccacgacuacaggacucuacaacagaagcaccgaucagugccauuauucacauuguaaggauaaaacaucacaggccaaaaggcuccauuaggaaugugguacccgcaggacugcgggauuugaaacuccaaugcuuuaugaccuaugucaaugccuccccucccgucuucugcuuccuuggcaagcuaucucggcagacguuaggugcccacaacaccggggucaugggcugauuccggaaguggggaaucggagcagugguacaggaaacaauuuccccagcagcuauagcagaugagaaagagggcugccaggaaaaccaaggcacauauugugcaagguuuccguuccaggaggaagcugagcagguagaagcccaugaacauggaguggcugaaccacagagcgggguugaggggcuuggggaugaggaggacgggcagcagccacuggaggcaauacaugaucucugccgggcagggccuucaccaaggcugccaggcaccgcugcaggaaccgaccuaaugggagccagcaggcacagguggcugcccuucgcuuucuucgacucucucuccaggagcugagccgcugugcucucuggcugucagcccgggaucaccaaggcagcagggauccugaagagaaaagucaacacaacaaacagacaaaggacagacagacacacacaaaaaacaaaaaacaacaaacaaaacaaacaaaaaaacaggaacaaauuguauacuuauuugggaaaauggaucaugguuaacaacagcaaaugugaaugcccuuuccuccccacccacccaugaaugucuacuccuauccaaauuauuacuuaaagauagccugcuagggugugucuucccuaggcuucuacugggggaucccaggaggacacgguccccacagugggcuggcuuugccugggcccugcccagcagagaucauguaucgccuccuggggcugcagcccguccucaaaggucccagaccucacaauaccgcccuguggcugccacaggacaccaugggcuugguguugugccaccgugugguaaggaaaggcucuguaucuagucucacaucuugcugcuacugagugugguggaguaugccaauuuuacaacaguuaucugugcacugccgaccuggagaggcuaggcaauggaaccucagauccuggcaagcuaugggaagauacaguagaaagcagccugaaccauuguuugccuuuugcaaauaguucagcaucauuuaccccaaaccagccaacuucuuugaaaaauaaauuuuuaaaaaaagaaaaccaaaaccacaauacccaaacucaguuggaccauuaaaccuccaucuuuuacugacauugaacagaaaugggucuaugaaaguauuuaaucaaaauuaauguccuauccaaauaggggcaaauacuauuuggccucugugccaaggaggcuugcuggagagguacuuucuccagccacugggaccgugggaaccuucuacuugcagauggcaauuuggucuugcuaccauuaucgcaauucacuaaagaucuauaagacaacgcuaacagaggacacaagcuuuacuuugaaacuagaagacaguagccacaacccuacguggauguagcaaaauccuauuuuguguuccagcugcauagcgaacucauacaaagaaccacccuggcucaggcagaccuacuaaggauuaagagaagggagcacaaaaaacagagguccguaucugucccgcagaaaauuuggucuacuucuccauaaagcucgcuccuuuggcacacacaaagcacgccaauccuuccuacaucccucccagaguagauacaauugcuuuagcuacgaagagcaagagugccgguccagcucgggaucgcagccacuaccgccugccggacagagcgggaaccaacagucagaaaagaucaaagauucucacaaaacagcuggcauggguuuaaaauucacggacuaguaggaaugcagaaaaaagguauacauuuugcuuucagagagacuucuguaacuucggcuuuccauccguauggaagguauauuuuggcgcggcacugguuacgcggcauguagaauuuguaggcuugggugugucgaaccaagaggcuugcaccccuacccucauucuacacuguagagccacgacuucccuccauuuuacaccgaauuucaaaagcgggcagagcagaaucuucuggaacgguguuagagcgggcucaggaggugggggucgguguggaaagaacagacgggauuuuuuuuucucucuuggcgaaugaggagcgccccccaucaccccuccuucucaacaucccccaagcgcgcaugcgcacuuagguggcaagaggguacuuaaggcacggccaccggggcugcggcauugcgcccagcagcggacuccgagaccaguagaccucggcgaacccuugcucucgaccacccacccacuuucggaaccauggccgcaguggcagcagccucggcagaacugcucaucaucggcugguacaucuuccgcgugcugcugcaggugaguauguacccgggcuuugggugggagagggcacccgaaacgcgccccgggaccccuuaauccauaucgcgauugccgccccuacccaacccauccuaucccaauugccgcaaucccuguguaccaaagugccgcggugguacuauuuguccccgcccguucccgugcccacauccucgcgcagacccuguccccagugcgcccgcgcccagccgggaacaaagacucaggggugcggcggucgcccgcugcggacgaucgcgaccaacgcgguaagaaauacccgcuauauucaggcucgaucccaggagggaggcggggcacuugugugcugugaaacuuuacaguucgcacaacagaaaauuuucaccuuaaaaaauugcgcaaugcaggaaauuuucuuuuaaauacacuauguacacacauauaacacuugggugggugaaaaagaaguuagaaaauggcacuccucaggaaaaauaacaaaaagaaucucaauaagggggaaagggaggaaauagagaaaacgcgcauugcaggaaaaauaagccagacaaaggcacuuacuaggagaaaaauggauuagauaaaagugcauuggaaaagaaacaaagaaacgaaaaaaaaaaaaaaaaaaaccgaauuggaaacacacuagagaaaaaaaugccccuugcaggacaaaaacggaaggggaaagaacauuuucaaaaaaaaaaaaaaaagaaagaaagaaagaaaaagaaaaaagaaagaaagaaagaaagaaaggggcaaaucauuuuauggaaaaagagagugcgcgauaucgcgcgcaaaagugcuucucuuaaagccaaacuggaagaaagcgcuuugugcaaaaaaaaacuaucuaccccaagagcucccuuugcaggaauccugcuaaaggaauccuuugccaaaggaaucgcauauuuccuucaagguguuccuggaaugcugcauuuacuggguaggauucgcuuuucgaaauccuccagggacacagcccauugcgagaagugagguauacuuaaguuguggguccaaucagcuugcagccaugcagcucucagcacaguuggaaaagcuccagcugcccugacugguggacaagcugugccucggccgccacuccaggcuaugcuggacaggcgggcggggcagggggcggggccgggcgggcaaagcagcagcagcaagcagcaguagcagcaguagcacacaggaucauggguacuucucuaaggguggguccugggucucucaccgcagguguucagguacucccugcagaagcuggcgcacacggugucccggaccgggcggcaggugcugggggagcgcaggcagcgagcccccaacugaggccccagcucccagcccugggcggccgugucaucaggugcuccugugcuucucgaccagcaugggagccagugccgcgcaggaaugggggguccccuguguucccucgucagaggagcacuugccaaggucagugaggggccgguaggcccccagaaaagcagcaccgacaaugaugaagauaucaguucccuucccagccccuuugccccugucccacuaccggcgggugggagaggaggggggaagaggggagcaacccucgagauaugggcguaggcaccacauucugaucuggaccaagucggaacaguaccaucucagccgcacaagauccuaccaugaagaucgaacagcccaucaaccagcagaauggacauucugacaucaccagcugaagcccuacaucucggugcagaagagaaagugucaacugugugcagcauggggggaguggagggcgugggugguggaggaagaggguuaagaaaacuaguggggcccccuugcugccccuugccuauggcacacauauuccugccuugcucccucauuuccccuuuuccccccgccuucgaaagcccuccccaaaaugugucacuugauuuggauauauucaaccaguaauugaaucccaccuuuaccaaaacacguucucuaacccccggcccuucacugaucuugcuuaucccuggucucacgcagcaguuguggucaauauugugguagucgcuaauuguacugguuuaagugugcauuaguagugucuccccagcuagauuguaagcuccuggagacagggaccaccuccaccaaaaauaaaaaaauggaccucuccugucuuguaguguccuaggacccugcagggcagugggggugcaccaaaaaguucuuuuguggcuucuuuugcgacugcgucacauuauccauaaagcugggcaauguacucauuguggaggggcacaccacuuggaauggggagggggaccacaagaagacaagaauaaacugagaugcccauaucugccucauuuaaaucuguccugagauaaaggacuauuucucauccgcaaugagaagaguggaauucaucugucccagaauaagggacauuuucccuuccccacgaugaugggugaauuuauuugguggugccgagauaagguaccauggcagguuuucuaucugggaaagauggagagaaaauaacugggacuggcccucuaaauggaauacuaagggucauacggguuaauuuaagaauauaaagcuauaccacagaucucucuacccaggagccccaggaaaugaaugcugggcaagaagagggggugguggcugggacaaugagcaugagguguggcuuggccccuccuccaccaagcuuaaugcuccagaccccaggaucacccuaaggcuggccauccugucuugauuuuccaacccuccagcuggacacucccucucuuaguuuucucaguucaucccuaagggccuuaucagaucgauagcuugccuuuuccccucccauugcagcagggagggugggcuggccccuuaguucccuuucuugguuagccagagcuguucacaagugucagcugacugccucaccaaaugguccugccaccuguuaagccucauuucuggcuuuacccgucccugucucugcacaccugcuccuaugccaaugaguuagaaggucaccagucucucuugcuauuuccucaaacuuccuaguccuggucaucacauuacacacucaggugcacaaagcaccucaaaguucuugaacccugaccugcagaucccccaagaaacccugauuuucaaaucaaucacuggcaccucccucuucugcagggacuuuauagucucauucagcacuagggaauuacgggggaaaguagcacagauuuugguguggccuuggcuuuuccacccagccagguugcuuuuaguucccuacuaagguccagaugagccccauacacaucagagaggcgggauuccacaggacuuggaugugaaacccauuccaaggcgcggucuuccuuagcaggguagauacagcugcugcuaaggccugaagucaggucagguccugugccugccccguaguuacucaucugcagucaguggcuaccuccuuuaugguuagaaacuucugugguuugccauacuaaacucauugaaccuugaguacauauacaacacagguuccaaaggaagguugacucuccccuuggagaucuggaguggggggccugaugucacucuauuguuccauguucuaacgucagcccaaauuagaugccagcugaguacacaaaagccaaaccagggagaaaggagucuggcuacucuggucauagcauauccugugcccaucccuaagccaggaggcuacuacugguaacuccagggcuuuccagaugaucuugguaaaaccuuuuucuuccaucuauuauccagcagugaugaguguagguggagucuucaaggcgcccuggugacccugagaaugugaaugucuacuacccacuuucuucucccacuccacacccuuuuguccugacagcaaacuaaacccuccagaggaggcaggaauguguucgugcccuuucuuugugucaaaccugcaagccugauacaaaaccaccuuguuuauacaaugcuuccacaagcuaugcauuaaaacauuuuauucucacauaaagcaaugggaugugucuuuauugcaaaguccuuaguacacagaacuaaauaucccuuuuucuuaaagagguugcuaccuccaaagaggagcaaagguggagaaggugaaguggaacagcuuuaugggaaucuagcaacacacgagauuccaggcacuaaugccagagaaggccugaccagcucaagcucaguaggguggagguuacuaaguaccaaaacuuuuagagauguggguucuaggagacuuuuaagucuaucuguaaaguaacugaauugugacugaaauguaucugagggacaggacaggaauuaagauuuuuggcuuugacucuggggcuggccaaagacagcuuaauuacacagagguuuugaaggaagcaggcucgcugcugacuccuuacuagauaucuacuuucaaacuuggaucgcuucaggagccaacaucccaaagggcgagccucugagcuggcagcuaaucuuccccaggagauuuaaauguguauacacaaacauaagacuaauuuaccaaagucucuuuuuucaggugaccacugacuucuuccauaugccugagagacaauguuugccacaaucuucucuggaaauaauccugucccccucccuccacagggcucauaccacaccaggauacagauuccugaacauucccagggcagagccagaagacagagaggaaggcaauacagggcucuugguaaaucacacagucacaagcuugaauggaaugcguguauuucaaagagaacaaguaaaaagggcagccuaacucucaucccccuagaaauaacagguaagaaguuaaaguguucugucaacaacuuuaagaugaccauuuucagaucgagaauugaucugguuccuggaaacugaccaagguuccagaaauccaaucuuuaaacaggaacucuggccauuaaugaaucuugacuuaaaagaaacaagccagcucaaucuaaugcuugccaggggcacauaaaauggaacuuuuuuuggguccuggcuuugguguugcaguucagauggcugacaggauggcuggaccaugucagacagggcagagcuguccccaauauaucaguucccugaaagggacaaagaagauccgaaccuauaaacagaaauaaccuauaaacuagaacgggccccaguuucccaaguaaaaagagacaagagacuuagaagaaaccuaaaggugguuuggcagagaaaggaaaaaaaaaaaaaaaucgacuguccccaucccccauucuuccuuuccagccaggcacuccguuccuucugcugcccuugagugccacuccccacaaacuggagagggaaccgguguccagacucgacgaaaaguugguggaagugagaagcacacgggacccguagcagauggucacccuaucacuccggacacaaaagagagcguucggggcccacuucuacuuucuccccacacuccuucggauaagggugggggaagaaaaagaaaaaaaaaggggggggggagagaaacugaaguggcgaggaaagaguguccagccucccagaagcugagccccucgccaagguccggaacagaggaggugguggucgcgcccgccccucccagccccgucccgggagcgcgcugaccuuggaggccagagugacagcuaaggaaccccggaacccacccaagggacgggaagggaccacccccaaggcccagguugggacgaaaaggggaggucaucugacgccagacaagggugcgcccgaccccggccgcgcggaaagccccggcgagaggccaagcgacgccuaaggugaccccggagggcuaacauggcggcgcggccgcaccgagcgcucucacccugcccaggcgggcgacgccacgauaccugcgagccccaccauggcacugccgccacugucgccgucgccgccgcugcuugccuccaccuuagcucgccaccaacgccgcaggagcuggggagacgcccccuucgucuucuaguggagcgguccaaggacccccgguccagaaccgagcugucuucugagaacgccugacaaacuggcucaaagcgaggcuacucucagacacucuccccucaguauccgccacgaaauguccuuucugaguuuuuaguagacuugaauaaaauuauggggcgcuaaggucuucaaacccguggaauauuuggucaggcguaucuuaggcagccccgaaccuccggcccaugguccccuucaugcauaugcagcagauugugauucuuacucuuugagagcuccgcgggcgagcgagguguaguuacgcugaugagcguaacuccgcagaauccuuagcaccuugugauuuguguacuuugggaaaacuucucguggcucagaucuggcccuucaaccacgggcugaggacgugcuuccuccuuggugaggaaauggcuugccccaggcuuguuaaugucuagaugagucaguguggucacuuacuagcuuauuagccacguuccugaccucauacugugcgcaagcgcagugcuagaggcuaaggagguacaauucuacuccugaccccaauuuucucagucaccagggugagagugagugucgggggauaguggagagacuaccacccaguaaccacuuguagucgcaccaguacaugauuuguaauuaggcaucguggaaggcacuaggaggcaaaguaaagagaggagaaaugaguggaauccuggugucuggagugggcgaggguuggggccgucuuaggcauauugaguuugugcauugugugagugaggggucuuguuccagacauggaggugacaacccuaaggguggaaggugaacaaggaauaugacagguaccuuggucaugaauuugaauuuuugucuugagagacaugggaagcuauguucuucgaggcaaugaaaagaaaucugggucucuccgaggccauugacuuucaggguuagaaaacaugaaagugagguuugggacaggaagccaguuaagcaaccagaacaucuuuccagacacaaagucauggugacucagacagguagugacuaagggagcuagaagagaucauaucaaacugggugcgggaagcacauacugaggcacaggcauugacuccuaagcuguggcuguagggaugaagaagaggugaagagcccuuggccaggguggaaaggcccgaagacaggcugcuaggggacaaucagaagugggacagagaacucaguagcggaaaugccugggcacaccguggauggagagaguggaccuguauaagggcuggugggccucccucagcacacgggucuugguagugucuagaagccaaggggauccaaggcaggaaggaaggaggccaauggugaucuagggaggagcugggaaaggaacugcagaagcggggugcagcagacucucuugucccuacugccacaggcugguccaugaagcagggguuccguggaguggagcuggcuggugcugacucacgugggagacuuuggacaccuuggauucgggaaugagauggcucuguagccuguucuucauguugccucucucucucuuucuuucuuucuuucuuucuuucuuucuuucuuucuuucuuucuuucuuucuuaacaguaaauuacugccuuaaaaaggaggggcuggcgagauggcucagugguuaaaagcaccgacugcucuuccgaagguucugaguucaaaucccagcaaccacaugguggcucacaaccaucuguaaugagaucugaugcccucuucuggugcaucugaagacagcuacaguguacuuagauauaauaauaaaaaauaaaucuuaaaaaaaaaaaaaaaaaggaaaugaguggccgggcgugguggugcacaccuuuaaucucagcacucaggaggcagaggcaggcagauuucugaguuugaggccagccuagucuacaaaguguguuccagaacagccagagcuacacagagaaacccugucucaaaaaacaacaacaaacaacaacaaaaaacaaaaacaaaaaaaaaaaaaaaaaggaaaugaguggcggauacauggaauggcuuggugucucagaggaccuggguuucuuccaacacucuguuauccuucaguucaugggcacaagaugaucccaguuccaggugucacaccugagcggggauggguugagaccacagcggguugggcugugacccucauguuuaauugcuuaugaguccuuuaccuguaccugguuuucugucaucuaacaacagaagaaaacagagggccagggagcucuuguuaaaugaauagcggucugagcacugaaugggggcaacucaaauuacugccugaaaacagaagagcuguuaucgcacuuacaggauuuugauagguuauuucucugccgccagugaaaugagccaauucaagccagauuagaauauuuugaaggcagguuuauugggaagcugcucucuggugaauucacuggcccuaaggaacgaggccggaaaaguccccauggggagugggagacagaagggaaggagaaagggacggagggaaagagagagcucgagggagcaaaaugucuggauuucuauagggaggagccacugagggaagagcagcccagccccugggcuggaaaguucaggguugggggccaggaggggacugagggaugcugggagaaccuggaggccaggucuguuuugauauguaaauuauguacccugguccugggguggucccaaaccaguuuuagcucaguuuucuagagcuggaguguagaggagguguguggggagccuguggaugcugcaccauaguaugagggacuugagcagcauccucauauuugggccuuagaaccaauccccucugacacacauauuuuaugcauaaauguaacaaaccacuaaagcacuacagauuaaucugacauauacaggaugcggguuagaaagagcuggacccacaccagugcaaaaagcaggaucccauugucuagcucaagaguugaugauacugaacagaggugauagcaaucaaauuaguggguucagggggucuggaggggaagggaccaagcaaagacuuggcucaggucucaagggaaacauucgaugguccuauaaaaaauuaaaaaaaaaaaaaaaaaaaaaggaaaagcauauuuuaaaagacccugcuggggaauguuuucggucauuguguauucagacacugauuucugaauccagagaucugguugcaaucuggacuuugguguugucauuauuaugaaauaggaauugagacucaguauguuguaaaacauuguaucccagaaucuucugauuguuuaaaauaaagggcugagcagcuuacagcugggcaggaaaggaaaaggugguaccucugugcucagagagagggagccagucucagguggggaaccagggaguggccgucacugggaagccgaagaagaaggagguguugucaaggcaagggcagguaucaggccauguggcuggaaagcagucugagaaguagucuaaggccagcuuugucggguuggaauagcucagaaccugcccggcuauagugucugaagcuuauuaguaaauauaagguauacaugucaguauucaaaacaaggguggguauagaaaagcucuguacuuauacagaucccaaaacaagggucagaaaguguuccuaguacuucuguggcggugugggcauugccaaagccccaguggccaacuuucuuaugggaacugcagagcuggaggcaggcauggcuucucaccuccgcuugguuucucugguugcuuccacccucaggcuugcuccauuuggauccugggauuuggaaugacccagaaacccuuucugcccuaaaauugggcuaagccaaccuugacuuccugccaaggccuccgaaauucuccccguccaccuggcagccaaccaggacaccugcuuuccucaacucggcacccccucugaaacuagucuuuuccuuggggaucccugucuccuuuagaccuuuuugucuucacugccaaaguuugguccugaucaccacccacccucccucccucccucccucccucccucccucccucccucccucccucccucaggccuguacuggccucucuguuuugacuccugugaaaccccaaacaguccuugugauggcuaguuuugccaacguagccaagaaucaccuggaaaaagucucagugagggacuuacuuaaagcagguuggcccauaggcaugucuguggaagaugcucuugauugcuuuaauuaauaugggaagaccuggucuggaaguugguggcaccauucccuggcuuuggaaccuggacuguauaggcagagaaaggucagugagcacccaagccuguaugcauucauuucucccugccuaugacuguggacuugguguggccagcugcuuccagcuccuggcaccuugaccuucucucccaccccauccccaguuaugacacucuguaaccuggcucucucuaagcugcucucugucagguuuuuguuacuguuuguuuguuuguuuuuuuuuuuuuuuuaaucacagcaacagagaucacagguguccuucauacugcagccagaagacccuguuacucuccucuggaggugguguccccuccucuguagugaccugucaaaguccuccccaucagccuucaguugcugugaagggacacugugacuauagcaacuguuacaaaggaaaacauuuaacugggggugacuuacaguuucagaaguuuaguccauuauugucauggcaggaagcaugguggugugcaggcagacaaaggugcuggagaaggggcugaaaguucuucauccugauccacaggcagcaggagagacag

SEQ ID NO: 1231 - RNA, 5632 nt, Mus musculus
caagaggguacuuaaggcacggccaccggggcugcggcauugcgcccagcagcggacuccgagaccaguagaccucggcgaacccuugcucucgaccacccacccacuuucggaaccauggccgcaguggcagcagccucggcagaacugcucaucaucggcugguacaucuuccgcgugcugcugcaggugaguauguacccgggcuuugggugggagagggcacccgaaacgcgccccgggaccccuuaauccauaucgcgauugccgccccuacccaacccauccuaucccaauugccgcaaucccuguguaccaaagugccgcggugguacuauuuguccccgcccguucccgugcccacauccucgcgcagacccuguccccagugcgcccgcgcccagccgggaacaaagacucaggggugcggcggucgcccgcugcggacgaucgcgaccaacgcgguaagaaauacccgcuauauucaggcucgaucccaggagggaggcggggcacuugugugcugugaaacuuuacaguucgcacaacagaaaauuuucaccuuaaaaaauugcgcaaugcaggaaauuuucuuuuaaauacacuauguacacacauauaacacuugggugggugaaaaagaaguuagaaaauggcacuccucaggaaaaauaacaaaaagaaucucaauaagggggaaagggaggaaauagagaaaacgcgcauugcaggaaaaauaagccagacaaaggcacuuacuaggagaaaaauggauuagauaaaagugcauuggaaaagaaacaaagaaacgaaaaaaaaaaaaaaaaaaaccgaauuggaaacacacuagagaaaaaaaugccccuugcaggacaaaaacggaaggggaaagaacauuuucaaaaaaaaaaaaaaaagaaagaaagaaagaaaaagaaaaaagaaagaaagaaagaaagaaaggggcaaaucauuuuauggaaaaagagagugcgcgauaucgcgcgcaaaagugcuucucuuaaagccaaacuggaagaaagcgcuuugugcaaaaaaaaacuaucuaccccaagagcucccuuugcaggaauccugcuaaaggaauccuuugccaaaggaaucgcauauuuccuucaagguguuccuggaaugcugcauuuacuggguaggauucgcuuuucgaaauccuccagggacacagcccauugcgagaagugagguauacuuaaguuguggguccaaucagcuugcagccaugcagcucucagcacaguuggaaaagcuccagcugcccugacugguggacaagcugugccucggccgccacuccaggcuaugcuggacaggcgggcggggcagggggcggggccgggcgggcaaagcagcagcagcaagcagcaguagcagcaguagcacacaggaucauggguacuucucuaaggguggguccugggucucucaccgcagguguucagguacucccugcagaagcuggcgcacacggugucccggaccgggcggcaggugcugggggagcgcaggcagcgagcccccaacugaggccccagcucccagcccugggcggccgugucaucaggugcuccugugcuucucgaccagcaugggagccagugccgcgcaggaaugggggguccccuguguucccucgucagaggagcacuugccaaggucagugaggggccgguaggcccccagaaaagcagcaccgacaaugaugaagauaucaguucccuucccagccccuuugccccugucccacuaccggcgggugggagaggaggggggaagaggggagcaacccucgagauaugggcguaggcaccacauucugaucuggaccaagucggaacaguaccaucucagccgcacaagauccuaccaugaagaucgaacagcccaucaaccagcagaauggacauucugacaucaccagcugaagcccuacaucucggugcagaagagaaagugucaacugugugcagcauggggggaguggagggcgugggugguggaggaagaggguuaagaaaacuaguggggcccccuugcugccccuugccuauggcacacauauuccugccuugcucccucauuuccccuuuuccccccgccuucgaaagcccuccccaaaaugugucacuugauuuggauauauucaaccaguaauugaaucccaccuuuaccaaaacacguucucuaacccccggcccuucacugaucuugcuuaucccuggucucacgcagcaguuguggucaauauugugguagucgcuaauuguacugguuuaagugugcauuaguagugucuccccagcuagauuguaagcuccuggagacagggaccaccuccaccaaaaauaaaaaaauggaccucuccugucuuguaguguccuaggacccugcagggcagugggggugcaccaaaaaguucuuuuguggcuucuuuugcgacugcgucacauuauccauaaagcugggcaauguacucauuguggaggggcacaccacuuggaauggggagggggaccacaagaagacaagaauaaacugagaugcccauaucugccucauuuaaaucuguccugagauaaaggacuauuucucauccgcaaugagaagaguggaauucaucugucccagaauaagggacauuuucccuuccccacgaugaugggugaauuuauuugguggugccgagauaagguaccauggcagguuuucuaucugggaaagauggagagaaaauaacugggacuggcccucuaaauggaauacuaagggucauacggguuaauuuaagaauauaaagcuauaccacagaucucucuacccaggagccccaggaaaugaaugcugggcaagaagagggggugguggcugggacaaugagcaugagguguggcuuggccccuccuccaccaagcuuaaugcuccagaccccaggaucacccuaaggcuggccauccugucuugauuuuccaacccuccagcuggacacucccucucuuaguuuucucaguucaucccuaagggccuuaucagaucgauagcuugccuuuuccccucccauugcagcagggagggugggcuggccccuuaguucccuuucuugguuagccagagcuguucacaagugucagcugacugccucaccaaaugguccugccaccuguuaagccucauuucuggcuuuacccgucccugucucugcacaccugcuccuaugccaaugaguuagaaggucaccagucucucuugcuauuuccucaaacuuccuaguccuggucaucacauuacacacucaggugcacaaagcaccucaaaguucuugaacccugaccugcagaucccccaagaaacccugauuuucaaaucaaucacuggcaccucccucuucugcagggacuuuauagucucauucagcacuagggaauuacgggggaaaguagcacagauuuugguguggccuuggcuuuuccacccagccagguugcuuuuaguucccuacuaagguccagaugagccccauacacaucagagaggcgggauuccacaggacuuggaugugaaacccauuccaaggcgcggucuuccuuagcaggguagauacagcugcugcuaaggccugaagucaggucagguccugugccugccccguaguuacucaucugcagucaguggcuaccuccuuuaugguuagaaacuucugugguuugccauacuaaacucauugaaccuugaguacauauacaacacagguuccaaaggaagguugacucuccccuuggagaucuggaguggggggccugaugucacucuauuguuccauguucuaacgucagcccaaauuagaugccagcugaguacacaaaagccaaaccagggagaaaggagucuggcuacucuggucauagcauauccugugcccaucccuaagccaggaggcuacuacugguaacuccagggcuuuccagaugaucuugguaaaaccuuuuucuuccaucuauuauccagcagugaugaguguagguggagucuucaaggcgcccuggugacccugagaaugugaaugucuacuacccacuuucuucucccacuccacacccuuuuguccugacagcaaacuaaacccuccagaggaggcaggaauguguucgugcccuuucuuugugucaaaccugcaagccugauacaaaaccaccuuguuuauacaaugcuuccacaagcuaugcauuaaaacauuuuauucucacauaaagcaaugggaugugucuuuauugcaaaguccuuaguacacagaacuaaauaucccuuuuucuuaaagagguugcuaccuccaaagaggagcaaagguggagaaggugaaguggaacagcuuuaugggaaucuagcaacacacgagauuccaggcacuaaugccagagaaggccugaccagcucaagcucaguaggguggagguuacuaaguaccaaaacuuuuagagauguggguucuaggagacuuuuaagucuaucuguaaaguaacugaauugugacugaaauguaucugagggacaggacaggaauuaagauuuuuggcuuugacucuggggcuggccaaagacagcuuaauuacacagagguuuugaaggaagcaggcucgcugcugacuccuuacuagauaucuacuuucaaacuuggaucgcuucaggagccaacaucccaaagggcgagccucugagcuggcagcuaaucuuccccaggagauuuaaauguguauacacaaacauaagacuaauuuaccaaagucucuuuuuucaggugaccacugacuucuuccauaugccugagagacaauguuugccacaaucuucucuggaaauaauccugucccccucccuccacagggcucauaccacaccaggauacagauuccugaacauucccagggcagagccagaagacagagaggaaggcaauacagggcucuugguaaaucacacagucacaagcuugaauggaaugcguguauuucaaagagaacaaguaaaaagggcagccuaacucucaucccccuagaaauaacagguaagaaguuaaaguguucugucaacaacuuuaagaugaccauuuucagaucgagaauugaucugguuccuggaaacugaccaagguuccagaaauccaaucuuuaaacaggaacucuggccauuaaugaaucuugacuuaaaagaaacaagccagcucaaucuaaugcuugccaggggcacauaaaauggaacuuuuuuuggguccuggcuuugguguugcaguucagauggcugacaggauggcuggaccaugucagacagggcagagcuguccccaauauaucaguucccugaaagggacaaagaagauccgaaccuauaaacagaaauaaccuauaaacuagaacgggccccaguuucccaaguaaaaagagacaagagacuuagaagaaaccuaaaggugguuuggcagagaaaggaaaaaaaaaaaaaaaucgacuguccccaucccccauucuuccuuuccagccaggcacuccguuccuucugcugcccuugagugccacuccccacaaacuggagagggaaccggugucca

SEQ ID NO: 1232 - RNA, 753 nt, Mus musculus
caauccucucacucagcacugcuuaggagaggggcaacucccugaaggaaaggcaggugaagaggagcaacagagauagcccagccagagccccuccucccugaagacagugugugccccugggauccccucaagggagguuucuucugggccucucucagccugauggauugccagcaccuggaggagagguguauaucaagugagaggacugccugugugcuccuugugagaggcagaugggaggacuccugucagccagcugaaggcacgugcagugggccguaaugggaagauggcugccuggaggcaggaggaccgagaaagaccaacucugacccccgauccccgaagaaaggcucugucucagaaaaacccggccuucacggagcacacagcggaacacagacgcgcaugccagggcccacgguacgaacaaaggcugagacagagcgugggugcuguugagggcgcggacuguuucuagcggucaggaagcauggcaucccccauggagagucagaggaggcucgcggcugaggggacaagcuuggcuuucaggccaaggaggcugcacggugaggggacacucggagcagccaagggccugcuccaggcagauuuccacaucuggcucuggagaacggucuccacuccuccacggggcuccuguaccauuggugcuguuauuuacuuaauauuuauuuucaaagcaucuuucucauuuuacuuaaauaaauucagcuuaagagg

SEQ ID NO: 1233 - RNA, 1903 nt, Mus musculus
caccauucauuacugauuuuaauauauauuaauaaauagcuacuguagaucagacggugcauggaaugcuaaaauggcaaugaaaggccuuaacagaggggcuggagagacagcccagugguuaagagcacugaccacuguugcagaggauuggaguucgguucccagcugcccuagucaggcagcccaugaccaccugugacuccagcuccaggguacacagcaaucuggccuccacagacacccacacacaugugcauguacaccacccccaacucguaacuaaacauaaauagccagcugugguggcgcacgccuucccagcacuugggaaggcagaggcaggcagauuucugaguuucaggccagccuggucuaaaaagcaaguuccuggacagccagggcuguuaaauagagaaacucugugucaaaaaaaauaagaaagaaagaagggaagaaagaaggaaagaaagaaagaaagaaagaaagaaagaaagaaagaaagaaagaaagaaagaaaggaaggaaggaaggaaggaagaaaaaaaggaaggaagaaaagaaagaaaggaaaaagaaaagagaagagaagaaaaaugaaaaaaaaggaaagaaacaaaaggaagacagacaagaaggaagaaacaaacaaacagacaaacaaaagaauagaaauaaauauuuaaaaaaaaaaccagcuggggguugguggugcaugccuuuaaucccagcacuugggaggcaaaggcaggcggauuucugaguucaaggccagccuggucuacaaagugagcuguaggacagccagggcuauacagagaaacccugucucaaaaacaacaacaacaacaacaaagguucuggccuuuacaggcucaugccaugagaaaagagacagacauaaauuaaguagcugagucaaguuaaacacuauauugucuuauauaacaugaauugcacugaggugccuacuguaaccugaggagcaaacaaggcuuccgggcacagaacccugcaugugcagagguccuaaggaagcaagaaacgguguggccaaaugcaucagggggcugauacguagcugucauucccaggcacaaggaguagcagccggaguccuugggagcuuccuuccugggguuggcacaaagacccccagaguaucagcccuuaccaagugucugacccaauuccuucugauacuaaugagaaaucaaaggccaaaggcauguccaaagacacaaagcuagucagggguagauccuggauccaaauccaggauaccuauaaucaucaucggauaauuauacacuuguauuguuauaacccacacagagucauacacauuccuccuugaugcagaagccggugcucacagcagggugcucgcuccacuugucacccugaccgaacccccugaagcccacuucugaugcccuguggcagagcaccuggggcugaucuuucccaaggacugacuaccucccugccucucccuuccccucucugcuucuggaggcuggucucuuucauuggcuccuguucucucagaagaguccucaggcccuuccuacuaggaccacaaaucccugaggaugcuccuuccagaccugggguggccuugccuuguguagcagaguccaguggacguuuuucucugucuuacaguaacacgaagccggucaccuuccuuguuuaugaaguuggaggaaauauugguaaguucccuggugggaagugaaucuacagggagggggggcuucaggcuuccgucuccccugccgugagggucaagaugagcacggcugacuuaggcacucuuccuucgugggcagcucuacccagagcugacuccugguuaguguuuggugugaaagcugucagugcucccacggaugucuca

SEQ ID NO: 1234 - RNA, 1419 nt, Mus musculus
ucgagacagggucucauauagcuaaggcuggcuuugaauuuaauauguggcugaggauguccuuguacuuccaaucccucuucauucgccucuccaaugcugcaguuauagguaucugccaccacaguggguuuaaacaguccuggagaucaaacccagggcugcaggcaacugagccaccuguccagucaaccaucacuacuucaugugugucaaguacuuacucuauguaguaaaguagagcaaugaggcccacgcuguuauuauuaacuccauuucccagcagagacagcaagguuaggcuaagcaacuuuccuaaggccacacagcuguuaggggacagcuggaauccaaacccaagcaggcuggguccauguaccaucuacucuuucugcuuccuuugcaccaauuacaucaggacaccaggguggccagaguagcccagacuggcuguucccugugucaaggggcagcugccaggugcagcugcaguaggguugacucuguggccaucuaccucugaggggugaaggggaugccuccagagcaucagcaauccagccuagcuaggcugaagcauccuccaucucccgucaccgggcauccuguccucaaucacacacacauuuauuucuccuaaucgcucuuccucgcugagauaaagucaucuuuuauagagccaacuacgugcauuucauuugaauuaagccugcuggucugucaguuuguguuggagaagcagacagauaaaagaagacgcauuucaacggucucuuccuuuuaacugcuugugcuccgggaugcuuuuguaguagucucccgucugcaaauacacuucgagaacucuagaacacuaggaaggccaacuagagccugcaggaagggcuugggucuugcuuugacacaugauguuagauacuggcauuauccccacugagugaccaacacccagccucuggggagugauacccuaggagggcagaggaugcgcuuucaugcagaagggcucugagacacuuggguccaguucaagguugugagcuccugcaucagagaaagcaacagcagagaaaaacuggcuggcuugggaaacuucagcucucccucugagggaagauggagggagacugugggugucuuugcuggaagcucuuucauuaugggcucauucaccauugagggcagugccaggcucaucagagaagugcaagguguguuugguguaggauggacagagugagcaaggcuaggaaccacugccagcucuugaccucucuggccagucuugaugucggcagauugaguaggaaccucuagggaugcagacuccaugaauaaucuccugugcuaguguggcuuuuuaauuuaucaucuuccugaggugggcuugucagggaugcagcugccuuugagacgucc

SEQ ID NO: 1235 - RNA, 1419 nt, Mus musculus
ggacgucucaaaggcagcugcaucccugacaagcccaccucaggaagaugauaaauuaaaaagccacacuagcacaggagauuauucauggagucugcaucccuagagguuccuacucaaucugccgacaucaagacuggccagagaggucaagagcuggcagugguuccuagccuugcucacucuguccauccuacaccaaacacaccuugcacuucucugaugagccuggcacugcccucaauggugaaugagcccauaaugaaagagcuuccagcaaagacacccacagucucccuccaucuucccucagagggagagcugaaguuucccaagccagccaguuuuucucugcuguugcuuucucugaugcaggagcucacaaccuugaacuggacccaagugucucagagcccuucugcaugaaagcgcauccucugcccuccuaggguaucacuccccagaggcuggguguuggucacucaguggggauaaugccaguaucuaacaucaugugucaaagcaagacccaagcccuuccugcaggcucuaguuggccuuccuaguguucuagaguucucgaaguguauuugcagacgggagacuacuacaaaagcaucccggagcacaagcaguuaaaaggaagagaccguugaaaugcgucuucuuuuaucugucugcuucuccaacacaaacugacagaccagcaggcuuaauucaaaugaaaugcacguaguuggcucuauaaaagaugacuuuaucucagcgaggaagagcgauuaggagaaauaaaugugugugugauugaggacaggaugcccggugacgggagauggaggaugcuucagccuagcuaggcuggauugcugaugcucuggaggcauccccuucaccccucagagguagauggccacagagucaacccuacugcagcugcaccuggcagcugccccuugacacagggaacagccagucugggcuacucuggccacccugguguccugauguaauuggugcaaaggaagcagaaagaguagaugguacauggacccagccugcuuggguuuggauuccagcuguccccuaacagcuguguggccuuaggaaaguugcuuagccuaaccuugcugucucugcugggaaauggaguuaauaauaacagcgugggccucauugcucuacuuuacuacauagaguaaguacuugacacacaugaaguagugaugguugacuggacagguggcucaguugccugcagcccuggguuugaucuccaggacuguuuaaacccacugugguggcagauaccuauaacugcagcauuggagaggcgaaugaagagggauuggaaguacaaggacauccucagccacauauuaaauucaaagccagccuuagcuauaugagacccugucucga

SEQ ID NO: 1236 - RNA, 14563 nt, Mus musculus
caguuagcgcgaagaggcguggccacaaggaggcuguugcggacaagcuggagcuacgguuggacuugaggccuggaucagcggggaauagaaacccacagaaaguucuggagcgccaggcgggaaucaggugcugaaaccagcgaguccucccguaaggaggaggcuuccggacgcuucggggcccagagacucagacgcggcccgggguuucgugacgcacucggcuucggggcgggaccggcgcuggccaagauggaggccaacguguuccgcuuccgagaugcccgcucugcuccggaucccgugcucgaagccgggccgguggccuucgggucgcagccggugccucuggugcuggacaacgggucguuccaggcucgggccgggugggcgugccccgggccggaccccggucccgagccucgccugcaguuccgcgccgugugugcgcgcggccgcggcggggcgcgcggcgggccggggccgcaggugggcaacgcgcugggaagccuggagccucugcgcuggaugcugcgcucgcccuucgaucgcaacgucccggucaaccuggaacugcaggaacugcugcuggacuacagcuuccagcaccucggcgucuccucgcaggugagggccugccgggcagggcgcgcucggcuucagccgucaugccaggcaguaggguauugaacacaaguucgucagccuugugcuaggagcuaaggguacaccacgaagucuuuaucuuccagaggaugggcugucucaggcacaaggguccaguuugcaauaguccaagugagaugaguuuuaccagcaccaguccgauccuggaaguauuuugaagauaaaaccaacgggguuuaucaguuaacaguuuagccaaagcuugacuuaauaaacuuaaaaugaaccgggcauggguucacggcccuuuaauccgggcacucgguaggcagaagcaggcagauguuugugaguucaaggccagccagggcuacacagagaaaccuuaucuuaaaaaaacaaaaaaccaacagacagacagaccuacgaaaagcuuaaauugaucauguuauuuuggcuucccaaaauaaucuccaauagagaugaaauguauucuuuaaaauggcccgugagcaccuuuuaaaagauguauuauuucaaaguuauaugugugagaauguguacaagaguguaggugccuuaggcaggugaucuucugugacuggagucagagauuaggugcugggaaacagaguuggguucuaauguguucucucuaguccucgugucuggccuugagugucucccuccacgaccucguguuuuaaauuagaguucaaaaguaaauucuguccugcguaaggauuugggguuauuuuugcauuucaugcaugcuuccguuugucucuuugugcuugucuuucaaaguagggcugcguugaucaucccauaguucugacagaggcuguguguaacccccucuacucccgucaaaugaugucggagcuccuuuucgaaugcuacaggaucccgaagguugccuaugggauagacagccucuucagcuucuaccacaacgugcccaagaaugcccuuuccagcggccucaucauuucauccggcuaccagugcacacacaucuuaccggucuuggaagggaggugagcugugccguggcauugugugggagaagcaucguuuuagggcugccuggaaucaugggacguaaaaggugccuguuggaaagucugggaagugcuaggugguuuaacugagcugggcucagaccuacaucagugagugccuucagaaguuacucuaccugcccuuugggaccuccuggagggacuucaaguuggucuuaugucugauugacaguuauacaguguuacaauucugauuuaugggggaacaguuaacaugauaccugcccauaggaggcauucaguaagcaugguuugaguaaguuauuccauuauauuucuuucuuucuucuuaaaauuugugugugugcuuaugcaugcaggagcacaccugugucugucugucuggauuugacagugcuugacaggaagcuggaagcagagaacuguauaagggcauugguucucuguuuccaccaugugggucuuaggaauugaacucagagguccucagccuugacagcaagugccuuuacugcugggccaucucccuuucucuuaguugaaucauuuaauuuagaccaucuugguauucuggaguuaauuuuuaauuaagauuuuuuugccccccccaaaaaaaaaacuugcacugccaacucuuuaauucauauuguccauaccuuuuauuuuugguuacauugccuaauacauacuaggcaauucuagaacuguuuaguagaauaaaagacagagaugguuuuagucuguucaugucugaguuuaguuuuguuuuauuuucuugugugaugaagcuagcauugugcccuuaaaaguucccacauugccagaagggcugugugccgcaggcagcgagcccuggcucuagcguggacgcuuagcuuugcagcccugcuaagaugaggcucuggucccuuuaccagccagcauguaugugcuuguucgucugauuguggagagaagcaguucccaggaagcuugugaaaucagacucuuaaggcccagagcaaguagcccuugggauuggccugcuugaccauuuuauuauuauuauuucuaggcuacguguucccaggagcccccagaagaacacacuugucacaugucacuuagacauccuacugaacuguuuuuuguuuuguuuuuuaaauugagacagggucuuuacauagcccuggaacucacucuauagaccaggcuggccucugccugugucugccucccaaguggugggauuaaaggcaugugccacuacuggccuaaaccgcuuuucugcgguagaagcuaaagggccacaugccggggucugcaguaggaguucuggcguuggguaagaggcugaaccaagggaaucuuccugauaugguuuuagguguccucacccuccacuagucuagucugccccuuugucugaauucaguucugcuuuccaagauggucuacauuuugucuuuucugcugcauugacucucaguguuguucuuuauuacuucgguauaggcucgaugccaaaaacugcaagcgcaucaaucuuggaggaagucaggcagcuggcuaccugcagcggcuucuccagcugaaguauccaggccaccuggcagccaucacacucagccgcauggaggagauccugcaggagcauagcuacauugccgaggacuacggggcaggugacacagggggccauggcgggugauacagaggaacuugcuccagguuuccaacucuguugaccgugaaggguccuugacucuugcucgcucagauccaccucugcuuucggugcucacauggugagaguauuaaguaaacuaauugucauaaacauaaacuauguugucccgucacacaacauagcuuuugcaguuugccucuguggaguccaguguucgaagacagccagggcuacacaaagaaacccugucuuaaaaagccaaaaaaaaguuugacaccaauugaaaaugcuuuaucucacauccuuagagugaugucagagcaccucucagucucccacauauccugaacuuuucuuuuugagucagagucuccuuauauagcucaggcuggccacugucccucaguguggucucagauccuccaucuuccugccuuagccucuaaguaucucaaucuuuugguuuguuuguugguuugguuugcuuuuuucugagacagguuucuuuguauauuccuggcuguccuggaacucaacucuuagaccaggcuggccaaagacucauaaagauucgcccgccucugccucccaagugcugggauuaaaggcgucacugccaccgcucaggguggagguaggaggaucagauaugcaggguuaucuuugugucacagugagcucaaagccugcaaagacugugugagaugcugcuucaaagaaaccaaccugcaggcggaaggaugaauggcucagagcacuugcugcuuuugcagagguccuggguuuccuuaggaguggcucacuaucaucccugauuccaguuucaggggaucugcugcucucuacugguuucagugggcauguacauagugcccuuaaacacgcgcauacacagaaaauauaaagaagugguguuuaaagagaccaaaaaaaaaaaaaaaauuacacagaggcauacaaaaaguaauccuaauuguguuuaaaaacaaacaaacaaaccauaagacauaaaauuuaccaucagccuuuccucccugcaccccucgcccucucuccuuucagacagucuccuguguaggcucagccuaacgucacaugucuggcucuucugucucagcuucccaauugaaggguucaucuuaaccauauucggagaauuaagugguguuuacaagcuguguguucagagcacuuuuguuaagcaccugugguuuaugagguacaaagaaacuggggagauagacauggaaagagaauuugugagugugggcucccuuuucuugauauacuuugauacuagcuuauuuuugcuuuuguuuauguaguccuagcucacaaacauauguaaucccagauccaggggggcugaugcccucuuguggcuuccaugagccaugcagguaguuccuguucaaaugcaggcaaaacacuccugcacagaauaaguaaacaaaccaaccagcauuugauucuguguguuucccuuuucagugcugcugcuguguccgcaucccauggguuuugauaaauuuccuuacuuguuacugaguuuacaaauauuuucuaauuucuuuaagugauugcuuacaaauauguugugaaaugccuuccugugauuuaucauugguucagucccauuauagugaaaggacuuuguuugaugucugcuaagcuuguuuauugcaugacccggcaugucgucaucuuuggcagaaguuccucacacaccugaagagcgugcacugugcucuuguggcuuugguguucagguguccuuuggugucugguggugaugguggccagcacuuggucaccugccuucuacuaguccuguugauaauugggaggaguguguugcugccacuaggagugguggugggcguccccacuucuccucuguucugucacugaggacaacauugacaagaugagcacgcguguuucugaacugugcucccagcccagaucugucagagugugcugucaguuugugacuuugucuuguuaguuucauauuuaacauggucauagcuuccugucagcugaccuuuugucauucuguaguguauuucauuuuauuucuuuuucuuuuucuuuuagacacaccuuuaaucacagcauuagggaagcagaggcagguggauuuugaguuugaggccagccuggccuguuaguaaauuccaggcuagccagguauccauagugagaucuuaucugaaaauaacauuggcaacaaggcacccagcuuucuuuugaaugcaguuuacauuggcauaucuuuccuuucauuuauuaagcaacagggucucguguggcucaggcuaaccucaaaauucccuugaaugugugaagacaaccuugaacucucaauccuucugccuccucuucucaaguguuaagauugggggcaggcgccaccauccccugcuuguaucccuuuaccucugaucuacuuagucaaugucaucaagaugcgcuugugguuguguuauaauaaauguucauuacucuuuccauggggauggcagcugggccuugcgccccucagcagccuccugugugugcugggaccguuugcaguuaguguauuuguguuugaauucggcauuacuauuuuauucuuguccuuuuuucucugcuuuuuagguuauuggauuccuuuuauuuuacuuuugaggcaggcucucacugugagcucuggcuggcccggagcucacuguauaguccaugcuuagcuugaacugagagaucugugaacuaguuccugggguucaaggugaacaucaccuuggucagcuagacuuuuuuuuucccccuugugccuguauuacuuaggugguuacuagagaauucaggcaugcauagcuuuuccucaucuguguagauuaaguauuggucaggguagcaguguuagcccuaggcuucugaguuaaagugucucccauauuaacccugugaacgcugggagcuggucagacagugauguuacuaguuuuaguuccaguuaucgaucaaguuuuaaggcacucaugaggcagucagcccgugaguuuaacagucuuuccccugcucuggcaguuccagcuuuccugugugguuucugucugcagacccucgcagcaggucuuugugugccuggguguguucagagguucagaguucguccacucauggcuggcaucgacuuuucacuucauuguucucuaacucccuuaaacuguuuguuugaagaauugcagaaguggcagugucccgauuacuacgagaacaauguccacaagaugcagcucccguucuccagcaagcuccugggcagcacacugacggcggaggagaagcaggagcggcggcagcagcagcugcgccggcugcaagagcucaacgcccggcggagggaggagaagcugcagcuggaucaggagcggcuggagcggcuguuguaugugcaggcaggugaugucuguggcgcuggacccuggccuugcucugcgaggugcucucuuccugucugguucccuuagacauaaugugcauuggcuguugucaccuugaauuagggaguccagagaccagaaucauggagaugguuagcaugcacagcagcaaguggcuguagagagcuguggacucaagcucuguuuauugauucauuuucuuguuuuugaacuuuuccauuaagugcagcaugcacauaccuuagggugggccucccugugaaugucacaaaguaacacugccccugcugccagauugaggagcagcugucaucuccucucagugacuucuucccucuuugaugucugucaacuuagauuaguuuugccuaauuaaguagugcugaaagcggugugcgaugcuagcaggcccagacagcuggagaggagggcggguaggaguguggugggagcuugcagggcaguucugcuggggacugacuagggccccccgccugcacuucugcuggcuuccuagcugccuucccuuuguugaugaccacacugcccgucucugagagugacuugugacugcucugguuuuaggagcuccuagaggaaggacagauggaccaguuucacaaagcucugaucgagcugaacauggacuccccagaagaacugcaguccuacauacagaagcucaccuuggcgguggagcaggccaaacagaaaauccugcaggccgaagccagccuggagguggaugugguagacagcaagccagaggugacugggccuggggagggaagccccuuggucccuuaggcuuggugacaagugcguucacucaccaagccaucuacccagccuuagcuuccucuuuuugagaugggauuucauauaagggcuacgcuggccuugagccuagcauguagccgagaugaccuugcacuucugauccuccugcuucugccuccccagugcugggauuuuaagugugugcugccaccaugaucggcuaauggggugcugggagucagagccugguacucuaccaccauucacgcuaccccccagcccccaagccauugagucggcuugcuuuaaacucuagaacgauaccauggaaaagucagggcuggugccauuugaugcuggguaugggguagugugccccaugaugucacagcugugucugagucaguguggacucucagagacaggcucccagcuggagcuccaccauagcucagcgcucagucuugcauucuugccucccuccacucacugcucuagcacaggcuuagaaagccuuuucugcugaugaccccauuguacuuagagaacgguuuacauaauccugguguagagaugcagcucugccauucacuaaaugaaaacaacauugcaugcugaugagaaagguguguuuaguuuuauauaggaauucaauccuggguaagcguugauaaugugggaugcagaggaaucuucaguaguuguucaguggucacuuuugagaucucuucuggggcuuacagcuacauugucuguuguggauucauccauuaacguguucuuaagaugugcaagucccgcagggucagauguagucuaggggcguugaauccagaggagaacuaagcagccgaagaugggacccgggcagugggagcgcuguucuucugugugcagguuccuaucagauaguccugagcucucaucagcaucccuccgucuggucaggggacuugugcaucgugucuaugcuuuggagauacagcaggucucugugggcuugggaaggcuuacgugaaugucaaagcuuguuuuaggggcuuggccccucaagcaugaguauugaguuuggauccucaguacucaggcagaagcugggcaugguggagugugccugaaauccuagcccagggaggcaaagacagaaggguccuuagcguucucagcugagccagugagcaucagauucagggaaaaaaucaucaaagagguagguggagggacaagagagaugguucagcucuuaagagcaugcucuuucagagggccugaguucaguguucacuguccacauugggcggcucacaaccaccugccucuccagcuuuaggaaucugauggcucuggccuccuagggcacauggccacacaugcacacaaccccacacagauauagaugcacauuguuuaugugucuaaaauggaaacaauggaggaagacacuggccauguguguuguuuaugugucuaaguaagauggaaacaauggaugaagacacuggccauguguguacgguacaugucuuagucaggguuucuauuccugcacaaacaucaugaccaagaagcaguuggggaggaaaggguuuauucagcuuacacuuccauacuguuguucaucaccaaaggaagucaggacuggaacucaaacaggucaggaagcaggagcugaugcagaggccauggagggauguuccuuacuggcuugcuuccccuggcuugcucagccugcucucucauagaaccaagauuaccagcccagagauggugccacccacaaggggccuuucccccuugaucacuaauugagaaaaugccuuacgguuggaucucauggaggcauuuccucaacugaagcucuuuucucugugauaaccccagcugugucaaguugacacaaaacuagccaggacaguacacacagguugcucucaguuuagcaaauuggaugcaguaaucugucaccaaaucucgagcagucguucuguuguuggaggaugacugcugguggugggaugagcuauaguucuaguccugaugaacucagccaugacauugacuaaucuguucugccuuuuaguauugccacaauguaauucaguuaggaugaagugaauagugugggcccugcaaggcaccggugaagcccagcuguggacugcaggcugaauuaacacagcuagccgggaguuugaaccagcauucccuacguccauuuuuccuacagacuguuccauugcgguuccuggagugccgaguuguuuguucucaugagaaugcuguaaggacuagauauagaacuuugguaguauucucucuuucuuccccuuucucucuagcucucuucacucucucucuuuuuccuuuucuugagacagguucucacucuacagcucugacuggcuucaaauuuucuccugccucugccuccugagugcugggauuaaaggugugugcuacaaugccugaccuuucuguugcuaagagguguguguguguguguguguguguguguacacacuguagugcacaaacaugaaggccagaggacaauuuugacaguuaauucuuuucuucccccauggagguuucaggaauugaacucagguugucaguuuuguggcaagcccucuuacccucugagccaucuugcugguccuauguuagucuuuugcuaacuuguauuauucccaccccuucccaugugaauugcuuugaagaguguuucgcuucugcacaggugcuuggaacauugggugagaugagaccccauccgauuccagcaucagaucggagcugaauuuugcugguguuugcuuaucugucuguccuguccucagaccccugaccuggagccgcuggaacccaccauggaggauguggagaacaucagugauuucgagccuuuguucucggaggaaacgcccgaaguggagaagccgcaagucaccacaguccagguuugagcacuguuaccaagaccaccuguacauuugaagcuguuugcauaagugaccggcccaguccgcuucuuggggagcacuggagagccccguugugcucucagccucagucagaggcuuuccccugcuggacaguugaggggcuggcgccaucccucaugugagcacugccagugacugaggucuccagaccugcacaugggcucuuagccauuaucaccauccuuacuggggucugugccucuuguuaugcugguagcagcaaaauaaaaugacugaaccugagcccuuggggauggggggagguguugaaccagggugagcagggacagggucugucccucugggccacuugacugcugcacuucagagucccuuccuguaacuuggggcucaggcgugacacaguguauggggauuugucacuuugagugugagcagagguagaaggcggagcuugaagggaggagagcugaagacuggugguacugggcuggaggagaugugguuugagaaaacugacagcgagcaaauggucaucuuagucuaaaaacaucucuuaaaccuuggguuugaagcccguguuuaacuuggcagcguaucaucagcugucuguugggacagagaggauccgugcuccggagauuauuuuccagccaucccucauaggagaggagcaggcggggauugcagagacccuccauuuuguccuggacaggugagccgugauacccccucagcuucccgagccagcucucaccauugcugccuggaugcagguagucugcccacugacccaggccugcaggcagaacagguacaagcuccaguccuucaucugugagcuuuaccaacuaagccuuugaguccuggccaggauguccccuggcuuucaugugaaauuugccauugcuaaaagccagugaucauuuuauuuguguguucacugaguuggggucucccuauauacucgucagccuugaccuugaagcuucagaguagcugggaucacaaguguagacaccauaccccugagagacuagugauuuuuauuucaucuuguuuuuaauuaugggggaagaaugcacacuuggccuauaguauggaguugugaaugaaaacaaaaauacugguuuaguuucuuuuaauuagaguugacuguuguaccaagagcuugccucuccaggucuugcuuccaugggcucagcagccagauuggugcacgcuuucucuccuagguacccaaaggccauucaggacacccugguucagaacguuuuccuuaccggugggaacgugauguacccaggcaugaaggcccgaguggagaaggagcugcuggagaugaggcccuuccaguccuccuuccagguacagacugcucuccccacccacuguuugugauuggcaucccagccacugacugcaaagucaagguguaaagacuggacucugcaaucccaucauccacugcagagguucauugcuggccuugucuuuaagccacagucagcuuaugcggacggcaauccuacuuguauaucgcucugcucuucuguuaguugacaguauugagcguguucugaaauccaaagagcauccgcagcagaggggaucgucaccuaugucuucccauagugaaggcuucgucucuggcuguuuacuuaucucuggacagggucuuguuucucugcaguaaccaggaagaugcuuugauggcuccucucugcauaguuguuacuuuaggucaagugagacuuggaaggagccugagccacgagucaugugauuaauuuacauuuuuagggagguaguauaaggucagccugaacuaaugagugaauucaagccagccuaaguuauacagacucauucucagaaauguucaagaggagagggugagguuuuucacuagauuaggagugauggacaggcuugaaguggaggaaaaugcacugucucaggcuguggcuagcacucagguaagaggccauuaggaacucagggccccccugggagaacagggaacaccaaggauccagcccuaaccacagccuuuaagggugcuugggagcuggaagacaucucggugaaguugaggagagaggcagccggaagaggagggauagcaguguugacaccaaggcguggcuuuucaggcuguaagccugugccugacuggaccuggcagggcagcugaggaggaaguuguuggguaaagggcucuuggaacggucacgcuguccacuuggcaauccgagaaucccccugccaugcugugagagccugguuguaagagcgcugcuucucacgccccacccacccugccacccauguccuguaucaguuuggugggacggcagcaucagguagcaguagcucguguccaauuauuuuacacuaacuuuaaaacacugacuuucaccggguggugguggcacacgccuuuaauccuagcacuugggauaggaggcagaggcaggcggauuucugaguucggggccagccuggucuacagagugaguuccaggacagccagggcuacacagagaaacccugucucgaaaaaaaacaaaacaaaacacugacuuucuagggcugggcuggggcucagugcggagcaucugucuggauccugaggcugggagcucagucucuagugugauacaaacaggacggaucacauuguuuuucuuuugcugguuuuacugucuuuguuaucuuuguaauuuuuguggugcugguggaagccuagagccacuuacaagcugugcaggccacuaccugcucagccgugucccagacaauuaaaugagcugaagugaaaagaggaaacaugguagggccuggagagguggcucagugguuagagcacuugcugcucuugcagaggcccuggguuugggucccagcaccuucguggcggcucacaacugucuguaggccagauucguggagauccacugccucuucuggccucuaugagcacuggacauguaaauacuacacagccacccgugcaggcacauacacacacacaccugggcaacuguguacucucacaauggaggcaucucugggccuuucugugugcuucugaggauguacaaaugguuggcugaggcagcagaaccuuccugacugggccgggagcccugggaggagacguggauucuuuagagugcaucugcgucuuguuccagguucagcucgccucgaacccugugcuggaugcgugguacggugcccgugacugggccuuggaucaccuagaagacaguggagccugggucaccaggaaggacuaugaagaaaaggggggcgaguaccucaaggaacauugcgccuccaacacguacguccccauccgccugccuaagcaggccucacgugccucagagacgcagacuuccggccgaggcuccagcgccaguggaaguggggcuggugaucaggccuagcaggggggacgccagaugaccuugugcuucacccuugccauggaggcaguguuugggacaaggacagugccccauggugcugccugggucugacagccuuguuuggccagugacuggaucuccccugggagcccagcagaggagagcaggugaucuaccucagugaaggacacaguggccucuggcaccaagaacuguggacaagcugggggacugccuuccucagcagugagggaaacagcuggagggagaagugggcagugcugcucuuugcacuguuuuguuuuguuuuuaaagcucuaaaguuauccauggaguguuuauucugugugugccacuguccugugugccacuguccucugacugcgcagagugugcuccaagcugcugcugaagcaguggaaguggccguccacugagccccuggagugggaagacccaccccgcccccaccccauucucugccugguuccugucuuaaguggaagguggcgcuuguguccagccuucuaacuguugcuuugcuggagaugcucccacacugugaagccuugccaga

SEQ ID NO: 1237 - RNA, 14563 nt, Mus musculus
ucuggcaaggcuucacagugugggagcaucuccagcaaagcaacaguuagaaggcuggacacaagcgccaccuuccacuuaagacaggaaccaggcagagaauggggugggggcggggugggucuucccacuccaggggcucaguggacggccacuuccacugcuucagcagcagcuuggagcacacucugcgcagucagaggacaguggcacacaggacaguggcacacacagaauaaacacuccauggauaacuuuagagcuuuaaaaacaaaacaaaacagugcaaagagcagcacugcccacuucucccuccagcuguuucccucacugcugaggaaggcagucccccagcuuguccacaguucuuggugccagaggccacuguguccuucacugagguagaucaccugcucuccucugcugggcucccaggggagauccagucacuggccaaacaaggcugucagacccaggcagcaccauggggcacuguccuugucccaaacacugccuccauggcaagggugaagcacaaggucaucuggcguccccccugcuaggccugaucaccagccccacuuccacuggcgcuggagccucggccggaagucugcgucucugaggcacgugaggccugcuuaggcaggcggauggggacguacguguuggaggcgcaauguuccuugagguacucgccccccuuuucuucauaguccuuccuggugacccaggcuccacugucuucuaggugauccaaggcccagucacgggcaccguaccacgcauccagcacaggguucgaggcgagcugaaccuggaacaagacgcagaugcacucuaaagaauccacgucuccucccagggcucccggcccagucaggaagguucugcugccucagccaaccauuuguacauccucagaagcacacagaaaggcccagagaugccuccauugugagaguacacaguugcccagguguguguguguaugugccugcacggguggcuguguaguauuuacauguccagugcucauagaggccagaagaggcaguggaucuccacgaaucuggccuacagacaguugugagccgccacgaaggugcugggacccaaacccagggccucugcaagagcagcaagugcucuaaccacugagccaccucuccaggcccuaccauguuuccucuuuucacuucagcucauuuaauugucugggacacggcugagcagguaguggccugcacagcuuguaaguggcucuaggcuuccaccagcaccacaaaaauuacaaagauaacaaagacaguaaaaccagcaaaagaaaaacaaugugauccguccuguuuguaucacacuagagacugagcucccagccucaggauccagacagaugcuccgcacugagccccagcccagcccuagaaagucaguguuuuguuuuguuuuuuuucgagacaggguuucucuguguagcccuggcuguccuggaacucacucuguagaccaggcuggccccgaacucagaaauccgccugccucugccuccuaucccaagugcuaggauuaaaggcgugugccaccaccacccggugaaagucaguguuuuaaaguuaguguaaaauaauuggacacgagcuacugcuaccugaugcugccgucccaccaaacugauacaggacauggguggcaggguggguggggcgugagaagcagcgcucuuacaaccaggcucucacagcauggcagggggauucucggauugccaaguggacagcgugaccguuccaagagcccuuuacccaacaacuuccuccucagcugcccugccagguccagucaggcacaggcuuacagccugaaaagccacgccuuggugucaacacugcuaucccuccucuuccggcugccucucuccucaacuucaccgagaugucuuccagcucccaagcacccuuaaaggcugugguuagggcuggauccuugguguucccuguucucccaggggggcccugaguuccuaauggccucuuaccugagugcuagccacagccugagacagugcauuuuccuccacuucaagccuguccaucacuccuaaucuagugaaaaaccucacccucuccucuugaacauuucugagaaugagucuguauaacuuaggcuggcuugaauucacucauuaguucaggcugaccuuauacuaccucccuaaaaauguaaauuaaucacaugacucguggcucaggcuccuuccaagucucacuugaccuaaaguaacaacuaugcagagaggagccaucaaagcaucuuccugguuacugcagagaaacaagacccuguccagagauaaguaaacagccagagacgaagccuucacuaugggaagacauaggugacgauccccucugcugcggaugcucuuuggauuucagaacacgcucaauacugucaacuaacagaagagcagagcgauauacaaguaggauugccguccgcauaagcugacuguggcuuaaagacaaggccagcaaugaaccucugcaguggaugaugggauugcagaguccagucuuuacaccuugacuuugcagucaguggcugggaugccaaucacaaacaguggguggggagagcagucuguaccuggaaggaggacuggaagggccucaucuccagcagcuccuucuccacucgggccuucaugccuggguacaucacguucccaccgguaaggaaaacguucugaaccaggguguccugaauggccuuuggguaccuaggagagaaagcgugcaccaaucuggcugcugagcccauggaagcaagaccuggagaggcaagcucuugguacaacagucaacucuaauuaaaagaaacuaaaccaguauuuuuguuuucauucacaacuccauacuauaggccaagugugcauucuucccccauaauuaaaaacaagaugaaauaaaaaucacuagucucucagggguauggugucuacacuugugaucccagcuacucugaagcuucaaggucaaggcugacgaguauauagggagaccccaacucagugaacacacaaauaaaaugaucacuggcuuuuagcaauggcaaauuucacaugaaagccaggggacauccuggccaggacucaaaggcuuaguugguaaagcucacagaugaaggacuggagcuuguaccuguucugccugcaggccugggucagugggcagacuaccugcauccaggcagcaauggugagagcuggcucgggaagcugaggggguaucacggcucaccuguccaggacaaaauggagggucucugcaauccccgccugcuccucuccuaugagggauggcuggaaaauaaucuccggagcacggauccucucugucccaacagacagcugaugauacgcugccaaguuaaacacgggcuucaaacccaagguuuaagagauguuuuuagacuaagaugaccauuugcucgcugucaguuuucucaaaccacaucuccuccagcccaguaccaccagucuucagcucuccucccuucaagcuccgccuucuaccucugcucacacucaaagugacaaauccccauacacugugucacgccugagccccaaguuacaggaagggacucugaagugcagcagucaaguggcccagagggacagacccugucccugcucacccugguucaacaccuccccccauccccaagggcucagguucagucauuuuauuuugcugcuaccagcauaacaagaggcacagaccccaguaaggauggugauaauggcuaagagcccaugugcaggucuggagaccucagucacuggcagugcucacaugagggauggcgccagccccucaacuguccagcaggggaaagccucugacugaggcugagagcacaacggggcucuccagugcuccccaagaagcggacugggccggucacuuaugcaaacagcuucaaauguacagguggucuugguaacagugcucaaaccuggacuguggugacuugcggcuucuccacuucgggcguuuccuccgagaacaaaggcucgaaaucacugauguucuccacauccuccaugguggguuccagcggcuccaggucaggggucugaggacaggacagacagauaagcaaacaccagcaaaauucagcuccgaucugaugcuggaaucggauggggucucaucucacccaauguuccaagcaccugugcagaagcgaaacacucuucaaagcaauucacaugggaaggggugggaauaauacaaguuagcaaaagacuaacauaggaccagcaagauggcucagaggguaagagggcuugccacaaaacugacaaccugaguucaauuccugaaaccuccaugggggaagaaaagaauuaacugucaaaauuguccucuggccuucauguuugugcacuacaguguguacacacacacacacacacacacacacaccucuuagcaacagaaaggucaggcauuguagcacacaccuuuaaucccagcacucaggaggcagaggcaggagaaaauuugaagccagucagagcuguagagugagaaccugucucaagaaaaggaaaaagagagagagugaagagagcuagagagaaaggggaagaaagagagaauacuaccaaaguucuauaucuaguccuuacagcauucucaugagaacaaacaacucggcacuccaggaaccgcaauggaacagucuguaggaaaaauggacguagggaaugcugguucaaacucccggcuagcuguguuaauucagccugcaguccacagcugggcuucaccggugccuugcagggcccacacuauucacuucauccuaacugaauuacauuguggcaauacuaaaaggcagaacagauuagucaaugucauggcugaguucaucaggacuagaacuauagcucaucccaccaccagcagucauccuccaacaacagaacgacugcucgagauuuggugacagauuacugcauccaauuugcuaaacugagagcaaccuguguguacuguccuggcuaguuuugugucaacuugacacagcugggguuaucacagagaaaagagcuucaguugaggaaaugccuccaugagauccaaccguaaggcauuuucucaauuagugaucaagggggaaaggccccuuguggguggcaccaucucugggcugguaaucuugguucuaugagagagcaggcugagcaagccaggggaagcaagccaguaaggaacaucccuccauggccucugcaucagcuccugcuuccugaccuguuugaguuccaguccugacuuccuuuggugaugaacaacaguauggaaguguaagcugaauaaacccuuuccuccccaacugcuucuuggucaugauguuugugcaggaauagaaacccugacuaagacauguaccguacacacauggccagugucuucauccauuguuuccaucuuacuuagacacauaaacaacacacauggccagugucuuccuccauuguuuccauuuuagacacauaaacaaugugcaucuauaucugugugggguugugugcauguguggccaugugcccuaggaggccagagccaucagauuccuaaagcuggagaggcaggugguugugagccgcccaauguggacagugaacacugaacucaggcccucugaaagagcaugcucuuaagagcugaaccaucucucuugucccuccaccuaccucuuugaugauuuuuucccugaaucugaugcucacuggcucagcugagaacgcuaaggacccuucugucuuugccucccugggcuaggauuucaggcacacuccaccaugcccagcuucugccugaguacugaggauccaaacucaauacucaugcuugaggggccaagccccuaaaacaagcuuugacauucacguaagccuucccaagcccacagagaccugcuguaucuccaaagcauagacacgaugcacaaguccccugaccagacggagggaugcugaugagagcucaggacuaucugauaggaaccugcacacagaagaacagcgcucccacugcccgggucccaucuucggcugcuuaguucuccucuggauucaacgccccuagacuacaucugacccugcgggacuugcacaucuuaagaacacguuaauggaugaauccacaacagacaauguagcuguaagccccagaagagaucucaaaagugaccacugaacaacuacugaagauuccucugcaucccacauuaucaacgcuuacccaggauugaauuccuauauaaaacuaaacacaccuuucucaucagcaugcaauguuguuuucauuuagugaauggcagagcugcaucucuacaccaggauuauguaaaccguucucuaaguacaauggggucaucagcagaaaaggcuuucuaagccugugcuagagcagugaguggagggaggcaagaaugcaagacugagcgcugagcuaugguggagcuccagcugggagccugucucugagaguccacacugacucagacacagcugugacaucauggggcacacuaccccauacccagcaucaaauggcaccagcccugacuuuuccaugguaucguucuagaguuuaaagcaagccgacucaauggcuugggggcugggggguagcgugaauggugguagaguaccaggcucugacucccagcaccccauuagccgaucaugguggcagcacacacuuaaaaucccagcacuggggaggcagaagcaggaggaucagaagugcaaggucaucucggcuacaugcuaggcucaaggccagcguagcccuuauaugaaaucccaucucaaaaagaggaagcuaaggcuggguagauggcuuggugagugaacgcacuugucaccaagccuaagggaccaaggggcuucccuccccaggcccagucaccucuggcuugcugucuaccacauccaccuccaggcuggcuucggccugcaggauuuucuguuuggccugcuccaccgccaaggugagcuucuguauguaggacugcaguucuucuggggaguccauguucagcucgaucagagcuuugugaaacugguccaucuguccuuccucuaggagcuccuaaaaccagagcagucacaagucacucucagagacgggcaguguggucaucaacaaagggaaggcagcuaggaagccagcagaagugcaggcggggggcccuagucaguccccagcagaacugcccugcaagcucccaccacacuccuacccgcccuccucuccagcugucugggccugcuagcaucgcacaccgcuuucagcacuacuuaauuaggcaaaacuaaucuaaguugacagacaucaaagagggaagaagucacugagaggagaugacagcugcuccucaaucuggcagcaggggcaguguuacuuugugacauucacagggaggcccacccuaagguaugugcaugcugcacuuaauggaaaaguucaaaaacaagaaaaugaaucaauaaacagagcuugaguccacagcucucuacagccacuugcugcugugcaugcuaaccaucuccaugauucuggucucuggacucccuaauucaaggugacaacagccaaugcacauuaugucuaagggaaccagacaggaagagagcaccucgcagagcaaggccaggguccagcgccacagacaucaccugccugcacauacaacagccgcuccagccgcuccugauccagcugcagcuucuccucccuccgccgggcguugagcucuugcagccggcgcagcugcugcugccgccgcuccugcuucuccuccgccgucagugugcugcccaggagcuugcuggagaacgggagcugcaucuuguggacauuguucucguaguaaucgggacacugccacuucugcaauucuucaaacaaacaguuuaagggaguuagagaacaaugaagugaaaagucgaugccagccaugaguggacgaacucugaaccucugaacacacccaggcacacaaagaccugcugcgagggucugcagacagaaaccacacaggaaagcuggaacugccagagcaggggaaagacuguuaaacucacgggcugacugccucaugagugccuuaaaacuugaucgauaacuggaacuaaaacuaguaacaucacugucugaccagcucccagcguucacaggguuaauaugggagacacuuuaacucagaagccuagggcuaacacugcuacccugaccaauacuuaaucuacacagaugaggaaaagcuaugcaugccugaauucucuaguaaccaccuaaguaauacaggcacaagggggaaaaaaaaagucuagcugaccaaggugauguucaccuugaaccccaggaacuaguucacagaucucucaguucaagcuaagcauggacuauacagugagcuccgggccagccagagcucacagugagagccugccucaaaaguaaaauaaaaggaauccaauaaccuaaaaagcagagaaaaaaggacaagaauaaaauaguaaugccgaauucaaacacaaauacacuaacugcaaacggucccagcacacacaggaggcugcugaggggcgcaaggcccagcugccauccccauggaaagaguaaugaacauuuauuauaacacaaccacaagcgcaucuugaugacauugacuaaguagaucagagguaaagggauacaagcaggggaugguggcgccugcccccaaucuuaacacuugagaagaggaggcagaaggauugagaguucaagguugucuucacacauucaagggaauuuugagguuagccugagccacacgagacccuguugcuuaauaaaugaaaggaaagauaugccaauguaaacugcauucaaaagaaagcugggugccuuguugccaauguuauuuucagauaagaucucacuauggauaccuggcuagccuggaauuuacuaacaggccaggcuggccucaaacucaaaauccaccugccucugcuucccuaaugcugugauuaaaggugugucuaaaagaaaaagaaaaagaaauaaaaugaaauacacuacagaaugacaaaaggucagcugacaggaagcuaugaccauguuaaauaugaaacuaacaagacaaagucacaaacugacagcacacucugacagaucugggcugggagcacaguucagaaacacgcgugcucaucuugucaauguuguccucagugacagaacagaggagaaguggggacgcccaccaccacuccuaguggcagcaacacacuccucccaauuaucaacaggacuaguagaaggcaggugaccaagugcuggccaccaucaccaccagacaccaaaggacaccugaacaccaaagccacaagagcacagugcacgcucuucaggugugugaggaacuucugccaaagaugacgacaugccgggucaugcaauaaacaagcuuagcagacaucaaacaaaguccuuucacuauaaugggacugaaccaaugauaaaucacaggaaggcauuucacaacauauuuguaagcaaucacuuaaagaaauuagaaaauauuuguaaacucaguaacaaguaaggaaauuuaucaaaacccaugggaugcggacacagcagcagcacugaaaagggaaacacacagaaucaaaugcugguugguuuguuuacuuauucugugcaggaguguuuugccugcauuugaacaggaacuaccugcauggcucauggaagccacaagagggcaucagccccccuggaucugggauuacauauguuugugagcuaggacuacauaaacaaaagcaaaaauaagcuaguaucaaaguauaucaagaaaagggagcccacacucacaaauucucuuuccaugucuaucuccccaguuucuuuguaccucauaaaccacaggugcuuaacaaaagugcucugaacacacagcuuguaaacaccacuuaauucuccgaauaugguuaagaugaacccuucaauugggaagcugagacagaagagccagacaugugacguuaggcugagccuacacaggagacugucugaaaggagagagggcgaggggugcagggaggaaaggcugaugguaaauuuuaugucuuaugguuuguuuguuuguuuuuaaacacaauuaggauuacuuuuuguaugccucuguguaauuuuuuuuuuuuuuuuggucucuuuaaacaccacuucuuuauauuuucuguguaugcgcguguuuaagggcacuauguacaugcccacugaaaccaguagagagcagcagauccccugaaacuggaaucagggaugauagugagccacuccuaaggaaacccaggaccucugcaaaagcagcaagugcucugagccauucauccuuccgccugcagguugguuucuuugaagcagcaucucacacagucuuugcaggcuuugagcucacugugacacaaagauaacccugcauaucugauccuccuaccuccacccugagcgguggcagugacgccuuuaaucccagcacuugggaggcagaggcgggcgaaucuuuaugagucuuuggccagccuggucuaagaguugaguuccaggacagccaggaauauacaaagaaaccugucucagaaaaaagcaaaccaaaccaacaaacaaaccaaaagauugagauacuuagaggcuaaggcaggaagauggaggaucugagaccacacugagggacaguggccagccugagcuauauaaggagacucugacucaaaaagaaaaguucaggauaugugggagacugagaggugcucugacaucacucuaaggaugugagauaaagcauuuucaauuggugucaaacuuuuuuuuggcuuuuuaagacaggguuucuuuguguagcccuggcugucuucgaacacuggacuccacagaggcaaacugcaaaagcuauguugugugacgggacaacauaguuuauguuuaugacaauuaguuuacuuaauacucucaccaugugagcaccgaaagcagagguggaucugagcgagcaagagucaaggacccuucacggucaacagaguuggaaaccuggagcaaguuccucuguaucacccgccauggcccccugugucaccugccccguaguccucggcaauguagcuaugcuccugcaggaucuccuccaugcggcugagugugauggcugccagguggccuggauacuucagcuggagaagccgcugcagguagccagcugccugacuuccuccaagauugaugcgcuugcaguuuuuggcaucgagccuauaccgaaguaauaaagaacaacacugagagucaaugcagcagaaaagacaaaauguagaccaucuuggaaagcagaacugaauucagacaaaggggcagacuagacuaguggagggugaggacaccuaaaaccauaucaggaagauucccuugguucagccucuuacccaacgccagaacuccuacugcagaccccggcauguggcccuuuagcuucuaccgcagaaaagcgguuuaggccaguaguggcacaugccuuuaaucccaccacuugggaggcagacacaggcagaggccagccuggucuauagagugaguuccagggcuauguaaagacccugucucaauuuaaaaaacaaaacaaaaaacaguucaguaggaugucuaagugacaugugacaaguguguucuucugggggcuccugggaacacguagccuagaaauaauaauaauaaaauggucaagcaggccaaucccaagggcuacuugcucugggccuuaagagucugauuucacaagcuuccugggaacugcuucucuccacaaucagacgaacaagcacauacaugcuggcugguaaagggaccagagccucaucuuagcagggcugcaaagcuaagcguccacgcuagagccagggcucgcugccugcggcacacagcccuucuggcaaugugggaacuuuuaagggcacaaugcuagcuucaucacacaagaaaauaaaacaaaacuaaacucagacaugaacagacuaaaaccaucucugucuuuuauucuacuaaacaguucuagaauugccuaguauguauuaggcaauguaaccaaaaauaaaagguauggacaauaugaauuaaagaguuggcagugcaaguuuuuuuuuuggggggggcaaaaaaaucuuaauuaaaaauuaacuccagaauaccaagauggucuaaauuaaaugauucaacuaagagaaagggagauggcccagcaguaaaggcacuugcugucaaggcugaggaccucugaguucaauuccuaagacccacaugguggaaacagagaaccaaugcccuuauacaguucucugcuuccagcuuccugucaagcacugucaaauccagacagacagacacaggugugcuccugcaugcauaagcacacacacaaauuuuaagaagaaagaaagaaauauaauggaauaacuuacucaaaccaugcuuacugaaugccuccuaugggcagguaucauguuaacuguucccccauaaaucagaauuguaacacuguauaacugucaaucagacauaagaccaacuugaagucccuccaggaggucccaaagggcagguagaguaacuucugaaggcacucacugauguaggucugagcccagcucaguuaaaccaccuagcacuucccagacuuuccaacaggcaccuuuuacgucccaugauuccaggcagcccuaaaacgaugcuucucccacacaaugccacggcacagcucaccucccuuccaagaccgguaagaugugugugcacugguagccggaugaaaugaugaggccgcuggaaagggcauucuugggcacguugugguagaagcugaagaggcugucuaucccauaggcaaccuucgggauccuguagcauucgaaaaggagcuccgacaucauuugacgggaguagaggggguuacacacagccucugucagaacuaugggaugaucaacgcagcccuacuuugaaagacaagcacaaagagacaaacggaagcaugcaugaaaugcaaaaauaaccccaaauccuuacgcaggacagaauuuacuuuugaacucuaauuuaaaacacgaggucguggagggagacacucaaggccagacacgaggacuagagagaacacauuagaacccaacucuguuucccagcaccuaaucucugacuccagucacagaagaucaccugccuaaggcaccuacacucuuguacacauucucacacauauaacuuugaaauaauacaucuuuuaaaaggugcucacgggccauuuuaaagaauacauuucaucucuauuggagauuauuuugggaagccaaaauaacaugaucaauuuaagcuuuucguaggucugucugucuguugguuuuuuguuuuuuuaagauaagguuucucuguguagcccuggcuggccuugaacucacaaacaucugccugcuucugccuaccgagugcccggauuaaagggccgugaacccaugcccgguucauuuuaaguuuauuaagucaagcuuuggcuaaacuguuaacugauaaaccccguugguuuuaucuucaaaauacuuccaggaucggacuggugcugguaaaacucaucucacuuggacuauugcaaacuggacccuugugccugagacagcccauccucuggaagauaaagacuucgugguguacccuuagcuccuagcacaaggcugacgaacuuguguucaauacccuacugccuggcaugacggcugaagccgagcgcgcccugcccggcaggcccucaccugcgaggagacgccgaggugcuggaagcuguaguccagcagcaguuccugcaguuccagguugaccgggacguugcgaucgaagggcgagcgcagcauccagcgcagaggcuccaggcuucccagcgcguugcccaccugcggccccggcccgccgcgcgccccgccgcggccgcgcgcacacacggcgcggaacugcaggcgaggcucgggaccgggguccggcccggggcacgcccacccggcccgagccuggaacgacccguuguccagcaccagaggcaccggcugcgacccgaaggccaccggcccggcuucgagcacgggauccggagcagagcgggcaucucggaagcggaacacguuggccuccaucuuggccagcgccggucccgccccgaagccgagugcgucacgaaaccccgggccgcgucugagucucugggccccgaagcguccggaagccuccuccuuacgggaggacucgcugguuucagcaccugauucccgccuggcgcuccagaacuuucuguggguuucuauuccccgcugauccaggccucaaguccaaccguagcuccagcuuguccgcaacagccuccuuguggccacgccucuucgcgcuaacug

SEQ ID NO: 1238 - RNA, 63425 nt, Mus musculus
cuggcgggccacgccccuugagcccggagggacucgcgcgggucuagaggggcggagucuucuucgugaccuuucaccccagcauggcugcgcccuugggaccagugaaauucuggaaaccggguaaggcagggcagggagccuggguagaugcccggacaugacuuucggccuggggacccacccgugggccugaccgggggagggcugggcaccacuccuccgcgcgcaaggaugcugcagcccacggugguccggaggaagucaaaggccucccuaagcugggcggaaacucugggugaccuuguuggaguuucuuagccuccucggcaccucuugagauguagaguccugaagcgcccguguguaucuugcugaaguccuggggcagcauuggggcucgagaggcagugcagcucaguggcuuagaagcuuggguuauggagucagagcgcccagguucaaggcugccucucugccuugcaucaguagauggagaaccuugaacucugcccccaucccucagaacaucgcuccccucaccugggaagugggcggaauacgaacaccugucccgugggcguggaguagggggaguacguaguccgacuuaauggcucauaaaagagaaaauguauuccaguguuuuaggguaggucuugcccacucugaauguuuaccacaaagugaacgcccuccuuccuaguggcugucacuuuuccuguuuuguaggcuaacaagucaccaucuuuuguuuuugcauuuucucaggucggguucuuguugaaauaccagaccaugaucuguguaggaugcgccuuuuguucacgcuuuucuuauaaacuaaaccaaaccaagcuaaaccaaaacacuguuucuuaacugguaccagccucugcccuuacuuuuuuacacauuuucuuuuuuucuccucuaccugcacuccagaagaucuggguguauacauuauauugugaugaugauaguuugagacagaaaaggcaacaagggacagcuuuuaaagaguguuuuagaugcucccuggaaaucugaccaugugccuaaguguuagagaaauaaacucaugaaggugacacauaauuauuuuuuuuuuuuuaaaucugaacuggauaugguaguccauggcuguaaucccaacacuugggaggcagaggcaggaggaucucuugaauuugaggccagucugguguauauuccaggacagccagggucacaaagacauacccugacucucucguuugucacuuucaugacucagcauuuucaggcaucagcugauuguccaccccaguaaguaaugaguuaccaacuuauucaagaguuaaccagcagaccaaagaguuaagucuaauagaggcuuggauaaauugccaaaacucagacccggguaccauuuugguuaaagaaccuggaacuguucugaacuguucuacaagucugucccauuguuuaguccauuacuguaucgagaguacacuucugucgucagucaggucgugaacacguacaugccugggcucagcucucaaggugugcucuccaaguuacguguccaugagaagaaugcuaagcaaggcagaggggugcuguaaggaagauggccucaaguacuggacugcagugccuucccugccugggugacuugcagagccacacaagugcuccaagucucugcuuccuuaucggucauuugucauaauaggauugcugugaggauuaaaugagacaaugcacaaaacacccguggugcuagguacacagcuauuauaauuguauuaagguauaggagagggagggaaagugcagugugaagaauuggcugcgucguagagaugguaaugguuuuggagcgaacacugagcgcugaaacaaguuuguuauggcuuguuuauggugagguagagaauggcucuccaggccauugaaaggauuuguguauuaaggauguccccaaacccccaguauggaguacugugaugguauauguggguauauuugggguguggcaggagauggugcuggaaagguaggaagggacuucaucuugaaaugucuuucaagaguuaaagaaucugagcuucugggccagugagauggcucagaggcaagggugcucucugugagagccuuagggcaccagcuugauccucauaagucauguaaugguggauagagcgacuccacaaaauuguccuuugaucuccauacaugugcuugcucgcucucucucucucucucucucucucucucucucacacacacacacacacacucacuacagguaaauuuaaaaaaaaagguuucccugcuuuaaccccagcagugauaugguuaagaaggcuacucuaagagagguugcuacuaaaauccaggauggauguugaaccucaggucuagccugggagcugacaggaggggcccguuagauaccuuagagguaaagagaagagaaaguaaagacagugauaaucuuguguucuggacagggugacugccuaguucaguggggccuugauggggugauggccuagguaaguggguuucaaauuuugcuguauuguugaaucacuuggaaaauuuaaaaaaaaaaaucaauccuuuuguuauuauugucaaaaaaucaggaacuagguagcaguauuuuuaaacauuuggggggcuucuagcaugccucaaaguuggggauccacuuuuuggggcccagguauacagcuuucauucacugagauuugaguagcuccagugaguccggaacccugggaauucacuuucacuuacagcaucuuaucagcucguaauaacaucucugugaugaguugguauucucacagaggagcaaaaaguuccagaugaaauggguugugggaaaugcaggucagggaggugguuggagcuaaguguaaggucagaucuuggaaucacaggcauguccugauaacuacaggggccuuuuaggcaaacugcauaaggaagguguguaauggacuaauaugugguggacugaggguuguguauacuggagagacguauacacuggaacuuccauaugcauuaccacacucagcuugacuguuguuguaugggcucagaguuguugauuuuuuuuuuuaagacagggucuuccucuuagccuaggcaggcucuaaccuugugauccuccugugguaggcuucugaguagcugggauuacagacccuuggccaaacuuggcucucaaaugggaaaaauuugauugauguuuuaaaugaaauauuuuucuugggucuggagagauggcucagugguuaagagcacugacugcucuuccagggguccugaguucaacucccagcaaccacacggugguuaacaaccaucuguaaugggauccgacguccucuucuggugugacugcagcuacaguguacucauacacauaaaauacauaaaucuuuaaaaacaaaacaaaaaaagaaauauuuuucuuaaagauuuauuuauuuacuuauuuauuuaucugguuaugagccaucauuugguugcugggaauugaacucagguccucuggaagagaagucaguucucuuaaucacugagccaucucucuagcccucccuuuuuaaaauaauuauuuacuuacuuuauguauaugaguacacuguaguuaucuucagaagagggaaucagauccuguuacaugguugagagccaccauguguuacugggaauugaacucaggaccucuggaagagcagacagugcucuuaacccaugagccaucucuccagccugacauauuuuucugaguguagugguacaugccuguauuuccaacacuugggaggccugaggcaggagaauugaaagcucaagguuagccuggaauuuguagugaauuucaggcuauccugagguacacagcaagacccggucuacuaagaccaaacugacaagaaccaucuccccaucacaagucaacaagacaguaaccacuuaaaacuguuuagucauaguguaaauggagagcuuaaaugacugguuugugaucucuaacuuaguagugugguauacuggucuuguguguucugccugagguuuucccagaaaagaauguucacuuuauucucugacacacaugggucagaggggccugucccuuuucauuuucucacucaguaaguauuuaaugguggcuguccuugugccuugcaaaagcuuuauugagcugcuugaggauuuuucccccacuugauucaugguaagaauugugcuguagggcuggagagauggcucaguggucagagcacuugguguucuugcagagaacccacaguuaguucccagcauccaugcuggaagggauucugaguugggugcucuuaucagccguguuuuacagauggguaaaugaaagcauuaaugguuuucgagaauugcaaaaaugcuacuuccuuaagcauggcacacacucccaauuuaaaaccugccacaaacagagugggcuguggggcggguaagcagccugggguuccgugugugugugugugugugugugugugugugugugugugugugugugugucugaauggagucuuuuguaaggagaagaaaagcucggguauguguacagcagcuguucuuguuaaaguccuaacagcuguagguuagagacaggagcgccccaggagggcugggaaccagugugugggaggaugcagaccucccaggaacaguguucacguacucagacauaauggcaugguuuaaugguuugagaagagggguauucugaacaaaaacagggcagaagaggauccaguguucucugccuuaguuugaguugggaagugggauguagcaauagaaacaggagcccaugacaucugcuuuccagcccaggcuuugguccaggcccugcucuuucuucucugguugaagggagauuagcauuuggcagauguggcaguggcccacuuacggcuuuuuggaagcugcauuccuggaaguaccuggaacagggcuggagaagaaagcugcugagcuuugaacuugcuucuaggagucugcagacccagcaucuucuguucagcuuuuuuccagagggaagcucacacaggucuuuaaucccagcaguugggaggcagaggcuguuggaucucugaguuugaggccagccugaucugagugagcuccaggacagccagagcuacacagagaaacccuugaaaagaacaaccaaacaaaacccagaagauucauuuuuauuuuguauuuugaguguuugccuacauguguguaugugcacuaugcaugugcuuaguccucauggagccagaagggggcguuaggcccucuggagcuggaguuaauggacagaugguugugugugcuaggaacucaacccagguccucugcaagagaagcaacugcuuuuagcuacugagcuaucucuccagcccauugcuaucuuuuaauuaauuaacuuuuuagagaguauuauuucuauuugugugaguuuggauugcaugugugucugcaccaugugaaugccuggugacagauucuguggaacuggaguuacggaugguugugagcuaccaugaggguacugggaacugaaccuggguccucugcaagaggagcaagugcucuuuaccacuaagccaucucuccagccguaucuuaaccuaguucuguccuuggcucacagagacaagacgagaagaaggaaaagcugaccauaugggaccuauacuucuuucuccaugagaucugcuuucuugauuugucauuguucugggcaagaugcugugacugucugcauuuuaaucugcccugcaauguuucuuggacugccauuucccauaugacuacccuaguugugggcaguugcaucaggguaggccuuccaucuaagggggaugugcgucccccgugguccaauguaaagaaccucucacugccgugcacagcacacccuggagcuccaagucccuuucagugcacuccgugacgcuuagcugucguucuuaguauaccaaguuacugggaggcagcgaaucccugagggccagucugcaucugugcugcccagggcugcuuucuagugcuuagaacagggcgugccccgaaacauuccacagucugucuugucuugugcaugggugcuggcagucaccugcgggcugaacucugggccaucagcauccuguggagaaacuaccccuuggccuggagguucuggcccacaggcuuugucuuuggcagagucccacuggguuucuuucacucuguucaguaugguaguacccaguucuagauggcccaguaggaccgcccuguccuuuguucuagacucugcacuggacucuuucuuguguucuguuaggcgccucccuagcuuuuauuuuuuauuauuuuuuuaauguuuuaaaacuccaaaguuuuauaaauuugaaaucaaaagcauuguuuucuuuguuuaucugucuuugaaaauguauaacuuuuacacacucuuuucuguuuaacacccagaaucugaaaaacuuuuuuuuuucugcuacagguacagaagggccaggugucagcauuucugaagagagacaaagugucaccgagaacucugggacaaccaucauuuacaaucccuacgcugcccuuucuauagagcagcagcggcagaagcugcccguguucaagguacugcgugccugugauucaccgugagcuugucacugaaggggcugucacugaacgguuccacaaguuauaguguuacaggagccuaccccauucucgugugugcauauacgcaugugggugugugcaugcgcauucguguguaugcguggggagagggggagagggggaagagaugagggcagagaacacacccgcuuuaagacugggaaggccugaagacuuuuuucuuagaucuugcauauuaggaaaugggaaggaucaggaaggcauuucuuuuuuccuuuccauuguuuugaguuaugaacaauuucugaugcagaaaaugacacagugaacuacuucuucuucuucuucuuuuuuuuuuuuaaagauuuauuuauuuuauuuauaugaguacacuguagcugucuucagacacaccagaagagggagucagaucucauuacaggugguugugagccaccaugugguugcugggaauugaacucaggaccuucggaagagcagucagugcucuuacccgcugagccaucucuccagccccacagugaacuucuaagucaacauguuaucaacauauggccaauuuuugcuuucuuuuaaaagauguauuuaacaguguuaacugguaguuuaagagugucuuuggaagagauuuuuugguacucuuaauccucaaugagacuguguugggauuucugggguuagcagacacuccgcauugugaguguaggugagaugggguuagcagacacuccgcauugugagcguaggugagaugggguuagcagacacucugcgucgugaguguaggugauaugggguuagcagacacucugcuuugugaguguaggugagaugggguuagcagacacuccgcuuugaguguaggugagaugggguuagcagacacuccgcaucgugaguguaggugagaugggguuagcagacacuccgcauugugagcguaggugagaugggguuagcagacacuccgcaucgugaguguaggugagaugggguuagcagacacuccgcaucgugagcguaggugagauggcguuagcagacacuccgcaucgugagcguaggugagaugggguuagcagacacuccgcaucgugaguguaggugagaugggguuagcagacacuccgcaucgugagcguaggugagaugggguuagcagacacuccgcaucgugaguguaggugagaugggguuagcagacacuccgcauugugaguguaggugagauggcgcauacccagcuuccuagaggcccagugcaugaacuugagcacacugagaaccuuuuuuuccucacugaaguccuuccgaccccuggacacuguugauggaucucuuggcagccucacauggcugguccccuugcagucagaagguaggcucacaggugacuaacuguuguuggugaaugcugauuucagccucugcagccucugagguuugagcuuugccuccgugcagugucucuggaaugacuuguguggcauggccagcagcaugugugcuggccuuccugcugggcagagcuguguggacgcugacaagguuuguuugguuguuuuuccuuuuuccuuuuuuuuuuuguggugcugaggauuuaauccaagaugugccaucaaguguucaaccccugagcugugucauaucccuaacacuucuuuuauuuuuuguuuugagacagggucuugccacauugcuuagacuggccuugaacucacugucuacuaguccaggcuggcuuugaacuuaggaucuucuugccucagucuccugaguugcugugcuaccagccccacuaagucuuggggauccuuucacauagacacugcuggagacacccuucuaauaauguguucuuucuccacauagauguggaacggcagccuuaauuuagcuaaguugccuugguuggaguuucaggugaccguagacauuuuaguugaccuaauugugucuaggcuuuuccucaggugacuagaguuaucccuuguaugugacugggacugggugggacccucaggacgugagaugaccauugcuuccccaccacugaggggcgccguuuuugagucaugaugaaguguccugacucuggaauagacuucagggucccucccuguuucaccagacacgugcugggugaccuugcuucaccacuguaagcuuucauuuccuuaucugugauauggguuaauagcaccugccccguaggauugcugugaggcugggugaggucacccgugugguguuuauaagguggccgacuugaacuacccaaguacaaggaagugguguguacugaguacggagaugcugaccuuucugcacugcccaucauuuuuuaccuauuguauaagugaggugaaacuuaacgaaaaacaaggugaggcuauugagaagugaaucaaucucagguccacauuacugauggggagcuaagcagagcccgggugcuguuggagucuugaaagacgugaagauggauagagcuggggaggaggacaguguggcgcucaccucuccuccuguucagaccaaauguaaagguagcuuuaggaaguucaugguggagccuagccaggcauggcacgauccuggccugauccagccuccccagccccggugggcagaaguggacugaagcagcaccagucuuuccucggcccauuuccaaggcagucuccccuugacuucccuccgaagcuguucccucuggggauggacacugcuaugaaaggcgucuaugccugccagcccccugucugaugugcacucccguccucaugggcaaucccagggucacacggccuggugacaguauccccgcaucucccugucuccauuccagcugucuccuugcccugucuggccauguuaggcuaaagcacaugcugugcccuguccggaucauccugugugugcucuccuuguagcccaggcuggccccgagcucagagauccacuugccucugccuccaugugcugggauuaaaggcgugcgccaccaccaccuggcuuaguuuuccuccucuucccucucccccacuuuuuuuuucuuuuuaaaaagauuuauuuauuuauuauauguaaguacacugucuucagaacagaagagagagucaaaucucagggaugguugugagccaccaugugguugcugggauuugaacucaggacuuucagaagagcagucagugcucuuaaccacugaaccaucucuccuuuuucaaucguauuuuauuuguguguucauuugcauaaauggagguuccuguguucuaccugcuccaguguuuagaagcuuugauguuaaagcuaggagucuucauuauuaacaaaugauccuagaagacuuuccuauuaagaccugaggacugcauaucuccauccagguauaacauauccagaagcccugaauaaguaggaccuuauucgcuagauggaaccugucagccccccaccagcccuuaucccuaccaaacaccuccaugguacgacaaaagaugagcugaccucugaucagagagggagccccaggcagguuuccggcugaaugaggcauuguggaauaccucuggaaucagccacgaguucacaagugcuuucugaagcuaagcaaauggaacacugggauuuucuggggcuuuuuaguagucaggccuguucccacugagugggcacgggagacucgauuaccuguggauguuuuauugucaacuuugguuuugauacuuuuccauacugccaaauaaggucuaauuuuuaaucagguaaugcauaaauauuguaaaaaacucagagcucuucacaucccuuuuccucaccuucuccccuccauggauuuaacacuguugucucucuccuuuaaaaacaaguccaggguccugggaagagcuccugcuguacaagcaugagggccugagucugugcaugugugcuaacugaagugccagugcggggcagaggcaggaggauggcugggacuugacucucagccuuguucagguucagucagagacccugucucaagggaauaagguauagacugauagagcaggacaccugacgcccuucugcacacgugcacaguugcucguacaugcacaagcccgcacacccauaccuucccacacguacgcacaccacagcaccacaugugcauauacugugcguacaucauucacacuagucgucccuugcuuucuuuucuuaucugugauaugguuaaacaucuguuccuuuaaauaaucgugaguuguuucauuuaaccacacacuuauugugaugaacauuuagacuguuggauuuuuuggugugugugugugugcgcgcgcgcgcgcaaucgcguaugcauguuuuuuauccagggucucauguaaccuaggcuggcauugaauuugugauguaccugaaaaugaccuugaauuacugauucucaugucucuauuuuguaagugcuaggauuacaaauacacccucaugcuugguuuuuaaauaugcauuguauguguguauguguauauauguguauauaugugugugugcauacauuaauaugccugcagcauuacuacuuauauuuuggagugugaguguauguauuacuucuuacaggugaaaaucauuaauuggagaguugggaguucacauguucuauagguguuccauacacaucuuggcucaugcugacaccacaacaccauggcacuugagagaugaaaccacauuuugacaguuuuuuuuuuuuuuaaauuuacuuucuucuggaaacaguuuauuucacaguuuaaguauguuuucuugggucuuuugcgacaagauaugguugauuacaaugucauuuuauucucucccagcuuaggaaccacauuuuguacuugguagaaaacuaucagaccguggugauuguuggagaaacaggaugugggaagagcacccagauuccacaggugagcauugcuaauguccugccgagcagauugcaguuuggaggacuucguaacuuggggauagucauuacugugaucaacgucuccucucaagaacuacuugucucagauauuuuuguuaaaccuuugagcuuaugauuuuuaaauuaauaauaaaguuaauaguuguuuucaauuuauuauauuuccaaaauagggagucuucauguuuaaucugucucuugguucugcuaucagauuugauaugcaugcaacuuccuaacauuaccaagccugagaucugucggcugucaaauaauuugcccaguuaugccucaauauaccuguguuguuuccuuucuuggugacuucgcacagugcagggucaccuggagggaggguuguuuggggcgguggcaucagauaggaauccagcugugggucuacuugcaguaccuggcagaagcuggcuggacagcggaaggacgaguggucggagugacccagccucgcagaguggcugccgugacggugaguuucucuuuguauugaagauucugccugcccuuucuguuuccuugaucaguucauucuuauuccucaaacaaugcaaaguaguagaaguuacuccuuaagaauuuagcuuaagaagagcuaugauuagaacuuuugcagaauugauagcuguuguugugaaucuuuuaguaguaaagugcuuagggaguaaaaguagauauauuuguuuaaagcccagaucugccagcagaagaauugugaugcuucuaagugucacuucacauuucucuucacgguaaaggggagcgguuggaaaagcggcugcaggcaggacaggaaggcucuucuaagugugcgguuaugaccauguuuaagugugcuaacuacagcgagagggagaaccgaaaugaggcaguaaaauggggcagcuguggaccuggagaaacauuucucaucacaagagaauuuauuaaagcuugaaaacagaaaacaaugacagaaagccuucagaauguuuccacagugauuuccucucuucuccucuuuucuuugugagacaaggucucacguagcagaagcuagccuucaacuggaagcaguccuucugacuagcuacccuggauauuagaaaugguagugugugccuuaagugucagcacucaggaagcagaggcagguggauugauaugaguuucaggccagccuggucuauauugccaguuccagaccagccaaggauacauagugacacccugugucaaaacaaaagcaaaaccacuaccaacagagcacacaaaugcuagcuucugcaccugccuccuuuucaagucuguguuaugagaggaggacacugaugcucugccucucuuccuucgucaacacagcaccaugauuuucauaacauuuuacaaauuuuauauuauuaagauuuuauguguuguaauuauuuuacuguguauggguguuuucccugagggaaugucaguguacuauguucaagcaaugcucauggaggucagaagaaggcaucagauccccugggacuagauuuacagaugguugugagucuccauguggguacugagaacugaacccagguccucugguugaggagucagugcucuuaaccacugagccaugucuccugccacauauucaguaauuaaaaaaaaacauguuugagugugguauuaguauaccauucuuuccuuuccuuucuuauucuccuucacucuuucuccuuucccccuaaacucccuauccccccccccccccccacccuguucuuugguaucugugcuggugauggagcccagggcccgcuaugaaagcacucugcugcugagccacccaguaugagaaucuugacucacacuuuuguuuucugggauugcagacauugcuccuuugucuuuugguacugaggucugguagcaugcccccaucuuuuggugguuuugucuacuugaauggguuccuuuuuaaaacccugugguuuguuuuccuccagauguggauaaacuccuaaaucucugguuccagcucucuguguucuacuaugguguacuguuuucuaacuguuucucuucucuuucucuucucuucucuucucuucucuucucuucucuucucuucucuucucuucucuucucuucucuucucuucucuucucuucucuucucuucucuucucuucucuucucuucuccucuccucuccucuccucuccucuccucuccucuccucuccucuccucuccucuccucuucucuucuuucucucucucucucuuucucucucucucucucucucucucucucucucucucucucucucuuucuuucuuucuuucuuucuuucuuucuuucuuucuuuucucuguguagcccuugcuguccugaaacucacuuuguagaccaggcuggccucgaacucagaaauccgccugcugggauuagaggcgugugccacguuuuuuucuaagugcacuguguaaguguguaucccuuguuuugaguguugauagauguccccugaguauacucuucucuaggacauuguguagacuuacccaguguugcuguguugguugguugguugguuuguuuguuuuagggcuguugguugacccagauccuggugcugcugggccaagugcuguaucaggcuccuacuccaagccuguugcugauuaucuuuaguuguguuuauuccauuugauuccuuuucauuucuaccugagucuuugaauguuuuuaguauagaagcaaauauuuagaaugagauauuaugcaguauguuacaaacacuaaaagcggguaauguaguaaacaugaaaaacaccuggagaaacggcauguuuuuaucaguuaagucugccggacaggcacauuuguagaaacccgccucccugaguucggcugcuuuccacugacagccauguacccagcagugacuuucuguuucuccucguggggacagagcagccucuccucucugugcacggucagcacacuuacguuuuguuuuugaggcugggagguuuucuugacuuguagcugguuaucaguggcauggcauaaacgucugagaucauugcaaauuuugggaagaccucucaucuuugcugugugcuugugggucuagaccaccucugaagccuguccagccugugcaccuaagacuggcuucucccuggcuugcccucgacuucgcuugauuuaguuucaacuugauguugcuuuuuaauauaugugcugccgcagcgagcacuugauguugcuuugacaguaguuuucuauggcugaaugcuucaucccucucuuuuggcuaugcacggcauuuagacuuuugucguuaucuuuugagacaaggucuucaaguaacucaggcuggccuuaucccucuugauacuccugcuucuacuucuggagugguggacuuacaggggaacucaggguggggugggggaggaagacagagagacagaaagucuauauaaaaggagaauaggaggcuuggaaucugcagugaguuaacuuuuuuuuuuuuuugcuuuauuuaaagcuuuuuuuuuucacauuagcauuuucuuuuugauuggauguuuucuuuauuuacauuucaaauguuuuucccuuuccaggucuccccuucagaaacccccuaucccauccucccucccccucacucucaccuccccuauucuggggcaucgaaaacccucagguccaagggucucuccucccacuguuguccaacaaggccauucucugccauacauguggccagcgccaugggucgcuccauguguauucuuugguuggugguccaggcccuggaagcuccagggggucuggucuguugacacuguugcucucccuccauggggcugcaaauccccucagcuccuucagucccuucuucaccuccuccaggggacccccaagcucaguccaacuguugguugugagcuuccaccucuguauuugucaggcucuggcagagccucucaggagacagccaugucaggcuuccaucagcaagcacuucccggcguccaccauaauguccugguuugguggcuguauaugggauggauccccagguggggcagucuccggauggcuuuaccuucagucucugcuccacacuuugccuccauauuuccuccucugaguauuuugcuuaaccuucuaaaaaacacugaagcaucuacauuuuggucuuccuuuuuucuuaggcuuuauaaggucugaauugaaucuuagguauuccuaacuuuugggcuaauaugcacaguaugcaaugaguacauacuguguuuguuccuuugugacugagucaccucacacaggaugauauucucaauuuccauccauuugccugcaaauuucaugaagucguuguuuuuaauaacucaguauuacuccacuuuguaaauguaucacauuuucuguauccauuccucuguugaagggcaucuggguuguuuccagcuucuggcuauuauaaacauggcuucugugaacacaguggagcauguguccuuauuacauguuggagcaucuucuggguauauggccauuagugguauagcuggguccucaguuaguacuaugguccaauuuucugaggaacugccagacugauuuccagagugguuguaccagcuugcaaucccaccagcaauggaggaguguuccucuuucuccacauccuugccagcaucugcuguccccugaguuuuugaucuuagccauucugacuggugugagguggaaucucaggguuguuuugauuugcauuucccucaugacuaaggauguugaacauuucuuuaagugcuucuuggccauuugaguuuccucaguugagaauuuucuguuuagcucuguuccccaauucaauagggcuguuugguucucuggagucuuaacuucuugaguucuuuguauauguuggauauuagcccucuaucagauguaggauugguaaagaucuuuucccaaucuguugguugccauuuuguccuauugacaguguccuuugccuuauagaaucuuugcaauuuuaugaggucccauuugucaauucuuuuuuuguuuguuuguuuuuguuuuucuuuuugagacaggguuucucuguguagcccuggcuauccuggagcucucuuguagaccaggcuggccuugaacucagaaauccgccugccucugccucccccauuuguugauucuugaucuuagagcauaagccauugguguucuguucaggaacuuucccccgugcccguguguuugagacuuuuccccacuuucuuuucuauuagauucaguguaucugguuuuaagauccacuuggacuugagcuuugcacagggagauaagaauggaucaguuugcagugagucaacuuuuuaugucacugaaagaugacuuagcuaaaaauuggagcaguuuucccuguguaugguuugaaaucccagcucuuaaucaguuuucauuuuagcuccaaguuuguagcuacagagaaccuuccguguucuugauagaaugaagaaugcuuaaauuaacaugagcagugacaugcugcuacguuagaaaagcugagucucagagaugugcugugcacgcagacugagcccaagaacggaccccagaaguugugcuggaucucugugagaggcagauaguaaggagggucacuggucucagcaguccagguuuacccuccagaccaggccuuccucccucuaagauucaggaccauagagcccauguguuuguagaggugagagaguguccugcuguaucucacccgcuguccugcacagggucucagguccagcuugccauggagcagugguuugcugacugggaucuguugaguuuggugcacuugcggagaauacagcauaagcaguagagguaaaguuuauuaagccaacagagggucggcaggacgacucaucagugaagaggcuuguugccaagucugauuaccugaguuugauuuccagcacccauaugguggaggaagagaacugugucccacaaguuguccucugacccucagagguacacugugacacauggaccuacacaucuacacauacuuagaauaaauaaauacagauaaauaaacaaagucaauagaauacaauccugugugauuauaagugguggaacaaaaaugguugagaauaaucuuacguacuaauuuaucuguauuuauuugaagacaagaagguugugccuauagccuagccuggucuggaacuggcagacugccugcuucagccuccuggguguugguauuauagaugugugccacuacacucaguuaaaauauuaagaacaauuuucauuauuuagcuguguguaugugugagcgcugguguucguggaggccagacacuuuuaucuccucggagcuagaguuagaggcaguugugagccacuggaugcacugcuggaacagaaccuggguccucugcaagagcagcauaugcucuugaugaccaagccaucucuccagugcagacaaacaagcacccaugugcgcacccucgguuuuauaugcauauuuauacaaauagccagauagcaagaguagaagagcuugguuuacuuucccacccacaaaaugguuguuuuuaaugagacgguuggcucaucuguucucacucuucccagccuuuuccccugcaggcucccaguaucucuucacagauccucugugccuuuuucugagauguggaggguuagcucagaaccaccaugauagcuaagccuccugggaaacgcugggcauggagagguacacccuccagaggcagagccgagcagggugcgucucuguuuucauaagauguuuugaaacgcugaguggugugaacuggcugcuugaugauugauuccguguggaucuugucagaucuauaauuucaagucacugggugaggcuacuucugaucuucaugugcuugucaguuucuuaugcauugguggcagauagugccaggccgcacuugguggggcggcugaguucagggcgucucuaugcuccugagacugggcugccucaggucccuucuuggagcaacugaguuccaaacucagacuagagacugugggguuuggggcugccugacuggagagugacauacacuuguuuccucugucugguguccugaguccuggagccucguggcuuagcuuuguucuuuucagucagguaguguaaauagcaaauguggaacuuucuuugaaaaaaccaguaagagugacugccccuuuacagugguuugcacuuugagguugugcccuugaggccucuccucuccaaguaacuggguuuacaggcaugagccacucacucuguguguguguguguguguguguacaugcagguauugaggcuagaagacaaccccuggugucauuucucaagugccacuuuguccuuuggagacagggucuguccuugguuuggagcucacugggaggccaggcuuaggaaucccuggccuacauucugggauuuuaauaucaugucuccacuccaggcuuuguaugugggugaacucagguccucaugcuuguaaggcaaacaccaggccaucuccucagcaucuccucagcaucuccccuccccuuuuaagauagucuugcuguguuucccaggcuggccuugaaccuuugauuuucuugccuuugcuucccagagcccgcgguugugaacaugugucacagaccucccuaaacugcccuuucauuuguagugugcccaggguaguccucauacucccgugcuuugucuccuccuauccuccguuacggcacggggauccuccauuagucuuuaaagacacugucuuguccuuuuucaaaaccaaguucuuaucugcauuggcuuucaggagugcugguaacuggaacacguuugagaauugaguuaagcauuuggcuuugggauauguuagcuuccaaagagaggaugaacuuggcccacuucuggucagucauccuggucuccugccuuccuaggucaaucuuauuuuaaggugugugaacaugagaaguugcccauuguuguguggucuagcagagggggagggaguacucacugguuccuuuccaucccaucuuugguaccagauucagagcugaguucuccuccuccuccuuuuccucuucuucuuccuccucuucuuucuccuccuuuuucugugcccuuccuuuuccuccccuuuaugaggaucagaacgcagaccuuuugcaggugugguaccaccaagcuggcuuuagauuugaauccaaggcuuaucugaaaagacuguaaugucuggaguuuuaauuuuucauacugccuuagaucuuuugaauuugaaugcaaaauuuugaauugucucucuuucucccugucugucugucugucugucugucugucuuucucucucuuccuuuuuuccucuggugcuggucauuuaaucugggguaacacucugauuaugaguagguaaccacucuacuccugaacacagcucaguuuccuuuauauugaucuguaaaaucauugugugauuuuucuuuuauuuuguaugcuuucugcuuuuuauuuuuuuauuuuuugagacggggucucacuguguuccucugacuagccuaggucugcucuguagaccagucuggcuucaaacucacagagacccuccugcccugggauuaaaggcauucaccacuaugccuagcucuuguuuacuguuuuaaguugucccaagaccaugacagaauggagagaugugucauuugaucuaaugaccugccucuuuucuucucaucauucacauacuauuugauaagaccuuuaaguuuucuauaguaugugcgcuguguaguaauuggugugucucuauuuucagcaugaucuuucuucccaaagguugcaggccgaguagcugaugaaaggggugcagugcugggccaugaagugggcuacuguauccgcuucgaugacugcaccgacccacuggccaccagaaucaaggugaagugcucagagugaccucuaggguggacuagggaggggacuggggacauucgucucugugaagaucagaguuguuugaaugaguccuugaguuuuagcacagacgagaacacagaaguaagauugaucccuggucuaggcuuaggaggucagugcuucacccuuuagauguccacugcugauggugugaggaugcagaguucccuuuuccuaugugugugcuguaaauacagaaacaaagcugugcagacaaacucagggugaacugguguaaacugguccagagugggauucaucauggcugacuaguuagagcucucugagucaugaauucugucucagccacacuugacagaguagcuaagaauaaaguaauuagcauagugguaauugguagaaaucaguucagcagagucuccugcucaccacuaugcuagaaccacuguuggcuacugcaguggagcagugagcaaagugcccugaugagauggagugagggccuuagcccuggugccuuccagacugaacauagcaauuacaacuguucagacaaucaaagucaacacuguagccauuuguaaguaaauggaccuuggucuagcuaggguuucuguugcugggauaaaaccaugaccaagagcaacuuguggagaaagggguuuguuucagcuuacugcuuguaguccaucauccagggaagucaggaggagcacgaggcaggaacuaaagcagaguccguggaggaaugcugcuuacuggcuugcucagcccgcucucuuacacacccaggacaaaguguucaggaaugccaguguccacagugagcugggcccuuccccaucagucuucagucagaaaaugcucacauacuugcccacuggccagccuggugagggaauuuucccaguugaaguuccucuuccuaaaugacucuagugugugucagacugauaaaaaacuaaccaacacagaccucguuuuccaaauuuuuguuacccauguugucagguaaagggaucauguguuuaugccuuauuuguauguaagcaguuacacugggugggugaugagucaggugacucuuucugggcccaugagaagcucugucugcuaagacucauuauagaacuuuucacuuuugcuuuugugggugacauuugguaccagggcuaagcaaacuaucuuagaaacauauccuacucuuagaguccaggggaggugacacugagggacacgcuuagccuuguuaaugcacugacuuuguuuuggggugagaauaacagcauuuuauuaguguucauuaguccuacuuaguuuuaacuguaacucggugaaauaguuguaucacgagauuugaugggugaggacugaggcucagagauggcaagcucucaggcuggguuuucacagcagguagaaguagggccgggcagacauagaagaauaggcucugucaggucagggugacucaagcccacgcucuucucugcaacucuguugguggagguggagguugagaagaugcugaggaguucucccagacucacagcucauuaccauaguaaguaaugguaaacggagacucacuguagacucuucacuguuugccuuugaugcucauuaacauagcaacuagcacagagaugguguugaaaggucugcagcccagugugggaucuguuuguuuguuuguuuguuugccaauguugaauaaagcgcugggaugccucucccugagcugucuugcgugugaacagagauuauaguuaaacuugcaccaucaauguaaauaaauuucucuaucuuuguauuuuuauuguuuuaguuccuuacagauggcaugcuggucagagaaaugaugguggauccgcuguuaacaaaauauagguaagccugagcuccugugagucccuaguguuuccagaaugcaccgugcacuggcagucaguagggugagcagcugagauccuguugugagcaaacaggcccgugcgcuuccaucaccagggcaccugcugccuugucuuugcucaucgugccuuuacaggcuccgggaauugaagugacuacaggaccacagcccacagagaugugacuagccagcguugggaccuccccaccccccuuugcauuucgcaaagcuggggauggaacuuggggucucacacauguuaggcgagggucccacuucugcccucuggacaguguucuguugagugccauacacaaaguccagaugagggcugagcucuuccugccucuuagugguuuugcccaucaccgggagcgcuagggcuaccccacagcuuugggacucgagacacgcugucccacuccucucccugccuggcacaugucguucacagcuguccucugucuauggcuguucucguggcuuagcauuguugaggugccugggcuuuguuauccaguguguugugugagguuacagaucauacauaccaguuagaaccagcuguuaaguucugcuggaaucccggguggguagugaagcucuuugcaaauagugugcuaucauuauucucacuaaggauguugaaaucacauucuguguaggccugacaucaucggcagagauugacuucggcuuucucuuaauucgaugucauuacaugagggcugaguacccagaggucucuuuggugguugggguggaauugcaugggguguuccaugcucacugagagcaucucugauucuuagugucaucaugcuggaugaagcccacgagaggaccuuguacacggacauugccauuggcuugcugaagaagguaccgcuccagcacugcacucugcuuucuaaguuuugcauugcugccuggcuaggaaaguaauuacaacaaucuagaaaacuaguaaauacagagugaaaaauucucccaucauccugcucguucucagaaccacgagccggagguuguuguguuuuucucccuguguauauguuuugacacagugggauuggauaauaugugcuaauuuguaucuuguacuuuuaauacuauaucaagaucauuucaccaugaaauagucuuugaagacauuauaauuauuauuuuaaagauuuuauauuuauguugagaguaaguguaagucuguguaccacaugcaugcaggugccugcagaggccagaagaggguaucagguccucaagagcuggcgugacucgugguugugacuggccugaugugggugcugggaacagaagcucuguaagagcagccagcgcucuuaaccccagagccaccucccagcccccgaagagucugcgaaguggcugcugcugucugccacauccuuccuauacuguuaggcaugagugugccuaggugucugucgggccuuggcagugagcauucuguaauuaaaugugccgcauuucuauuucuuuucucuuuuuaacauuucaguauucagaaaauauuucaaacauacccagagucauuuauaauaaccuuuuuguucauugucuaguuuuggcaguuaacuccacucucauuucuccccuuaacauuauuauuguggcuuuuuuuguuuuguuuuuuuaauuuguuguuuucucugcauaugauccucaauuacaagagucuaaaaagaaaugguagauugggaugaccaagaacugcggccuugggaagacugccugggugcaaaucuugacugccagauaaaugccucuccaaaccugugucugugugucugugugggugcaagccuauauuguaaccauuagcugcgagucuagcuuggaauuguugaaagggggauaaaauaacucuuugaucuuugcaugggcucuucgugccacauguggcccgaggcugcugccuggagagggcagccuaggagcugcuuuuugggggggucugcugggcagacguguuggaugucguaauuugucauaaggcuuaaguaaggcagcccagaucuuacgaugacaucauauauagagccguguacaaauagaaggccgccccucugacugugucugucuacagugaggugacagaaggugggcuaggucucagaugcucacuaccuccucagccuugcgucuccgugcaguguacacacugauuggcucuguauggcacacagcuaggaauguauaaauugccuuggcuguuaucuuuuuccauuaccuuuuggccgaugaucagacuuuugauaugcaugaggaguguucucacuaggcucucccuaccaaggaccgaguaguaagagaacaaugcugcccaggcuccgccaguguugagcauccucgcacagcugcuccugagcauggcagacaucugugccaugcccggggaccacauuucuuugaauaacuguuagcacaccaauugcuaucuuggugcuacuacuuguuaguuauggauuuuagucuaccuuuucauauuucugaaugugaauacaugugagaaaaaaauguuuauuuuuaauaauuucaaauucagcccuuaaauuuaggguuagaguuaggcaguggguuaggguuacaguuaaauuuuaaauucccuuuauauuuugcacaacauuuuuacugggucauaauuuagcaagcucugacaucuuaaacucaggaagaauugucuacaucacauugacucuugacaucaucaguuguaccaucccugucucauggaugagccuccuuuuugccuugagacaggguuucugucuagcccugccuggucucgaacuugugacccucccgccaccugccugcuggaauuuacaggccuugucaccaugcguggcuaggauugcaggauugaacauuuuuccacugucaccauuauuucucggugccuucuuuuucagauucagaaaaagcgaggggaucuucgcuugauuguggccucagccacucuggacgcagagguaagggcaucucucuccuucugcuuaaacacuggaguugucagauauucccuugggacugcaccucuggccaaagcaugucuucggcaggacgaccugccucuuugggggccauguggugcucuagaugucaccugaugcuccuucuccacgguggguagacguuagccuguguaccccagggcguugaugaucaccagcuugcccugucucugucucugcuguccuccuccugacacaggcagcuucuuuuuaguuacuggucagugugaagcuauauuaauugaaauuauuuaugaaaauuacauacuuauuuuaauuuuuugguguaguggaaguuucucuucuaacauagugauuuccauguuaaguguuuuuuuuuaauuguuuuuacuuuuuguaugugggguaggguguacacaugccauggcuggaggucagaggucagcuuggaggucaguucuaucuuuccuccauguggguuccucugauaaaggucuucaggcuuagcaguagacaucuuuaccagcugagccaucucuuucaucccaauguuuuuauauggcugauuugcucuuuugaugacuaauauuuuauuuaaaaaaaaaaaccaguucaacucaucucauucuuuuggccacuugcuguuuauauauucuaaacaguaagccuccugcuagcuacgggugauccauagauccaggaguccagggaaggaggcacauagauagguauuugcuauguuaaggugcugagguaaccuagaaggcugcucuuaacuccagccagccgggacugucaagaacuugucaccaaagagauggcauuuuagcaggguuugaaauaaaaugacccuuucuucaugggcaaagggcgagccaagcucccugaccauguggggcccacgaggaacccugaguucuacaagcuaccagaacucuuucugccaggcaccacagggauacuccauccccagaggugcuccauccccaggggugcuccauccucagcugcugcucuaacuucaucuccuuccacucugucugguguucucuguuuaucagcuccacugguccccuuccauucuucugaggaaaccaggcuucuccuuggcaugagguaggguuuucucucagucuguuuuucuuucagacaugccuguggcucuuccagcguucuccuuaugguccuagagaacccccugucugagagaggcuuccuuucuggccucacccugccgcuucugcccucuugcacagcuuugacugugugucagucacaccgauuucugaugcauguuuagggguugucuguguccuugaagacugggacucugucuuacucaugauuuuaucccucucgccuuacgguguaggagccagggcaguggcuugcccauaugugggacgcaggaagcucauucuuguguuagguagagacccaggaauaguuaauggagaugcuggucaggaaccagcucuuuaugccaggggagauguggugagggccuggcccuggcuuguucuugugucuuccuauggguggaagaaugcaggccgacuuggugagaggugccuccuauguacccgggcuggccugccagcuucccacaggcugugggagcucuuggcuucaggcugccuacagucaccucugcccauuguccccaugcuuuagcugucaucucugucaccacgauguaugcuggaauguucucuggagguguuuuaauuuuguuucugaugcugaugacauauucuggcaaaaagcaaccuaggaacaacagcauuuauguccucagaaaugaaugcagacagguguugugggaaaaauuaaggagccgccacuucacuuuacuuuagcuuaccuuuuucugcuccuuuaaaaguuauuaacauaaaaagaaguuuacucuuguauguauagguguuuugccugcauguauguuugugcaccaugugcgugcgcucagugcccaugaagccaggagagugugcccgauccccugggacuggagugacaguuaguugugagcugccgcgugggugcuggcgauugaacccugcuucucuuaacgcacuuaagccagugcccuuagcccgggagccagcucuccagccguacauuuuccccauucgaauacagucagagugguacugcccgggaugggcuugagucuucucacagccuuacuguaaacagacgguccuuccuccugacagacacguccacaggccaaccugcucuggacacucugcugacucuuucuccccuggugaugggagagcgcagcaggaccaccauugcaggaaccuggcccgccucugcuccuguccucugugcuccaguugcacagaucauguugucuuuucacguccaucuuucucucuuaaacacuaggaaugguuauuuucuaaacagguuuaguuguggggaaaguguaaugcccaaguuuacuccuccccgacugggcucgcugcuaauggacaaguauaaacuguuuauugcugccuuucuugucuucuuuuaaaauuuuauuuuugagauaauauacuuacaucauuucccccuucucuuuucuuuuccuuaacucccauauauuguccuuggucucuuucaaguuccuaaccuucuuuuccccauuuauuguugaucacaugcaucucuguauaugcacauauauuccuaaauguaaccugucuagucuguauguuucuuguguguauguuuucguggccgagccuuugguauuaaaaaggaacuagaagugguggguguacuugucucggaagaagacugucucuuccacccucagcucuccuuccuugccugcaguucuuuguguaggguugaggacucgugggcuuucccugcccaugucacauggcuguuuguugucccugugcggcucauguuuaggcaggcauguugcugagauuuuauggauauagcuucugauauuacuaggagacacaguuucacagaaaacuccccggcccucucccucuuccacaguguucucugagccuuauauucagagugucuuuuaaugugauguagagacuggaggacauugccucauucgguuccauccguaguagcggauguagaugaccuccggacaccuuuugugaauuggaaggcagagccuagauuugucauucccugguguguuuugauguagggcuggcggguacauuagcaguacuuagcuggcucaggcugagcuauaggucauucauuccacucucccuuccuuccuugccuggacauccagugccuucucccgagggagcuguugaagaaagacagcggcuaugggauccccugguuaggaugugggauagguagaugcagguccgagagcguguggaaucugcagucuuaagugagaggaagaggaugugagugggcugaagaggucuggagugagcaggggcaggauaugucuuacuuagcuuuuguauauggaagaccaaggguacccaggagccaucuucucacccaaguugcugugucuaaaggugauaaacuugaugccaaacuguguguguugcugcugucaggccaccugcucugguggcuggcccagccggagacgagaagccaguguccacagaaggcagguggcagagaaggccggaggccgcuccggugguugcccugguugguuuggccacccuguuuguagaagcucgguuagcugagcgguuacauacacagcaggugugauugcaaagugucacuucaccccguaucacauucuucuacuugagccuguccacaugacggaagcuagguuugcagacaguuccuacuguucccuuguuuugucagaugucugauaacuuguagagagauuaauuucccucuuccaucaguccuggcgaaggauccugaguccccuggggucagggccucacuggaccaguuugcagguugcagucuuguuggcuuggguaggaguuggacagggcauggacaugguucuuagagcucucugcguggaccgggugggagcagcucccaggauaggaagcuggagugggccgacgguggcgcugcagguccgaaucauucccauuucguuucacagacugcgccccuuccucuccgucuucuuguuccauuucuuaccugguguucaugucauugugaccccagcaccugaagcugacucagauuauuccaggugaggggcuggcaucacuuccuguguccuugauucugccucaggccaucucuuacuggcuuuuuaagaaaaaaaaauauauuacuguuuauuuuaugugucugaguauaugucugcauauauaucuguguaccacuugcauucuuagugcccauggaggccagaaagggccaucagauccccugucacuggaguuagagaguugugggccacugagcucucucuccagccugacuuuuuggcuuuuaucuguauauuccaaaugcagauaaaggauaaaaaccuuaggguguagaccuugugucucagugcauccagaguguucuuuaaagaggcgcuccagguccuuacucgucagcucucccagcagcuggggcucagccguccaguccauccaggaaagcugcugugguccuaccucacuccggguuccacauggccuggugcuagcuguguucagcacgcccuucuuaaagcccucuuccuucuggagaaggacccugcuguccugcucuuccuccuccuccuccuccucaccuccuccugggcaucuugaaucuccacucugucuuuaaggcucuccacuccuuccauggccccuggcucaguugacacuggguguuggugacagucuugaauguguuacuuguguccugccucugagcugucuggaguguuuaaacuuggcucugguugggucucuccaguucuguuccagccuuucucguggucauaguaauucaggcccaggaucuccauugcugaggacacugcuuuuuuaagaaguggcucuguccuguucucuguuacaugcgcgugcucauaauuggagaaggcuguuuaugcuaucagauggcuugaaaccuauuggaaaguuacagugacuacauagcagagacacaccuagugcacaagaaggaaaccuuugugaauugauaaccuugugugauuagauauguguuuucuagauuagcuaucccucagucugauuuaaccuguaccaaacuugagccacaccuaauuuucagcuaaagaaacuacagaggacggggauaaaguuaccacagcugugcaucagcugagguucauugaagucuaaccuuuauuuauaaucaaacuuuuagcaucugccauugaaauuuccucugcaauuucaauaagagaaaaguaaauuuagcuggcuguggugaugcaugucugcaaucccagcauucaggaggcagaggcaggaggauacugagcuugggucuaaucugggcuacguagaguuucaggucugcuugaguugaguaucaagacccugucuucaacaaaugaaagcuuguggggagauggccugguggagcuauuaaaaaaaaagaauuuugugaauguagaaaaucauuuugugugaugugauagugcacaccugucaucccagucaagaaguggaggcaggaggaucaggggugcagggcuaaccucagcuauuuagugaguuagagccuagcuggaccacaucagagccugucucuaaaguaaaacaagcuauucugcagugugcacgcuugugugucugaguuuugugaucccacuuaccucugccaguuuuauauuuucuuucuuucuguugauuacucugaaccauccucuuucuuuuuuuuaguuauguauuuauuuauuuuuagaaauuucgagauuucuuuaaccagaaugagaccagugacccagccagagauaccucugugacgcucacaguggaaggacggacauuuccaguggauaucuuuuaccuacaaagguuugagaauguuugauucuuggugauggugauuugggaccucagcugucacgcaggauaauagggaagaucaucugccuccagggaggaguauggcucagcuccuguuccuggcagaauucgggacgcuggaccagcaucauuguuggauucagaguuugauucuccugcucacauuuacaugcaccuguggccgucaguucaggcggagagagucaggugggccgacgggaggugguguggcaguuuucugaacuggggcucuccagagugccaucaguaagggaagcagugcugagucuuucagucccuuacauccuuaacaaggagaccuagcucgaauuuuugggagaagucccuuugaauaagaaaggggccguucuaauuuacucuaucuaguuacugggccuaguuuagcaccugauaaguccagagcuauaaacuucaucuuuggguccuucuggcuggagggaaugucugccauuuccauucacucagccauuggugcuggcugggaagaugaugggugugcucugaugguuaguuucuuaucaccuugacacuagcuagcucaccugagaggaggaagccucaacugagaaaaugcuucccugagugugagcuuuaggcaagccuguaaugcaguuucuuaacugguuauugaugagggagggccuagcccuucgaaggugguucugggcuuuaagaaagcaggcugagcaagccauuaggagcaagucaggaagcagcccuccuccaugaccacugucugcaucaccuccuagcuccagguuccugccuguuugagucucuguccugacuuccuucagugauggauugugacuugggauauauaagccuuuccuccccagcuugcuuuuugucaugguguuucaucacagcaagcaguagaaaggcuaacuugggcagugggccucugcacugaaacugaagcccuugguuuucugagacuuggcauuuuugcaugcugaagauaaauaacuucuaugcacuucccauuagccucuugcugcuuuacucuccugcugaggcaguggccacagguaaauuugcacagaaguaucaagacucaauccagcaauagugcagguccagcuuccagaacauucuaucuuuuagaacguuauuucuuaggaaauauagcccaaacccauuguuuacauguaauuaugcauagaagugcuacauuuaauguuguucuuuucuuucuugugcuggggauugaaccugggaccuuacauguguuaggcaagugcuguaucauugagauacacccucaguuauugguugcugcccuuggaaauaaaggaguguguauguauuuuacuucucuauauguuaauuaccugcugggcuggcccggauucacucugaugagguuuggcugccagguuauuaggguaauugaucugugauuaaugagcguguuccagugaugaucuuuuuccucauacauuuucccaguccuguuccagauuauaucaaggcaacuguggacaccgugguaaaaauucaucagacagaaggagauggagacauacuagccuuucuuacuggccagguaacuccacccagucccucugcacagacaugcuaagacagcacagagcuagcauaaagucuuguucuuagucauuuguuguuuuuuuuuuucuuuucauuuuuuuucuuuuuuaaauguauuuuaaaauuuugucuaccugcuugguuccugaggaggccggaaaauagugucaggucucccagaacuggaguuaaggggugauugugagcugccauguggaugcugggaacugaacccagguccuccggaagagcagccagcuccuugugucuuguuuaauugugucuuguaguugcuaaauugcaugaaagaaaaaaauuacugguuugaugccaucuaguggccuauugguccucuaccauccagauugugaggggucauuagcucaucccuagucugucuguagaggguuaauugaauuuuuuaaauuugaauuuuaugugugugagccuuuguguauguauauguaccaugugggugcaguggaggccagaaaagggugucagaucuguuggagcuagaguuacagaugauucugaucugccugugccgggaacugaacccagguccucugaaagacuggcuagugcuuuuucccucugagccaucucuccugcucugauaguucaaacguauccgcugauuucagaguaagcuagguucugugucaguggcugccgccuuugccauaguugauggugcguuagguacguugugcuucaugcguauuacagucucauccugugaccaaacaguugggcaccauuucccaaggggccuaaguuaggaguggguccuuugauugugaccucucuccagcucauucugcagguacaacugaaucaaccagaauacugucuuaagguuguaaugccacuccaaccaccuccagcugcaaucuuuuccacugcccaacauuucccauaguuaguaucuguccucaggaaagcuuuuaaugauuucauagguaacagcuugcccauaugcacagcauguccauacacaggggaugcuguuuaccccaguccauaaaaguuguguaaaaauagucauuuaaagaguuaugugucuauguaggucaucuaugugcagcgagugcaggugccugugugcaggccugaagaggguguuggaucccuggagcuggaggcacaggcagaguaagcugccugacaugggugcugggaacugagcucugguccucugcaagagcaguagagccucuucaccacugagccaucucuccaguuccuuguuguuuuauucaugggaacucuucuauuaacuacggaugguuuaguuuuacuaauuaauuguacaguuacagagcuuuacuccuuugacacugucguuugguagcauuugguaaagugccauccugagugggacauggcagcacagcagcuucugaaggugaccacagcuaaagccccguuccagcguuugcuccuucaguaugacggcuugaccggcuucuucgcuuucuggucccguguuuaggaagaaguagagacuguuguguccauguugaucgagcaggcccgggcgcuggcucgcacugggaugaagaaacaccuccggguccuccccauguaugcaggacugccuucuuuugagcagaugaagguguuugaaagggugucacacagcgucaggaaggugagacuccuagugaucagugguccuugcagccauugguaaucacauuggcuccccuuuguauugcagaauguugucuuugguguguguaucuauucgucuguguucauguguguauuugugugugugugugagagcacucguguguaaguguagacacaugccccaguuuguaugugaaagucagaggaaaaucuuuuugaggcagguuguuuguugcugugucugcaaggcuaggcagcccacgaaugcuguggcuccccuccgccuccucacuguggggauucuggcauuacagacacaugcugccccuccuggcuguacguggguucuggagauucagggcacacacacagccagcauuuuacagacggagcuaucucccuagauccuguuuuauuguuuuaauugaagugaacuuugcuaaauaggaguuuucuuucaaaucuuagguccaugguucuaugcaguagaucuaaaaguccguaguaaauaauguguugugaguauuucuaaaccugcccagaagggccacuccaacaguaauugucagagcaggucaccucuuguagcuuuucuuugucugcugaaugguuuucacagcauauuauuaccuuauccucagagacugucaugguagguuauguucagccagaacuagauaaaauuacuaaccaugguuccuaaagcauuuguuaggaguaucaguuugcccuuaaagccaguuuuaaaucagguaagucuuuagccuugaaauuagguugaggaugggugugguggcgagacgcauuggaugggaggagccaggggccugacuucugccuccccuaccccuuguccuauccccuagaugaggagcacacgcgggguggcucagagugcaguagcugagggacccauucccaacuuaaggccaccugguauggagcaauccaaauccucacacaagaacugcugucagccaggcugcaggccuggguuccaccuguguguguguugcugugugccuugcccuaaguuauuuagcuucagauuuccuagcuguaaaacauucauaacuaaacuuuuuuauuacauuuauuuaugugggguggggcagggcacauauguguccugugcacacauaugugucgugugcacacauggaggugagagugcacaugcaggaggcaguucuucccuucuagcguguggaucucagggacugaagucagagccaucucgccugccuccgcaauagcuuuuagauauaaaaguaggaagauuuucaaagaugauuuuauaaaauguaaagguugaaaaaagugugugccucuuauauacaugucuccagcuacguuaaacccggcaggggcagcuggcagguagccagagacuugacuggugcacacuagcugggcccccucugucuccaagccccucguacaguggcaguguuggccggaucuccuuccucugugguaguucuuucuggucugaaggguuggccagucccugucaggaggucugaguuuauguucauguuuuagugcuguugucucugggcagccagugugaaggggaagcuuuguuauacuauaugauguauauaacauguauauaacacguagcauauaaugacacagcguauacucuuacguauaucccagguugugcuuuuucccuggcaccuguugcucucugacguuaucugcucugacguuaggaaacagacauuauugaacuucccaugugcucagugugagcuucuaaucucuuuguguuuggauccuccuugacaacccugggggaagcgguggucauacuaugugcaugagaaagcagugcucaggagcuuggggaagcugugcaugguuauagaacuggaacauuuccggccagugugcuggucuuacgcuccugccugguagcaggauguuugaaauaguaguaugucuuuaggauuuuuaaacuuacuuaaaauggaaagaaccaacuaauucucuuucucuuuucggcaggugaucguggccaccaauguggcagagacuuccaucacaaucaguggcauuguguaugugauugacuguggcuuuaugaagcugcgagccuacaaccccaggacagcuauugaaugcuugguggugguaccagugucucaggcgucagccaaucagcgggcaggacguggugggcgcaaccgcucgggaaaguguuaucgccuuuacacagguauguaugguguuucuuaacaacuuuggauuuucuuagaguagccugggcuuuggaucccagggcagacauuugucccuccuggcagaacucacugucaaauccagcucucccagggaccccaccacuuccuuccuuccuuugcuaggauuccccagcuggcucagugaaccaccuccugccuaccaccuccauucuaaccuaauguugggccuugugucagaccccugagcauagacuugugcaucaaguguugucuuucugcuuaaugggcuguguucuuacagcuccugaacccagaggcacggcccaucagauccccgcuugccuuugcagaguucuccugagaaucauucauggauggcaaauaguuggcucaguucuguaucacaagccgugcuaacuucugagggcacagagugaaauucugguagacaguccuggccuuuaaugagcuuuccucucagccugcuggcacugcuaggcacagguaccaugauguuccagagcugcugucugucugucugucugucucuuucacugggagugguucugagacauccaccacccccacugcccaugcccacagagcuuaccuuccugccuucuuagugugcagauggaguuccaagucauuaaugcccuccuguguccagcacccacuuacgcugucuuuccauuccucuuuuacgcgguuuccuagggauuaguggggcuggauguaaguguguggguagacuugggacaugaaggggaaccuuuauuucuuugaggaauugcagaguuguagguauaguaauuguguggcuaaggaauuauuuauuuuugaggcaggauuucucuguggagccuaggcuggccucagccuccgagaucucccuaccguugccucucaaggucugggacguaaagacaggcaccaccauucucagcaauauuuuuaguuuuagguaauuuuauuuuguguguugugccugcaugucugucugugcaguacaugugugccuggugcugagguggucagaggaguguuacuggaauaggaauugcaggugagucuuagcuggcacaugggggcugcgagcugaaccuggcaccucugcauuugcuuuuaaccgcugagccaucuuccagcucuaacucaaaugauuuuuuuaaaguggaaauggacaccggcauuuggugucaaagaagccaugugauaagauacggacugaagcugggcaaguggaucuggguggaaggucacugagccuuuagucguagcugcuuuagcaagggcgugguugggaaagaccagggacaguaagcaacgguuagugcccacccuucagauugccagcagaucuucagagccugcagcucuucuuuacucagauaauuugguguuccagaacuuuccaaggcuucuccuuagcuccucugcucucacuccuacucugccugguucucagcuacuccguucuuagacacgugaucugcuucccgcuuugccaugcauaccucugaugccuugggcuugucugucuuuguaucuucucagagaggccggccuuucagcuagugacuuguuucugccuuggccaguggugugccuggggaguguaguuguccugguaacaguacuauaaccacaaagauccuccugauacucuuggcagcuccuguguagcuuuucucaguuucugcucaucucuuuccugagccucccaugguccacggcaggggcauaugucccucuugggccuguuuuuuggucuugauccaggucccuccuaccucugaagucuccagggccauugcgugaggccucugccccucuugaccucugugccccuggcucuggggccuuugcagcuuuccugugucaucacaucuuuuugucucugagaaucaacaccugcuucucucagcaucuucucagugggaccagccucucagcuaaugacuuguuucugccuuggucaguggugugccuggggaaugugguugucuugguaacagaacaguaaccacaauguucuuaaagcuaaagaacuucuuuccuugcuugccaucuagaaccuucccgcuagacccaugcauuuggcaauuuauguuacacaguccagaauauugguugucucuuuucucaggaaaaccuuucuaaaguucuuacagauaguaguguuucuccaggagacuuggcuguaauucauuuuccucucuaguuaacugcagccuucuggucuaaauggagacuucgugaugcuuguguguaaggaggguguguaucuguacagcggucaguacagcguugacuuacaugggaggguuuggcguguaauccauaggcuuucugaauacacagggaaagugauuucagaaaagccuuccuuucuccccacccuuugaucugguuuucagaaaguccuccccugacucucuauccuuccccuccucccccaucucugugccucggggugcuucuccgguuugaggucaccuuuuguuccugugggacaagcaaguacaggauccugggugugacugcauuuggcuccuugguuuaaaaacuagguuuguaugaauucugcucucugugaugagauccuucuucagagucuagggcagcucuggugauuuauuuuuacauuuuucuuugcuuauuuugcuguucuugcuuccuugaagcgcucugccuuaugcagagugaacagcaacugggccugagaguaauuacccaaaugcuugcuacuuucguuuugcugacaaaagcauuugaaaagcaagguuuggaaguaaaggagagugcuuuuguaaagggguacuguucaacucucuaugcuuuugaaguagaacguccuuccuaaacguaaaaauaacuuuguaucauaauguuguacauguggucccagaaucccagagcucuuguucacgguagagaagguggacucugccgauguacaggugcauuugagugucacguuugaucuguuucugauuuccuauccuuagaggaagccuuugaccagcuaccucaguccaccgucccugagaugcagcgcagcaauuuggcccccgucauccugcagcuaaaagcccuagggauagacaauguccucagguuccacuucaugucuguaaguccugcuucugguugaggggcucauguggguaugguggaaggacacuggucaggcaugccaucuuucuuccucacauagcugaaacaccguaugccgcuugguccuauccaggguguggggcaaacuggcauccaggcgagccagaauucuuccucuguagcuccuguccuuucuccuugaaaaagacaagccacuggguagcuacaggacagcuugacagugcucagagagacaaggaggguggggagucaggacauagccugugacugggccuggcuggagaguugcaaagcuugggaaggacccugcggcucucaguaucuaugaugauuuccuaaggcaaguuauaggagugaaucauuagucuucuuucuguaggcucugaggcauggcugccuggcucuccuaggcuccccucagcagcaugcaaggccuggccugcgugcucagaugaaguggugggugaguggggaaggugugcuacagccauuauucuuguagaguuuuuuguuuuuuuaaagcuuauuggucauuuuauaguucauaucaaaacuuaagcuuauuugucuguuaauauuuguuaguuauucccaugagucugcuguuaaauaguaaaguuugacuucacucuaaugucauguuuuuggcaaauauacauauaugucaucugcccacuuauagaaaagcugacuucuuuguagucugacaucagcucgggcuuguguagugaucccaagugcuuacccuggagcuccugugaguacgagagacagaccaggacggcgugccggcaggaacccaggggcacuagugugcugcucugccgucccguuacuuucucacagcagcgcuccagauuugcagugauuccuuggguccccugaggguaggccccacaggguaaagucuauguauauagccagccaccaaaccguuuaaagauuugacuuuguucuuuggugaacaacaacuaaaagcaaggacuucguuuagccucugacccugccgucaagugcuccgaagccgucuucaaagcuccgucugugaagucgaguuaaaucacucuugaggcuuaaagugcuucuugugcugcagauucgggaggcaagcaguucacuggaaaggugcugaccuugucagcgggcugcuaggaagagccccuugaaaggucuacugauguuugacacccgugugcucaggcuuuggagggaaggaaagaggugucagugcacucaucacagcgcacagugugagccugcugcccuuugcggcaucggugucgucugcaggguuagcgauuucaccgugucgcuagcucaccauuggcagggccggggugguagaagcugguccuuccucaaccugugcugugcuguagggucugcagcuccaggcacagaaggcugagagcagcuuagggaagugaagagguaguuaaaguaggggcucucccugcugagggaggagaggaguaggaggggagggggcagcugcagaggcgcugcccaggaagcuacagaggugggaggcacaugccaagguaccagcagugcagagacugggcggcuggagugggauagagcgagagugagccgguguggucacagaaacuaaugggaggccuuugauguguuucacagcccccgccagcacagucgaugguucaagccuuggagcugcucuaugcucucggagguaagccuucuucuccuguguucaccuauaugauaauggguagcuggacuuaaauuagcauucuucaagucuuuaagaaugggauugguccuccccauggguauaauaaacucuucggugacauuuacucuauugaaauagaaauuagacacagguagcucauggccugucuuaggguuacugcugugaagagacaccaugaccauggcaauucuuuuuuuuuuuucuuuuuaaaauuuuauuuuauuuauaugaguacacuguagcugacuucagacacaccagaagagggcaucagaucccauuauagaugguggugagccaccaugggguugcugggaauugaacacaggaccucugaaagagcagucagugcuauuaaccucuaagccaucucuccagcccaugaccauggcaacucuuauaaaggaaaacauuuaacugggucuggcuuauaguucagagguuuugcucauuauccauggugggaagcaugauggcaugcagguacacauggugcuggcaagccaacugagaguucuacaucuggaucuacaggcagcaggaagagagugaaccacugggccuagccugaacaucugaaaccuaaaauccaccccacagugacacacuaaaaaggccacaccuccuaauagugccacucgcuauaggccuaugggggccauuuucauucaccaccacauggccauauaugauaauuuauaagguguggcagaagcuguagauugccaucaccagggccacacguccuagagacacccaguucuuguccucagaccccuuucccucuuccagcuccacccugaaaugucguucauuuccccccugaguuccugugggaauugggcagguagcagcaguacuguucgggcaagggcgcucugugcugugcaggaagcccccguggcucauuugagagcacaguaugugucuuaagguagagaaaauggugucggcucagcagauacugugucuuuuaugagugguagccucuugggauguucugugagaucgaguucgucaguaaguuuuaguggagguuuugcccugagguuuugccaugaguauuuuaaaaauagcucuauugagguauacaucauaaaccacgcaguucacuccuuuacaguuuucuguucaaaggcuucuguugucacaggguugugcugucuuuaguacaauccaauuuuagaauauuuucaucguucugaaaugugucucuuagugcucacucucuacuccuguccuccucagccccaggcagccacuaagcugcugagucuauggcucugucuagucgaaccguugcucagaaguggaaucuuagguugucucuggacagcuucuuucauguagcucuuucuaaggcuacccuuggaucaccuguucaauggggcauuuauuuuuccugcugaguaaugucucagaguauggacauacccacauagugauuuucuuuuucuguucauuagauuguggguguugugaauugcuucuuuuuggcugguaucaguaaugcugcugugacuauuagcaugugggguuugguggauauccuccugccccccaacuuucucuacauuugauauuguuugucuuagcacagcugaccuaguggauaugagauggugucuggugguuuugauuugcaugucuuugauaacuuacaauauugagaaccuucugcgugcuugcaagucagugugcaaggccaguuagugucucucuagcuagucucucuguaucuauggaugagaauuuccuucuaggacucccuucagauaccagaaaucuagggaugcucacuccuguguaaaauggcauggcauuugcacauaacccacacuucaucucagacacuuuaagcuaucuuuagguuucuuaugccugucacaguguaaacaccaugccauugguuauuauucuguagugcuuagggaaccgugacaguagagacugugugugauuguucaggcaguuguuuuucucacauauuucacacagcaguugguugaauguaaggguauggaauccauagacagggagauggacuguauagugcccaggaguaugucaauucagcuugcaugcuggcaucugcugucucuacuccugaguuggaguucuuugcaugcucugauuacagaucuccuuugugaucacaaguacuggagacuuaaauauuggagguguggugugcagucccaguucacaccuuguugcuuuucuucugccuuuugugcgugugucuucaugucucaggacacagugaugugggucugggguccuaguucagggggagagugugugcuuggugugucuggggccuugagucucugacgucccagcaccagcagcagcugggcaagcaaagggaagcagcgcugcuggcuccuuaccucugacucauaggcucgagucugugcuuuguucugcugugcgugugugcaugcgcgcgugugugugugugcgugcgugugugugugugugugugugugcgcgcgugcgugcgugcgugugugugcgcgcgugugugugcgugugugugcgugugugugugcgcgcgugugugugcgugugugugcgugcgugugugugcgcgugcgugugugcgugcgugugugugugcgcgcgugugugcgcgcgugugugugcgugugugugcgugcaugugugugcgugcgugugugugcgugcgugcgugugugugcgcgcgcgcgcgcguguguguguguguacgugugugugcgugugcacgcgugugugugcgugugugugugugcgugcguguguguauagggagggaggggaaggaagggagggagaggcccauuuucauuauuuucauuuaugauauuuaaauuucuuucucugugaaggaaucaucaguuguggcuguaagcgcucucucuccaccaaugagagagguguuaagcuugagacauaauaucagccuguagugugugucuuguuaggguuuuguccccagcucccagcgugugacaggagugugugaacugaggagcaggaauguugauucuguguugucuguccucugcaaugguuguucugaaagucauacagcgggcagaccguccucacugauauaaacauucuggaggguguuggggacaccccgguuuaaaaaggacaauuguauuggaacagaaaggacuuaacuuuucuggcucaucccaagcguuuggagcacuuauuuugauuggugaagcuauugucuguaucuugggguucuugggaaucuugugccuacuaauggugcuugguagagaggccugugggaaagguggaggagguggggaagugccggaaagauggaguagucugucuacuucaagggggagagggucagggucaguucagaaucugaguguucagccccgugauugcucaugcggugugaggaugcuggacuuuugaggccuaucagguccuagcuauggagugagauccagaaggugagaaagcaggcccaugucgugggaacucaggagagcagugaguggucugcagugacagaggcugcuuccggucucaaccccacagagggccccacagagggcgguuucuguggagcauccuguggggaagcgagggaacaggagcagagcaggcugcugcccgugugaagucguucacuagagcuccuuaaaagcaucauugaaacuggguugagcucagcuggcuuccccuuuucaugugcagcccuuuugucaggcugcgcucaggagcagugagucaucuucuuuucucccagcuacugcucaucugcagcacaguagugucgccuccugacuucuucuucuguucugcucgcaggucuggacaaagacugucgccuaacugagccucuuggcaugagaauugcagaguuuccucugaaccccauguuugccaagaugcugcuggaaucagguggguggagccugauggcuccuuuugaguuuuuguugguuucucugaauucugugcacccagggaggagggaccaauugugauuuaaaaguggcaauagugguaaagugcuuauuuuugacuaaugacgaaacguguguuuauaagauaagugugauguuugauacauguauaguggaaagcuucagucaagguaauuagugcaucuaguauguuauggauuuucuuguagcaauuggaacuauacaccuuacuguguuaccauagugucagaucacuacagcucacuccuccagccugaaacugugucccugaagcaacacccuccuaccagccuggaccaguuccuuucuacucuguucccaugaguuccuaaccuguacagugugugcccugugccuggccugacacacuccacugccaucccacuguacagugugugcccugugccuggccugacacacuccacugccauccaugaugggacgauaggauugacuuuuuuaaagauuguguaaagguuacaccacaugcaucaugucguccuuauccaucccuccgcugaugcacaggaggcugcuuccucauuuuuguuuacugcaauggacaccagaguguaggucccuucugcaaaccaacuucaguucuuucggguguacccagaggcacgguuucuggaucauguggccacucuguuuuagguucuuaagaggaacauccauguauuuuccaaaauggcugugcuaacucuuaacugccaagacacuaucauaccacgugccacaguggcugcgugacagcacugucaugcaguauacaggguuccaguuucucugaauaguuuuuugagcaugugaguuaggaaaaggucuguuucuuuacuuacaaacgucuugaccauucagaacccguuucucuuucuaggaaaggugcuguucauauuuuaaguuuuugucuaacuguuacaucgagugguaguuuaugaaggcgugugucagagccagcgaggugaacguuagcagugagggaccaccuucccugagagacagauucuaagugcagcaggagcagaguccccugugccucaggcagggagcuguggggagccaauaggagugcaguuugcuuggucugguguccucguuggugagcuguuacagagccuguucucaagaggcagcagcagcucuggauguugucccggccaccccaagcugcaggcuucccagaguagagcaguacuugggguugggggggggcaggcuaccccacaggugggcugggagcggcaggacagcuggaggaccacagcccugcacuuccuccccuuucccuccgugcuucaccuggacuccagcuguccacauagaggacagggagcaagcaugccgccaaucuguccuuggugacaggccaguguggccucauccuggcuggcaucaagagcccucagccuuagcacuucugggaggaaucgucaguugagacacguggggcaauccguggcaccauaaguucuuauauaugagagacuugaaaaaaaaaagaacuauaagauacgaccuuauuuauagcacacuacaaggaacacauuggaaaaugcccucucucucccguuggugcacugucuguuugcaaacauacuuuucauguuuuagggaacuucggcuguucucaggagguccugaguaucgccgccaugaugcagauccagaaugucuucguguuccccucaaaccagaagucucaggcaguaagucccgcuucucccccagcucuucacacuguucucuggcacauucuugucagagcucaguuagaaacugcugaagacaguuguguaaaagagccuagcuugcacuugagugggucugcugugucucaugggaaguauaccuuccuguacacacggaggcagagccugucacccacacccgaguguggcuguauuucugaaguuaauguguccgugucuuugccauauguuuguguccguaucuccucaaccccagggaacaaguggcauuauucagaaacuucuccacagaaagaauucaagggugggucugaagggagcucaggaggugugaacagcauaugauuguaggacaugcgaggucaagcugucagcccuccugcagugugccaggucccucagcacaagagggucauggaagucagcuucugaauggagcuuuauucuucacagacucgagugcaccggaaauuugcuguggaagagggugaccaucucaccaugcucaauguguaugaagcguuuaucaaaguaagcacagccacccucggggacacuccacacgcacgcacgcaugcacgcacgcacugugaugagcuaggagcaaggucagaggguaguucacacacacacauggccaagagacuccucugcuuuccagguagcuaggucaccagccucccacuggagauuccagucuccagcugcuggagaggcuaagggagguuuccuuucucaaguggcugacagcccagccucccagagccccacacucacugugcuuggcaggaagggcgcacaugaaugggaaguucugagaaccgcugcugugugggcugagucuucagggaccucccaggcucccccagaacauggccagugaggcuugcgugugccuccugggcagccacucagucccacaguaauuuaacacaucuuaaaaaggagaaauagcaagguuuguucuaccagagacuugaggaugguuagucuguaaaugagauacagacugggucaauuaaaauccaggauacaggcacgguguguugccuccaaggcagagcgucacacagagggcgugucuacagaucugccuuguggaaaaauccugugugaauuacauuuuuaaaauguuauuuaaacauuuaauuuaaaacguaauuaauaacacauuuaaaauuuuuuauuugaaaaacuucucuccauggcuuagaauguaauuuuagauguacauugcucugcaaaaauuuaaaacaagaugucauuauuggacucaagaaaauagaaaguuaagcaucauugguagaaaaaaaauccuaguuucaguacagaucaggauuugauaaugauuucugaacguguuguaguuuaauaagaugagaggggacgguaacagacuggucaagaggcacggggaagcagagcugacccugcuguggugugcuuagguuggccucugcuugccccucuguucuuacugcuuggaaguguggagaguggcgucggggagcaacaggcgauugcuugguuguuaccaucugcucuagagauagggguugggcaggucccaucagaccagaaagaggggaagagaaaggauuugugcugaugguacugcuucggcuguggcugugucugacauggugacugucuccucuguguggccuuuuugcagcacaacaagagcucacaguggugucaggagcauuuccugaauuacaagggucuugucagagcugccaccgugagagaccaguugaaaaagcuccuugucaaguuccaggugcccaagguguccagcgaagguggguguggccagccccacuuuuggcucccucccauccccgcccuguucuguccaguugcauucucaaguucuuuugcucgacugcuaggaggccaugcgccugcagccuuucccauucugagcugcaggcucauucacuggugagcauacgccuggugucuuuuuguauggagccauuuuuauuucugugggcuguuacuccuuccuucaaauuucuaaugcucaugaaaaugcuuaaaaauugcuagcuccuauaucauuucacauauaacuaauauaaugaugguuguugcagaaaauuuacuuuuuucugggacagugucucaugucccagaccucagacuuauuauacagcugagggugaccuuaaacuuccacuccuccugcuucugcaagugcuacugugugcgugugcacgugugugcguguguguuugugugugcauguguguagugggcacacaguugagucuuuucuuuugccauguacugaacucaugucuuaaggcuugccuguaguuucuugcugaaccaucuugucaucccugaaaaauuacuuuaaaaguggaugguauucuuagguaucacaugaaaauugcauuuucuucucaggugcgaguguuaauaaagcagacacuggcacauguuuagcuuaggcauucuccaaagguaagguagaacugcggcagauggccucccauggagcauuggugggcagccauuuguggaguccacaguggguuggaccaugucagggucucugugcccuagcuuuaucuuccuuuguuugaggggggguugaugguguccuuaguuuacagaggaaccaggaguccugggagggguuacaugaccuucagggugauacagcuuuagcuagcauggccagagaccaggagccuucuaggagguggcacacugaauucauucagcacucgaagccuccuaugccacagcaccuguugacauuugcugacagcaucugcuaggccgggcaguguucucaguaugucauguguucauuugcaucgugcuuagcauucugggaaaugugugcuacguuuaucucacauauagaaggcaaauaaugaguagacugaagguagccuugagagucaggauccaggaaguucuguuucauuuugcuuuuauacgaagaacaaguaagugauugaaaagugacaaaaacuugauucucucaggcuucaugcagacaggaagacugugacgucaggcuggagggccuuuuagaagugauguguagacugguaaccguggacaacaguggcaaguaguagaaauaaauucagagaaggggaaaugagcagggcuuguccagggugccaugucagcgggagcgcaucugccuagaauccugucgccuggcaggugaaugacagccucucgucugcauuugggugccuucuccugucauucucacugcccggggaagggcuauguuggauuagucuuccaaauaagaggaauggaauauuaaggaacgagauguuaugaagcugaguuuugagggucacaaaguaucauaauaaaguguuuucacccuuuauaaagugacccccugagaagaaagugcauuguauaugggauucugaacagcuggagagagauugcaucuggguaggugguggggcagaaagcaggcuugaggcuuagcagcucugcuagaaacaguaaugacagacaggccaagcaauuaccugcaaaucagaaugcaucuaggagguuagaggaaauagugagauguauuuucagcaguuacauaauuaaaaacuaaguguauuuuuaaaugacuuuauuugaggcuauuuggcaaaugaacaaaggauuagaauauuaaaauucaccaagaagaaauaaaaacacacaaguaguaauuaaauuuauaaaaaaauaaaagaauguagccuucauuuuggcuaaaaucugcuggaaagaacucaguaaaaugauuuuuuuauauauuguugagaauccuguaaggcucccaccuauagggaaauguuugcccuuguacuguacuucaccagagcuauccauaaguauguuauguaucacugagaaagaauggcugucacugugacugugucuugacuugagugaguuaaaauggcucagaauuggugaaguaggggguauuuucagucauuaaaacguaauuauccccugcaugauaguuuagaauucaucucauggcuuugagcgagugaauggagaugcuuuauucaugacagauguguuugcuauaacaauaaaaaugucaguuaaaaaggaacagaguguuuggagaauugcagacuaucugacagccagagacagggcagugugcuuucaugguguguguccuagggaaagaaggcauuucuacagugcucugagcucagcagccaucgguggggcagcuucuuggguccaguccucuguggccugggauugaagaggugcuaguuacagagcagaccugccuuguccuuagcuacugcuggggaaagaugcccccucagaugucgggcagacaucagacaugggagacacagggccguguucagagaugguuucagguggguugcagaggggcaggggagcuggccuagauccuaugcaucacagcccagggccuggcauguggaacauggggccagugcugggucucaccaggcgucuguugcugccuuguguaggugacccggauccaguccugaggugcaucgugucgggguucuuugcgaaugcagcccgguuucacuccaguggagccuaucgguaaggagacucugaggugacuuggugaaggggacagaaagcugccccuugugcagagaugaaaaccaagcagcuuuuaacuuacaucaucaucaugcccgcuuccaaagccuggugaggccggcugcccagugcucggcagguucucugcucucugggagucuuacuccuuaggguguccguacgcagugaugguguuggggugaccguggcagauguacacugcaggagggaguagccauuaacugacguuucugaagaagccauuuuucccaauguguuauucuucacccuguccuccauuucgguagggugccaauaguaguuuuuacuguaaaaacuacagcauaguuuagucugcuuuucucuaggcuaaauauccugguucuuggaauuguuauuuuaaguugguuucuucagucccucaggcucauuguggucaugugacuucugcaccuauucaagguguagcuguccuuguacccauuucacaggguggagucuagggcccgacaccugccagacaagugcucuaccacuagacuucacacuagcuauguuaaguuuucuuucucuuccuggggucuuccuucucacuauggcuggccuagaacuuguuagcagacuagaacuuguuagcagaccagaaugucaauacugaguccacauucucauuucacauggggcucaucaccugccucaguccccuccacccaccccccccuucagggguugagcuuacaggucuuuaguaagggaacaaucuaaggcuuucuucuaucucccuuuuggauuucauauauuauuuugguguuagcuuccuccccuaacagaaauguuucuuguuauuugaggcuagcucagauuccuuuuucuagacacuacagaaucuacugagcauuaaggaaaaaagauguguguguguguguguguguguguguguguguguguguguguauguguguguauguguguguguaugaguguaagaauguuuugucuacauguauguguaucacaugugugcuuggugucaauagaggccagagggugucaaguccccuggucucuuggaagauaagcaaugcucuuaaccucugagccaucucuccauccccacugagaucguuuuuaguuuuggcagccauaucugccucaucuuccugguauggcacugugaacuuggcagcauagccuguggccucuguggugugcaguguuacuccagaccacaugcuccagucaugacucccaugaugcucuugcccauuacacaagccccgcucccacaaggcuaagcuccuccccagugacgcucccucucagcauuuugauugucccuuuuucuugacaagugccaacuauuucuguguggguaaccuauuucaugggcacccucaacaaaaggugcuccauuggagauuccaggucagucauuccucugaagugaauuuauugccagcccacuaccauuugacagagagugggaccccagaugcugucuuagggugcuggugaugagccccaugugaaaugagcauggggacucaguauugacauucuagucugcuaacuuuuaugaucuguucauaaaaguagcuggcuguuuacuuuugaaucggauggaaacaaauagaauuuggaauuagaaguaaguauucugcaggagcuggccugugugagcuugcugggcucagucuuagcuccuuaggguccuuaguguuuagugucuaacuuugggcaguagggaagucuguuaaaacucagaguuucuguugugaagggauuauuuugaaagggaacuauagaagauaauuauuuugaaggggaaucuauagaagauagacacggacauaaauauggguaucguguuuucuuccugugggggcuguguccauauuugcuccccacucccauucugaggaugaaguccaggccuugcacacgugaggcaagccugugcccugagcuaacccugacaccuucuuaauucagcaggagacaggucuuucuauguugcccaaguugcccccagccugaaccggaaauagcugacauuacaucuaugccccucugugcuggcccgguuucuuauuuugcaugacuuauucuuggcuucugaggugguaguggugguggaggugugucuagagcaguggaucucagccuuuuacaggagucacacaccgaauauucugcaucaugauucauaacagaagcaaaauuauagugaugaaguaguaacaaaagucauuuuuaugguugggggcccccgcagccugugcagcagcuaaaggauugcaggagagggaggguuagaaccacugcucuagagagucgugucguguccgcagaaaauucggucuucauacauucgggggaggagguugaaucaacacauugugggaaaacacuuaaauguguacagcaaugcagguucuuacaguaaguggauacaaugugcuucacacagaauucuugugucucacaaggacuauucgugaugaccacgagcugcacauccacccugccucaguucucuaugcagagaagccaccccgcugguaagccccucccccgcugguaagccccuccccugaugggaagccccucccccgcugguaagccccuccccugcugggaagccccuccccccgcugagcuuggcccugcucaucucugggucuccaagccuaggcuugcaguacaggugcucccuccacgcuguugacguuggugugcuggguugccaggguuuguacucuugucaaggguccccuaaagguagagaguccuccaguuacugcugagcugccuugcgcugugcucaguaaaauauccuuuugagaaaucucuguaaguauugaugauuacuuccucccuuguccucccaacaaaauacuuuuguuggugacagaaggauuguggguuggggccacuugggcaguuugucuucugcaaaaauaaaaagugugacaaggagcagcaaaggugcucgcugugaccacagacugaggcuuccugcagcaggcacagcauguagggaugacuuagaacccagcugaagucuuauuuaccaggcgaacagauugaagucccguaggagaagcuuuucugaagggcugugcuauugcagugugugugcacugugugcucugcuguggguuggcacugaaggugcugggaagccaggcuguacagguucucacggagaagcuaacccuugcucuggaccuggugacuggcauuuuuuagguaggucugaaagacauccacaccuagguaauaggguggccuagcuguggcagcaugaaggagguaccugucuugggggccugggaaugagcugacagugggaaugaggugaccagggcugguuccaucugcagugcuggcugggaaggugggcggggcaagugcagcagcaggagacagcacacauacuuuaagguguuuucacaagucacgcaguuauaccuucccagguccaugcuaauuucagcuuguaguuuguguuuauuucugauuucuaauuuauuuauauuguauuuuacaaaaauauagauugucaaagguuagaaaauuuaaagagagcaacacuggacucuuuaggagcugaaagaacagugcauguguggugagccgugggaaggacagucugggagcaccgugucaggaccucguacccugcucugcaggcagcagccuccccuggaaccacucgcacccagccuuccucagucagaaccggggugaggugggggcgggggacucuuuaaacaaguccuggcaguguuuccgauuguagccagucagauauagaagcuuccuagguggagugugacaguggugcugacuuuccaagggcuucucugcugccgugagaagacagaaguccaugggcaccaaacugcagugccgcuuuccucuccagcucccucucccuccaucccacccccauuucucuccuuccucacuucccucccucgcucuucccgcucuccuucccucccuugcuguguuggggugaacccccaggccuugagcauguuagguaacuguuacauucccgcccugccuccuccucccaccagccccgauuccuuuacugguguuugagagacaaaguguggcuuuuguauuuauaguuaauucuucccauaguucagaaacucguguuuacucuacggauuccugaguccagggcuuacaaaacaucccuugcucuuagguuuguuacuggcccuaguaacaaacuuuuagauauguauuuuuuccucuuuaagauguaauuauguacagugaaagguggguuuugacagacgugcaagcuccacaccaaacuauauuuaaaauacuuucauugcucuggaaaguuauugucugggucuuuauagucauuuucuaguaacuuucagaacagucaaacccuugaguccauuucugugcuuucuaauuaagucguuuaaguuguauucagaguucucuaagugcagaccaugaucuagaaagcccuugguggauaacugcagagcccuggaaaucguacaggaugcagaguugccuccgaggcacacugaccuaacagcucgggccagcagguugagugaacagcccguguguaaagccucacacacgggugaaacacaccugcuguggugagugcagagacggcuugugggucuugucauugugggucucauguuuauucucuguuucaggguuaucuacaaugaaguaauacagaccuccaaguauuacaugcgagaugugaccgccauagaaucugcuuggcugcuggagcuggcuccccacuuuuaucaacaaggaacgguaggaauggguagagcauggcccuagacaagcaguagccucuucauggucuucagucucuguguguucuucaguaguacccuaaaucauucccagcucccuccagccccccuaaaucaccacuguaccccagaaccucugaaaacaccuucacugccuucauagggaagugcaguuacaaacaaauccugcaaccccauaagaaaaggcucagggcgguugaaacccgcuauguaguccgcuccaugcucucccucccccgcauuguuggauaacagauuuaagguuucuguuuuucauucauugccccaaaguccaugccuccuucugacaugacucaauucaaagauggccaaccgcgcuugaaagacugggugugggccaggaacuguucagucuguacugugcucucauuaaucaauuuaaucaauuaacuaacuuaagaaauugagugaauugcaaugguaaguuauguagaguaauuauuauuaugugaagugugcgugggggcuggaaguugaacuuagugauugcugaugacuguaagcacgcugccuuggaauuauuuucuguuaguacauuuuaaccuuuguuccuuuuaaaaacuauuuuacugcuuuucaaauuaaugauuuuuuuuuuaaaguccuguaguuuauuucuuaaugggcuuugccuccucaugguuggucuugaauuaguaucacacugcucagcuguacugggaggaaccuacaccagguugcugguuuuaccaaauggcuuuugugcuuugcuggucagucucuuauuucugcacauguuuauacuauguuuggcagucuguggguauuguuuuugaacaguuaguugugucucccacagauuacagcauagagccuuccuuccuguuguccccuguggcugugugggucccugccugcagacccuccuuuaguguaucuucagcgcccccuguugaugagcaccccugcuccuugauuauuugcaggaguacuguuucauuuuuauuuuugaaggcuaguuuuccuccauggaauucuuccuugaaugacuuuuguugcuguuucucaucucuugcaucugugugcagugucucuguccucuucaggccguccuggguuugcagggggucuuguuucaccccuguagcuacucuugagguuuuugguuuuugguuuuuuuuuuuccuuuuccagccguuugaccuaugagauacuuuucuuccuacgucuccuucucagaguuaacugaacugucuagaucugugagcagaugucuauaguuauauuagggcaacaugggguuuuuccuuuaaaucuauauuuuuuuucugcucuaaucuuggcccucugaagcuccagucacacacacguucuacccagcacuuguuugugucuuauucaucacaaaggcucuggucuuuuuuuccccgaacuucacuuggacaguuucucaguauuacuggucgguucugcagggccccauuggcaguuaagccaucugagggguccugggcaccucacuuuucuguucuuguauuugauuccucucugccucuuauucucugugcucauucguuacaccuaccuuuuucuucagaucuuugcauacacgcacacacgcacacgcacaugcacacguacacguacacacacacacacacacacacacgcuuuagaagccacuuaacucagcauggcugucacuucagccuugauuggguuuuggcccgucucauaaccagacaagcuucucuugucuaguagcuucguguccguguuuuacguucacuauuauaggugcuguguuaacugaaucugaaguuucuuuucauaggugaugucaguuucuuccuugcugaguuaguuuauggcucauaacuggauucugcugagccuugaucucagucuuuaauggggcaggucuuagccauccaugaaagacauaucuuuucuuuuucuccuccuccuccuccuccuccuccuccuccuccuccucuucuuccucuucuucuuccuccuccucuuccuccuccuccuccuccuccuuccuucuccuuccuccuccuuccuccucuuuccuccuccuuccuccuccuuccuccuccuccuuccuccuccuuccuccuccuucuuccuccuuccuccuccuuccuccuucuucuuuuucuuuuuuauugucugaucaaaugucuaggacucuuggugaugucugugcacugguccaugagcaguguccagcugugugcagaccuccagcauauuucuccaauaaugguucucugccacucuuagaaugccuuggucuacacauuucaucuuggguguucagcaagagacuggcauagccuuauguaauaucugcucuaaugcccuguauuaguuaggguuuuacugcugugaacagacaccaugaccaaggcaagucuuauaaaaaacauuuaauuggggcuugcuuacagguucagagguucaguccauuaucaucaagguaggagcauggcaguauccaggcaggcaaggcgcaggaggagcugagcuaugucuucauccaaaggcugcuaguggaagacugacuuccaggcaacuagggugaagaucuuauauccacacccacagugacacacccauuccaaccaggccacaccuauuccaacaaggccacaccuucagauggugccacuaccugguccaaggauauacaaaccaucacaugcccuauuuuguguauuucucagcaaccccaaacccucuucuuaccuguguuguuuccuauuuagaauuuauucccuugugcaagaguuuggagaguuaggcagagaccugggauguauguaacaguguguuauucaggguucucuagagggacaggacugauugagugaaugagcgaaucagugugugucugugugucugucugucccaucuaucuaucuaucuaucuaucuaucuaucuaucuaucuaucuaucuaucuaucuaucuaucuaucuaucuaucuaucuaccuaccuaccuaccuaccuaccuaccuaccuaccuaaaggggauuuauuagaauggcuuauaggcuguggucccgcuagucuagcaauggcugucuaccaacagaagauccaagaauccaguaguugcucaguccacaaggcugaguauauuccggaacccugaagaaguaggcucuaaugccagugaaggaaugggcuugucagcaagagcacgagccagcaggcagagagagcaagcuuugcccuccguggucuuucuauaggcugccggcaguguggcccagauuaaagguggaucuuacagccucaaaggucagauuaagaguaggucuucccacuucaggugauuuauuuaggaaaagucccucacagaugugcccagcugcuuggguuuaguucauucuagauauagucagggugaggacagagacuggccauaacagacacuccccuguguccccguuuucaaggacucugcuugugggcuugggucaguaugcaucaggacacagcuuagcuuuguggucagacccuggcacccaaaaguaaaggagaaaguccaugugaguccugucuucuuugcuuuccagauguuugcuaaaaguagcuccagauguuucaguagaguuuuuaguccagcugcuguuuauagcacaggggaaucugaguuccauuucuccgucagggcgacugggcugcacagugaauccaagcugagauuggucugauugcuuuguguaaaauuuggaagaguucagccaguccugcuggugugcuccuuuagguccaacugcuagggaaacugaggcaggagguuuauuugagcccauaaaaguggagacgacccaggaguccaaaggaaguccaacaggcagacuaugaguggagagcagagcaggcgccugcaguuaggcacagcccagcauugcccuggcuccccugaggcuccuguagaguagaaauggcugacaaacugaguuacuuuuucuccucaaaauucauuuauuuagguuaaggggcaggcagacuguuucagaacauggaagaaaaugacagggucagcgaucugccucuucucucagacuucugccauuuagcucaucacuaacacugugaugagaguguugagaagagcugaggccuguagaagccauccuuguagaaugacagccuuguuguaguacgggguuccugaagcuccuucgggacagcuugcuauguuuucugauugagguccagagguagagcuguuuccucagggacucuccagguccccgggggcugcccacacagggcaggucugcugugcuggacgcuucaggugucagcgugcugggccuccugcaccuccagugacuuucucucacuuguuuucaaaguugcuuucaugcuguagaggccuggaauggcucaagucaacuuuguuuauacucggcguucuuuccagugaagguuaccaaaacugccucacaggcagauggugucaucgcccauccuggauaaggcuacacauguccaggauuaguuuagggucaugucuggugaagaacagagaagaaagaguccagagaagcaguaaacguacagauuugccucagagagaccauugugagccgggagugaugccugacucacugugugaggaccugugcuugcucucccaggcacaaguguauagaaagccuggaguccaccauuuccuugaaccugggccugccccucugucagggcaugccaucgucauugguggugugcuguuuucuuucagggcuuguaguucucuggggagcuaugaggucaugugggugugcuaggacauggggcuuggguccuagcgguugggggugcagcguccucuugggaagaguuccugagugcuagcuuggcucagguuugggucuguacuucgcuggaucacguuauugaugggugacaggacccccucagguggugaggagaggucccugaauagaagcuauguucauacauucugccucaaacacuuauuugagaacuaguaguaauuuggcuuuaugauacagaauuuuuaucccccaguccugucagcugaugcccauggcaauguaaggaagcuucaagugugccuuuaccugucucuucuccugcaggcuggacacagccuuucucgggaaggugugugccagacaggagacucgacuugugggggcugggcuggagccugcuuucccugucucaccaccccagugauguuuccuuuucucuugcagcaccugucccugaaagccaaaagggccaagguccaagaucagugaguggagcucggcaaguggcugcagggaugcagaguguggcauccuuccuucguguugucucuggcaccagaucagguggaacaggcagacaguccgcugugggcugcacccugcucauuagcuccccuuucugcuccccucagcauuggccauccucacugggccccagaggagucugagcauggccaguguucugcuguacugcgugcuggccaagcaggaguuggcugagcugugcacugggcccgguccucacccucagcagcccgcaugcuacuccaguaggcacaguccugguccaguucuguggugaggaacgugagcugcugaaggcugcaggccguguagacagggcucucuuggccuccugugucuugccugcuguggccauaguugcugaucacugaggucagcugcugcuaugugcguuaaguauaaaaggaaaugccgggcauuuccaucaagauccccagagcugugcgaggcacaggggcuuccaaucgaagcagcuuuuuccuccccucugcccgugcgccugccugucugcagugggagacagagcagugacgggggucacucgggagacucagccccugccuuugcuagucaccugcuuugcaaguggacuucgcucucucuccgaucacgaugccacacccugggccaguggcugggcgccagcgaacguucaccaaccucgacccauggggcuucucuuuagcaggaacucacuacaguuuagacgcccuaaacuuguguagcucaggaacauaacucuuguauauuucucuuuguuuguuugcuugcauucuugcaagaacacaggcagcucccgggcucuguucccacugcaccaggguugccuugcgaugacagcgauggcacuucagcacacagcaagacagacucuccuguacuguuucaaugacguuuauuuuaacaccguagcuugaaaguuuauuuuuguacuggucuuaguuuggaugugucacuuuuggcaccaaaccuaugucauuuuuauuuccauuuuauaauguguaaauagcugugguaaguuguuaaauguaguaaauauuucuaccugaggggacauguuucuccugucu

SEQ ID NO: 1239 - RNA, 1837 nt, Mus musculus
cagugcugggguguauauaagcaguccucccuggguuuccgggguccacauaguaucaagguguuccugaaauaaaaaaggcuguugagaagaauucgaccauguugcguuuuuuucuugcuggacgaggugagcgcaacagcagaccaagacaacagaccagcagggccuucuuugcuucugugaguuucaagcagcugccugaccucugagggcaguuccuguaaaauggacugcacugcacucccuagagaggugagugaacacacuagacagcuccuagucuggaaaagucugaaacccagcugaugccagcugagucgcucccacguuuaguuuugcccugggauccucuuagacccaucaguugcucacugacccauuuuucuaaccaggaccagcugugccccugccccuuagcgaugcauccccuccgagagugaguccauccaaaggcaauggccagcugggugguggaugagggucgggggcuuccugggcucggccaaacagaagcagaagcuaggaaaacauuggacugagcucaaagccuuucuggggagacuccaugauuccaacugugccacaccccagugggagaucagugguuaccagaggcagcgggaggaagaaggagacagguagaaaacaaagcauuggggggggggggggagacagcgaaacugcucccucugcugcuacaaaggauccgguuguggugugucuguggaaugaacaacaccaacuacccagucuggagaaaaggugaguucacaggcuacaccugcugagggauucuaggagugggcaguuccacucaggguaagggaggaaagauggagaaacugggucauacaucauuuaggggacaaaucgagaacacaaauuccaaagcucaaccauaaaaaagaggguagagaagacagggaggggagagagggaaauggagagaggaagagaggaaaggaggaaggaaagaagggaagaagaaaagaaggaaggaagggaggaaaggaaagagggaaagagggagggaaagagagagagaggaaagggaaagacaaaagacccaagagauggaaagaagcagaacuuugcugggguguccagggcccuuuguccugauccaccaccaagugcccagagaggacacucccaaaucucaccccacaccuuccucccuguuagcucacucucuccuuuccaccacagucugcucaaaucaucacaaacugucccuuuaucauugaaccucccuaauuaagcuaacauuauuagaagguugggagggggaggaaaccccucccaaauucucuuugcguuucaguagcucuuuaauaugcgagucgacgagagagaugagcggccccuaauugccagucccuggaguagccggucagaaaaugaauugaugcaguuuuuuuuuccuuaugaacaaugcauguagcacaaauugcaguggccgucaccagagauuuaauuaccaaauaucauuacuuucacacaucauuucagauuuggccugaucaaaucaaaguccgggagagagggagagaaaacugcacucuuagcaggucauucguucagggauggcuucagagcaguguggcuuggcguuggggagacuuccuucagccacuguggaagcagcagcugccagaggcguccauggcaagagagaugcccuagguuccaggcuuuggaagaaggaaggcugcauacccacaggaagauucuccaggaccugggaaacagcccccaaccuccccuccccccccaaggaaagggccaagcugaaucaagcccuguaacccuacaaguagaagguacuacagca

SEQ ID NO: 1240 - RNA, 1837 nt, Mus musculus
ugcuguaguaccuucuacuuguaggguuacagggcuugauucagcuuggcccuuuccuuggggggggaggggagguugggggcuguuucccagguccuggagaaucuuccuguggguaugcagccuuccuucuuccaaagccuggaaccuagggcaucucucuugccauggacgccucuggcagcugcugcuuccacaguggcugaaggaagucuccccaacgccaagccacacugcucugaagccaucccugaacgaaugaccugcuaagagugcaguuuucucucccucucucccggacuuugauuugaucaggccaaaucugaaaugaugugugaaaguaaugauauuugguaauuaaaucucuggugacggccacugcaauuugugcuacaugcauuguucauaaggaaaaaaaaacugcaucaauucauuuucugaccggcuacuccagggacuggcaauuaggggccgcucaucucucucgucgacucgcauauuaaagagcuacugaaacgcaaagagaauuugggagggguuuccucccccucccaaccuucuaauaauguuagcuuaauuagggagguucaaugauaaagggacaguuugugaugauuugagcagacugugguggaaaggagagagugagcuaacagggaggaagguguggggugagauuugggaguguccucucugggcacuuggugguggaucaggacaaagggcccuggacaccccagcaaaguucugcuucuuuccaucucuugggucuuuugucuuucccuuuccucucucucucuuucccucccucuuucccucuuuccuuuccucccuuccuuccuucuuuucuucuucccuucuuuccuuccuccuuuccucucuuccucucuccauuucccucucuccccucccugucuucucuacccucuuuuuuaugguugagcuuuggaauuuguguucucgauuuguccccuaaaugauguaugacccaguuucuccaucuuuccucccuuacccugaguggaacugcccacuccuagaaucccucagcagguguagccugugaacucaccuuuucuccagacuggguaguugguguuguucauuccacagacacaccacaaccggauccuuuguagcagcagagggagcaguuucgcugucuccccccccccccccaaugcuuuguuuucuaccugucuccuucuuccucccgcugccucugguaaccacugaucucccacugggguguggcacaguuggaaucauggagucuccccagaaaggcuuugagcucaguccaauguuuuccuagcuucugcuucuguuuggccgagcccaggaagcccccgacccucauccaccacccagcuggccauugccuuuggauggacucacucucggaggggaugcaucgcuaaggggcaggggcacagcugguccugguuagaaaaaugggucagugagcaacugaugggucuaagaggaucccagggcaaaacuaaacgugggagcgacucagcuggcaucagcuggguuucagacuuuuccagacuaggagcugucuaguguguucacucaccucucuagggagugcagugcaguccauuuuacaggaacugcccucagaggucaggcagcugcuugaaacucacagaagcaaagaaggcccugcuggucuguugucuuggucugcuguugcgcucaccucguccagcaagaaaaaaacgcaacauggucgaauucuucucaacagccuuuuuuauuucaggaacaccuugauacuauguggaccccggaaacccagggaggacugcuuauauacaccccagcacug

SEQ ID NO: 1241 - RNA, 76879 nt, Mus musculus
guuuccguuaaguuguaggaguuuauuuuaaauaaccuacaguugauuaaaagggaauucaugauaaaaauagaagauacuugaggaaagaugugggaauggacucugcacacacacuaacuaacaaugccucuaaaacuaaugauuauagcaaaaaaaaagucuucacauuaaaauuuuccuuuuuauguuuuuuuuuccauuuuuuacacaauuacaaaagaaaaaauaaaagcccuaaaaucuugauuauuuuuccuuuuuuguuuuguuuugguuuuuguuuuucuuggaccaaaugcucauuuuccucuaaauuuauugaccuguggaaguuuuuauacaauaacaucuuucaaaugaaagacugggguuuccaaagaaaaagauggaucucuuaaaggguacaaagaauggucagaacaaaggaugaugggaaaaugguuucagucacugauuauuacauuauccuuagacucacucgcccuucaucccuccccaaccccaagcuacacgaucuuuaagaucaagaagaaggcuuaaauauuuuaaaauaauuaaaacgaaauaaaaauucacauuuaaaaaggaacacucaagucaggaaauauuuucccaucaugcuuuucugugaauaggugucugaaccaaaacacugccaaugucacaacugcuucaaguuuaaugaaaacugauucccaugacgauagaaugacagcuguaauaggugcgcuggguuuuuguuuuguucuacuuaauuuuaaauuccugaaauaggggagaggagggaguuuaggaauuuguuucuauuaaaauauagaaguuauugcaaaacccuaacuguaaaaacgcaccaauauaaucagacuucacauacaguagcugagagaauccaaacauugcagcaaaacugaauuugccuggcaggaugcugacaaauucccauccacuugcucucuugaaaguaaaaacaaaauucaaaacaaaucauacagcuagaauuuugauaucugaaauauuuuuaaauaaguuguccauaggacaacuggcucagcucucccuuauaguaucuccaggucuaucuuuuugcaaagauguugguuuguuaagacuuguggccucucccucgggugugagggcaagugaggcucaguuuauccaucuuccccaaaccacacuguuccuuuucacagaaccccugccgagacuggucaaaacucguaguccucaucagucauaucaauggcccaagcaaacuucucccucuggguuuuguuguaaaucuucucaauugggaccccccacuuuuugcaccuguaaaaaaaaaaaaagaaagaaagaaagaaagaaaaaagaaacgaauaaauauggagacaacaaaggagauuagucuagcucaaugauaacccauagcagggguccagagcuuucuggugcacaaaaauauucaaaggacuuuauuuuaucagcucauucuuuaucucagagaucucgaaagcaggcaugggcuacuauacuaaugugcccauggggcaccuaggauauuccauguaccucagcaaccagagcuguaggcucuccuggaagaaauguaaacuuagacacggcaugaaggagcuggcaauauccaagagacuuucugccuuuccuuaaccaaaagcaggaaaucuacacaggccuaagacuuaccaagccacugugauccuaggguccagauaauugaguuuggagguccccaaggcaauuuguuuguucuccucucgaucuguggcuugaacuuccagcuucaucaacugcucuucuagucucuguacagccuucuuuuuugacucuacuacccuggaagaauggcagaaucauacauuaagacugaccucuggacaagaacaaacaaguauccuauauacugcuuaaaggagaaaaucauggaaaauuuccucaagaaguauuugaaaacagcugagaauggugguuuauccuaggaagccaaggcuacauaaugagaccaugugagcuggaacacucaggccucugagugauggugccaacuguucucccuuauccaacccuugguacagugucagguacauacuucuuggucuuugcauccuucaugacuuuggcaucagccuuagcacuuuucaggucccuucgagcaucugcuaacugaucuuucuuggcaucaaucuagauagacagagaaaaacggcagugcaguuaggaauaaaaugaccuggagagggaaagaagcuucaucugagaacguaaaacugggagcuguagugcuuccuaguacaaaaaggcuuuaugaaaaugguggacagugacugcagaaaacaauccagcugcugucugcugcucauuuacguucuucggugaacaauauaagguucuguagaguaaccuggaaaucugguuguacucuuucaggaaaacacacuagcuuuagaaaacagaggaggacccagaugacagcuauuuucaaauuaauccuaugccagacuuuagcauucuuuuguuuguuuaugaguuaguuaguucguuagaaagagacuggagccgguggugcacaccuuuaaucccagcacuugggaggcagaggcaggcagauuucugaguuugaggccagccugguauacagaguugaguuccaggacagccagggcuauacagagaaacccuguuucaaaaaaaaaaaaaaaaaaaaaaaaaaaaaaaggaaggaaggaagagacuagaacucacucuguagacuaagcuggccuuaaacucagugaucagugaucuuccuguccuugacuuucaaaugcugggauuauaggcgugggccaccacucugggccuuuagcauuccuucugagacuaccagaggagauacacacaucuacuaagcaagccugccaaaucugggaaagaauugccagcuuugggaaaggauauacuaaagaggauaucacaggaaauuauaaacuggcaaguagacaucaaugaggaauugcuucaacuuggcuuacuauuuuagaaaguaaaggagucuaaagugagaagaaaauuagucaucauucaauaagcaucaauugaaguuuucccuccacagaggaaaucuuauggaauccauaucuacaaggaagagacagaauaauuccaucauucuuuccugcuuguugaacccacaaaaccuaaauucugcuuuggguguugcuuagaaacagcaauaugaugauauuguagcuaaugcuggugaguuugugcugcuggauucuaaagaauccuauccccauaaucacccugcugaccuaugaggucaagagaauaucccagagugaauacauguugacuuacacacauuggguuguuguugacugagccuaaaauuuguuagaaaaacaccacacccauugccacccucuacccuuccggggguggggguaggggacccacauaaaaugcagcccaagauuagaaacaauucaccauugugagagaaucauuaaauguuuacuguuaguggcuuccuuccacuaucuauguuguacuagaacugacuuugcacacaaaagcauuggagccacaacuaggcagaggcuucuuagacuagaaacacagcaaaucacagucguaaccauuucugugaaugcuaaacuggcaagcuaugucaaauucucucaaagacuccauugacugacuaggcaacugggcguguguuuacuuugugggcacacuggagaagguuccuacacuuggagggcuucuuuggcagacagcccgagcugcucaaacagugguuucaaaugagagcaacaaaugaccuccucauucuccaggaagggucuccugaacuguguaaauagcaccugguacucauacuuuauuuauucugggcuuggaaugacaacacaugaggaaaguaagcagcaucagaggaucuccaucuaacagggcaaagcaaaggcucaugcucaaaaggcagucugugggguucuuagcuugcugaccgucguccuuugcugaccuuaggugcagauuugagauucacucccuguggaucuggagauccuuucaggccagggguaucagaaucucuagguuguagcuuuagauuaauauacauuaugccuguguucucaucuugcagaaaucucaauaggggaauauucuaagccugaaaauauguguuaaguuucauugcaaagcaguuucuaaaaguaaauuguccaaguauagaauucuauaaauuuggauuaaaaaaaaaaugcaucuguacuuuggcuacucucuaguugacauuauuuccucuuuaacugugagcaagaauccaaagaaauaacuugucuugugacuauugccaacagauggugaauacuuuccuguuaugcauugcaguguugcagaacucuggaaaugucacuuuuauuaucauugucuuaaacuuuauaauuguuaggaucaccucaagaucuuaaaugaggauacuuauuccuaagccacagacuguguguauuaaauguuuuccauuguaacccugugugucuguuuuaacauguucacuguggauuuaaaugcauaguuaagcagccagugccgagagagaaacaacaacuuguucucguaucagucucucccaauagggcacaaccugacacagucauaucugacacaccucaaccgauguaaauaguuguucuaggauuaggagcgaauuaaaugccauugcuucaccaucuuuuaaacuucaaacaauguaacaggauuccucucccuuccccugcuucugcuuuggggaucaagcccagggcuucacauaugguagacaagcaaagguggguucugccacugagguguaucuuucugucauguuucuuagccagaucaccgagacuuuauuuuugucaugcuagggauggagcccagagcaugcugcacacaaggcaagcauucuaccacgaagauuuccauuuucccuaaguauaacaaggacaacaacuagcaauucagugguaugucaaaguuagcacuucaaaacagaaaguggcucauagagaacuugugucuccagcacaaauauuuuaggaaaaaaaaacaaugauacuaucaaauuauuuccauuuguugaaaaaaaaucuuucuaaaccgacccagauuagccugcuguuaucccaggccauacuaugucagauuccagaagccucugcuugucagaagacaucagacauggacucccuuugcuacccuaccuuuggacccaccauaccuuagacugcaaguucaucauugacuucucaaaggucuuugguggcgcccucuggugguuacaaagaauugcaacagcucgauuggcacgguuauaagauagaaucuucgcugguacauucucaucagcuacaaagaaauauaauaguaacugggucaguuuguauaccaagaauauacacaugaaaugcauucuagauguuuuuacaaaccuucaguuuaucauaaccaaguuucaaggucaacauuugagucaaaggcaguaaauuucuacauaaaccugaaugaguuucugucacaggaggaauucugagccucucuuuuauauuuuucuuuacccuuacuggauuuuguguccaggucucauuaugaaguccagguggucucuaaacugcuaaguuccugaauagcuauaacuacugcccagcuugucuacauuacagggaaaucuauauuuuugguuuuguuucuuaaaaacuucaagaguugggccuggagagauggcucagcuguuaagagcacugacugcuuuccagaugguugugagugcaauucccagcaaccacacagugguucauagucaucuguaauggaauccaauauccucuucugguaugucugaagacagugacaguguacucacauaaaacaaguaaaucuuuaaacaaacaaacaaaccaaaacaaaaaacaaaaacccaaagcccccagaccuuuauacugcuuuucuuauucccugucucccacuuacuaggcagauguagcaaaugcugcagcugugcuagaagaaaugacuacaggagaaugagaugaagggauccuaagcuauacugcaggggcugcagagaaggcucagugguuaaaaaauacuugcugcucaugcagagaaccuggguuugguuucaucuauuacucuaguucuagggaucugacuuucuuucuuuuuuguggagggguaggaguggggaugggguguucuuuuaagacaggguccuugaacuugcucuauagaccaggcuagcuucaaacucaagagauuuguuugccucugcuuccaagugcugggcugccaccaacacauccaggcuuuuuagccacuguuuaaaccaauccuaauuacugaucuccagcauaccaucucuggcucgucuaagagcauuugauacauuuauagaaggcaguggaaauucaaguggcaggagcagaaggguugccuacagccucagcuguggguaggcugaagcagaagguucacuagcuuggaucacaugaugaaugugcccagccuuuagcuacagugugagaguuuguuuuaaauggagaggaaaagaaguucuaaggucccagagguaauuauuacauacuauuaugaagaccaaaaagaaaaaaagaaaaagauuuacuacuacauuuuucugguaaccaugacaacucuauucuccccaauuuaacaccacugccuauacccucugagcuuguaaguaacacagauaaaacauaaaaauuuuuagaccagaugcaaagcucuuguuaguauucuaugagauuaaucuagaguuugcagcagcagugggaagaaaggccuugguuuugcuuagacagcaaagccucuucaagagguuggcgggaaagaaugaagagaaggaaacuggcaccaucccaaggacaaccauacagaguauuacuuacgggcugugagcucuuuaagcugcugcuguagugugauggaggcauuguagguacggaacaccuuggcagucaagcccuccaugagauccugaagauguuuauuuagaauaccagucugcauuaaacacgacaacaaagaggauauuggaacugagguaaacaccaaaucacccuuucccuuacagugaauacuaggaguccuugugccagugcugccaccauccugccaguuacuguccuguccuucacagaggaaguuagcaaagagggaaaauaauuccagaauacaggaaggauugcauagugccuuucuauaaaguacuuuaaucuuaaguucaagacaacaaauuuuuucuuucuuauaaauaucucucccaguaaagaaagcaagugaaagccuuaggucuguagcaaaggcagcugggcgucucaugaaagcaugaaaggaugaaaggaagagggaagauccauggaaagcucagcucccucugccuugcagcuuugguaggaauccacagcaccacccacagggugggaggagggagggucugcugcugguuacagaugacugagugccccaagggaggagggauauguagaaugucacuggacaaucuagacugaauggacaguccaaauacccuuugacaacucuugaccccaggagcuugagauugccuuggacuuuagccuaguguccuguguuuacucacauuaagucgaucaaaaagaucguccucaggcugcuuguucuccauaaacaguuguaaguuuuuaaaaaccuaaaacaaguccaauuauuauuuuaaaauuuuuuagaaauaauuucaaacucacaauaacuuucaaaaaagagaaaagguagaaagacaaccuauauauauuauacccaaauucuuguucugcauguguaaauuuacauaaauaccuaaguaucaguucucagccauuugugguauauauuguaacucaaauaggauguuuguuagcaucaaacauccuggcaucuacuuccuaagaacaaaaacacucccuuauagccaaccuaugcuuacccuaguuacucgauugaacuggcacccacuguuaucgaaugggcgaaaguaguagguaccuaugucuaucucaugggucuacagagaugagcucagagacugagaacugaaagauuaccauuuuauucaguuggggcuuggacuggggcuaagaaaaaccacaagauaacaagugaucagcagaugcugugaugcuuaaaucacuaaagcggcuguguucaaucuuaacauugaguuugcuauaaaggcuaacucucugcagacucuguuauaaacugcuuccagagauggccacagguucccagcaauguagcagagguugcagggcaggcaugaaaugaggcacaccauauaccaaauauuaucucuuuucuuucuuugagaucaauuuuacuagagcucaucaaaaugcagaacaugcaaaagcccucaaaaaauauuugcugaauaaacaaacauguaaaaagagcaagcuagagaaagaagcacaggccacaugaacuuacucguuucucaacugggacuuuguuauaguaucugauugaguccuucccaggaaagucaaauuccaccacauacuccugaccauccaauucuggguguaaauugauguguuccacucuaagugaacagcagcccacagugucugccgucucuccuucuuccuucucauugccugcucucagagcaagcugugcaagaaagggaacagaguuguucagaaagagaugagugaagaaacauagaccacauauaaucucaaugacacucuaaaccagaagcccccaauuuuguagauggaaugaacaucagucuacauaacuuagaaacucaacucauaagaaagucacagggcuagagagauggcucagcuguuaagagcccagcaaccacaugguaacuugcaaccaucuguaauaagaucugacauccucuucaggucugaagacagcuacaguguacuuaaauauaguaacaaauaaaagaguaagagagagagagagagagagagagagacagagagagaaagggagagaaggaggaggaggaggaggaggagggagggagggagagagggagguaagaagggaaggagggaaggaagguagguagguagguagguagguagguaggucagucacagaauacccagagacccaaguuucucuacuccauccuuagaguagagauagaagaagaaaaaaauuaaaacaaggcaacaaaugagaccauauuuucaugagaacagucagauuaaaaacuuaucaauuuugugugaauucagaauuugggcuaaaauuuaaguguaaaaugaagaaaaaaaucugagcacuaaaaaaacuaucuuucaaacugcaauuaucauaaaucacacuuuuuuaagaauuguauagguuauaauugucauuuucuaaaagaaugaaaugagaaauaaccaccagaauucaaugcuacuaguuaaccagugguuugugcaacuuucgauuuaauuucacauaaauaaaacuguuauguuggauuuugacauaaaguaaguacuuuugcagauuauggucaaaaaucuugagcaucacaguuauuaaaaaaacaaacagccgggcagugguggcacacgccuuuaaucccagcacuugggaggcagaggcaggaagauuucugaguuugagcccagccucgucuacaaagugaguuccaggacagccagggcuacacagagaaaccuugucucgaaaaaccaaaaacaagcaaacaaacaaacuaacuaauaauguucaguuuaugcagauccucuuguuauagagacugcucaauagccaacauacuguacaugccucuuucuuuguauccacaucuacucuuccuacuuaaguaaauuuggauuauaagucacacagcagauauacauuccugaucccuauacuguagacauucccuauaccuguaaacagaacuguccaauguggauaaaggaacauguccccaccuuaucaaugaaguacagugcuacagcucucugacgaacuuucaucucuuuggacuuccagucuucccgauacugauuucggaucuuguccacacacuucuucagacgccgcgcagucucauacuucugccagucuuucucacccugcaguggagcaacacauugaauauuuagagcucugaaccccaaaacaggaaccugauuuuaaccaaagcuggaaaagcauagaacugaagagaaagucuggggcauguaacaugacaagaauacuugcuauucuacugacuccguccuguauaauugcuaagaaagcuuuccuaucuaaaaaaugguucccacucuugugagauccaccaagcaugcccccaaacugacuucugucaacauaaaggauguaagcaucuccauugcuucagaagcaccacagccuugcuguggaaugcaugcuccaguucucugcuagcacugaauuccauuaaauucaagacagccauagcgguuucagggaccuaucaaagaaacagaacccaagacaacaacauguaauuaccaaggaagacaaaagcuuccaugaauaggcguaauuauucaccauuuucucacuucugcauuuaaaauggucucugauuugacugagaaaaaaaauguuucugggaacaccuuccuucuuucuuugguuuuucaagacaggguuucucuauauagcccuaacuguccuagagcuagcuccauagauuuagcuuccuugaacucagagaucugcuggccucugccuccaaauguuaggauuaaagguguacaccaaccacgacuaccuggcuucuuuaaaaacauaacaaaagagcuuuuggcauaaaguuugagaucugauccuaaagcccaugaaaaugucacacgugcuugguaauauaaaccuaucugagaaccuauagcuggggaacucacaggucugauggguuaagaaaagcacugaugagacuuugcuaaauggacauggcaccaggcugcuuucuaaacacauaucuguacacccccagacuugguccucaucagaagaguugugcaauggauuugguuaauaccagggcugcgacuggucaaauuacagagaacagaaugucugugaaauauucaggcaugaauugaaccccuacaucacacacucugaccucaaaauucaggaagcaucggaaaaggugauggaaagacuuaaagagguacaaacuugacuggggccaaggugucuucuaaacaugguagggccacacugcacucaggaacugcucugguugcuugcacaguaucaacauuccaucaugaaauggggagggauacauaaaccccaacuccuagcugaggagcuauugacauuugauagcugcuaguguguauuuguaguggucucuuuugaggugugauaccugguagcuuucccacaccccauuggacagccccuauguaugcauauauggacaccacuauuucaacugagucacaguugagagaaugauguguguagggaaucugguaguaguugggaaguguggaguuguacauuauguaaaauauauaaauacuaaauaaaaaauauuauaaaaaaaauaaagacugauauuaaacaacaaaagauuucuguuaccacccugaguagaaaaggacuugaaagcaaggaucaauaaugucaagugagaaagaucaggaaaauuccacaaggcagaauuuuacaaggugaaaauccccuaagaaucugggguuagagauggcuuaucaauugagagcccaugcugcucucuuccagaagacuugugcucaauacgcauaucagaggugaccugugacuccagcuccagaggaaucuaaugccucccacacugcaggacucaaacgcacaugccccuacacagacaugagauuuaaagauccuacaacaaagaggagaugguagugauuucuuuuuguauauuguuuuccaccuaagacaaaaggaccuaacccauaggaccacaugaaagcaugggggugcauggaauaaaaaggcuuacuuccagaucuuaacaaaugcucagaaaguaaugcuuuuuuggaugugcuagggagucgucaacauuuccucacaacugaguguguacuauuuguaugggcuuguuuggcuuuuaaacaagggguucaauaacuuucaggaagcugaaaauuucucucugauuucucuaaguccaacuugacauuaagagaauaaauuagaaaauguacaauacaagcuauccuccugguacaaagcuacaaagcaagguguaccucuaccacaauuucuuacauaaaccaccaccaagacaccugagagacucacuaaaauacacuaucuagccaggaguggacucuuuucaccacuacaaaacacauaagcauugguuguggucaggcagacaaaguuugagaaagucaaguaaguaauuuauagaagaaaccacuaaagaguguuuccuugacaugauuggccuccuggaacaaaucaaaguuuucucuagaacacuaggaugaggaucaagaagaggagacauccugugaagggcuagcaggcaagggcuaguucccaaauacgcuuauccugguggcuuacagcgcugcugaucagaaccuauaaaaugauaauagacucaaaacccuuuaggacugcuucuaaaaaauacccaccuaggucuuccagggagucacaucaaagccaucauaaaaaguaccuuccugacacuggcagaaaugugcucccucaaauucuauuacuacaucagcacauuacuaguauggaguagaaaaucaguuugguaaaacaaagguagauauuguaggagucucugacuccuuuuccucuuucccuaguuggcaacuucuccauaauggagaaaaaacuaguuagugauaguuauaaaccaguggccaccauacuucuuuuaaauguagauacuuauccacucaauaauauaggcagaacaggaagugagucauuugcuuuuaacucuucacaggaccuguacugaggaagaugccauuugcuaauauacuuugaguuugugaguaagacaaacucaagcugguugcucagaggcuuguaccugaaauagggucucucacuggcccagaacucaccacuuaggucagacuguuggacaagccaggcccagggaucccuucccaucuccccagugcuggaguuaccagcaaguguuaccaugcccagcuuuuaaaaaauaauuugaauugccacauauuuuaucuuuacuuuugaaauguucauacauuuauauaauaaaaugauaucuaucauccauuucuccucaagucccccaugccccccuacuacuucaaguuuuugguuuuaugaacaguuagugccacccauaaauccuccauguguauauuugcaugguaacacuugauggaacaugugaaaucucucagaaucuagggaaaaaaaaaaaaacaaggccucccuaguagcccuggcuagcuuggaacuugcuacaaaaaccaggauagccuuagacucaaagcgacacacacacucucucuuucuuucuuucuuucuuucuuucuuucuuucuuucuuucuuucuuucuuucuuucuuucuuucugagacagguuucucuguauagcucuggcuguccuggaacucacuuuguagacgaggcuggccucgaacucagaaaucugccugccucugccucccaagugcugggauuaaaggcgugugccaccaugcccagcucaaagcgacucuucugccuuccaaguauuagguuaaauaaaggcuaugccacuagaguauuuuuuuuuuaagauuuauuuauuuauuuauuauauguaaguacacuguagcugucuucagaucucauuacaggugguugugagccaccaugugauuggugggauuugaacucaggaacucuggaagagcagucagugcucuuaaccucugggccaucucaccaaccccccuucaagaguaguuuuuuuaauuaacugauuugaguauauuggacaaagugcuaagaucugacaauggcagacaagacauucuuacauauuugaauuauuucauuaaaagaaaacucagaccuagaaaaauuguucagagacuaagugcacucucugcccuuaaaaaggaaguacauuugguuccuagcacccaugaagagcuugccacugucccuaacuaccucugguucuggggaucugauaccuuuuauuggacucugcaaacacaagggacauaaaacaguaugcaugcauuaugcaggcaaaauacucacacauaaaaauaaagaagccuauaaaacaacaacagcaacaacaaccccaugcccccucccaccaaaaaauccuaaagcuugaaccuaugucuuuauuuaagaauggaauaauucucugguagcaguacacuauucauggugcuaucauauucuucccucugaagccacugcuauucugcuagaugaaggagccuaugacaagacugagagcaacugcaagaagccacaggcacugccuccucaccccugguugccagcaguuccaccuuuccagaccugugaugacuacucuuggaaucucaucccaguuguaucaagucaagcauucuaucauggggugauuuucaaguuuacggucaaaaccaucuugaagaaaccuagaaaaauccuuacuaugcaguuaucugguuauuacugccuagacuaagcaccucuguccuuggggugcugcucuggcuugccuagcagguaucuaucucacucuugugagaacuacaguuuccugugauuuugccuauaggaggacacaacagccacauacuugaaaucuacuccuuuuccuccacucucacugcuaucaccugccuugaucacuacaguuucuugccugaagaagagcuaucuagaggccuccuaacuuccuguuuguguucaauacauacaggcuacauacaccaaguaguagucaaaacuaucaauuaugucaccacuccaguccuauuuucuucuuuacgucugucuaggucgguagcuuccuuuuagacucauuuaaaaaguuggaacugaaguccuggccugucugcuucugcggggccuucuucauuucucuuacugcucaaagcacucuguucuccaaacacgugagcucuuucucauggcagaaacuugaaaaguucucauucccucuuugaaaugcuaauucccuuuguuuuucuuuccaguggcaaaugagauuccuauucaucucacaaauacaaccuuaaauauuaucuuuguggaaaagccuuuccugaaacugagcuaagauugagcacugagguaugcucuuaaaugguaugcagcauuucucguaguuuauauuuauugguguaauaacuugcuaaucuugcugaaauugguaacccauguuuaagagagccuucauucaaaguccuuaaaggguucucuucccggaacagaagaccgucuucuugggcauguuauuuaagacuggccacaauuugacaccaggaugucaugggaaagcaugagauuggagaucuaaauuacauucuaagaagacugagaagaguugccagcuaucagauguaggacuuuuuuuuuaauucccacagacuaaauuuauuugugaauauaugccuguaauaguuauuaaaugucaacuuacaugaaaagcuuuuuaacacuaaaauaauacucaucacagacugacaauauacugacuguggugaauauauauauauagaauguaccauuaaugugacauuuaguauauuaauaauauuauauauagaaccacuacuacuugguaguugugguauaugugguacaugcacauuacagggugugguauguauguaugcauguaugcauguauguauguauguaugcauguaggcauacaacucuguaagcaugaggagauucucuaccucauacuguuguauguaugggcgcuaggaauaucaaacaccggcaaucacgaaaaauagccaguacacuuagccacugaguuaucucguuagccccuccaccugauuaagaaacugaagaccacaaucagccaggagcuccuagcuucugacaguucccaacacugaagucugcauggcuauguguagcuuuaugugggugcuggagaggugaacucaggucuuuuuuacaaaaaggauucuuauccauugagcuuccuccccagcccuacuugacacugugugguacuugucacaucccuguagaccaacuuaccuuccucuuuuguccauaagcaccugggucuauuuagaagaccucuuuaaagagcucauuuuaaucuaauuuccuuuaaaaaguccauucugauguuaagaauaacuacucuuauguacaagaacgacuaccuuucuucuaacacaacuggauccuuacacaauuugcccacccauaaagaaaaaaaaaaaaaaacaugguuucuuuacccacuucuguaguucuguaaacuaucucauggaagaaaggaauaaaggagucucaguucucccuucugauuauuuucuuauucugaaacagauacuauuuuccaauuuauuugaagaaaguauccagaugguauuuuucauuaagaagguagagacacaugucagaacacaggauauaagcuagaaagcauguaaauuuacauagcauuuucaucugugacucuuggaucuuaacagaagcuaaauccuuaggaacaaggguuucuuuagcuuuagacucuucaauggaaaacaguucuauaggcuacacagagccaauuuucuuggcuguuuuuuugugaacccaaugucucuuuuauuuguaguucauauauccauaaagucugauggaaggagcuuauaaaaugcuaaagaacacagaguuuauagcuaccuggcuaacaagaucagagacagucccucucaguaaaucuaacaauugaaaacaauugaguauguauacauggugggcuagcaauauuucaaucacaaccuaaaggaaccuacucagaugagacaaaguauguuuuaucagaaaacauaaaguauauaaagcucuagguccuauaguugucucuauauuuagagaaaaauaguaucuacauuucucacauaagccuacuagccacuucaucacauccugaccaccagacaguagcaccugcacaaccauuauuaccacaugcauucacucagaacauaaugggauuucagagaauguccacagcuaagauuacuauaggacacaaauguaaaacaucuuuaauaagaguuuacuagguaaugcuaacuaaccaugaagccagggagaggguagguuuuuaauuuguugaaaugaguaucauuuguuaaaaugagucuagaaagcacauuacaauacaaccaaaagagaaugagauuacuauauuagcuccaccaauggauguggccuagauuuaugcuuaccuugauucgugaacugggauucagcaugauauauuugauagaaccuuggauauucucuguccaggagaccagccaaguaaccuuguuaucaugucggacuuccuuccauuuauguccaggagggggagaaggaaccuuugcgucucuaugaacauaaccauucagaaagaaaaugaaaugaaaagugacaaaccauguccccucucauccugcccucaauccugaacaaacuugggagaccugcccaugcaagcgcugcaccgcucucauaacacuaggaauagucccaauaaccagccuugaggaaauagcccugcacccacuucucccccuaaagaguuuugugcucacuugcuacaguugaugaugauguccucaggcaugauccuucucuucagcauacccaucuuggggugguucccucggccucggaaaagccccggaggcucuaucuugaaguuggcaauccgcucucuaugauuauccauuacacaaaagccguauucuuucaauaacuuuucauuuucuucuuugauuuucuaaaauagaccaaggaaguauacaaaauggauucaaacuccuacaugcuaagaauuacauauuuuuaucucuugcagaagaaagaucaagguaaaguuuaaaaucacucagaaacaaacuaaaauauaggaaaaugucuaguguauuuuaaacguacauauauuauuacagauauauaaaauaaacugccaaaagaucuaucaagaauaacugacuuuacacaaauaagauucucaacuuuugucuuuuguaguauuacagaacugugucuaccagugaacuagugcuucaacacuuaaucuucauuacaaaggguauagacuuauaaaugucauuuauuuucaguguagcuuaguuuaaguaucuggucucauguaccccagaugucuucaaacucucuauguaacugagaaugacagugaauuucugaucccccgcuucccaagggcugacacucuaagcauguaccaucacuacacaugguuuuaugcagugcugagaagcaaaaucaugguuccacacacauuaggaaagcccuguaccaacugagcccuuccuagguauuuuuaaaugugagccuuagaaagaggagagguaaaugcuggguaguaaagaaggauugaaugcaaaacacagacucacaaaaggguauaaagcaauuuuuuucccuuuuaguuucaacacugucauggauuuuguuuugguuuauuuugugguaggggauaaguccauaaaacaugcauuugauggugaaaguguaaaauuuaaugcacacuuucagaaucacuuuuuuucagugauuuggaaaacuacagauaaaaugaacuuaaagaagucuaaugcaauauuuuguuuguuuuguggagacaucauaguucuugcucaagucuagaugcugagauuacaggcaugugccaacacagauagcugccaguuagcacaacacauacauguaauuauacuuuacuaaguaaaucuuuaacacagaaaaauauaaaaguaaugaauucacuguugugucacaagaagcaaaaaauuauacaaagaaucacuauccaagauuuucuaguuuagcagacgaucauaccaauuuuucuuccuugcucaucuguuuccgagcuucugacugcgcuuugaaauacuggcucaucuguguaaagucgcauuugcuuagguugguaaucguauuuuuuucgucauuagucauuuccuaauugaguaaaaagguuaagaaaauuaaauauauuaauaagucuuccugucucuucaaaauucauccuuuuuccccuuuaaucaaaggugucuagaagggaagccaaccucaauaaccauugcuucuggggaguggugcugcucuguuauaagaugauuaguuucauauaaaauaucacuagucauuuaucaaagaaaauuacucauuuuuuagcgaucuuugacaaaaacacaaacucaaacauauaaacaccaauccaagagaccuauauuaaucaauuacuuuagcaauaaagagaaauacuuucuuauucccaugcacacuaaucugcucuuauuaaauuuagaaugcccuuggauggugaauuuuaauucaaccucuuuucaaaauuauccaaauugaaaacaaugguacuuuuuuauaucaauacagaauagauggucagacugacccuguguaaaggcaucagaggacagucccugcagaaacaaugcuuccuuugcucaacuggauuugagguuuucuguuuaaccuaaucugauaagcuccuuccugcagucacaugaaagcugagaagggauauauucuuguugaacaaaaaccacauuaaaauaguaagggaaaaaagauauacauuaaacuauacuuugcauuuuuuaaacaaacaagacauuaacaaaugagcuauaccucuaagucagcacuuuuauaaaugauuaagauaugaacacaugggccacaauaccuuucuccaaucuuuaaagaaauuuuuccugaauauuuccuuaguaguauauucguggucaagcauuuuugcaaagaauguagcuacuucuucugcuuuaggacucagcuucauaacuuuaccugaaggaagaaaaugguuccaaacagugaggcacacuauucauauucuaugugcacugaacacuggagaggucaugacugauggcucaccuuuccaagguguacaaaggucugcugacacacagugauaacaacaacagaguaacauacugucagagaucuacuuaaaaauuucuccuucucuuuaguagauauuuaccugggucuuuuuuuggagacuaugccaguuaauuguucccaggugccugcucaggacagggaugaccuggggaaggcccagccacucuuccuuuuccuuucagcaagcaggguccuuuacaccucuucaaugguuuuuaaaaaucaaauccucagaaggacuccugccacugcuaagcuaagcagccucuguucaagaaggggaggaaaggauaggggcagggaguggaagaaaggaauuguggggaaaagaaauaggcaucuuucuucuucaaaguuacguggguggaauaugaauaagaauauauauucauagcaggcaagcccagauuucccacauaaaaagcguaaauaagaccuuccucuagaaccuugcuacucaaguaguucacagaccaaaaccaucacaagcaaguuuguuauaaauaccaaguuuugggccucaguccuauaccuagaaucaaaaacugcacuguaugucuaugugugggguuguauguguacaacaguacccauggaaggucagagccuuaggugucaguccuugccuuccaucuuauuuugagauaaggucucuuuguucacugcuauauauauauauagaggcuagcuggcacggacucauccauucucgucuccacuuccccucucaccacagggacacgcuacaauugcagacaagugugcuacuuugaugugguucuaaaaaaacauccuuaagacaccaggcugguacagcagguacuuuacccacugagccagccucccagccagaaaagcacuuuuggagcacuaguguauucagagugaaauacagguacacaugcaccugaaacacugggaauagcaccaggaacucacuucuuucaggaaagucuaaucauuccacagcaugaggugaggguggguuaggcagcaaguaaguauauguaaagacuguccaaaaaagccugugguucacaaggaaagccacuacaauaguuaauaaauccuggaagugauuuuguguccucagauagaucauaacugacagugaaagaaaaguacuuaaaagcuuaaucuacaaaauauucaaagagaauauugcacuccuagggccaauuucuaucuuuucucaaaaaaaaaaaaaucaacuuuauaauauuauauagaaacaauuuaugccacaauagcauuuugcugcauucuaaaugagauuaauaucucacacuuacaacuauguaaguacuaauaauaauucaaaagaauuaaaauuuauuacagaaaucuaaaacuuaaccagaagccuacucauuguaauaauugagagacaucucaucucauaauggguaguauugcucaaccagacuguaugaaacauagggaauacaucacaaaacaaacuugugcuacagguacauuaucagcuuagaagacauaaccuaaaaggcaaauaggugguguagcucuuccucagcacacucaagauucuguguuggaaaaggauuuuuugaguaagguguuuccuguuuuccccacucagucugaacaagaguugccagcaaaacagcaacaugauucaaauauaauggaggggaauacaaacaaacaaacaaacaaaugggggcaaaaagacaagguagcaguagccuauaauuguagcauucggaaggcugggaaaggaggauugugcauuugaaacuggucucagcuacaaaaucagcaucucaaaacaaaaaauaaaaauagauaaggaaauuuuaaggaauguguucccugguauguuuguuuucauaaacuaaauauuccccaauaguguucuuauuuuggguggggagccuuugcacugcacuggcuuugucccacccacaaagaaccuacuugauuuguuuuaaaugggcuguggaaggauuaaguaacagcuauagcaccggagugguggaggguguguagguucccagcaaucaucguaguacuuugugggaaaaguugagcucccggaaacaaaaagaaacuguugagucagaguugaaauggcagguccuuaacagcggcugcaauucugugcuucagccaacucauguccugugcagaggcggccagggggaaguccagggcaaggcagcaauguccugccuaccaguacuuacuuaucaguuugcacuaguaagucaaacacucuugacuuauuuggaggaguuuuauaaccaaagggaggaaauccuaggaggaccaacagagaaaaggaaacuagagguagggaccacaggccuuaguuuccuugaaaccccacaauaaaaaaaaaaaaaaaaaaaaacuacuuucuaucgucaucaccuuggcuuucacagugaggcuuuuccagcgagcugucuaaaguuagugagcucaggucaggcuacagaauacagcaauugucuuuuucaaggucuuaaggccuuuucucuucacuaggaaguuuaaauuuguguauuuucguaaaucuucaggaaugaucuaguguguagggugucuuacaguuucuggucaaacugguuagcuaaucuaaaaacuugccagucacaccaccaaguguuuuaugccacugacuuccuacauagauuaaaucaguagucucuaucuaucugggacuugggugucugaacacaagcauauucaauaaacauuuccgaaccuuucgaaaauauuaguugaacauccauuucccaaaacaugugauuuuuuuccauuuucauuuuuuucaccccuagauuuuggagaaugacgguauguggggguguguuuguaaaaauaagguaucagguuggguauuauuaguaaucagugaugggaaucuuuaauuccagcacucaggcagagacaagcaggccucugagaucaaagccagcuaagacuacaaaaaugagaccuuaucucaaaaaaaaaaaaaaaaaagagggagggagagagagaaauaaaauaucuuaaggaugagacccaggucaaaauucacuuguuucauauacagauuucaauuauuggaugcuaauaaacccgucucauccuaaacccacaggcaucuaugcuccuaaagccauugcuggcgguuaaagagauacaccaaggggcuggugagauggcucaguggguaagagcacccgacugcucuucugaagguccagaguucaaaucccagcaaccacaugguggcucacaaccaucuguaacaaaaucugacgcccucuucuucuggagugucugaagacagcuacaguauacuuacauauaauaaauaaauaaaucuaaaaaaaaaaaaaaaaaaaaaaaaaagagauacaccaaauagcucugaaugguuuugcuauuuugguguccagugucucucccuguuaguaaauacauuuauuugauucauaaacacccaguccuaccucucaucuauuaaccuggugaauuauaaauacauagagaguuugagaacgaacucuagcaucucuggacagaacucuuagaaugaaggagucaguuggacauuacuaccugauacacagucagucgaaggauugugagaggcuacucucagaucccucaacccaaggacaaaaacacagauguggaacucucagacauuuuagaaaguuccaagagacccaaggaggccagauaagguggcaugugccucaggagcagauggguacaucuacugaauucaaggacagcugaucuauauuaucaaguuacaggccaggcagggcuacacaguuagaaaugucucaaaaaaauaaaauuaagagaccuaggcagagcguuucuuuaaaauucaccugucaaaggcacaguugcacuacuuagagugacauagcuuagguuucuuaccuauaagcugaaugauggccacuaauccuuugcuaauacaauuucuagugauaagcagcauguuggcauacuauauuaucacuaagugcuacuauuuaaaugagaacucaauacagaacagcuuccuauugaguuacacacucaaaauaaaaaccuucaauguguauuuuauaggcugugagccaaacagauaaaccuuuuuagacuacagauaagacauuaacagcccccuuuuucauauuuuucaagcagcaaagggguccuucugaauuaaacaccugagauuccuuuucccaagccacacauagacaauaaaacaaagugaaauaacuagcuaggacugugcaauauaggcagugcccucauuuucuaacccugaauagaaacaaaccauucuuagccaaaauucaaacaaccugaaauaacucaccaucauaguaaaacuugacacucucuggcagaggcucauaugguggagcgaagacaggcccuuuaugcucuaggaauuuccauuugaugccuucuggauaacguucuucuucccaccuuucaaagacaaggcacaagcucauuaagugaucaccuggcuuaguaaaaagauccucaccuauuaaauucaaaauaauuaacuaaucaauuuguggugcccauucaaaggcugugucucacugaaaagagcagcaauuucaagcaaacugaaagaauaugguaauuaaaaaaauuucauuucaacaguuucaauuuagagauacuaaguauuaaaagaccauccaucacucaaaaaacccauauaaaacuauuuauauauaaaauaugccacagugguacaugcaaaagaggcauuacuaaacugauggcacaugcaggugagaguuuagaagaaagcagcccuauuugaaaauucaaagcacaaccagacuggaugccuucaguuccagaguguggaauucugagaccagcagaagguagaguucugggacagccaaggcuacauaguaagaccuggacucaagaaaaccaacaauacaaacgcaagaggacugaggagauucuaauggaggugcacuaaguuuaaggcacuucugaaauacagggaacuaucccguagauacuugacaaaaaucuaaauaaacugcagaauaaauaucuuucuaaaacauuuuauuuuuuaaaaauuaagcauagggggcuggugagauggcucaacagguaagagcacccgacugcucuuccgaagguccugaguucaaaucccagcaaccacaugguggcucacaaccauccguaacgagaucugacucucucuucuggugugucugaaaacagcuacaguguacuuacauauaauaauaaauaauaaauaaaucuuuaaaaaaaguuuaaaaaaauuaagcauauaaaaacaauuaacuguaaauauauacaaagaauuauuaaaauuuauuacauuucuacuuuuacugaucacuucaaaauuaguuuuggaugugaaaguucaauaaauauuauagcaauuaucuuuauaaaacugaucuuguauagaacuauaacaucagauugauuuuuuuugugucacuuuauuuuuuauaaauucaccaaugagauccaguauuuuacaaguacaaaucuacugauuuugggcauuacauauggaugugucucuaacacacccuuuacacugauaaacagaucuuaccaccccucucagaguuguaaaagaauccaucugauacauacagacuacuuuuaaauuucucaaacuuauuacugcuacuucuacacaaaaggaauuuuauggauuccuguuuugguuuggguuuguaguuguugucuuuugagacaggguuucucuguguaguccuggcuguccuggaaauagcucuguagaccaagcuggccuugaacuugaucugccugucuccugagugcugggauaguucugccuuguucugcuguuaauuaauuccaugaauuccaagucccauauuuuaaacauucagaaucacaggguaagagauaaaugaauccguuuaagcuguaacaauacuguuauauaaaauuacugucaacauauauuggcaagucauuuuaaacaggaauuaucaucauguuaugguuagagaugacagaguuucaacacuggaguuugaagagaaugacacuggggcaaguccuuuauacuauauacaaaaauuaacucuauaugaaucaggaauuaaaauucuaauuuauaaaaacuaaagcucauuuggacauuaggagaaaauaagagggaauggcuucaucacacugaauuuggcagugacuuccuggauacaauaaauauaaaaguaacagcaacaaaaccacauaaguuggguuacaucaaaauuuaaaaaacaaaaacaaaaacaaaaaacccuauggaucaaauggaauauucaagaaaaaaagagguaacucauaaugaaaauagcucauaaguuaaaaauccuaaaaaggguugauauaauacacaaagaauuccauauuggacauaaugggauuggcugacaguuccaguaacuugggaggcuaaggaaaaaaagccaggaacccaaggccagccugagcaacagcaguaaggacaaaggaaagcugaguauugguagacguaccucccuguauucuauacaauauucucuccaagauuccaauuuuucuauuucagucccaccaaaacuucuuuuuguugccucuuaauggauguacaguuucucauuacagcuuauuuacaauaagaugacaaaauguaaauauacaucuaaauuacauuguaagaaagaaguauuauuuucuuucuuaaagauuuuauaaagagggaauaagccgggcgugguggcacacccuuaauccagcacucaggaggcagaggcaggcggauuucugaguucgaggccagccuggucuacaaagugaguuccagggcagccagagcucuacagagaaacccugucucgaaaaacaaaaagagggaacaauaaagacuuuguauaaucaacaaccacuuuacagauaaaacguuauuauacuagcugaugucaaaugcccagauagaaacuaccuaaccuucaaauuuacuacucuccaaaucagagaaaaauguuugcaagcaugugaaagcaccuacaagugacucaucuguuuuaauagucauauaguaaccggggagugauucagaauaccauucccuuuauauucuugucaucaacuccauuguuuugaaauuaagauuccaagccauguuucacaauuccuccaaauucaacauguuuuuuuucuucaggacaaauaacaacuuccuuaccauuuaagcaaagauucaaugaaucacuaaacacaaaaccuugaguuuaaacagaccgguacuaccauacaaauaaaacuguaguguuggccuucuaacaguccaacaccagcaccaacuaaagaaggguaggcuuauaaauucaaguuagguagcaguuuuauuuaaaaaaaaacaaaaaaguuuccuuggaaagacaaaaaguuuaacagucuaaaaaugaauagaaaauagcucagaaguuaaaaauccuauaaagaguuaauauaauacacaaagaauuccguauuggacauaaugggauugggauuggcuuacaguuccaguaacuugggaggcuaaggggaaaaaaagccaggaacccaaggccagccugagcaacagcauaggccuacuacuuucucaagucaaggucuccugguguuagcagguaucuuaaaacagacuauauaauuuaugaaaaauaaagauuuguagauaaaaaucuaaaacuagagauuucuggaagcugucuagaaugaagaacagacucugauuuggagaagauaugauaaugcuuguucuuuaagguuucuuaauuauguauguaugcauguauguauugcauaagcauugucauuguuaagacuguuaaguccuggucuuucaacaguaauuccuauacaauauuauuuaucccuagcuucuuuuuuaacauuuuucuuugcccaaagacuugaaacuucaaccuagcauaggugaugaacuggccauucuccaagucuuuugguaaagaauuaucuguuuagaauuauucuuguucuuguuuuugguugucuuaaaagauggauuauuuggggaaaaagaugauguuuguccagaagaggguggagcuauagaggauuaugagaagauaacuaaacauaaguccuuugcaagaguagcagguguucuaguacacuuuaagcuuaugcaugcuuuucuuaaaucugaguaaacuuggcucuaugaggucaguugagagaggaaaaaagacaaauagaccugaaaaccuaugcaaauuggcaguuuuaugaaaaugauuuauagauuaaaaaaaaaagaacccuuuacauagugaauacauuucuaagagcaauaauaaacugacacaggaaaguaugcugguaguucucagcauaaagauagaauguauuaugagauagguagacuuagccugauuuaaacauuacauaaaguauauauacacugauauauuauaauacuacuagguacaauuugaagugauugaaugaaugaaugaaugaaugaaugaauucauuuugaagucccuucuauauauaagcuauauucaauccgauucaaugagaagaaacuaguuuugagauccacuagauuuagagcugguaaauuacuaggaucugaaaacuuaucuguucuucaaaagagucuguaaguacuucuccaucaaaugucaagaaauuaaccuuaauauuucaacucuuguuuaauugggcugcacagugaaagugcugacaucuuaacccagugcugagauguuaccauuuccacuucuguuccucuuccuuuuucggcuucuuuuucuuauuaucuggcucagcaacuuuuuuaucuuuaucuuuauucuugggcuuuuuaaguuuaccauccuacaaaaaaacagaaagcacuuaaaucaggauuguuuacacgccuggaagcuguuuuuggaagccacuaggaagaaaaacuaugaacaagaaguccuggaacuggaaaagaucguauaucuaauuccuccccgaaaucaagggaaaaauuuauugauauuuuacaauugaguaaauacuucccgcagucccucuagcaaacaauuauuuaggaauuucacaagggaaagccuggggaacuaacaguaaucccaggguauuuucuucauuuauuuuaaaguguguucaucuuuaaucucuuuaaauauaacaaaguauagaaaagaaauacaagaaaaauuuaguauuugaucugaaaggagauuucugugauucaguuacuauugcuuauauacacaaaguuaagaguauucucagcugggaacugcucgcaguggcaaaguaaaaaaaaaaaaaaaaacaaaaaaacaaaacacaccagucaagcaugauagugcacaccuguugauucuagcacuaaaggaagcuguagcaggaacugucaugauacauacauaguaaaagcauaccaaaaaaaaaaaaaaaaagucaggcauagugguagcguacaccuuuaauuccaguauuagggagacagaagcagguggaccucuugaguuugaggccaggacagccaggguuaacacagagaaacccuauucccccccuccccccccaaaaaaacccaaaaaaacccaaaaaaccuuuacugcuagguuagggaagagucuguuuacuucagggauugagguccugagaggcuaacuaugcucacaccacacccauguucuaagaaaauacuaagugggcucaguggauuaagacaauaaaugagaggcaaaguuaggagagagguaggacaggaauuggaaggaagggagugaggggaugaaguucgagguugagagcgaaguugagaguauccugucuuugugugucuaaacaguaguaacuuagccacaggaguucaaagacagacugccagauuccaaucuuaaaaacacaaaauaggcuggggauagcauaugccuucaaucuuaguauucaggagacagagacaaagggaucguuugaguuugaggucaaccguggguguguaacucuaaaaacaaaaaaaaaaaaaagcuucaaacccaagaguaagacaaauccaaaacacaucccaacaaaaaugugacucaacagguaaagaggcagacuccagagaaucuacuuucuucugaagaaccuaacuuugaucuacauuuucagcaucacaugaggcuuuacuugguaaguuuuauauagcaaugaaagaugguuuauggaauggaaacuauuugguuucuucucuuccagcaauaaucaagauaguucuaaaaucaguuuccauuugaucaaguuuauauaacugcugcugaacaaaauaaaacccuaaguauauuuucaaaucaaacaaacaaaaaccaacagaauaugaugaaugaaaauggcuagagaauauccugugagucuguaauaagaugguaaucaaaguaguaauaaacuugaaggucuuuaaguauuauuuuaaggaugaaaaaagcaaaugcuaugcuauugcauuuuaaguaacaaugaggaauacaagugugcaaguagaagagcauucaaauacucuguugguggcucgagucuaaaaauaccuauagucaagggggagauaggaggauugccaggagucacagaguaaaacuccuuaucucucugucucugucucucucucucugauguucucuucuaacuucugcaggcaucugagacaaacaugguacaagcgggucucauauacaaaaauuuuaaaaucuuuuuuuuuuaaagauuuauuuauuauuucuaaguacacuguagcugucuucagaugcaccagaagagggagucagaucucaucacggaugguugugagccaccaugugguugcugggauuugaacucaggaccuuuggaagagcagucggugcucuuaaccacugagccaucucuccagccugcauaucaaguucuuaauaaauggcauauuuaguugucacuguguagcccaggcuagacuuugaucucauaauucucccaucucagucuucaaaguacugagauuacaauuuugcagucaccauaacugaucaaauuacuuucucugugccuccugaauacaaggucuuuguagacgcaaacucauguauuccugccucugccuucugagugcugggauuagaggugugugucaccauacucacccugagauaacaaucucaaaagcccaugccccauuaucacuauuaugacugcugguacauuuuaaccuaaccacauuuaagccuauuuuguccacaacauugauuaaccucacagaaugaacauaaaguuaagaacucuacuuaagagccuaaagaauugcugauuuuuuuaaaaaaaauucuugcaaguaaauacaaguaauuaaaaaaauaaagaaaauaacuacauuauucuauuuauaucuaccacaagcaccaaauaggauccuuggaaaaaaguacuugaacuaaaguuaugaaauuauggaagauuauaaaacaguagaagggaauaaauaauguguguuccagacagaagaacaacauguacuacacaccgaaaucugaaguacaaaaucuggugugaaaaacaaacagaggcagccaguauggccagagcaaggugagcucaggagggacaaaaugaagcaaggcacaagaugcaaaggccagacugaggaaagguacuccagugcuuagauuucauccuacaaccaagagggcacugauuaaauuagagcuacauuuauuuaaaaugaggaaagagcaugcuucauuggucaugaaauauuguuaagacagaauuuucagaguuguuccuuaugaacauuuuucugcauaccuacagguggcauacuuuaucaacaucaacgcaggcuaugaauagacucaaggguggcgaguaaucuggauacuucaaaaucuuggcaaacucagcacaaccacaacuuguuugcaaaacauuuccccacucuaacuacuacaacaaaccaaaaauuuucuaaagcucauuuggccucaagaucuauuuuaggacauaagagaugaugaugcagcaguuaaagguaccugcugucaaacuuaacccccguucaauuuccaggagaaucgacuucucaaagcuguccucugacuuccacaugugcaucaugauacccacaauuaaaaauaaucucaugcuuuuuaaggcuauuuuauacaaauaaauguaugccucaaaaacuuuuacuaaccucuuccucuucugauuuucuuuucuucuccuucuugauaucuucugucuuaauuuucuuagguuuauaaucagcacuagaaaggagaacaugaauaugcaguuauugcaacuacaacucaagagaucucaccuauagaauuaggaucucccaacucuuugaaaaguguccauggcaggugacugcuguuauucuugauaggaauucaaugguagugaagacgagauuaaggucuggggagauguucaagcugguaagacuacuggcugcucuugcagagaaccucagcuuaguuaucagcauccacaugggauagcucauagcaaucuauaacuccaguucuaaagaaucugaugaacucuuuaggcuucuguagguaccaggcaugcauaugguauacauauaaauguucaggaucaugacauaauauaaaaagugaaauaaauauaaaagacagacagaaacagacuagaggcuauaaagagcugccuaauauggaugcuggcaaacaaacuugaguucucuagaagaacagcaagcacucuuaacaacuaagcuauagcuguagccauuauuugauuuuuaaauguuauuuaagugcacacacgucugaaugcucauauucauguggaagccaauggacaacuuguacuguccuccuaaagaacauucucaagcuccauugagaccuggcuucucaggagcauggagcucacuaaguaagcuaagcuaaauugccagcaguccuagggagucuccggucucugccuuuccaaguccuagcaugcucuagcacaccugaaauuuguaugugagcucuggaucaaacucagguccucaugcuuguaaaguaaguacuuuaucaacugugcuacagccucagccauuccaucuuaaauccugugacuaucucauagaauagaauaaguauuauauaauuauauaauauaauacucaaaacuaguaaaauggaauacauuaucauuggagguaaauguaagccuuaaauaacaauaucaacuucacuaucucuguacauugaagguucccuuauaucaaaaggcauagauccuagaaggaaaaagaauugaagcagagucucauguagcccaaguuagccucaaauucacucuguagucaaaaaugacugaauuucugaucuucuugccuccacuucccaaauguugguauaugagguuuguaugaguucuaugagguucugggaucaaccccuggcuuuuugugugguagauaagcauucuaccaacugagcuauauaucccuaaccuaauauuucucaauuuacuugugguacaaaacugaaaaacucccaaggaucuaaaauaguuuacccgucacuaauucuauuuugaaauaguuugaaauaucuauaauaaauaugcauuauuuuuuuaguaagaaaaaacacauuacacauaacccauaaauuaauuugcuuagcaaacccacuucucauaaauuaguccauuaaccacaaaugccaauuaauauauuauuauuaauuauagauauacacauauuuauucuuaaaacagauuuucccuucuguuuuguuuuguuuauuuuuucaagacaagguaucucuguguagcccuggcaguccuagacccuguucuauagaucaggcuggccuuaaacuuagagauccccugccucugccucuugaguaauaggauuaaaggcgguggcaucaugccuggcucuggccuuuucuuuuuaaacguuguugaaguaguccgguggugguguugcaugccuuuaaucccagcacuugagaggcagaggcaggcugauuucugaguuccgagggcagccagagcuauacagagaaacccugucucgaaacaaacaaacaaacaaacaacaacaaaaaaccaaacaaacaaaaaauaaauaaaauaaaaauuaugaaguaucucuucuuauaauuuuauaauuuuuuauaaauuuauauauacauauauauauauacacacauguauauauaaacucuuccaaauuaccauacuaaaacuaacagaucuaguucaaugaacauuuauauuuuaaacaggcacucagaaugaaguucuacagcuuuguucaauuuuacauuuucaauacugaauguaguuuaugcccuuaucuaccaccaaauggggaaaaagagggugggggaggaaaaaaagaagauuccacauaaaaacagaaguagaaaaacaauuagcuuuauauccucguuuauaaugcauucaguacuuccucaucuguuucaauuacuuagccuuuccuauucucuuccuucaaaguauugguagaauuccaggagagaaugugaguuuuuuucuuugagauuauaugaccuugcuugcuauuacauauuuuaaauccauccauauuccuauaaaacuauuaauuucauguuucuauagagaugagcagcacauucuacuauccacccacagaucacacguccauuagccauucauuuguugaugaacaagguugauuccaauuuuaccauuguuaaucaggcagcaacaaacauuauuucaaaauugaaauuucuuuauauguuccacuuuaaucaaaauggaagaaauacauacucaucuucaucucgaagccucuucaauggcuuaauauccucuuuuggaggagcaaaauagccaucauccucagguucaucuuuaauucguggcggacuaaagagagaacaaagcagcuaguuaaggauuacuaaauugucagaauuguguuaaauaacauaaaguaggugcccugccuaguuuaauguccaccugagugacacaagcuacaguuauuggaaaggaagggaccucaacugagaaaauaccucccuaaagauacaguuguagggcauuuuaauuagugauugaugugagagaacccaguccauuguguguaggaccaccccugggcugcugguccugagcacugagaaagcagguugagcaagccaugacaggcaagccaguaagcagcaccccuccaugaccucugcgccagcuccuagcuccagguuccugcccugaauuccuucaguaauaaaaggugaugugaaaaaaaaaugcaacugaggauguaaacugguacagucacuaugaaaauccuauagaggucuuccacaacaugacccagcuauacuacuccuagguauaugcccaagagaagcuuugucaguacaccauaaaacauggaucucucuguaaauccauaauaguauaaauccagaaccaguguagaugcuaaucaauagaugaauggauaaagaaaauauggcauauacacaauggaauuuuauucaggcauaaagaauaaaauuguguuauuugcagggaaaaauagaagaaauaacauguuuucuuuauuaugcaaaaaacccucaauuuuuaaaaauguggcaugaaaggagauggagagauggcauaauguuuaggagcacuuacuaaucuuccagaaagcauagacccaaguuccaggggaucuucuuuagugacuaggcacaggcaugguguauagaacuacaugaggcuaaaauagucauauacauuuaaaaaaaaaaucuuuucaugaaaauagaacgggauagguuuauagcaagggagaaaagaaugucacauuuucuuuccuuugcaaaaucucuaucuaucuagagaauuuaugagcagaguacaaugacauuaugaaaccuguacuaacuagaaagaauaaacugggggucuggagagauggcucagcacuuauagagcacuuguuuuugcaaggagcccagauuuauccaacacucaccaggaagcucaccaucaccuauaacuagcuccaggauauccaacacuucauuuuuaccuccauggaaauaggcaagcacagauacauaugagcaaaacauuuacucauacacguaaaauuuaaauaucuaauuuuuucuuuuuuaaauuaaguuggguacacacgucuguaauuucaacacuuccaacaauuaaggaggaggagcaggaguggagguucgucuugguuuauguaaugguucaagccacucugaacuucagaagacucugccauuuacuaauaaugagauaggggagcguguaugucagcuaucuuauagugauauggugauggugguagugguggugguggaggaggaggagguggugguagugaugaugaugaugggggaaggggaaggggaaggagaauugccggugacacggacaaacacucagaaaccuuggaauguucuuuccuagguuggcuuguuacaucucuucaaauuagaccucacugacuuaacucaguaaagaaaauggccucccaaaauaaagcugccauucaugaagugguggaucugaaguguaaguaucuagucucaacaguaaaauauauucacagcaugaaguauagauaauguauucuccuuucuuucuaaaagcauuaaaaccaguuugcuugcaacaaaaucugaagguuuaaaaagauuagcucuucuuauuccagcacauuuuccccaauuccuaaaugccacuucuacagcuguuucgccuucaauuacaaagcccuggagauccaaagaagacacuacaacauccaaugguucaaaguuaaugccccauccuaagugucgugugugaaagcaaauagugaguuaccacacuucgaagaugaaguucaagugaagcaucuggauucucuacaggacucacugcugacaagcaggccagcaacgacaaucgggggcaaagcacacacgccuguccuucuaaucccccaagucauuaagugaauucaugacgaaaguucaaauaaucuauucauaucuugcaggaucucuuggcaaagaauagacaucgugagccucauuuuauuguuuaacagaauuccuaggguacuuuguagaaugcuuacucaacuuuauuauucugcuuucuuacaccauuuguaaaauaucccuauaaaaggcaccugcuucucuuuuucuaaaggaccuggauacaaagucucaagaaagcaaagcucuuaaaacucuguuacagucaauaaggcaaaugcuuucaacaagucuuaacaaauccauuccgugguuccauggaagacaucagaauauacaaugugaucuuaaauggucuucucaaucuagaguggacuugagcacuuacuuuagggaacugaaaaugaggaaaacagaacagauggacugcagaguguaaaaacagccuauagguaauauacacuauauuaaaaaauuaaguccaauaaggguuuacguaugucuuauauuacaaaggaggaauuaauuuaagacuaagaaauuccauaauuacuaccaaggaguuucucuugaaauauugggaaauagugagguaaauaccauaaaagcccauaagcuauauauaugcuagcauagcaaauuuugugguauguauauaccucaacuuuuaaaaucucauucuggccgggcgugguggcacacaccuuuaaucccagcacucgggaggcagaggcaggcggauuucugaguucgaggccagccuggucuacaaagugaguuccaggacagccagagaaacccugucucgaaaaaccaaaaaaaaaccucauucugauagccuucuccauuucugguagauuucuggauaaaugcuguucagucucacuaacuagaacuauuaaaaaaccaaaguuugccuaggucaagugcucuuaauacugacuuuuuuugaauugucaagguggcuaguucaguucauguuggaaaagcuuagacaccaccaugcagagucacacaccccccucccaaaaaaagcugcuguagcaaaaggucuuaccuagagaagccauuuuccuuuuccuucuuuauuuuugcauccccagcagcucuaaucugcaagguaaaaccacagccucucaguaaguacuuugaaaguuuuuaauacuaaaacaagacaaaaaacucuuauucaagaagauuaccaucaauuugggagauuuuaaauuuguuagcauacacuaauuauacauaaagcagguuucauuaugguauaugcaaguauaugagguacucggaucuacucacuccccguuccuaaugauccccuucccagccaugacuugucuuuucuuccugcuuuuuggaugucccacugaguugaaucagaauugcuuauaggaguguagauaggcaccuuaacagugacuauaccaccugagaaaaugucucaacuuccucuaauaaccauuaauggaugguagucuucaaggaagagaccucaucuacccuucuccaagacagaaugcugacaggcucaauacugcucguguccugugcugauaaccacagucauugaguguucgggaauggcaagaucaugccaggcuauuuuggagcaucuugauccuggacugacucuucuuguuagcaaaacugaagugggucaacuaaagacauuuucccagggcuguuuuuugacaauucuggugaaauuaaucgagaaaguucuuccucaaaacagcaacuuuuuaaucuuaaaauaacaguagauuucaucuccccaauaaauauauccacuacucaaaaauuugcugcgagccucacaguggggugaggguaccauaaaauagacuagucuauuuccugcccucucuaguguaugauugcccaccuacaaauuucuuuuucacuuuaaaaaacaaaaacaaaaaaacaaaacaaaacaaaaaaacaaugcauugaaaaaccuugacacauacacacaaaaggauggcccucaacuccuuaucuacagggucucugaaaagucacaaagugaucagugcauuggcuaccucauagaaaagacagggacuguaagucaggaauaaacaaggauaucuuguucaacagucuuuacuccccaguguccgaguuuuucauucaaguauccucuuucuuucaugagacagaguauacaucccagauuggggaucaccuugaacucacucuguagcccaagaugaccuuaaguuucuacucgcccuaucuccccaccucccaagugcuagaauaacaggcacacacaaacacaacuguugguaguagugcuggaaaucauaagacuuccuucaugcuagucaaacuuagucagucuaucaacuaaguauagacacagccccagaaucuucaaucagaggagacccaauaaagcuuuagguuuuccaaaaacaaaacuuucccuaaaacagaaaagauguuuccagaaacauuauaggcacacuguaguauaaaauaaacauacuuauugcauuguuaaagacaugguguuaaauaauuugguuaucauagcuucagacagauugaaucuaaaaucuuuuuuguuuggggagugaggaguuuaaugaguacauugcaaggaagccaguguuuaguuguaguuuuugcuauagcacuaccugcuaauuuugaagucugcuacagggucaaggguagauauaacaaaguuacuuucauuaccacuucuaaaguauucaaaauaaaaguacaucuuaacucuuguuuccccuuaaggcaaaguucuguaccuuuuccuccuuucgucuuuccuugucucugucuuuauguuugucuuuauguuuuucugagcugccaucuuuguguuugguuuucucuuucucuuuguguuucuuuucagaaucuuuauguucacuguuaaaaauaagacauaaaaaguuagccuagaguaagaacaacaaaaucaacucaaaagccauacaccaugaaaacuuauaaugcuuacacaguccugaaaaaagguucaaagacugcuagcuguaucagaggggaccuccuggguuaaauucaccgaguguaaccagaaagcacuaaaagucauaaggaguuuguauugaucucccuucagcuccuagguacaaguugcugcugggacaggagcccauggugauccaggagagacaaagacauguacccaguguauaacugcacugcuguguuaggaacacaugaacaacuggaaauauaaacgauuccauggcauaaccuugcuucaugacccauaaugagguuaucauggaacaaaugagaccugggggaugguggcccuuuaugugucuguugauucagcaaucaaucaagucccuuaaaaauaaaguugcuagaauccugaacauggucaccuguuuccuauccuaacaagagcuucuuuaggaugccuucauaguugacuaauuauuacauggaaauucggaguucccacucucauuaacaaaaaaacuuaagagauucagaaggaaguucagggcacacagguggaaaucucaguaccucccagaggaaaagaaagagaaaagaggaagaccaagaaaaaaaaaaaucuaugcugcugaauuaggcuggcauguucagcaauggaggucugcaaauagcuacuuggcaaacaagcaacuacauggcagaagggggcacuggggaaguugucucagagaacaagugagaagcucaguguuagagaaaguauagccaggauuuugcccugcauaucaaaagaaagauuuaaaaaaaaaaaaaaagacaaguuaagcuuucagauuaggucuuacugaagcagguggauaaacucuaaagcacuacauaauguaagcucugcaagcauuuuaaaagguaguagaauauacaguagguuuagucuuauuucuguaacuuucuaacaauaaaauauacaguugaaaggucuaucuccaacagucacaacugcuguaagaggacucaauccaaauuacccaaaaaaguauuuguugacugugccagacucaggacaaaacauuguaaacugaauggcccaacacacuaaaagcuuucucacuaacuacgaagaaacagaugaaguuuguagauccugcaggccucuuccucacaauaagacccaccugaaagcaaggacaaggucuauguucaucauauuucuaagucuuauuugaaagagguaugugucauauuaguagccccguaaaaguacauuuuucuauuuuggaaagcaagauauuacaucacaaggcaagagucauuaaaaugaucauacauguucauauaagaucuucuagaaaugucucuuagggaagauguuuauuuugguacuuacuauaguauccaaagggaaaaagaaaaugagaaaauggaugcaaucuaaaugauuaaccagagaggaaacuguguuauaugaaauaagauaacuauuaaggaauauuuguuauuuuaaguacacauccagaauacuacugacagaucccaacaagacuauacaaaauaccuuugacuguaaauguagauaaagacaagagacuagcagcaaaaaccacauguugcagaacaauguggauagucauuuucuuugguguuaaggcaccugcucccugcuggauuauuccacagcuaagcaaaacagaacucaagcucaaguggucugaauuagggguucaucacaggugcagaauugcuaacuguaagcccaaacaauagaaacagucaggacuauaagauuugucacagcucauuugccacuuguuugacucagagcagaaaaagcuggccucacuggcaaugaucucaagagacccaagaauuuuccuuuaaacacuuuccuaaaaaagguguuugucuauaaagaagauuaaaaacaagacaaaaagcaauggcauuuaauuaagccaagcaacagaauacauaucaaaucgccuacuguuacacucacuucuaugcacaaaaguagccauaacuaagacaggcaucuggguuauaaacacaaacugaagcugagcagugguagugcacaccuuugaucccaacacuuggugggcagaggcaggcaaaugugaguucgaggccagccgggucuacagaguuaguucuaggacagccaagggccacacagagaaacccugccucaaaaaaacaaauucuuagaaaauuaaccagaagguaaagacuagcagauacaggacuacagguuuaggaggauuccagcacuaucacagaugggagggaaggagggcccacuuugcauuguuuacauacucccucauuuccauucuccuccagcacucguuagcuguuacuuauaugagcuauacauuaaagggcaaguuuccacagcaaaccuuccacucauuaaggcugaauggcacacagaaugcuaauggcacacacagagaccacauuuuaccaacaguacaucauuccacucauuguguuuucaugauguguuucuaucaguauaaaaaaauccuuuauauagugcaaagacuaaaacuagacucacuauauaucauacacaugauaauaugcaugguuuugauauuaccauguuuagcuucuauuauaaagguacuauaguaauaguuauagaaaccuauaacaacaacaacaacaacaaaaacccuuagucuccuacacaaauuuuacauaaaaauaaacuccagaaacaaucgcaggcauuuugaugaugaacacaucuucuccuuacaacauccuuacagcauugcacuuguuuuuugauguugagaaaguauuauguacagacuaguguguguagcaugugugcauggugugugugcuuuggguuuuuggcuugucuuugagauugggucuuaauaugcagccuggcuagccuauaacucacuauguagaccaggcuguucuuaaacucacagggaccugcuggccccuguugggagauuaaagguguaagccacaccugacuggcuguacuuggucuuacaacccuuauuuuacucaauucuguaauaauucuaagagguuuuauuuucuuuuagacaaauguauauacagaagaaauggucacuuaaaaaacugaugcacacugacugcucuuccagagguccugagcucaauucccagcaaccacaugguggcucacaaccaucuguaaugagaucugaugcugcucucuucggugugucugaagacaguuacaguguacucaucacauaaauaaaauuaauaaauaaaucagaaagaaagaaagaaaggaaggaaggaaggaaggaaggaaggaggcagugguggcauacgccuuuaaucccagcaugaggcagaggaggcagaggaggcagaggcagaggcagaggcagauuucuaaguucaaggccagccuggucuacagagugaguuccaguacagccacggcuauacagagaaacccugucucaaaaaaacaagacaaaaaacuaaugcaaauucuguuauagaggacaaugcuaggauuaaacuuaguauuuccauuuagaaguuuagaaaaccuguacauuguuauuacauuuccacuuaaaucguuuuuaaaaauauuuguuuauuguauguggguguuuugccugcauguaugucuguaccacaugcacaccugguauuugaggaagacagagggugucagauccccugggacuagaguaagcugugagcuggcaugugggugcaagugacuguaaugggguacucuugaaaaguaguaaguacucuaaacugcugaaccaccucuucaaccucagauauaaaugguguuguacuuaagucuaagauuugacauaucuugccaccaaguagguauuuucuaaauacuugaaaagaucaaaccuuugugauuacuucuuaugaaaauauaaauggcuaauuagagugcuucaggcucugucuuccuuuaguuauuacacuacucuucucaauucucuuucuuaaugaaaauuauuagaaaacuaaucugccuuaguggaaaaaugaccuuuuggcaaucagaggaugcaaaccugagucucuagauuucaguuuuguuauucauuagaacaccaaacuaaaagaaucaguaaguaguaaugguauaucaagacuacucuaggguaauaaaacaaaacacacaaauuguuacuuccucugaagagggagccuaaugagaaucuauguagaaaacucaaagauccuccuggaguauuaauccucuuguguaccaauaacaguaaaacggaugaaaugucaaccuuauuuuuuaaacagacuaagucuccuuuauacccaucuguuuggaauaucauaaacuagguuuguauuuugaacuaguuaaacucagauaauuuacaguuggguauuaagacaggguuucuccccauaacucugcuguccugaaacucacuauguaaaccaggcugauaucaaagucaggcauccaccuacuucugccuccuuugugcuggcugggauuaaaggcaugcaccaccugggcaggagaucuugccacuuuuucagcaauagacaguaugucaaagucacaaagcuaguuuuaacaaccaaaggcuacaacagaggcuagagaguggccaacuuuaccaaugaaaagacuucuagaaauuaaauacauaaaagaaaugcuuaggaacaagcauaggaaggaacuugaaaaacauagugcucaggaccuacauggauauucuguaaugguuacacuuuuggaugaaauauaaaauuaacaccacagauaugaggcacucugaaagaaaaaaaaauccuaaugaauggcuaugaacagagguugacuccuugauucaauacucauguuucucuguaagacuguaccacaccgguugaauaagcaagucauguuuaagaaaguaaauagacaauauccauagcccuaaauggaauacacgcaacacacgcaccccccuccuuuaaaaucucagggucacuucagaagagagcgcagaaagaaagacaaagaggugauagauaaugaugucuucaaaaucucuaagaauaauuuuuaaaagaaggauaauaaaaauucuuaaaaccuuuuuuucauaaugugcaugcuugacuuauacuucaaacaacugaauuuuaaugaugaugaucaugaagaagggaggggggaggaagaagaggaagaggaggaagaguuagaggaagaggaggaggagaagaaacuaaugauaaagauggugggagaaaauagccaugcuauuucuuaggugacaauuaugaaacuucuggucuaugauucucauagaagcuaaacaaacuaaagaaaaaaauggcaggguuucuuuaaagaccuuaagcagaaggaaggcaugagaaaggacaagugagggauggcaguaaaaugggaaaauaaagcauuccucuuuugcacuagaaaaguaauuaaucuuuagaaaaaaaauauagagaguaguaguacuccugcaaaacucagagucugauacucaggaaggcuagauguuggcuaugggaagccaucaaaauuuaaaguuuacuuuauggucaauuaaaguauuuagcaaauagcaacgauauuaccaccuaauauuauacacaucuugcuacaacaaaacccugaaaugaauacugguaucuaaacuuugcacaucuggaaauuaaaagcacagaaugcuuaaguaacuuguccagggaaaaugaggaguucaacucaggcaguuugucuccagucaugaaauuaaccauucuauuacuucuauucuauucuauucuucccaaacaaagcaaacaaaaaccaaacacuauuagguagaaucugcucaucuucugagaagagaacuuagccacuaauauuugccaacuaugcaaagcagcagacagggugacagacaauggcaucucaggcacuccuauaagagaaugaguaggcuuuaacaauacagaaggaaagaaauuaauguguuuacaaggaaagcaggcaucaaaauaaagcuuaaaugcuuuaaauaaaagaauuccggguaacuuuaaguugucucccagacaauaguacagcagcuaguuuucaaaaggcucuaaagcauagcggcugcugaauguccaucaucauuaggcuacuaagcaaaaucacaaggacacuugcccaccuuggauguagugaauuccugacaccagauaguacccaacucuauauacaagggcaggguugggguggagguccggguggggguugauuuccuuauacaaacauaucuacuauaaauuuuggccuauaaauuggguauaaggaauuaauacacagccaucauuuucuggaguucaacacaaccauucacgcucuucuuugagaacuuuugcuuuccacuuacaagaaacaccuuacugcccgcuuuuugguauaucccaauugcugaaucaccacacucucacucugaaggcauuaaauaaagguaaauugaacacaacuuucaauuaugauugacaaacggauaagaauguauguauuuugaauauagaagucagagagaugaauuaagucccaggguuguauuuccuaagggugcucagaaagucauaacauuuuaaacuuacauucauaaguauaauccauaagaucuuaauuaaauccagccuggguaacuauuucaagacaaauaaacaaacaaaacucauuuaguguuuaucacgaggaauuuucuauuagguuaguuugaacuugcugucugaaaaaaaaucauugcaucuugugcccaggaaggaaaauugugugcaauuacagaaaagucaaauagaauaacuuauuccuucguuugcggacuggaaaagauaaaaggauguuuccaaaaaaaaaaaaaaaaaggauguuuccaaagaugcccaaaccagugcacuuucuaaaccucuauuccuucucgaaguucuaauuuauacguuauauucugguuuacagcucagccuuuuguggcuaccuaucuuauuauaaaaagcugcccaauuguccaaaacaagaaccauuucuguauuauaaauuccccuuucugaacuguuuccaguagcuucuuccucccuuuaaaaacuaaagcucuucuuuaaauuaaagcaauuucuugaauuaaaacaguuuucagcaguaguuuaucucaagacaacauuuuagaccucauuucuguccuacacuuuguaacuaaaguauccacuuaauuggauccauucugaaacaaaaugcaugcuacaacaguaacaugucuuguguauguuuuguuucuugugauauugggaauaaaacauagggcuuguauauucuacgggguacacacuaacacggagcuacauuccuuaaccucuucaugcuuuucuuaucaucugaaaggcuccuuuaauuauauuugagacaguuauagcucaguuuggcuuggaacuuggucacccuucugccauaaccucccaagucaaguaccacuguacccaccagauaccucuuuuuuuagccauuauccuuucauccuucugugaucguaacuauuuucaguggcuagcuucauauguugucuccaugagcuggguguggugauauaugucuucaaucccagcacuugagaggcagaaacaggaggguaucugaguugcuggucagccuggccuauagaacuaguuuuagaacagccagagcuacacagagaaacccggucuuaaaaaaacaaaaagguugggggcuggagagauggcucaguaguuaagagcacugacugcucuuucagagguccugaguucaaaucccagcaaucacaugauggcucacaaccaucuguaauaguaucugaugcucucuucuggugugucugaagauugcaacaguguacucauauacauuaaaugaauaaaaagauuuuuuuuuuaaaaaaaaagagccagaaucaacaaguuugauaaccaacaucugcaaaaacaaacaaaaagguugccuccaccaugaaaucuuaaaagcaaugauaguacucaacuauaaagcuagaaauaacuaaaaaguccuaguuccaaaucagauuuaucaauaauuaacuacugaguuagauuccacuacaaaaacugacaguugcaauuuaucuacaugaucuuuuauuagguuuuguuauaauugucaucaucaccaucauuaucuaaauuacuuagcaggaaaucaaucaaaaaugaaaaggaggcaaaaaagguaagaugcuuagauuaggauacaguuugugaguggcagaacuugaccuuuuguuuuauagugcuuuucaauauuacaaauuaaagaaaaucugauuaagaaugauuaagagagcuaccuggucacacuacaagcccaguaaugccuugagaccuagaaaaacaguccuuuuauuucaaaguguauuuuuaaauaucugaucuguaaaauauuacuacuuucuauuguucugauaaaacacugaucaaaaggaacuuggggagaaaaugguuuauuuggcuuacaugucccgggucacaucgcacugaaggcagaagccaugaagccauaaaggaaugcugcuuacuggcuuacucugcaugggucgcccagccagccuucuuauacaacuaccaccucagccacaguagauugagccuucuaacaucaaccauuaaucuagaacaacccccccccccaccucuugccuauaggccgaucuuuuuuuuggggggggggggggguugagacaggguuuuucuguguagcucuggcuguccuggaacucacuuuguagaccaggcuggccucgaacucagaaauccaccugccucugccucccaaguacugggauuaaagguguguaccaccacgaauggccuauaggccgaucuuagggaagcaguuuuucaguuucccaauugagguucccucuuuccaaaugacuaaaacuuaugccaaauucauguaagucaccaacauauaacuauagcuacauuaucaaaaaaugaggacuauggagauggcaaagcugaguacuugcugcucuugcagagggccuggguucaguuccuagcauccacauagugguucaaaaccauccacaugacuccaauuccaggguacuugauguccucuucugaucuuugaggguaccaggcauacaugugguacacauacauacaugaagguacacauacauaaaaaauacccauaagauaaaucuaauuaaaaauauauaaguaauuauuucauuugauuaguguaaaccaugcaacgucagaugccaaauaguagacagucggggaugaaguuuuccuaaaguuagaauuuaaugugauuagugcuuuucgugacaaguuugagagacuuggaauccaaagaaaaaggaaguaacauaagcuggcauuuaagacauuuuuagacacugucaaaaagcaaagcauaacaaaaagcugccuaaaucugugugugcuuacucacucaaaacuguaauuaugaaaaauggacaaaauauauuuucacauuuguagagcacuucauaagaucuuuacauuuauugacuccugggcccuccugugaagcacuggagaaaaaggguuuugggugaccuagugaaagucauagaacacauuaguggacaggccaggacgcccaagacagaggcuauugaauuauuguaauaguucugacaauaaaauaccaguuuuaagaaaagauuucaguaaaacaguacaagaaacuagucccuagguccuuagauacacuuuugcuuuaugcugucccucucgcucauuauaaucauaaauugugguuggugaaauauguaagagaacaugaaaucauuuuggaaaagcuuguuuuaaauauuaaucuuucuuuuaaauauuuucaaaauaaauuccuaauaacauuaaaaucagcaugucuugaucagaccuguaaaaacaugucucugaucacuacugaugauaaagcuucuucaugguaaagaggaaaaaauaaguuaaaaaaaacccaacaaaucgaaaccucuuuguuuuucuauugcauuauacauaagcuaggccaucauaacaagcaggguaaaacggguuaaggguuacagauguagcucagcuguagaauguuggccauguucaaucaccucaguccaauccccaguaccucaaaaggaaaaagaaagcaacgacugacaugguccaauaccuccacucuuagauguacacaccugaaggaauugagaacagaacuucaaauguguguucaaauaucaauguucauagcaguauuauuccuaacagccaaaccugguaauuacuauggaaauaauauauucaggagaccacagaaauuaguaauaugacauaguuagaaaguuauuacuaaaagaauauuaagaaagcaacaagaaaguccagguacaguagugcuugggaagaugaaguaguuuccaggccugccugggccuauggaacaagaaccaacaagccugggcaagguggugggacccaaucucuaucaaucuaaaaaagggucagggauauugugguauuguugacuagcauuuaaggcccuacguucaaucucuaauaggagaaggggaauaaggagugaagaguaagaguacucuacaauagccauagcauauuuuaaggccuagugguuuaucagaaacaugucguaucuaagaaauuuaaaagaaguuuacaaugcucaauuaacagugugagguaaaggcaaaugacaagggaaauucagcagaggaaggcaaccaaagccuccuagauaagcacuaugcacauuagaaggaaaugaaaacaugcaugcacgcgcgcgcgcgcacacacacacacacacaccacacacacacacacaaaagcauggagaaguaaaagggaugauuuuaagagagacuagcuaaaagcacgaguuaucucagcaccuacuugaacacaguccuaagauuuuggugucacuauucuguaaaugucaauuaagucaaguugugcaacacuacacuuuuuuguuuguuuguuuguuuguuuguuucuguaaguuagugucuugcaccauguagccuagaucuggccucaaucuucugguuauccaccgugcucaggcucagaaugcuaagguuacauacagguguuagucaaccaugcucagauacuguuuucuguuauuuaacccucccuuagccuuggaaauuucuuacaugcacgaauaacaauuauugaaaacaaaagaauaaaaucauuaacuacaaucaugaauucucuucaaaauucuaauaguuucugugugugcauauuuugaggcucugaugauacuauagaaacauuuuuaauguccuuuguauuaucaugaaauggguuucuuuauuguuggcaguguucuuugcucucaagucucuuuugguaguguuagauagacaaauguagauugagaagaagggugcauaaaaagcaaaacuugacucaagugcugagauuaauauuaagaauaaaacauaaacuaaguuguaagaaaugacuacgagaugggaaaaaacaauauuaagaauaaaacauaaacuaaguuguaagaaaugacuaugugaugggaaaaaacaggaggagcacauaauuugagaagaaauauccuaagagaaaauuaaacuaguuuuuuaaugacucaaaaaauuuauuacuggcuggguggugguggcacacaccuuuaauccuagcacucaaaucuacagagcuagcuccaggacagccaaggauauaaaaagaaaacaagucucaaaaaaugguaaaacaaaacacaauuauuaaaaaaggauaggaauuuucucuuuaacuugucugcugacaauaagacaaaccaauaaagcaguuuuaaaauauaaauuuuaaauauaaauauagcuuuaagaaacaauggcauugcugggcgugguggcacacgccuuuaauccuagcacucgggaggcagaggcaggcggauuucugaguucgaggccagccuggucuacagagugaguuucaggacagccaggacuacacagagaaacccugucucgaaaaaccaaaaaaaaaaaaaaagaaagaaaugcauauugaaagaagacucacugugcuucucuguacaucuagaucuaaacuuaccaagugaggcauuaauucuuaaaggagucucuucaguaacuacaacagauauagucucuuacuuugcuacucaccucaagcugauaccuauccauggacaccaaggaugcuaacucccuauugaucaauucuuuuuuaauuauuuauuuaucuuuauuagauauuuucuuuauuuacauuucaaaugcuaucccgaaaguucccuauacccuccccgcuguuggucaauucuuaccuguugcuaugcuuagacuuuucccgguccuuauccuuauccuucuugugcuccuuaugccgguguucucgaucuuuguguuuaucuuuguguuugugagaaucugcaaucauaagagacaagucaaucacaaggaaucauaaggcaucauuugccuaccugccuuaacaaacaacuuuagaaacagaagucagucaaagggcaaagugaccauaaaagcacauccuacugguaaggagacuucacaaagacaucccauugccuugccucaaauccaguaacuuauaaauaauaagcaagcacugucccacuaagcugccuccauggcuucauuuccugcugagugaaaaccauuacauggaaguacuguaauuuacaacucacauguugaugaaccuuugcuucuaaaugaaguaaaacugcuagaucauauaaaaaauucacuuuuaacuuuauuggaaacugcucaacuauauauuccuaaguggcauacucucauauauuuccaugaauauuauuaagaguuccaagcuacuacaaaucauuagcaacaucuagaauuaccaguguuggcuuuguuuguuuguuuuucuuuaaggcaaacucuugcuaugcagcucuggugagcauguaauucucuauguacaucaggcuggccucaaucugagagccccaccuaccucugcuuccugaguacauuacaaugccuggcuaacagccuuuacugucuuaauuuuugcucuucuaaaagguauauuauggugauuugaguaagaaugaccccacccccacccccauaguaucguaguggcacuguuugaaacuuguaucuuuauuagugaaaguuuaucacuaggagugggcuuugagguuucaaaagccaaaagcaggcccaggagccucuuggacaguaggccagaaucggaauauagcucucagcuacucucuagcuccaugccuaccuccugcugccaugcuccuaaacaugauaacggacuaaaccucugaugaaacuguaagcaaguccccaguuaaaugcuuucuuuugcaaaauuugcuuugguugugauguuuuauuuauuuauauauacauaauauauauauauauauaauuagccugcuguguuuuuuuaauuauuuuuaaaaauuuuacccaugaauguuuugccugcauguauguaaaugcccugugugcugggucccuguggaggccauaagaguauuggauucucuggaacugaaaugcuuagagccaaaccuagguccucuacaagagcaagugcucuuaaccagccagcacccucauuaugaauuuaauuccuaauuuucuucuagugauuaaauauuuaaugaaaacuauuugugcuuauugacuauucacauccuuuaaauaacuauugcaaguucacuacaguauuugcuuguuugacuguacauuguauuacugagcuguauauguucuucccccuacccccugguuuuucaggacaggguuucucugucuagaccaggcuauccuuggacucacagagauccaccugccucuguaaguucuuuauauacuucuggauugcuauuuuuggccacauauauuaugauacuauggcuugcuauuuuggauacauaucuuccaaccucaaagacucaaguguuagaaaguauaaaagugaacaggcuuuuaaaaaaacagagagagauuuauauauauggguauuuugcuuauauggaugucuguguaccauguguaugcaaugccugggaagccagaagaggacauuagauucucuagaacuggagcuguauauggucgugagccuccauguggguguuggaaaucaacaccccauucucuggaagaacagccagugcuccuaacugcuaaguuaucccuguagucacuaugaccagucauucauucauaaauaaauaaauccuaaagguguuuuucaaagagccucuuuuaaaauuuaguaaaauuuuauuuaaucaauuuucucuugauuugaguuuugcuuaccaaaacaucaguugcucgcccccauucucacccccacccaguuccacaaagcuacauccuaagccuuaugaaaauauuuaaacauauaaaguacuuugauaauauccccuccauuacucacacuuauccccacucccacugauucccuuucuauucucauuuacuguggugccuuuuuaagaauacaggagggaaacagugcuauauguaucucugauuuuggcuuauugcuguguaccuaucuauaucacaguucuggggaaacagagacagaucucuggaagcgccaguucaauaaauauuuuaucuaaaaaaaaggugaaaagaggcuggagaaaaguuucaguaguuaagaguacuugcugagauagauaacagaggggucaguucauagcauccauguuaggggcaacucacaaccuccuguaauucuagccccuugagaucuaacacccucuccuggccuccagggccaucuauacucauacauacacauggacaaguaauaagauacaucuuuuaaaaauaaggcagagcaagccugauagacaucugauguugaccugcaaaugcacaugcaccguccgucucuugcacuugcacaaguaaauggcaguacagcacccaacauuagcucacaaaggcacugcaacuucccauuugcucuccuuguucuagugagaaaucagcuaccaaacuagcagcacucaagaaacauguggugaggaacugauacuuccuucuaauagccacgugaagaaauuaucuuggaagugaauaugccacagcccaauuuagccuucagaugacuguuacucuaggugacaugcgauuuuuaugaaaaacuuuuuuuuuuuuuaauuauuuuuuuuuaaagauuuauuuauuuauuauauguaaguacacuguagcuguccucagauacuccagaagagggcaucagauuucguuacagaugguugugagccaccauaugguugcugggauuugaacucgggaccuucggaagagcaaucggcgcucuuaaccacugagccaucucgccagcccgaaaaacuuuuuuuuuuaaaugaauucuuucuuacauucaaccagacuaacgaauguaauguauuugacacuuauaaccaaccuauaucaacuaaauuugaaguagcauguuucacagcaauaagauuauauauaaauuaaguauugcugaucugaagcaacugaagugcuauuuggcauaacugcaugucuauucuagacagaucccaaggaaagagaaacacuaauacuugcaagaucaaggcccugguucuaagaacuuuccaucccacagagaugagaauaguaaguaaagcauauaguguuagaagacugaacucaaaucucccaugcaguguacaggacccucugacuucuaagucuccagucuaaagucuuaacaugcugagucaaucaggauaaaacuggugacuuuuaccucauggcauaaaaaugacaaugcaugcaugcaccaggacuacaaccugaaauaaagcauguguuguuuuguuuauaguuagaaaucaguaaaugggcuucagaauauugaacguuaagaucuacugcuuugguucaaaggcaugacaaggaaauuaucugaaaaggagagaaaaugagcaccacuguauguaauucaauaaauccaugaccacauacaaaaaagacuggaagacauacauuuuaaaaagaauguaguaauuuuaaaauuuagaaauuugugaacuugaguucuuaagugugcuucaucuuauuuuccauaaugaacgacuuuuauaauaaaguuagagauuagcaaacuuuaaaauuugaagccagaccugguaguacacgccuuuaaucccagcacucaggagacaaaggcagacagauugaguucaaggccagccuggucuacacagagaguuccaggacaaccaggguuacagagagacccugucuaaauaaacaaacaaauuuauuuuugucaaauacaaacaugcaaaagucacuaaaaagcacuaaacuuuaaaauacaaauucagaguaguuccuauuagauuucacauuauuaucuuccugaaaugcauaaauuuucaaaauggaauuuaaaaccgggucccaagccuuugaaaacaaaugcuaucuaaaaauguaaaaauuaacuaucucagagaaaauuaggguugcugguaaauaauuccauggacaaaacaucuaggccaauaauaugaacucaaagucauuacauaucuaguauauccucaaacugugcuacagaugcugugagagauuuuaaauuaaaaacaaaacaaagcagaaaacaaagaagacaaaguucuuaauugaaaucucuauggcuuuuccagcucaggcuggaaaagucccugaugccaaacaugacaauuaugugcaauccccaggaaucuacacagcagaaaaaugacuuccauggauugucuucugaccagaacauguguuccauaacccugucugcccaccaaccucuacauacaaaucaauguaaguguaauaagagauaugaaugucuguugagcucuauaaaucaauacaguuaaguucuacauggcaggcuuggauaucugaggaaaaaugauacaauagauuuaaaucacuauacaaguagcauugccacaaagaaaguuguuaaacaaucauuuaacauuuaaaaaacuuaauaaucuacuaacuuaacuguauagaugcccuguauacuacuaguagguaaacugauagauuaaaaccuuuaccccugcugggugugguggcacacgccuuuaaucccagcacuggggaggcagaggcaggcagauuucugaguuuugaggccagccuggucuacaaagugaauuccaggacagccagggccacacagagaaacccuaucucgaaaaaccaaaaccaaaaccaaaaaaaaaaaaaaaaaaaaaaaaaaaaaaaccuuuaccaacagugguggaucacaccuuuaggcccagcacuuagggcagaagcagguagaguuugaggcccgccugggucuacagauugaguucaaggacagccaggacuacacagagaacccaugucucagaagaaaaaagaaaucuuuaaaaguacuuaaaaaauauuucugaguaaauuagaguuagaaucaagaauuauaaagauauauaaaacacuagcaaaagauugcuagcuauuaaaguuaugauggguacacaggaaaucaaacugcaguuacacauguguauccuuggaacuuuuuacauuuagauaaugaacaugagcucuaagcauuuuccuuuccauucuuuauuuuuccuuauuauguaaaagaagaaaauaaguguaauucaagagagaaucuauugaggaaaaaaaaaaacaauuuuguuuggaauuggggcuagggggucaaauccaaaguccuguucuacacuggaaacugguuccuuuugaauauucccagcccuuggguuuuugaaacaagggcuugcuaagcugucuauagaacucaagaucccccugcccccaccuccuaaguacacugggaaaacagaccuuugccaccacaguaggugccaaaagauaaauuuuaauaguuaacccugggucagaauguucuacucuaggaugacagcuacuucaauuuguaaaagaccaaaaaucauacuuaaaggaaaaacaaaaaacaaaaaacaaaaacaaaaacaaagacaaaaaaaaaaccagaaaccagaagacaguaauagcaaaagauuaagauuaagaacaaugggaaauuuuucaagaaaauagaaguugaacccaguucuaagaacuuauugugaaaaagaguauagaggaggagggaagguaagggauauucuugagguccuaguagcuggaagaaccagaggcccuaguaaaacagaaagcaaagacuuuauuugucuaaaguauauaaggcaguagugggaccccugaccuagacaguacaaaggaagaggcaguaaguaaaagguaaaacccaguaaaagcacacagaacucuaucaugcaugcugaaaauacuuguuuauagagaauacauuaguggcuuuaaagauuaaguauaccuccuggaauuugucaaaaaguagauauuguuaaaauauuuguaaaaacauuugugacacucgaaguaucuaucaaaugcaaaaagaacuguaaaaaacuugauagcuaagaaaugaaacaugccaaccacuguguacuauagcaccauaaaaauccacauaacacaacuggguuuuuaaagaaacucacuaacagguauuucuguguaacagucuuggcuguccuggaacucacuauguagaccaggcuggccucggaacucagaaauccaccugccucugccucccaagcacugacuggguuuaaaggcgugggccaccacaccuggcuaaccauaaaaucuuauucacuaaauauccuaugccucuuaagacauucugcuugaacccauacacaaucucacauacaaaacaauaauuguuucaauucuuaacauuugaaaacucuggaugguggguggagagauggcucaguaguaguuaaauauacugacucuucccgaaggacccaguuucaaaucccaccacccacauagcagcuauaaauguaacuccaagaucugucacucucacauagacauacauacaugcaggcaaaacaucaaugcaaauaaaauaugaaagauaaaaaagaaaaaagaaaacucuagaugaaaccacaggaagaaugcuagcuaaagucuuugaagacagaaaugugcaacaaauuuuuuggugucauuuaaauaaaauuauuccagaaaaacgcauaaguaaaugaauaaauagaaaacacuagaaaaaucaacaucuuuuuguuauuauuauccaaaguauuccuccuuaaaauuaaaagggcuuuuaaguaaauaaauuuccagguccugaguucaguuccuagcacuuaauguugggugaacucacaaguaccuauaauuucaucucuggauuccaagggcacagauauacacacauuuaaaaauaaagcagaaaacaaacuaccaaaugaugaagauccuccaucuuuuucucacuguaggagcaauuucuaguuagcauuacacaggauucaaugguuaaugcacacaacaaaagucauccuuguauuagcagcugcaggauuauacuauaagggcuauuuaauuuacaaacauuauauuucucaaguucaaagcaccuuacuaaagacugaucagacaagggcucuguccuuuauaauccaaucauguaaaugaauauauggacuuaaauagccauuacacaagacacucaagacaaauggacauuaaaacaagagccagcaacaugcagacucuuaacauguggccauuuuaaugaaaaggaaauauacacauuucaccaaagguaauagcuauuccuuacuaaauaugcauuuugcuuuauauuuuuuuaaauaagauauaccuaguuggaaaauauaauucuugaggcaggagaauuccacaaugucuaaugaaauaacuagcucaaucccuccucugacccagcagugccuaggaauuuacccugaagacauaacauaccuucaagguaucuaccucuagacucuagaguuagaaaaaggaagaauggacagcaaguuuacuaagaggaaaaacaagugacagauaaagggaaccaaucaaaaggcagacuaacacuaaguacacaaaaaaggauuaagaaaaacaaugaggaaauuaagacuauucugaagaauuauaaccgaauuucuauauuaccauccuucaaagaauaauuguauuaauaaugcuauaaaugucuugcuacugcuauuuuccuacauuuacuugugcuuguaaauuacuucuauucuuuuaugaaguggguuuuagagauugagcuaaggugaaaaaagcaguuugggcuacuuuuacuaggagcugaggaaauuaagaaucaagcacucuggcagauggccuaacuacagccagaaauaagcaacaaccugugcaguggugaagcauaccuuuaaucucagagcucaggaaucagaggcaggaagaucucuuacuucuaggccagaccgaucuacagagggagcuccaguguugccagagcuacagagaaacccugucuuguuuuggggggcuggaggugggagagcuggagggugugggagggaaggguagucgggggucagagagcaaggagcaggagaggagggacaaugagcaacagcagcuagccacuauuaucauugcugaaaauuucauccacucaugacugaucaaaauuaaguaaaauguacuuuuuggcagugaggaaaugaaguugauuucuuaucgggaacauauuuuuuaaaaaaaguuuaaaccaggcguggugacgcacgccuuuaaucccagcacucgggaggcagaggcaggcagauuucugaguucaaggcccagccuggucuacaaaagaguuccaggacagccaggggccagggcuacagagaaacccugucuggaaaagccaaaaaaaaaaaaaaaagaugaaugagacagagaauaccuguagccccuuuaacugcucagaagcuaaagaaccuacuccuucaaaagaaugagacagaauaugaacaaucauaauuaaacucuaccacacacagauaaaacagauuugcucuacagcuaaagggaaacccugucucagcagcaccacucaaaaggcagcaugggaaaggucucaggagcuuuacaucucugcucauuauaaacuugauaucuguguccuuaguaaaaauguuccucuuuguuagaggaaacaaaagcugggauucagaaaaacuggguuuuuuguuuuuguuuuguuuuguuuugguaagcuaaucaacagaauaguuucaacagaauuccuggcuaauuucuaacaaauuacaaacauacugacaacugccuaggaaaugcaaucauuauuuaauuaucuucauuauuaauuuauauagaacugaauuaaacuuagucauugcauacaagguaaaagcuuuggauauauauauauauauauauauauauauauacacacacacacacacacacacacacacacacauauauacauacauacauauacacacucaaagcaggaaccaugcccuagguaccuugccugauaaggcaacauuggauaaaagauguuugggguuuuauuccccuauacuuagagauucugacaaagacaaacuaauacaauuuuggccuucucuaacaauccuguacuuuuuuuggccuucucuaacaauccuguacuuagaagucugaggaauuuccaggcugguccaggaagauggcucagcaugucauaaugcuaguccacaacuagagaacccauauaaaaugccagaugagguggcaggcaccuauaaucucaacacugguggcauagauaggagaaucaccccuacaagcuugaaagucuuuagaaaugagagaauaucuuucaggaguugguucucuucuaccuugaggugggggggucucuuuuuucugcuguuugcauuauucauguuugcauuauuuaguagguggccaccuaacaaaauagacaagucuauuuuucuuuaaaugcaaucaaaagacaauccaaacacacuuacacuuucuaagaggaaacgggcugggggagugacccaggcucaaugguacugcauuugccuaggagacaauuccaucucguggagaagauacacuaaagaauuaacaaacauuaacaauuauagaacuguuucacaaucuccaagauuuuaaaguaaccaaaucaagcuauaagaaagaguccuuuccuuccuuccauaaaaacaaaggcagaaagaacuuucugguacaaagggagcucugagccauguuugaagccagacucuuuacaccaacuuuucuugauagacuuugagauuuuauuauaacagcuauaugacaguaugacuuuccuccuucaaauauaguauuuacagguguaaacaguguaggaggaaggaguuauauauacuauccaaagcugucuuccccaagaagguacacacacaguacaacuuuugucauagaaaaucucuauuccucucagacauacaaauauacaaccaguucacaaaaugaacacuggaacuacuugugauagcccuuaaauguaaucuaaggaggcagaggcaaguagacugacugggcacuggaggccagccuauaauauuuaacaaugccuugucucaaaaaaagacaauacacugugcuugguggcacaugccuuuaauccuccuuuaaggagaucucggugaguuggaggccagcuucacucaucuacauaauguauuccaggcuagcuggggcuacauagcaagaacuuuucuccaaaaaaauucaucauaaaaucauaaaaacaagagcuuuagcagugguucucaaucugugggucaugacuccuucggagauugaacaauccuuuuauaaggguuacauaucagauauuuuacaauaaauuauaaauuugaaaaagcaaaauuacaauuauaaaguagcaaugaaaauaauguuuugaucggggucaccacauccugaguaaaggaucagggcauuagaaaggcugcggaccacuggcuuagaauguagcucagugcuacaggauuugccucccauguacaaggacuuagguuugcuuuccagaaccacaaaauaacauaacaauaaaccaucuaucagaauggacuaauuaacuuaauuuuuuaaaagaaaacauagccgagugugguggcgcacgacuuuaaucccagcacucgggaggcagaggcagguggauuucugaguucgaggccagccuggucuacagagugaguuccaggacagccauggcuacacagagaagcccugucucgaaaaagaaaccaaaaaaaaaaaaggaagaaagaaagacaaaagaaaaaagaagacauuauuauaaagcuuacugaaacccugcaucuuggucuuagaaccacauccccaaagcuggaguuuauacaaaaucaacauacuuaauauuaugcacuuguacuuucuaaugcuuuaaaauucuguuuuuguuuaggacagauaacaaacuggccucuggugauaaagcccaacauccaagugugcccauguacuaggacucuccaugaaucucccccccaggaacuaacaagccugaaagcuuauugucauuggaaguuaagaacagugaaaaaauuccacucccucuuuccaacugucucaauucauacuuuaauaaaaguguuaguuuacucucaguguuagguccaucuuaacaguggcuaauuuaaguaaaucuauacaaaagcaguuauuuuacaauaguucucauugagaauucaaaauucuagaacauaauuaauaaaucuuucuaagucagaagacacaaggaguuccugacuaaaaucucuucuuaagaauucugaaauugcaaaggagaggaaaaaagaauucacucugagccgggugugguggcgcacaccuuuaaucccagcacucgggaggcagagucaggaggaucucugaguuccaggccagccuggucuacagagugaguuccaggacaaccagggcuauaaagaaaaacccugucucgaaaagccaaaaaaaaaaaaaagaauucacucugaagcaaauccugggcuggggaugugggucaggagccgaguacuuguauagcaaauguggguaaagcccuggagauucaauccucaguacuauaaaauaaacaaauaauccaggaguggugguacaagccuuuaaaaaccgcaaaggcaggcaaugcuauuauuucgccuggagugaguuccacgacagagcuacauagcaagaaccugucuuuaaaaaaaggagagagccgggcgugguggcgcacgccuuuaaucccagcacuugggaggcagaggcagucggauuucugaguucgaggccagccuggucuacaaagugaguuccgggacagccagagcuacacagagaaacccugucucaaaaaaaaaaaaaaaaaccaaaaaaaaaaaaaaaaaaaaggagagauagggcugaagcugaagagaugacucagcagagugcuggcugcucuuucagggaaccacagccaccaccacuccccaacccacacccaccccaguucaauuucuagcacccacacggcagcucacaccugucuguaacaccaguucagggacacacagacauaaaugcugauaaaacauuaaaaagccauuaucaaucgacuuaagauccaucacaaacagaaccacagucugauggauauuuaacuacucccaugauguccugggggugucacucaggcaccccuucaccucauucuguuucacauuuaacucaaucuguggcaucaaucaaacaguggauuaaacuccuugcuuuagaguuuaguuaaaaauuacacaacugugagcuaauuaacaucugagccuaaauuucuaaaguggaaaauagugacaggugaaauuacagagccuuuuagacauugcuagaguaauaguaauugauuacauuucugcuauucauuucaccucuaagcauuuccuacucuauuauccaaaaaccugauaauauucaaagcuaaacugagaggaaacugguucuauuucuggucucuacauaauuuacucaaguuguuaagaucuuaaauaucuauugucaguggucucagcagccaaggcuauaucauuuugucucaguagauuaauaugucuuagcuaauugugaacgcaauuauuuauaagcuguagcacauacucaacauaggcaugcacgugagaaaacaacccugacggccauacaggaaagaauaguucuaaucugcucuuacguaaaaguaaauguaccagauucucuauaauuuauguauauguaguguuuacauuauuaacugcaacuuaauguaacugcaaacuugauauagguaacaugcuagaaacuuaagacuuccuuuuuuucuuuucuuucuuuuuuuuuuuuccgagacaggguuucucugugcagcccuggcuguccuggaacucacucuguagaccaggcuggccuugaacucagaaauccgccugccucugccuccugagugcugggauuaaaggcgugcgccaccacgcccagcgaaauuuagacuuucaaaugaaguuauaagcaaacaguuaaucauuuuaaagaauacugauccaugaaauuguguaaauuuaagccaaccuacuuugccaaauauagacauuaacuacuucuuagggacacugagauaaaauaagaacuuauucuaucuaaaggacuuuaaauuuucuguuguuuggcacugggggugggagguggucaaguaaaaccaugaucuaucugaacuucuaagugguaaguucuauuagcacauuaucuaaaauaaaguaauguaaacauauagguggaaaauucauucuauuuuaacacacuauacacacuggucuucagauuucuggagaaguuacaagagccccaaacaucuauucaagcaaaauauaaaccuaaaucucuuggguuguaucuacauucaaaguuguacugucuaagaaagcaaucagucacaugugaguauuuuaaauucaacaaaaccgaagguuguugggggaggggguuuuguacaguuuuguacaguguauucagaugcugauggaccugccagcagucuggagguuggcauugucaugguauuuggagcaucuccugucucaaagauguguaaaaacucuuuucuaucaccucagauugguuaauaaaaucuaauucagccuauagcugagcagaagugaauaagguggggcuucugaucagagucagggguucccaaaaagagagggagagagaugagagaagaggaagaagagagaccuggagaaggacaggacgacuggcugguggcaagcagaucagcagggaguugccaagaggacacacauggaaaagcacgagccaggguaagaagacucagauugcagguaaagaaccacguggcugggaaguaggcagccauugaggguuagaauagaugacuauauggccagcauagugccuacaguuuaauaacuuuauuaguucucuguguuauacucagaagcuaaaacggacuacaauggugggcauacaaaugcccugcuguuaauugggagcaaaaagggcaaagaaaagcccucagaauuccauuuacagaagguaggguuggggagggaggcagcacuaccuuucauguuggugucuugcaacauuguagcuguuccugggcaucugcuguaccaguuaccagcugccaugagccagccugguaggcuacacuagccaaauucugagcaugaacuaugagcaguuccaugccagugaaagcuaggugcccagacacagauggaguucuuacagccagucucucaugcuccgacaugacacaauauucaguauaacuauuuuuuaccacaauaaaaagcagcagguacagcugcugcacuugagcucugcuaccaccaaagaugccuuuguguacuuagggagcacaacuguggagccuggcggugucauggcccuggggacucccauuauacuggauggccuugaugguccaaggagcccucuugaaaacagugccaucuacuuggauggaaaaagggaugcauuagguggcacaaugggaugucacaguugggauuagauaccaugugacaaaaggugagagaacucaagaaaauugcucacacugggaaaauagagaauaugaguaaugacaagagaagaaauuaaggagaccugugguuguagacaaacugaugccaaaaauuugguaagaagccaaaaauucccuuaggaaaccccccccccccccaaaucacugugacaaacuacgaccccaaggaagggucucucaucucagcugaucaucuaaagauaccucaagaaaaccuacucuaugguucuaagggauaauccauaccuguguccuuuccuccucagggcucuugaucaagguaguuauauuagggguauauuuucuaccuuguuaaaagccugauaugguauuaucauauuauagcuacaauagaggacaauacagaacuggauuuugcuaaucuagaaacuugggaccaaaacauucuacuauaugaccuccucugcauaauaacaauugagaaucccuuugccuuaccuaacuccauaccuagaauucugucugacccacccaugaagcugaagcaucuuucccacauagcauaaucuacaggggugggcuaccacuaaguagacugcuucugaacaaugucccuuaaaagucaaaaccugaguuugcagaguauauuaaacugaagcauuagucuacuucaggagcaagacaaauacuauuuguacuaacuuaucuuuuaaggacaauacuuaaaguuagaaugcuuuauucuuuuuuuuuuuaaagaucuauuuauuauauguaaguacacuguaguugucuucagacacaccagaagagggcaucagaucuuguuacggaugguugugagccaccaugggguugcugugauuugaacucgggaccuuuggaagagcagucagcgcucuuaaccgcugagccaucucuccagcccagaaugcuuuauucuugccuacauaagucucuguaguaugacucauuuucacaaggauaucccuucauugcaaucuucuccuuucccaggagguagacuaaucuaaccugaacauguaccuucucgagccuucucaauuagaguaagacuguuucugcaggcuuguccuccuucacuuccaucaacugagcucuuaaggccuggguaacagaaaaaguaacuuccaaauugccuaugcucuagagaaccccuuccucauuaggaauuauuugauaucacaaccuuaaggaagcacaaauacuguccaaccuuggagcuuugagguugggggaggauauauccuuaagcagccaaauuauacaaaauaaaacuaggcuuuguacaaauaaaugucaggauuauagagcuuaaccagaagauuaugaccagauaauucaucuuauucaacaauuugauauggaaauacauuaguaccaguaccuaccuuaauucuauauagucuuugccuauuauaaugaucuucuugaucaaugguauaagauuuauucuaagacucauuagguuuagucuaauggauacuagcgaagcauuccuaagugacuuuuauuuccuuuaagugguaguuuaaaaauaacaaauucaagacaauucaguauuuagcauuaacaagacuuaugagccacuguggaaguuucuaacugcaugaucuuuuucacaacucacaaauaccuauccucucauacaacuauuaauauaagcuuuaauuuagggguuguuuuuguaguacuagagaucaaaccuauagcauugcacauuguaggugugugcucuacucuugaguuguacugacugccauuuuuaauagaagcaacucuggaaggaagauuacaagaucagccaaugguguacagggaacaaagugguagggugaguggaauguuuauggcaugucguaguacaguaguaccuuaugaggaacaggguguuucccuccaaagcaugaggggauaaagggagugaaugagcagagaaaugaaaucugggagaaugaaagaaggaacagcugcuaccaccaugugguauucugagccagaaggcuuaaauccuuguaucugagcaauguagcugucucugagcacagagauauucugauuaaagaccacaggagacuggcuagaggugaguuuugcauguagaggugcccuauccuuguugguaaaacuggcugagaagacgaugugcuuguugguguggcuggacuagaaguguuauaugagcuugggcaaccccacagugcagugucagacugaacacauacuagacaaaggcucuguaucaccaagcaggcaccuuuucccccucagcacaccaccaaaacugccagcaggacagcaaagcugaugguuugauucauggugcaagugcucuguccuaaauucugggcuuugggcuuugguagcugcagucuugucugaaagcaccacugccucccucuuuuuauuuuuaggacaaggucucacuaaauugccgagguugacauggaacucauuugaucauccucuugccucggcuuucuaagaagcuaggaacacaggccugagcuuacguggauacucauuucccuauuucaagacggcugaguuggccacuuuaagaaagauacagaauuaauaaggauuaaauaauucucaggugucuucagucuugcaacuuaaaaauguuuuggggucuuugaaaaaacaugcgguuuuuuuuucuugagggggagguuuacaggguuucucuguguagcccuggcuguccuggaacucacuuuguagaccaggcuggccucgaacucagaaauccacaaggguuggcuaguucuuggcucuuagaaaaaauaggaagccucaagaaaguggugguccaugcuuuuaaucucagcacucaggagguugaggcaaguaguucucugugaguuuaagguuugagaucagccaaaccuuuauucuacauaaugaaauccagggcagccagggauauggggagggggagggagggagagggagagggaaagagagguugauugcagccaagccucacagccugagcccauaugguaggagaacugacucuagcaaguuguugaccucugacuacaugucauauuguggcugugaugugagcucuacacacacacacacacacacacacacacacacacacacacacaccacccauguaugcaagcacccacacaaagcaaauaauuauaaagacaaagaaaaaauugggaagcugucauaauucaaaaauauguuguucuuauguauauaacaaaagcagauaacacuaucuguuuuaacaccuuuccuuguauuugucuagaugaaucucuggucacuucaauccacagaaacaagcacaaaauauuaauuaaaagugggaggacaggguggcacaaaacaaaaaugaaauaaaauauggauuaauauucugguagaagggccaggcaugguggcgcacgccuuuaauccuagcacucgggagguagaggcaggcggauuucugaguuccaggccagccuggucuacaaagugaguuccaggacagccagggcuauacagagaaacccugucuugaaaaaccaaaaaaauaaaauaaaauaaaauaaaauauucugguagaaaagcauauaagaauucagaaagugucagggaugguauauaggugagaauaguagaaaaguggauguaucuaaaaacagggcaaaaaauuaaaaaugaguaccuacuaaaaagaaauaaaaacuaaaguugccuccuuaccaaaauugagacauauguaacaguuaacucacauugaugugggcaaucuaagucaaugcuauuauaaucuagaauuacuaccccaaauaacaguaacacuacugucugagaacauacugagcagaugccauguuaaacaacgccaacuuguuaaacaacucuaagaugcuuucucuaacaguaacaaaauacuauaauaucuaaauaggguucugcuuuaaacguuuucuuuccuaaucaagccuaggccacagugcuucccuccacccuucuuucuucauucccuucuaaaguucccaggcccacacuuaucagcccagcacacugccagcaccuagacagucaagaggagguaggaagagaaggugcuugaaaaaaagcuaauucuuccaaacuaauguauucaguuuuagaauuccuauuucaacuagagcugaagccacagaauagaauggugcuucucauacuucagacuuacaaagaaugaaaagagaaacaacacaccugguuauuacuuaagguaaauagaaucugaaaucuucccuuaaacacaguacuccauugacuaagucuggaacuucuauccuaaacucuacaccuuaagaaggugaauucucaauuguuugcccaaaugacuuugauuugucaaguuaguagauuaaaaguaaucaaggcauaaucauguaauuuaaaaccacaggaaagaauuucauucaaggacucccacuucuaaaugccauuccuuuaagccguuuuuuucuucuuucuuucuucccuccuucuucccuccuuccuuccuuccuuccuuccuuuucuuucuuuuaaaacaaauaaauauaaacuuucuggguuuaacaccaaauauugccagcauuuuguagucucaagguaaacuauaccuauauucaaaguaauuacacuuggaauucauuucaaagugaacuucuaaauuagaguccaucauaguuucauaggagaaaaaucacaacacacuucugggaaaaugacuggguuuggcuuugaagaaagccaauuuuacucagcaucauuagauaaaaguuauugaagaucuauaguauauguuauacacugaugccccaauauggucuucuaaaaugacacaaauuauuuuccaugucacaaucaacauaagacaacugcugcuauaauauacaauuuucuaacauauuuacaaguuuaaaaagcagacuuuuuucacuuucccaugccacgcacacugaaaacaaaaaaaaaaaucuuauaaauucuaacuuugguauaaccuuaaaacagguuaacuauaaagauuccugucacucauacaaacagcuaucacacuucacuauacccagaauaaaucaguaucuuucaaacucuaaaauccaucauuuuuaugcugacaggaaaaagaaucuacuucccugccccugugcuauugaucgacaugagauuugggagccaacuccaggucccacacuaucugcuuaccaaagaaaaauagauucaaggcuuagaaauaguaucccauuugucuuuuaaaccaugaggguuuuuuuuuuuuuuuuucugauuucuuuaggaaacccuagauuuucuuguuuuacuagaaauagacaggcugaaauuugugagaucugauaugcucuaagauaucagcaguuuacuaauuucaaaaaugucccucaaggagucuggcucuaaaggguaaaaagacuccacuggaaucuaauacuucuauuagucguccagacuaaaucuaaagauuuccagauuucauuuggagagaucaccaguuuucaggcuuaaagccucacgagccuccucaaugccuaucauaacucaugcacagcaagcacagaaguacaaccauuacaaucaaaacaauucccuucauucaaauuaaauccauuagaccuacucauaaucuacacauugucaaauuacaauauaaugaaguuguguagcuccauaauuccaguaaaacagacaggaacuuagaguucuugaaacagaaaaggauuaccagcaccuucaacuaauguuaacagcugugcagcuaggcauccugugcacuacuauaauaauaauucaagcucacuaugauuagugcuacugacaaagggaaucuuucacucaggugaaagggaaauacaaaguaugggcugugcuccugaagugacuagcucauugcuuauaucuuaaauauagauuuaccacacaaauaacauuucacagcaguugaguaugacccagaauguucuaaauuucccacaaaaggcuguaaauguuaaguacuauuaaaacaaaacaaaacaaaaccgcuccaguuaggagagaaaaucuuuuuuaucuuagaagauuugaggaagcaaaccaagggauaugugguuuuacuucaugaaugugauuguucagacucaccuaaaaccauguuuaaguaaauauccucucacuauaaagaucaauuaagaagccuggguauuaaaaacuaguuuuaauuuuuuaaauugucuuuuauauuuaucaaucacuagcuaacaguguacgcuugauagagcaaauaguuacugacacuaacauccagacaauaaccacaaagacaaucacuacaacauuagaaccuuaagguaguagguacacaaaacugcuuuuuuucuucaagauuuugguaaaaaguaaccggcaugcuaucaauuuuucccuuucccucuuaauugccccauacaaaacaggaaacuucauuucuucauaccagcaucauccgguuugcacagaggcuagguucauggcuucacugaguacacucaguuucaucucaaauggagauaacuguaauuaacuccuaaggguccuuuccaaagaguaagaugagauucaagccugaacaguuaggugcccaauaaauacuaaauaucauuguuggaaaauggaaauacauccuaaaaguuaacauaggcaguucaauucacucuauaaaaaugcaaagauaacauacccagcccauaaucaugcauagauucaauagcucuuuuguauuuagaugggaacaauggaaguuaaacuuaagaggaaaaaggacucaauuuuguuucauugcuaaauauauuacauacuaggcccaacuaaaaagcaaauaaauuuucuauauuaaauuccuaccuuccuucagagagcucaaaaccauuuuacauccacaacuaccacauccuuucuuuacccccuuuccaaagaagcuuaucuauaugcuugacagucucaucucccucguuuaaaagccugauaggauggacucccaagaaauaauccaaccccugacaauucucaguaccuagucuuauacaacacccugcucagucaccuccaagaaauuuccccacccccagauaaaauuaagcccuuuaugcucccaaagcauuuuggguacacauacacuccaacgccuaccuuguaauuaacugaugugacucccccaauaggcugaguugaacaaagacagaugugguuggugacagguucaauucuagcacaguaccuggcauauauuaggugcucaagaaaagcuuuaccuagacagagucucuaacucagugucaucucucuuuggaugaccaacuuggaaauauaaacauaaggcuuucaguugggcaggccaguaccauggacugcugcaccagaaaaccuacucaauggcuucucccacucaguuccccagaacccaaacuaacugaacacaaucggacccauaagaaucugugggaauuuccagcauacuacaauggaauugcuggaaaauccauuaaaugugagcuucuuacugggguggugggagacacccaccaacauucuucccuggguaacuuuaguggaaauauuuugaaaacaugacuggaaagggcucaagagccuaaggaugugaggaaagccaguuaacucuuaauuccugaaaaaaauagcagccccugagaagaaugaggaagaagacaggagucagggcuggccacucuacuucaauaaauaaaaucuuuuuuaaaacucccuaugaccccaaagaaaaggccagcacaccaugucuaaaugagcaauucagcaaccuuucggaacaagcacaauaaacugugucucaaaaauaacccaaaaaacaaaaaacucuaccuugccacaauaggaaguucuggucacuaauacuuuuaauuuuuuuuaaagaauauaugcucaaguccaacacucacacuagaugacacacagacaaccugaaaacuuuuuuaaagggaguuaucuuugcaaacagcacaacuugggaaaacaaucccaaaauacaaagaacuccacaaaagauggcuuuaguuucaagaacuguaacugcuauuauaaacaucucaccauuuaaaaaauaaaaggacuaaaaacaaaaaacaaaagaaacaaaaaaaacccauaaaacccuuagcugccuaagggaaucuuucguucuggaaucacaaaaauuaaaaaagaagaagaaagcaagcaaacaugaagcagaaagcaaguaacuuccaaaauaaaguucuauuaagaaaaaauaaaagauaauuccgucccuaagccuuccuucuuuggugaggucugugauuuauauggcucugcucugcagaaagcucuuucuggacagcucaaggaaggagcugagggagggagagaaagacacaggcacagaaaggagaggagagagaaaaagaaaauggcgcagagacuaagucccgaccgucgacaaggcgacuuucccgggaagaaucccggcggagaaaggccgcccgagacccagcgacggucgacgcggggucuccggugcccccucuggagaaggccgugaucugggggugcugagaccccgggaaaggggguccagaggcggcccgaugggaacaauggggccggugagcgaggagccgggacuuagucucugggacgccaugucuguccucugcccggcuccggcccggcgcgggggaggcaggcagcggcguguggggacacuuggggcggggcggggggcacacucaccauucaaucggaaauccgcuucgaucugaggaaagaaaaggagggaagaugaaacaaccggcacaugaagccccggggcggcggacgagagcgcgcggccgggggccggggcucgggcccacccggcgccccggaacccagaggcccgcgaauggccuacccggggcugccauccccccaccaaacuccaacuugacggcuccgcccgggacccggccauccaagcgacuccaaccggccgccccucaucgcagacucgggccugucaacccggcgcggccggcuggggcugggaccggggcccuggccggggccggagccggcccgggcccgagcagcuggggacgagucgggggccggcuggucgcaccugggaaucguuguggagaugguccccgcucaugucggccggcgugcgaacgcugcgggcucagaggcagcgcgggggaagagaggcggacggcagggacggccugaacgggcggacgaagcuccugagaagcacgaacagacggcgacagcagccaccggcccgagacucccgggacaguggaggaggcagcggcgguagcgacgcgacugacagacugccgggcgggcggacagcgagaacagaccccagcaguuguguaacagccuaaguucgcauuuccccucacugcgccugcgcggccgcuuuuaaaugggacgucgucgucgacgucagcgcucguggaaagaggcugaggguugcggcgggucucuua

SEQ ID NO: 1242 - RNA, 44471 nt, Mus musculus
cugaugggcaaccaagaggaaugacaguggcuuguauuuuugugcacaucucuggcucuaugaccaacaacucauaaggcauuaucucacauuuggccucaccaaaacaaaaaaacaaaaaacaaaaacaaccaaacaaaaaacuagcaaagcauccugcugaacauucacagcauccugaggugagcaugaagaggcuuuccugguuugguaaaugucugcuuucugugcagcaguccucuuucaacacagcaggcagccugggaacuauggcccagguugcugguguggcuuauuuuugccagaggguaguaaugacuuuguccuccaaaacuugcagcuugccgcauuuuugccaucauagaggccagcaucuucuuagccacuggguauuuaaagagagcacuuccaccuuuuggcaaaccagacauuuaaagaaucuuauguuuccacagagacaacacagcagaaacuucaauaaccccacauaugaagaguacacacuugacaggaaguuuggaaaaaaaucucaaaacagauggcuccagcccucacugagcaaaaauuaucaauucuggaggcuaagagaauuaaauuuugaguuaccacauaccauacuuagaagguccaguuuucaauagaaaauuacaaaacagaaaaaagaaaaaguauguccauuaacagaaaaaagagauugacacauagcuucccuugaaaagucgaggcaucgacuggaaucacugauuaaagaucuuagaucugccuucaaucugcucagugaaauacaggaaaccaugagaagaaugacgagaaaucagggagaaaauggaucaucacaaugacaauguuagcuaaagaggcacaaacuauaauagcaaacacacucuagagaaaaacaguauaaucacugagacgaaaaauuuauuaggcuaagcaaccgauuugagcaagaaggaaggggucagaggauuugaagagaugaugaaauuacccacaggcacagaaaacaaaauggauaauaaauagaaacuaaaggggccugugggacauagauaaacacggacauguguuguaggaauucuaggagaaagagacaaaauaucuaaugacagaaaacuuuucaaauuagaugaaaggacacaaacauacacauccaaggaauuagagaacucacagcuugucauguaagggauccucaauaagguuaguggcugaggaaggaccaucugaaguacugaaagaggaaagcagcuaagucauuuccagaugaacaaaagcaaaaguugguuguugcuauagguuguucuacuggagaugcuaucaagaggccuuuguguagaaaugaaaugauagugaaugguaauuugagcccacaagaaaaaauaaccacaauaaugaugauuuuauagguaaauauaauaccaguguuauauuguuauagcuauauaauuauaguuaguuuguaauuuuucuaucaucccuguaugauuuaaaaugcaaaccucaugaaaaguauaacucuguuaauccaauaggaagaugaaucugcaguaaacagcauggucagggucugucuuagucaggguuucuauuccuacacaaacaucaugaccaagaagcaaguuggggaguaaagaguuuauucagcuuacacuuccauacugcuguucaucaccaaaggaagucaggacuggcacucaagcaggucagaaagcaggagcugaugcagaugccauggagggauguucuuuacuggcuugcuuccccuggcuugcucagccugcucucuuauagaaccaagauuaccagcccagagacggucccacccacaaggggccuuuccccugugaucacuaauugagaaaaugccuuacaguuggaucucauggaggcaucuccucaaccgaagcuccuuuuucugugauaacuccagcugugucaaguugacacaaaacuagccaguacagggucugaauaacacggaaagugaguggugucagguuggauuguuucaaguuuauagcauuauuaugauccccaaguuaagcaauaaaauaacaaaauacaaaggagucaaacugagcacacuaagaaaaguaaauauccaaaaugacaguaagggaggguuuaaaaauaaaaaccaaauaagacaaaaaaaaaaaaaauagcuggguggcaggaauucuccuucuucaucaguaaucacauacaaugucaauggauuaaguuguucuaaagacaaagauugccauauuggaccaaaaccauacaggaaccaucuauuuacuguauguaaagauucacuuuaaauacagggacacaaaagaagucaaagguaaaggauagaaagagaauuaccagugguuggagucuuuacugagguguuuccaggucucucucucucucucucucucucucucucucucucucucucucucucucucucucuccccuuuucugugugugugugugugugugugugugugguuuuucaagaaaggguuuuucuauguagcauuguuuguucuggaacuugcugccaggcuggccucaaacucacagagaucuaccugccucugccuucuaagugcugggauaaaaggcgugugucacuaccacccugccuaguuccuagucucuuauccaaaaaccugaaaaaucagagaucacacagauguacagaagcagcaagauaacuccccuccagggagacacugugaugauugacaauggaccucuacuggccucccaagcugucauguaauacacagacauacaugcaggaaauacacccacagacaugaaaauuauuuuuuuaaagauaaaaaauuguuuuaagauuaagauguuuuguuuuuagggaaaugcauaugaaacaauaaaggucuacaaugagauucuagcucgcacuuaaaucagcuguuguuaauauguacacagacagagccaaaggcauugcugaggagguggggagagccagcucccugauccacugcugcuguggauguaaagggauuaaaccuuggaaaccucuucagcaggucucaagaaacaaacacagguuucucauccaauccuaagucucacuccuagcacugaaaagagggccugaacugacacugugacugaauauucaaagcagucgaauucacaagucuccaaagaaggaaacaagcuguauacauuaacaauacaggaauggauaaaugugccauagauggauggacggacagacagauagauagauacacacauauacauauguaauauaauauuauucaauuauaaaaaagaauacaauucugauacacugcauguggauggaacuugaacacauaaugcugaguuaaauaagcuacucauaaaagagaaauaguguaugauucuacuuuuaugaagucgacaaauuuauagagauugaagguagaauguaagcuucugagaagaacugacaguuauuauauaauggauacagaacuucuauuuaaauguacauaaaacuagugagacauaguguggcugugaugagaaacuguguguuacguguauuguaccauauuaugcuuuaaacuggagacaagaugagugaguguaacaggcauggcagagcagagcagagcagcaagggcggccaaacccuagugguagcuuggccuccaaggcuuggcuguuaucuguaccauagcuucuugugcucuccagccagccucaguagaaagacccugucuguaaacaugggauaagagccugugaucagcugcccugaccuugacuuccaacuugcaagguguacaugagaugucagagcucagagcucugggggcaggaggcaggacuuuuggaacacaggguuaacaggcaucaugggucagaggccaggaugaugggcuaggugagugacaggagccuaagaugucugaaggccuuguccaacugagccagcaucuuguccuugacccacacucugcucuuucaccuccucucaggcuggaggggacaguggccuggcauuccucguggaauuaaggaguccccaacuccagugauaccagcccaggauagugaggauaggacaucccuggggacuguacacguuguagcugccauggagugacagguauguguuuucuccucagaagcagacugaauuugaucuugauuacugugaaggaccggccagucugggaugcuguaugccauguggaagggccaaaacugccacauaucaucuugauggccagcugccaggcaccaggagagccucuggagccucgcugaacccagaaccugccaccgccccaaccaccuuccgccugacauuucugagcaaauagcaaugguuucucaucagcccaucuucccacagagcaggaccuuuccauggccucccagggacaauucagauugcauauaccuagacccagaaucaaguuguuagcauauacagcugccuauauucauuuaauaaagcauacuacuacagacauuuucaauacauaggaacucggguuaccaaaacaguacagcucugacaaugccaugucuguuuucugggaagcugagaccacagggacccucauccucugcaacagugggagucccaggcaugcucagaacugcaccaggccuggcccuacuugucuucucaagggaacagauuguuggaagagaucucugcaucacugaguggaggcaagccacauuuugugccagacuugucuuguguucugauugacaaagagcccacuguuaccuucaguucugaacacaaccaagcuaugacauuaccauuggaugcuaaccauucucuuuaguuaacuguaauucugguuuuuuuuuguuuguuuguuuguuuuugaguuugaaucauggaccaacuucuccauuaucagaucaacuaaagaaaccauuguuguaaagcccaaucuacugaccuguagcucccuucagcccuucaauccagacuccuuuagaacaaaaggaaagugaucaaaguagagccaauugcuguggcuuuggucaccaaagugcucaaugccuccugcaggucagaaggaaauacaugguggcuggaggaagaaugaggcugaagggcuugggagauuugaagugacuagagcuacacuguucuugaacacaaagaccugcaggucagaguuccuggcaaaaugccugucacacaccaagggcccuggccagcuacugguuucaugauccagaggugcugggcaucacuggacagauuccugugaggguguuuuuaaaguuccacauuuauauucccaaccugagaaacaaguacucuaucuacuuuugccuaagccucaugucuuuuuaauuaaaaucacaagaaauggugccuuugaaacaauggaaaacuugcuuagggaacuguacuaaacauuaaagccccagucucaccuaggcuggcuucucugagagcaguagacaaagcaggguaggggagggaaagaugacaaacaggaugugucaucauagccccacuuaccucuuggagauuccaucaggagacccacaggcagggcaagagcuuugaaaaccaagaagcaguggucaacuuccagguguucuccucccucccuucccaggggaggggaauagucugaggaugaacauggcggccuucagccuuuuaggaaagagggcuuuuuuuuguaauccagggcccuggaaccauuauaaguuguuucuccugcccuuccuguucccauagggauggccucacguuugauuggaauuuauuauuuuguuuuauuuuugggguuuuuuuuuuuuuuuuuuuuugacuacuuggcaaguuuuguugccuauuuuuguauccuuucuguuuggggagggaagcuauuuggccccaaaccuugaggaauuggaaagaauaaauggugagugauuguuuuucuucagagaacagaagccugaacguucuccagaacauguuuguauaugugcagauuuacauauccauauauacaggacacauacuuauuugauacuuuauucauaaaucguacaacugaugugcauuugagcuucauguggaugccuagggggaaguagucugugugugaagagagaacaguauacugggcagcuggagcagcaggggaagccaucuccugucuaagaagcaugugugucucaccugagcccagacgccugcugggcuucuccuccagagcccugcugcacuagcugaacaguagacuauaaaaaugucugaacaauguacauggaacagaaacauuacguuacuugguggacauuaugcaggacacagagagcagccuggucucgggcacuagguagucuucuggaugggaaguugcaguaacacuggccccagcacaccuuucucagagcugguaauggcaagauuguucagguaagaaacaaguugcuuccuuugcccuuggauaggggagggaaguuguggcuuggaccuuguuugauagauaauggugagggagguggucauagcguaggcacuccagggaagggcuuuggguaccaagcaugggugcacugacagaggaguugggguguagguuggcagauaccaggucuaugguuacuaugugacaucacaguggccuuguacaguuggaggcucaauagaaggcuggccguggcugcugaggugggguggaaugugcuucuccuaacaaggugugcuuugugacauggugagucuugcccuaucuucugcacucacuuggacuuaccagaggcaguacauucuaagugucuuuugugcuggucuuguauauugauuuuuuucuacucauauaugucaguucaguuacagaucagaaccaacucuaacagaaaccuaaacuuauacauaagcuuugcauauuauuuguaauuuuuugaucagauuuuuuuuucuuuugguaguuggguguguuaguguugggaguccuuucccuagaugacuuugaggucuacuagugacgguccuugcacuuuucucuuggcugggugucagcagcugccagugaacaaaauaccuuagcacgagggcacccuccccucuggaagcacaaggagaguugggugggaccugguagguagcuaccuguauccuaagucucucuccagcugcccuuggguaugugcuaccaggaagcucagcugcauucuccagacccagauggcucucagagauuuuacuuguucugacaguagcuaugucauaccugugucccuuccucccugcuggcccuaggacaucugucacacagcugccuccuguggaggguagggaugagggagcaaccuugcugguuggagacucguuuuguccucuaggugaguguugagcugucccuaucuugagccauuaccuuuugucuuccuaguuucuacguggaccaaaacccucagaguggagcagcucagucagugccacugucacagcccaaaggcacuuucugggaagccggccaaggaaauccuaaaacaaaacuuagaauuuguguuuuuacuaaagccacuuugcagaugaaguucuaucauauucauuuguaaggcucuguuuucugcaguagucuucuagauacauaaaggucuuuggucagcucauccuauccaaauuuuggcaugcugccugguuuuucuuauacuagacugaagccuuuucgcuaacaucccugauuuagccucaucuucuccuauaagagcacaccguucaccaccaaccugcccaaaccuuuaugagcugauuuccauguguuauagcacuggagcccacaggccuuucuaaguacaggucucccaagacuugagccugaauuauccacauugcaguuucuucugccuugguucaguggaguagguagguugcugcgcucuauccucuagggcuaauaaggcuguugagggucuucaguggaauggcuggguuuaguuuugacuaaugacagaacugacgaucguacuaucugcuguuuacaucgcuuacuagcuagaaauccaaaaggaaugggguucucagagucuguuucugccaaaaucugugaucucuugugccuggccacuagggauggcuggcaucuagguaguggcaagcccaaauguacuuuccagaauuuguacuuuguuguggugugaaagcagcucagagagugaauggcccuaggacugagcgccugcuuuguucugagugcuuauuaacccagcaggccuaugaacuuggucccccagacuggaaagccaaaacaggguuuucuaguucugagucuagcaggaacaccucuucccaacucccuaaauucuggagcagggauguaaauccagagagaacacuugggcugccuacuacagacuaaggcagauucugguugcuacaaggaagagguaggcacccgcuuccuugguucuucaggcucuuauggaugugggacugaauggauucagugaaguuaccacucuguugucucuucccuccuugaaacauaccuugcagcuacucuggcaggaaccaggcagaagagagggaggacagcuauuuggcagggacugugcuacauggugucuuccugcuguugacaagggugggcaaauggcaaguuagaacaccugggaggggcuugcacauuuaccugcuaucagugccacuuuugucaagagacuggcauacugugcccacagugggcaccuguauguuaauagcuuuucuugaucuaugccuuuugacacauguucccuuccauggaaagugggugauucaguuuauucagaacuugaguugaagguaaacugccuaggauaaagccugcucaaucacugaauauaaaaagggcugccagugcucuguucucccccaaacaagcaccagaagagacauguccagugggcggaagucuauuacgugguccugcuaaccugcaguuagugcuucggaaagaucuugccccuagcuccuguccacacaucuuggucuuguucuuguagccccauaugagaaggcuggcugcagugagagcgaacucccauuccuuagcaggauuccagcacaaguuagguugcucugugaaaugggugggccgagggcaggaguggucacucagggcacuggucucucucccaugcuucugaguagcuggcuuuguucagcuuugccaggaaggucagacugugucauaauuguuauuaaacacagaaaaugagccaacuuuuuucuggcccuugcugacuauuguucuuugaguuguccugacauagcccuuggggaaauuggggaggcagccaaagaccugcaguguccuugcugacaaugucuuggauccugguccccagcaccugcuuuguguccugaccucaguguggacggcuuuguucucagggggcccgacugcugagaaguacggcugggggugauuugaacagucugccuuuggugugcuuccugucucccaggaacagcugaagcgacuauccuggugcuaagugagggucaccugcuacugcggccaacuaugaaagcgaacuaagaaauagcauauucugucacauagaccuauguguggcccuagcuggccuccuaccugccuggucgacucacuguguagaccaggcuggccucagacuugggugcucuuccugccucuaccucccaagcacugaguuacaggcaugggccacaacuggcuggaguguagaaauccuucacccugggaaacauuggaauagaaagacagccuuugcuuuuggugugggcuguguguggugggaggugcgaggaugaccucuucugucugagucucgggccucuuaaggucccccauggggaugcugcuauuuccaagaugcaaauugcacauuuccuagauuuuguaucugcaaauauggauaagggaugggaugagggacaaaacugcuuguguaguuugaaugggccucggcgguacuuccaaucuuuuaacuguuccuaaauaaaaauguacagacacuucuuaucugcugucuuugugggggggagugaauuaauaaacaaaaaucuaaaaucccuucuauugauuuuugggggcaggggacaaaucugacccuuaaaaguaaauagguauuggggcuucccucagcuccccagggagauuccaguuuuuggaauucuuugucuucugcauuccugaacucacugugaugcaaaacugucugcguauaaagcaagucugaucuuagagccaugaacuguggggugugagggcaugggcaaguuuuccuguguuccuuucuuuuucugugugagagaagaggugucggugaagcaugcuguuugcuaaggagagccugucaccgugcagaaggacccuggacccuacuagaggaccagugucaucccuacaccuccaagccucauagcaacugguuguugcuaggaugcucucauuggccauaaagaaaaggggacucccaaaauaaagccaccugagugaagugucaggaucugcucuugaucugcucuuucccaaggccagcucagguccuaaagaaguuguguguugaaucuaacagccaggucauagaacuaacuaaacuagggcaauaccauggaacuaucucuugaguccuuggugggcagguucagaacacacugguggagacggcaggaucagccugcagggagcuguagagucuuccugauaagacacagugacccauggauauaaauccucuggggauuuauauccuagguggggaaagccucuaagggaaagaugcacuuaacuaaaauguaaggcaggucugggcuuguuuuggucacuaaguuggugggguaaccucacacucacucagcagaucugauauggucgagguaaggaauaaguugaaagacaagugacuguuuagucccuguccucagcuaaaguccagggugagucuggccccaagugaggccccagcucucucuguuaggggcacagcuacuugugauuuuucuuaguaaaggccacaaaauguuucugucuuuuaaucccgcauuucaguccuauaccccugaagucacaggcagugacuucuuuuguuaacguguuuucacugguaacacucaguggucccucuuuacuugucucuggccugcuagccaaaaggagucaucucuuggcuuguauuccuguuaucacugccuucccuuccaaccccacucuuuugguuuccucugccaaagauaaugguucucaaccugacuucucauuuucaugcuccagggagcaaagcccugacaacaguauuucucagauguaccugaggguguuuuuaaacaaugcuuggcugagauucuacaggucauaacccaaugggugcaaagcaguguuaaccaagcugucacauguagggacacacuggaugaaucaggcaagacagccacggggcaccaagaugggucuccuggaucacucaacaguagucagguuuaccugggggauuuaaguaaugaaacugauccuuaaaucuacuccacugagaagaaaccacuaccugaagggaaauaugguaaggggacaagacgugugaaucacgguucugugaagcuguuuaggaggcagugcugagccucucugggagacuugcucagaaaaaggaaauuaagaugcucagcaccaagcaaagcugucauguagcaguacugaguacugaaaaacauggcuccuaccuucuccugggccacaagacucaaggaugaacucagagagucugaggaccugauacacuccacccaccauuuccugugugugaaaggaucccuccccucggucugugaugggacaggaaaauuuuccaucagugguugucaaccuuucuaaugcuucggcucuuuaauacggucccucaugcuguaaugaaccccaaccauaaaauuauuucacugcugcuucauaacuaacuuugcuguuauaaaucauaauguaaauaccugauauguaaggcaucugauauugggucccaaagggauuacaacacacagguugaaauucacugcguuagaugaaagcuacagacccagccaucacccaaauacuuaugcucugugaccugagccagcuaguucagcacaugguacacgcugcuucacuguggcaugguuuuguccugcuccagcaaagugcugcagcaaagccucaggaaggaauaggccuuccucagcaugggaggcacagagguucuaacuggcagaugaagaggcaaacagacgcaccuggcagcacauaaccaaaugcuacuuuuuugaaguagguuucugugcaauggagacugagcuugccccuugauggggugggcaggcuucaacaauaccauuagaagaugggguggcagaggggccucacauuuuagagccacagggaagagcugugugacuucccaggucuccagggauauuauaccacacuugcuucuauucucaaucaccauguucuccugagcccccaagaaacaaacaaguuaaaagaaaaaggacaugaggaugauuuauuuggcagucagaucuuaagagggcagcagaacuagcaaauggccaacccugagcccaaauuugggcaguggguuugcgugugcugaugcuggcuaugcugaggcaccuuugcacccacaggccuggaccccagccucuguucucagagguggggcuuaccuucccaaccuucccaucuccuuugcaucuuuuuaccaacugcauagaaacugcaccaagcagcagcuuaauuugguaccuacugccugacuccacuuaccuauaucuccauuccuaaggggaagcauaucgagucgucuuugucauaaaaacaaaaaagcucaccaggguagacauugcucuucucucuuccugccccuccacccuucuugacagugcccucucccaguacaacaccccauagagcugcuguucccaaaggcucugugcugggucuucccuuccaaggugaggagcaggacagaauaacuuaguuacaauaccacugagaagaaaaaaaaauuaauacugcuauuuuuaucaugauccccuguaucuuucaggcuggguaguguacccagccaugggcaaugugcccuugugcugugucuuccuccaugggcagagcagagccuucucauuauaggcccugcauuccucuguccuggcuccagggccaaacugcagggcauuuacucuuucacccugugguuuuaaagcuacaggacaauguaaacuuuguuucccuggcccaccaaggcuccuccuccuucuccuucuccucuuucaggaaugugucagcagcuccuugagaccuccuaugccaccaacugaggcaacuucucuuuccaaggggcuucagcccuacuccuggcccaagauggaaggacccaccuccacauucagggccagaugugugugcuuaauucgagacacaguacaguuuuuugccuucacccagagcugggcagggaggcccaaaacaauacauaucauuaauggcuugguuuugucuagccuucacugcuggaauccaggcuccaggcugugagaccaagaaggcuuuacaguagacagcucccagagaacccaguucauggcauuccacagguggacagcaccugcugcucuccaacuagguggggucugacuagaggcgguugucuccauugacccgaguccuucuuggggcccugaacagaagugaaguguccuuacuggccuugcagccagacaggacaacccaagacacacgguuaucccuuuuccacagaggagaaagcugccaaaggauugaucuuucuggcuccagcacccuuccuccaaggucccacacuggcuaacuuccccucaucucccucaccuucguucccgacugucaaaauggucugcuagaugcuccugcgagaugcggaaaucuucaaauggcugcugguaucuggcuucaaaggacccuucccgggcccggacauggaacagcuggcuggaggcaucugaggcccguucccuuagggauaugccacugaaaggacugaggucaccguucuccugcucagcaagggaagugcacaaaaguugaggucucuucugcaucucaggggcuaugacugaacucucugcucacgcugcuguaguuaccuuagcagggaaaaugucaaucuugaugagcagggaggccaacuccaggucuucacuguaguuguucuucaaaggcacugcucuauauccuaagagaaauaccuggcucucagccuaucaagugucaagcaaguggauaagccccauccugacagcaagacuuuauaaggaagauuccucaccugucuucaggccuuuuacugggaaaguagccugagccaagaaguucuggucacuaaacaugucuuccucauacaccacaaagcgcagaaaggcaaacucuggguuacugaucuggaaguggaagggcuuagcaggccacacaggguucaguccguuguccacugugaaagcaagggcaaaagcugaggccacaucuacgggaugugaugacugguggagaggucuuuaacaccccaggggaaugauggguaaugagggaagacugacuuaccuacaaacuccgucuuuugcuuggugcugucguacucagccccagccaccucaaucuccacaaaaggacacacaauaccccggccauucuucggcagaugccuggcccccagcaccugugaggcaggcaggcagagauggggugaugacauccccccagcaccccgaacauccucccagcagaagcuuggggagcaaaucguggaggaaaaugcaccauggaggcaguaugcccccugcugggcccugaaggugcugcccauuaggccgcucauuguucacuccagagcaagcuguuggcuguaaaacccugagcuuuagcuaaguaucaugcguacuuggcaguccauuucauguuaaauccaugucuguuccaaugugggaaucuuuuaaauuauuccacuuuagagggaauaucuggaaaguagcagucauguccaucuguggcucugugcuccuaagugugcucagcuggccauagacuauucuuacucuuuccagacuguucaggccaccccugcugauucccauagcgaaggcugagcugacccuugaucacagcauuucaccagacauggacuggggagcucuauucuaggaacugggaaaggcaaacaggcugcuggucaugcucuagcaagcucagguuuugcuugguccugcagacaggagccuggcucagcacaggccccuuuuagccugauuugugucauucugaccagguuuuuccuuccagguagugacuuuucacagguuagcuuuaacccgacauccuaacucauuugugccaaaaacuggccaugaucagccaugcuaccccugggaucccaaccucacagagaaccuguagcuggauuuccacuucaggugguccuacuucaagcucaggaauagaccaagauaaguucucuuccccaauguaaagcagaaaugcugcucaccucuggcccuguacccuuucccacuugugcugacccaccuggucgccaccuucuuagcagguuuaguaucaauggucuucauaacccuuucccacccugaagaacccagacaaauauacucaccucaaugcaaaugacacaggguuccagaccucggagacugcucuuaucaaaggggucaaaggcuucgucucucauggugcuuggcugcagcacauagccacaaugcccaccagccaugaagagggccugguucaucugcauaggcuugucugcaagagugggauuacagugugcuccaguggaacugcccuaagugucucuccccacccacagagacccccucaccuggggucuggaaauugagugcuacaagcuggcuaccgcagauccacaugggcagagggucauaauuggaggagucuagccucuggcccuuaggguagaugcgcgagagcugcagccgguuguacuggaggaacuucuugccuuuggccuuguucacauacuucucagccuugguuuccggaaaggaggacaugucccgguaacaagcacguucugugccaaucucugagccaaacagugagagcguguauagagcggcccccuuguguaguguauguaagggacaggguauuaaacgccacucucaagccaccagccccucagcacaugcacaccacaccuggccccagccuuacucucuucaucaaagggaacgggccggcaguagaccacaagcucggagagcuccaaggcgaucuucuuccuccucuccaucaucuuucccucagugagcuggugacacacacaaggcccaggcugagcccugcccaggagaaggaagcuccuaccagccuuggguacacacacacuucagguguucugaggcccucuucucuccuugcacauuuuaaauagcagcagacacuaaacaaaacuacuggcucccaguuuuggccaaaaauuaucucuuucuucgucuccacagauacacuuguuccccaacccucuugggguggaagucucaccauaacuuaagugccaaaugaccucacauggagcuaaggucggcaaggcccucccaauaaugcuuucugauuauucuuuaccuagccucguccuucagcaaaaacacugcuucccgguucccugaagcacuaaggccuuaagcccaccuggcaaugugugugccuuagacgaccuuaccaucucacguccccauggccaaugcagccuuccuccucccguucccgaucuuagcugcagccuacucaggcacuccccacacuguucuuuguagucuucuccuucaggggcuccacuauuuauaaucuuucuuuucauuccaggcuaaauccaggcagggucuagccugccagccacuggaucuuucaguaccuugcccuccggggcacacuaacaaaauccucagcauugugucuguccccagucacaaaucugcucaccaaaugcgcuggggggacaggcucuaaguagaagcuuccauacaucuacaaaugcuucgccaggcucaauggaagagggcuccuccagaaagcugguccuuccaaacaaauacaugcuacccacuauccacaaacuccaacucccacucugaacucccuacaacccacugccauccaaccuucucaugacacuaagacaccucaauagugucacuaggaauaucugcugcuuuuaaagcuacaggacaccauaccucuguggcccucagcauagcaaaguuccacuacuguggguaucuguaacuucucugccuccugucccagacccaugcccuguuacaaauguuuacgugaacccucuuccucucuucuaagccugaucugacuccugcugccagcccaggaccucucuucccucuugccuuacacucauucaggugaucgagaguacuuaaugcucaacauuuccuaagcccauccaucacaauccugucuugaguuuguucuuuugggugccuuaucuaaggccuggccacaucaguugccuucucuagaggagcucgcuggggguuggaggccuuggcucccgggcaggcccacauguugcccccacagaucccaguagcaccuucuaagcuguggcagguucucacccuggcaucugcagucugggcaacuucacggaucuuuuucacccaguccuguaacuccuccugugagucagcugcaacauccagggaccacugagccacugauggcaugcugauggagaagacgaagagccgguuguuuuugcccucaggacggauggcuguuggggguaaaauaauacagggcuaggaaugcucucugggcuuucuaaugcugugaacccuucaauauaguuccaaccauaaaauuuuuucauugauauuucauaauuuugcuacuauuuaugaauuauacuguaaauaucugauaugcagcguaucugauaugcaaacccugggaaaggguuguuaggccuccaaagggguuaaaacccacaguuugagaaccacagccauagacacuggcucaaaggaauucauuccauuucuuccuggccauacuuauaagcaggcaaaacugguauauagauccgauuuacagaggauacuguagcucagacauaccauaguaguuaugguggaaccaaggcuccaacccagcugagacucaugccucuuccuuggagccaugcacuguagcccccacccuaacccaucuccaagcuucugucacaaugcuguggucuaaaccauuaggacuggaugucagucugucaacaucucugccaacuuuugacuccacuguacuuggcagaggguaaaauuuggggaugacaaaagagucugggacuuccauaguauaagaguagccucugggaacucggccacuggauuccucuccagaagcaggaggagugacaaggacacccugacacuaagaggaaucaugagcuaggaauuagaucucaccgaucugacaagcuggcacaucuaagaccccucgcagcaagucccccagugggcuguucucauccaggugcuguaggaagcaaaaccccaggauggucagcaucgcugccgcaggcucagcugagggaacuuuuugacgaucuuuuaggucuacucaugaccagccaagcaugacauagguacaagagagacuagaguguagccacacaggauguguggcucacagaugacaggaaggccugggugugauagacacaucaaaagaaaaccuggggacagggaaacaaacccgugacacagagugguuccagacauaccucccucucaggcucuaggacugcuggauugaucaucucuuccacauaguuugaggggaaccacagcugcuucuucccaccauaguccccucgccaccuguggaagccacaggguacugacuccagcaacugccccaaacucacaagcucuuccugggggguucccacacauaagucaggccaaggcagacacugcuagugagcaugagacagaugcucucaaagcauacugucacaagugcuuucagugacagcuccacagaggccccggccuccugucccaccacaccacaggcuuucuagccuggaugguuuaucucaccagccaccaucuugcuuuuccacauucuggaugauggcacucuuggugaaggucagcucauccucucucugggccuuguagucgaagagggcuuuuacugcacacugcagaggugagacagugggauuggauuguguggaguaaagcagagggcaguccccauccuuuaaccuaguacagcacaugugcauacaugugccuacaugugccugggcuuacgcuagugggcagugccacuguuggcaagugacccuagacacaggucuuaaugcugucuugggguaaguuucagaacaagcaggauggguuuucuccagggaaauucuuggccacccagguagagucuuuggcacucugucuggggucugcucccacaagccagggcugagguccaguaagaguaagugcacagcccuguggagcucccuccauaguuaagacucuuacagggcaaugugcuacauuaaagaaaaggucaaaaccaagaagacccuaagaucuucauaacgaagggaaugccuggacagugugccaucuggccccuguucuacuuacuacccauggaagacacggggaucacucugaaggaauggugacaaagggccaguucuaacccaagacacuggcuauaaagugguugaucccuggagauuuauggucauuuaccaaccacacaucuuaaaaucucuugagccucagaaaaccacaacuaacacuuguuucuccacaccuaccacaaaagggcccagaauacagaaauauaagccccaagcaguagggaaccccuccuuccuuguggcuuccugugccaagcacagauauuuaccuugaaaguuggcauaggguuugccuccacauagaaaccaggguugcggcccucguauagugccccauaaucggguuccuggaaacaggacacauugugaucuaucaccaucccagaacugagauaaaugcagcugcuagcucccauugcccaguuucugaagcacagcuggccucuucuacaggacauuugccccagcucauuggccccuggccuacaggaaucccccuccucaucuuccaaggggagggugccuguagggacuugauccacacuccuuuugcacucuuaccccacauccaccacuguggcuccugcagccggagcucccugcugccgagcugccagcaacaccacauacuuaauguuuguucaguggcugagcucacggucaggaaguagcccagcacaccucuccugacuucagggaacagcaugacccugaccagguuaucgugucacaacugacaacucgcaaccaauccugugugagaugccugccuucuauuaaaaaccacaacacugauccaagacccuugcacuaccaagccacggucuucccuccagagccuucccacagaacaaacacaucuauacaauuguaccuacucugccccauacacuccagacccaguccaugugagcuccuagaccuugccaccuaccgcuuaguucauggggacuuugucugaauacccaggcacggcucaggugccauuuccuccagcuacacaccauaguucccaguuacuccuagcgcucucaugugaacuugaaaauaccccaagaugaguuuucaacacauucagacagugguacauugugaauguccucuaacuauacugggaucccugccccccauccccgccauucucacagcugucccgaucuucuccagugccuccucguugaugggguagcguagcuucauuuugcgguacagggggugcuucucauaguagcugaugaggucaaccaggcugucaaacucagaguuccccagcaucacugucuggccuuccugcuguacucggcagugcuugaucuuucccucagcccuucacaaugacaggacagucagcaaggaagacagcccggaccccaacaagaacccacagcuguccagcaugccucaccggaaagagauggcauaugaguuaggcucauugcguuuccgcaccaggaaggccccaucccggggcacucgcaucagcauauguucagccugagcucuagucaggcuugcgugguaccaccugaaaaccaacagaguuaggcccuggccaaucaguccuaccauuaccccugcuccccucccugucccugcccucacucuuugcucucaugggcauucgucuguggaacaggcucugaaaggcgcaucucaaacucauugcagcgcagggguacuugcugauaaugugugaugaggucauagagagagucaaagacaagguuaucugucaagaagaacuuaggagucccagcauccugccgggaguggaugcggcagugcuggacuuucccauuccgccugagggaagacaggaugggagaggcgucaaaagcaggucagagcuccaaagaauacauaacuaggcaaggcauaacauuucaaaaagggaggccauucuccaaagaagcuuggaggaagacauacacaucaaacauacauguuuaaguucacacaugccuguguaagaaugaauuguguuuuauggaaaaccuagacccaaggcuaaaauguuaaccaauuaugucuagguauaguagacuaaacauggguauagugcuggauguggguuaccagaaagacagcguguagucacccacgaaggucucacuuucucgcacuaggaaggagccaucaggagccccagucucuaugcaguacucagugagcaggcgcucagcaaugugccgcccgucacguccagccccgagcuucccguggaaccacuucucacucgagugcagcucugugcugcugcuggccuagacaggaugacagcaaagauacccagugacugucacguucucauucagcugaccccaugccccucaacaauucuaccuccuucggcuccucuucauccucauugcccuggucacugcuggucuccucagaguaguagaucuugcugcuagucagaacgaaguaguggggauaccacuccuggaggagaccaaaggggaccuguaagccagaguucaacacacugccccaccauguccaggcucagcuagaccucacaugauucacgggguccuccaaguagaggauaccauucuugauggaguuacugaugucauucucggaguacaucacagagguaggcaccuccucauaggcacugcccucagccagcuucuugugcuguggaagcagaccaggucauggcaaaaaccauuccacaccuagcccaucuccuaauucaagguuucuccuggcaacgaugucacaccuuaauaaggaucuuccuccugagcugguugggagaaggaaggccaucagcagcaauguccacaggcuugguaaggagugugucgccaagcaccuuucugaagugcugagccauguuucucugcugggcaaugcugcagugguccucgauggacaggaugacuggguaccugaaggcaaagggccaggacaguaacacugcugcuacgguuauugugauucaaaucucaguccaaacaguuccuuacagagugaaauaaugggagucaagggccuggggcaccuuauccacaggaccccucugaagagagggagcccuggaguuggggugggggcacaucaggaggcagugggaaccaagaagaggcaaguguugcagagggggagccucgugaguugcuggccuagcaaaagacauuccacacaaaauaggucaggaaggaugagaauuagcccccagugcagcuuguggauccuuucagugcaguggggacugugggccugguggcagcuagcaacugagauggcucauaggaaacauucucuucugggcaaugaaggagauggagauaaccugagaccacagcuacaggcauguuuuugagaaugagaugcacuucagugcuacccagagaagcagggagcagaggcaagaacucaggaaacuggcuggaguaagagcagaggagacuggaagaaugggagcaagccaugcaagcaggggauccuaggaguaaaaggaccuucuggaggcugcccgugaucugcacgccuacucacucugaggcuacgaaagcaugcuccuugauggugugcaggacgucagagaacuugaucuugguggugagagugugcccaugguaaaugacuggcaucccaucuggcccaucccagcaguccacuagagaacaauaucacacagucaaacaggcaggccucucaccuucccucuccaaaccuuagacccaacguacacucaaugcagcgacagcccauccucaggcagcgagcauaggcuuccagggaggacucacuggagaacugguccccagucagguaccuggauaagcaaggagagguacauauggucuggagggccuuccucccuccuuaggaaggguuggaugagcaaaaagaggcuuacucacguauuaugugaggaggagauccaauagugagagaguggguuguucaugguguccgggcacacagcauccagcugugaguuccacacgcuguucucuuuggagaacaggaaggugacaagcuacaaggauaaauguggaggagaaagugaaugagugcuggcugccacuugggauggaaguagguacaagaaugugcugagucucgacuccacuggcaaaguaggcaguagagugcaugcacagcuuuuagagcacaggucagcucuggucacccaccccaccugcuuucucuaacagaauggugggaaaggugaggcucaccucauccaagaagaaguauggcuccucaaucucucgcaaggggucucgaaggaagcugagcaugaauuccugcaccuggagccggucgacagcccacagcuccugccagguaaagaagucauggaggaggccaccaaugaugaagccacccugcagccuaacucccuggcccagacauacccccugguauucaaggaggaacugcuggaacucagaaagggacaccuggcaaugcuccggacgcucuccaguccuguagggagaaaaccuagugucuggcacuggcugacaaagggcccccgucuaguguagauacccagugguuuauuaugccccauccccaucuacccacugcuucccaccuggaucugaaaccacccagagaaaaagcccaauuggcuguuccaaaccaaaccucaaagcguugguuuccaagaagggaagguccaucugcagagaacagaaucuggucaggaggagcccugggaggccaugcaggaaaggggcucuuaagaaaaggcuagggagcagaugccccgggggagggguguguguggcuagaguaauggcaccaaaaccacuccaaagcagggcagcagggcuaugagagaaggcagaggaguugggccaaggacagggagggugggagguucaugcaccgucuucugggcgcuguacaugaggcugcgguacagcugagcaaacugcccguaggugauguccccgcugcgcuguucaagguccuacauaguacagagcaaaacugccagucaagccccuuaggaggagucacuggccuccccuuccuugccagaggauagccccaaguguccauuaccgucagccgcucucggaggaagcgcauauuggggacucgguaguugaccugagacagcauguucuucaaguccuuggcugauauacuaaggggagaaaaaggauucccuuuugacuuuaggcugaaccuaaggauggacagguaaacaccuauacucugggaaccugcagucuuaagagcaacacucuuucaaacuucaugcugugcuagauggagcgaguuccugccuuucucugggccucaaguuucugcagugaaagagaaaaagcccaauagccacaagugaccaagcucaggaaagcagaggaaagcaggucaggcugggaugggaggcagaauaagccauuuccagcaguugcccccagcucugaucugcugccuguacagggcagggcagugcccacugccacuaacggaggcauccuaggacccacaguccccaggauagguagcagggaagggagcgcgggcacccuuagccauguguaacugcugcugcugagcacacuccugaggcuccaggaaaagaacucagagagagggacagaagggaagagagaagagggagaggagagggagacagagagagaagagagcaucagcgcacucuacccucuaagcauagcagcuuggacaacaacaggaugaaaaagcuggaaaaggaugcucuccugggaggagugggugcuggagagagaacacacccucuucuggccuaaagccaggcacgaaagaccaaaauucccuaaggcucggaucuucaccaauaauugaauguccuggaacagguaguucccaaaguaaugcugcgcccuuuuaauacaguuccuccucacguuguggugaccuccaacuagaaaauuauuuuaucacuacuuccuaacuguaacuuugcuacuguuaugaauccuaauguaaaugucugcugugcagaaagucuuaggugacuccugggaaagggucauccaaccccccccacaggggucgagacccacagguugagaaccaaugcccuagagucaaggcucugcggggagcauugggucaccugacccucagucagccaggaagcugcagucaagccugucuccucccuuucccgcugucauaaaaaucacacugcucucuccacccugcccugcuuaauucuguguuuguugucccuuccccucuaugcaaaacuccuuuuuuaagaguauuuauuuauuuauuuauuugauguaugugaguacauuguugcugucuucagacacgccagaagagggcauuggagcccauuacagaugguugugagccaccauguguugcugggaauugaccucugagugagugcucuuaagcgcugagccauccguccagcgcuauggaaaacucucacaagacucaccugcaaucuccucugccccuaagcugcucaccacggacugaagcugcuuuccccacaacaugacuacucagaaggguuaagcauacuccuccuuuccuagcuucccauguggaagcagucugcagcugccacuuggccucuucccuuuucuugcuaucugggucccugaguuuuuaucuggggaccccaagaguuuccauuucaccuguccacaguccuguguuacuaccuccagcccgaccuccucauuugaacucauucuaccagccugguaacuccauaccucucuaccugggaaucuauuaugcaccauaaaacuuacauccauacuggacccuaagcucccacaguaaguuccucccacugucuucuugucucagccaauggcaacuuuacuucccaguugcgcaugucaaaagccuauugaucucugacuuuuuagaugcaauuuuaaacaaagaacauagcccaaauccagcuaauuccuacuauuauuaccucaaccugagcccucucaccuacacccagaauggucggacagugucuaacagcccucuacagcaguaugaucuugguuguguuugccuaguuuuaugucuucuugacacaagccagagucaucgguaaaagagagagcuucgauugagaaaaugccucuguaagauccagcuguaggcaagccugcagggcauuuucuuaauuagugauuggugugggagggcccagcucuauguugguggguagggacaccucuaggcugguagucguggacucuauaagaaagcaggcugaguaagccaugaggagcaagccaguaagcagcaccccuccauggccucugcaucagcuccugccuccaggauccugcacuguuugaguuccugagcugguuuccuuuggugaucaacagcaacgaggaagccaauugaagcugaauaaacccuuaccuccccaagcuguucguucaugguguuucacugcagcaauuguaagccuauguaggacacuggggaaacucuaggucagagcaggucacuccucuacacaucccauggcuuccugccucugggggaccuugcaacaguacaaagcagcacugacagcaggccaucuggucucugcuuccuccagcuccuggugcucuggcugcauugccaguuacaccuagaaguccagcacuaucucuguaccccacgcucagcagcauggacuacuuuugugucagagccccuaaccccucccaauguaacucaguucuauggacccucuggcuccaaugcucugggugccucuacccacugguuaggcauccgccucagcuuagcaccuaccgauccucucgguuacgauccacugaguagaacugcuuccggagccaccugaagagagaaaagccugagguaagggccucuucucagcuaagguaaagccuggguagaagagaaguuaccgugugcccaggagaccugaagucucugucucuucccuugguuccgagaugcacaguuuuaaccacaugaagacgauucuuaccucucaauuugcagggguguggcugccugcaguguauccuccauuagccaaguuaagcccuugauccacauguucacuucauccucagauguggcugugagcagagcaguggcugaaccaagggcacacagcucccacaagagcaagugcuugggcuccccuuaccuacaccccaccuccucucagcccaugucucccaccuugcaggcucagggucuucaagcggaauuccauuccauagaggaugacaaagcagugugauugaucuggccggaaggcagggucuucuugguagcggucaaagucccgagaagucuucccuggacggaucuccuugauuucucggauaucaacugggaugacgguaaaggccaaguucaagcuaagguccucacagucagcaucaaagggagcagagccugcucuccucacucacuuccacacccuccuuccucagggcuggaccacaaagagcaacccuuucugacacagaccgaacccacucaauuaucccaggcaacagagaguugggcuuaucuaagaguagacccuuuuguuguugcucaaggugaaggcucuuggggacaaggagguacauguguuacccugccuuaccuaucuuggggacaaggagguacauguguuaccccugccuuaccuaugucccacugcuggcagcgcaggcuacacacucagacccggaaaagagcagggucccaagcagucgguuccuugugagucacuuucuaacacaauacauacgcagacccagcuguaaaauccuagcgacugggcugggcaagucuagaucggucucagaauuccagacagaacguuggaucagauccagaaaacuggcacauccugaaacgacccacaccccagacaugcccacacaagucuuagcaaaaggccaaguugugguuuaggcccaggcuguccaagucugucugcugugcagcuugguaucauuaucucaguuacaaggguacucucaacucuuccccuaccuucacaagccaaggugaggcacguacacgagccugagguaaacgaucgauugguacuggcuacuaaccugagugacagacagacagagcaacuguuagcgagugaccacuaaagagcuaagggucugacucaguuucucagggaaaugggguaguaggcugcaaggacuagaauguggcucuacaucacauuagugaugucacacugugagucugagcagagacaacugccugaauccaccucaacaaggggcggagaagaacaucagagaggacgcuggcaagaccacaaguggcgccgaaagcauggaaacugugccccacaaaaaggggacuguuccuuagccagcauuuguucagauggggcucucagcccacucaggucugaaagauccugcuacagcugcccugacuguacacccacuccauccuugaacuagcugggagccuagacaaaagaaaacaacaagagagauucaggcuugacaaugagcuuucccucagcuugggaacuuccuaaaauguucugaccagucccccuucugaguaaauuccccuuagauucuaguucuaaacaccagcauggcuggagcaucccaaaggcuccaaccggcaccuggaagucuucuugucuugucccuugagucaaccacaguagccucaucugccccaccuagaacaauggcaacacuguggucccacccccaggucugcuaccauaaacagcacuagcuucacccuuauccaacucuguccccucagcaaagcccccaggucuauccuccagcaggaagucugagcuuuccuguugguggccacaguucucaccagcuagcuuuccuuccugucucuuccaaaccauaaaacauuguuuggacaccugguccuguaggcccacucauguuccuccugugaauauccacuaaccuaccaugagcccacucccuuuacagcuuuugagguucucaugauggggcucagagauuuaccuugaguuuuuguuuugcccucucucugaucuuuccaacccaagucaggccuacagcaagaacaacaaauguuccugccccugcauugcauccuggauccuggccucaguucuaccacuggauugucuccuacuagagauccaaacgggaagcuccauccugcaguaaucaucuggucaaugccucaggcugcuaugagauaaauguauguuccucacacuccaugggcgacagagccccuuccaguacccacugaaugcaaaagugagaaaaaugcaggcucauggaucugccaaggaaaaaggcauaggggauggagugaaacagagguuuucuauucaguucuacaaugagggcggagagcugggccacaaacccacaacuugauaacaguuucuaaagguggaaggaagagcucccauuaggaggaaaugccuacaucacacaccacacaaccacccaaaacucugcccuuugaaacagaaacuagaauauucuuccagugcaaagcuaucauucccuuccuacacauucaaccaugugugugcaugcacacacaccuacaugauccacaguuaaggucuuuccugcugcugcccccacaggcuguacacaauaagguguauacacaauagacagguagcuauaaagucugucuaaggcucauggguaggccauaugugcuugcccuaaauauauacgugcacacauggaugguguguauauguguggagagccaguaggcccaggugagcucuagccuguucuguguucuagacacauuugcacaaagucuaaguuagaacaggcauacaauuaaauaggaaaagcaggaaggcacagggcagagaggccaggcacacuccucuccuaagcccucacuggucacacugaccccuucuuccuccucccagaagaagacacagcauggcccugaugcccuaagucuaugaagucagaagcagacgagaaggaccugacagcagugaaaauggccuucaaggccacgagagcacagccugugucucaggacaaacagagagcccaggcucauuccuagaaacugccaccacggggaagagacuaccucaucagacacagccucugcuuuaguugcacaagaggagaggaagccugccagcccagccacugucugggugagaccuucuguaugucaggaaugacugugugugcaagugcaugugugcgugcauucacaacugcuuagauauucauucccuaugccuggacgagccaugagcuagcauucccuucuuccuaacaauaugggagaacagcauuuggaggaacauuagugaaaaaguaaguccaggauacccagaggcccugauguccaggggcugggaaaugaaaagaagauaugcgcugaaacaagggcagauuuccacaaccgggggccgugaugcaacaauggcccaacugcaggcuuaccauaaccugaauggccauagccagccagcacaaccugucaggagcuuugauauaugcacucuuccaaggacaagggcucugggccaagcgagaaggcuuacccgggcguuaggaauggccugggcagcaagggacacccaguccuuuacacuuaaucuuuauauacucuuauaaugaaaucaagacuugguuuuucuuuuguuucugucuuuuuuuuuuuagauagauagcccuggaucuugcaguucuccaaauucugccucgagagugcugacaucacuaggugugagcuaccaugauaggcucuucucaaaaagauuuaaauaaugaggagccaccuacaccuaugccagggacuaacaucacaugguagcucuaaggccagacagucuaguacaccaggagaauccugguggucugugcuccucagcaccccuaguggagaccuuccuacuccuaugcucucagaaaaucugcccuggucagacauuccugaagcugccaggccuggcaggaagaaccaagaacuacaggcccuucaauuccagcugugagguucugguagucccucacucuuucagauucaguuucccaagcuggaaaacugaauucuucucacuucacaagauaagggccuuacugauaaguaccugucugugagccuggugcuauugacagggguccugugaaagacagccauggggggagauggcacagcugccugccagggcucugcucgaagggcaaacucaaaccucuaagaguuuuucugaagauaaaggccaccggggaaagaauccaagcaguuauuucccagcucaaaacuggccuugcaggaugaguaucugugggguauaggucucauaguauaugcaaagaugagcuaagauacuauuuccugagucuguagcaaaccccacaguguaggcauguguucuccacagcuauaguccaggaaaaaaaaagaucugaaauugcaaagaugagcuauuuccuuucuggaucgucaaaacaaguuagggguacccacuacccaaacauccacuggggacaccaacccugaucugucccaucauuucaaucuucuauuuuggcuuuguaggaguugaaauguacuugccgccucucuuaaaucugaggcagaugauaaagacuaaauuuguaaaaucaaaguuuguaugaugaggcaggaacucugggaaggcuaauuaguguucccuuuccgucuccuuuccucucuguucugcuucuaacccagggacagacuccuaacuccuaacuccuaacccagggacagacuccuaacuccuaacuccuaacccagggacagacuccuaacuccuaacuccuaacccagggacaaacuccuaacuccuaacccagggacagacuccuaacuccuaacuccuaacccagggacagacuccuaacuccaaacccugagacuagagaucagaucagccuuacucaaaauguagcgucuggaagaugcucacacagacagcaagaaacuuuagacaugccagugucccucuaaaagacaucucaucuggggcacuccagaugagaacuaaccccaagcacucuaacagccaugaagguggcacucagggcugagugagggccugcuucuucuguagaauagguucuuacaccucaaacagggcucaacucacugaguaaacagaagacacagugcugacacagggacaagcuaaauagcagccagccaguccgcagccugagaaagggggaagaggacucuucuggugcuugguuccugaaagcagacucuucccagacaucaggcaaaugccugucaucaucucucuugcccaucacaaugagacaaccacgcugugcacccacugcagauggauguuguugguaaguauucuauaaaccagucagaguucaccagcaggaacaucagagaaagagaauaaaaagaaugggacacuaaaccuuuuuagaggucuuuaguacacaagccggagagccaagucacaaaaccccaaaacuuaauuuagacccaugguucugggccagaacuccuguccuagcauucccaccuccaacaaagccacuuuccaaacagccccacagaugaauaucccccacagggucacauggcagagaagguagugccaagacauacucuccuuccugugccugugcagcaagcagcugcugccacaccagcaacuguagaggaaagcaacagugaccccuccucagaacccuagucaaaccagucuacacucacucacaagacacugccuccacccugaccaaggagagcagcucagccuaacccugcauucagcuucuuuccuacccugguaaacaggaaacaccguucagacagcugcuuagagguccacaguccccuaguacacaggacuugcagugcucuguacaaauugcuucagugcacaauccucaccaauacacaaggccaccuagagaccagauucuagaugacuuuccuguuuaggcaaaugagggaugggacccaaugggucugucucaucaaauggugauucauggcagauggugguucuggagaguucucauggcaguaccaacacugauaauggguacauagagaaaaagaaaggaggucacagaaggcuucacgcugcccaggcaggcagcucucuuucuuaaaacauaguuuauuucagugguaacagcauauauaagucccaaaggaaggaggaaggaaggaaggaaaagacggccccacagggagcacagagucagaagagcccucagucaccuaaggcucauguacucgguccaugacuuuuguuaguuaccagacaacugucugcucuacccuaggcccuaagauggguccuggggaaacagaucaaugggcacugaguuccugcccuucagaaaaucccagccugauggaggaaacagauggggaagcagauaacucugaggucaugcaaagaauggagcagcagggagacaucuguggugcucugugugcacaaccucccuucuauuugguguucugcucuugacuuuuuccacacaaccuuacccagccuuuccugcuucuuugugugcuaaaggccgacccaauuaaacaugggccaugauccucugucccugugcucugcuuucuccucaaugauacucauguccacagcuuuaauuccuucugguauauagacaauucacaaaacaucucuacccucaagugucuggcauuacacuucaacugcuuacuuccuauuucuaucuguccaucuaagaaacgcacacgcacacacaccacacacuucaaagcaaauaucuucucuuacccaaaacccuaggcuucuggccaugcuccucuggguauaccaacaauaugaacugaaaacuucacaaccacccaucaauauucucuuuucucgggccuagcaaaaugguucaucaggagaaggcaccggcugccaagccugaacgacgugaguucaauccccgggacccacgugguagaaggagagaaccaaccccccaaguugucuacugaccucaaaacauacucguucugaaguuuuuuugauuucuguuucucguuaguccaacccugccagcccagcugacuguuauucauaaugagcagcuguaagaaggacacaaacgaggagcgagagcucagccauggaggaaggacuggguuugcccggugcuaacaggcuguguuaaacagccugcagacaguucucagaaacuacaaagcacagaggaugaggucgaugccucggcagguggggagggcagcagcaggaguggcaucugguguccugucacucaucucuggcauguuugcuacgcauuauuacaucaagcucuuaauuaaaccgaguuguuucauucuuacaaccaauacuguaaaacaagucuuaggguucccauuccccaagcaaggacccugagcagagagugguuaaugauccuacccaaggugacaguuggcaaguggcagagccccuggcuugugcucucugugggaagcagccaagucggagcaacacaaggagaauggcaggacuccaggcugcuuuuuuauauguguguguguguauguacauauacauacauauauauauuuaaauuuuauuauuauuauuugugugugcguguauguaauguguaagggugcacacaucccauaacacuugggaaggccagaggacaacuauggguuccaaugaucaaagguugucaggcuugcacggcaaguauguuuacccacugaaugagcuaucucucaguucuauguguguucuagggugauuuggcuguuuuuuuguaaauuccuugaggacacgaaccaugucuaucaucuucacuacuccauaccuagcagaaacuuaacaaguguacaaggaaaaaaaaaacuauaaugagagucuuuucucggcuaaccaaccugcuccugccagcagacaagugagcccucacauccucagcugacuacugccucucugcugccccucccacagggcagaggacaagccauggucagaaggagaagggaaaaucugggcucucccuuccacaaagcaaacaaagcagcuucaggcugaagaagagauaggagagagggaguggggcuggggaguuucccuugccaaaauacucagcauauucucuuaccacuugcuuguacaacagaaggucacagagguuaauucccaaggacaaagggagucaucaaguuggagacuuggugaccacagacuuauuucuuuauaccccaggaggcucuccugcuuuggagcuucauggcccagccccuccauagcaccugucacaaucccucaggccugccagccaaagccacuccccuuuugcuuccuagaaaagcaaagccccagagaaaggucuagucucugucuucaccuaccuugugagcccacccacaguucugguaagcacucacaauugcccaccaacauccauccaugcuaggaugaacaccauguuucuagugcaggccaguucucagagcagaaagcaggacaaccucucagaagcagucuggaaccaaguacccucaugucacugcuggacucaagaggccugccacaaaacugauaaagugccacuguuaccuucugaaccuuccugguagcuaugcuaaguggucccaagaacacaagcacauuacacucuuuuacuguuguggaugagaaagugacuggggugggaagagaaaagcugcucccagaauguaaggcaucaggugagaccauuacguggucugcagagccuuagagaaggaccaucacuaccugcaccaacccccuaacuuguccaagaagggaacucuauacccgugcugaccuaccaccaccugaggcugagaaaccugugggcuaacagauaacagaggcuuuccucugcucuuucucaggcuaaccacucuaugaacuuaggccugaggcuggaaucgccccaacauacacucacaucuaccugcacagccagaaacuauauuguccaggccuuacucuuaccacagcuauggccaagccaaggacucucuaacacucagguacacauguccccaagaaucacuguauaagacuuuuaauucacccacaucuccaggaagucaacccgaaaugaauaucccacuugagcugaaggaagauuagauccacaaacaaguaguguaugaguucucucacugguuggaccagugcacucuucagugucuguguucugcuuuacuccagugcugaugugucugccaaucaauaggggaagagccuauacaguaaaggauaggcugcccugccagagaaagaucugggcccuugggcucagcccucagcacuuuaagucagugcugucuccugugaguccugguuucccaucugcucuagauuucaaacuccccaggauuaaggacugggccaucucuuuuucuugcuuaccuaacuccucucugccagaccugggcucaauagaggagaugcuagucuucugcuggagaaagccucgcccauuuacuccugaauuuugcugaagcaagggccucuggccaacacgggaagggcaggagccggaaggaagcagcagagccuauacacaaagccucuaugcggcuauaaaaaggagccccucccugcuucccccaggaugggucugguuccugggaggugagaguaaagugcgcuacuugugccaggcacaaagccacuacagccucucaaagguagcccagcacuaccucagaccucuucuugaaaggagaacaugagagcaccaagggcugagccaggaaugcagguagagacuccugagaucaaccccauggugcccaccaacucgccccgcagcucuccagcccucagcuccuggcccaguacuucuugcucucaaggggccaaaaacagauucucuggaagccucuaggagccugggcuuccaguucucuagagcugugggagcaaccaugauaagaugcuauaagaaucucugauuuugaggcuacaggagaaacacuaagaucacaacagaugaugcucagggggcucaagcaaggcuaagagggacauuauagaaggguuuuagagucuaaaugcuaucucucgaaggucacacacacuauacccagcuuuacagagaaaccuuucuugucuagccacucgacuccaaaucccucucuagcuuacucugcccacaguguccauucagaucuacacuacagaccugaccuagaccacugaggccacccuccaaagacucuaagugauguggcuuagauggaugguacauguaacauaaaggacaaaugagccuuuaugccaccaaugcgaggucgguuggggccuuuguccuugcagcaugcccucaaccauccuucggacagagcagccuaugcuugcuuccuucacagcgcucaccacacccuguaauuauuugucuggcuguuucagcccuaacuguaugcucacuaugagacucuacagugcuuuccacagugagaagccagagcacgcguggcaccuugcuuguucagugauccagugaggcccaaggaagccacaguucuuuuuuauugagauuuauuuuuauuuuauacauaugaauaguugccugaacgcaugacuguaugagugccuacagaggccagaagagggcaucagauuuccugcuaggacuaagguuacagaugacugugcugggaaucacaccuggggccucuggaagagcagucagugcucuaaccacuaagccaucucuccagccucucuccucccuuccuuuuuaaagaaaguggcuaggcuggcaugaaggcaaccuaguugagugcuaccauacauaaacuggcagaaguagaggaaaccccacccagcuaggugugcccagcacagcaccuaggcccacccgacaccugauggauggauauagggacacagaaauggagguacacuggacucuguuaugaggggggccugggaaggugcuucuugcugcaccuggaacccugugacccucucucugaagagguacugauaggcuguuaccauggacuaauaggguaaguccagagaugaggugcucuggccuccacguuggacaguaccuagcauccaccuaaggaccaugcccaggauaagacugagagugguauagcggcauugagucgagcuuguccauugaugaaagccuggccuggguaaacccaugugaccagaguauagaacagaggucaaguaucuacacaacaguccaccuuacuguuacacccuagaguaggaaaauaaacaauacuauagcaaaaaucagaaaucccacacuuaaacuaugcuccgugacuucacugcugggaccuuuguuuccuuacagggacaauuaacuccugcuuucucuggaagcacagagccauugcagagggugggagagcguaccaugcacucccagcacauuacucaaacaccagauccuuccuucucugcauccaaacucaaggagacaauaggcuuccagccacaccccaguggaaagcagaacucugcugucaacuaaugagugcaaagggaaggcgugacuaagggccccaggugucaaaugugcugcuggucauuucucaaacaccucucaugcuuagaugcaaucuuacuucauuaauuaaccugccaacucuaugagaaggaaauuuuuuuugucugcuuuuugguuuuggagacugaacucacccugcagcccaaacuggucuacauguaacucaguauguagccaagauggccuugaacuugccuuaccuggcuaagaauuguucuauagaaaguaacuuacccggggucacaaggacacacugccucuggccacacauuuggguguucacagcucaguuaccaggaugguaggauuggcuccccaaggacacuaagguuucccuugucauuauccaaggccauagagcacucuacaaggcuacgugguacaccaaaacacuuguguccuccuccccaacaccucuccaaagacucuccugaggugcacacuggccucucccggugagagagaagggagagucagucuccuaacagcaagacucaacagcaggcgucuaugaccucgggcacuuccuccaguguauucagugaaggauacacugaccuugaaacccuuuccauaggaaaagagagugagaagagacacucugaguuaacagaagcggauguaggccuaccauucugggcugugucacagcacuuccuggaagacugggccucccugaucauucagacaacucaagagcugaacuggcuuagagacaaacccugauguccaagcagccacucucagccaacugccuucucuccacaucaagacccaagguagcagaaagcccugaucacagaggcccucccugcugagaacuguagcuucaugcccuucaucaaaggacuugguggccaggcaccagccccugaccacaacagacacaucuauucuaaccuggcccucuuggggacucgauccuauuucucuccugucagauuccauaccacagcacccuagccgccaaguacuuuacacaaacacuccuccaaaccucauuaggaaccgcgaagucggugcugugaacagaugaaaagcucagaaggacacguagcccauuggaagucacagagcaggcgagcugcagccagugugcauucucugcccagggcuuuacuacuuugugcucagcccuuucuucucaucacugcauucuggucuugucuccuccacaagucaaauaagggguguacaaacaauauuuacugaacaaauaaaugcacauaauugcaaagagccacaugaagcaaugugaucaagcucucuaaacuccaacucaagucuaugugcaucuaugcagaccuuccccuuccagacacaaagucccagggagaagcugggguguugggcuuccugguacuguguuugcucaucucugcuagucauuuaugaagcagguucaggggacccgaaaacuuucacagcaggcaagccagaggugccaagaaaacacuaagaggucuaacuuccccuggaaaaaugauagucaaagaggaagcacauggcgggaauggcuggcucuggagauccaggcgcaugcuuucugcugcucucucacugugggccagcaaaaaggaauccuugagggacaugugcagacaauucuuaggugccacggaccuacucucagagccagccccuugguacugcaauccucaccacaauaacaacauagcuuuagagucucuacuggagcuacuaugccaacagugguccuuaacuggacaaccucacgaagaauaggucugagccaucucacuacaggcauuacauauggaaagccuaggaaggcgucuuugaugaagauggaggucucugccuguaaauaccaccuaaacauggagguuucucuucacaaggggcaacaaaggcuacagaaaacaggagaccaaggccuaccaccaacacaaccugggagcagaguccucugaggacuagccugcagucagagugaaaagucuguuuagcacugggcaggaagucuauggcugcuuuuaacucacuaaauucugcaacauaaaugccagacaccagccugacuucagucacacaaccaaacagcaccaaagcacuucucaaguagaccgcugccuuagacaucagaaggugcuaacuaguuucacaagugucacagugagagaacucaagauuuaggaaauggcagucagccuguccuucuguuccgugagcacccugagggcagacagcggcagucuuucucucuggccuggcuucagguagggauaagguuaucagcaaaaagucaaauaccugaggcaucugaacaagagaccagacaguaggggacccagcuggcaacucaauccuuuucacaaucugcaggaggcugcagguuugggaacccacaaaggcagugaggugcauuccagcagaaguggggcagggcuucgguggugggcuccauuuacaagguaugaaguccacacaggcuagucugcagccuucauucuggaccccaaaaaucacagggucgggcccaaugaaaacaugcauaucucugggugacuuuugugggucuggaaaggugacguccucuguauuccugccacccauccucaaagacccaagugagacaaaacggacuggaugguucugucucuaagucccuucuuucuguccaggccccaacucacaaugacauccaauguacaaaauuccaaacauagaaacucaucuuacaugacaggugaacagaaggguaaacgauguacggcaaaacaagaguuuccucuuuuuuccuggguaaugaauuaaggagaacgggacccucucucggcccuccucccucagagcccuuucuuuuucuaacagccacauuagaccucccucagaagccccaucccagggucuaggaggacaagcaucuaccauagcuacugcuacuaauaacugguucuuaaacuucuguaacgucucugcucgcaucuauuacauauuuaguuugcuuacuuuacaccaacuaucucacuuccaaaagugaccauuuauaguaaauauacuucuucuaacuuacagaggaaccgaggcuccgagagggaaagcaccuggcugggugacguacagcuaacacacuggcuucaaauaccauagcuaucuuccacuacugggcuacacacacgguuuacagugcagcuguuaccaagagcuagcuaccggggaacuaaugccaccacuuaaacacaggaaauacuacaaacguaaaaugccaugccugcaaccugaugucugagugaugucucaggacuaccggaacugucugcaguuccaucccccaacacugaaaaucacugaaauguucuuccagcggaggccagggcugaugggcacuggugaugguuaagggccaauucugucagaccugaaguuuguaguugaggauggcugucuuaccacagaaaccuuccuuccuccucaucuccucacccaucgacacacauguacaccauccccaggaagaucugugggaccuucucuccguuguuacuuccugacaccacccccccuucucuaacacagaccuggcucuuaggcuaggucccuucaaccauagacucuuuggggguucuuguaagaaacaucucaaagccuggaguugcaaagacuccucauccugccucacaccgaggaaaaugacuaucagaaagagccgagguuucucaaaacuccugacuuacuucucccaccagagacuuguguguaaacccaccacacucaggucugggaaggcuacgacaggaaaccagaggagcaacucugggcuacccuguggucacgagaacauccaacacaaagggcuggaccucaaaacccaaggccagggaaccuuucugaaugcaagcuccuuguuauaugcugcaagggcaaaggagcccuggcucuagcuuuggauggcugccuagcaccauggaccuccaaaauucagaucuggggcaaaaaaaaaaaaaaaaaaaaaaaccauccacgggacauggggagggggaagcagucacgguuuuagcuuucauaccccauccucccaaagaagagggagaugaguaggcccgcucugcuccacaaccagcccuaccccaacaucugccuaaguucuacaugaggauuccaaagguucuugcgccaauaagcccaucccggagcucuuaggaguuuucacagacagcacacucuggagaaauggcagugggcaggaagaucuugucgguuccccagguucucagguuggaugagggggucccugucuuggcuuccccucacagccacugacagccgcccgaugcuaagggccggaaucccacuccacuuguccaaccagugaggacucuuaggccucagggcaaagugccuggaacacucccccccuacugggggaggggguguccuaucaggugauccaagacccggaugccccccuccacccgccccagagugaccaccagggacugggcggagacggggcgccaggcgcgaggcccgaaaguuugcccaaguguuugggaggcgggcaggcgcgaggcaggccggaguggggcgcacuuacuggaccccucgauuuuguccgcgccgcggcuccaugugaucuggcgcgucuccaacuugaccuggaaggucuuccguucuggccgcugcgacuucuuggaguagaacaaagucaugacggugcccaccucgaggcugcggcagaggugcagcaccucggcuucggagggugcgccaggcccgcagccguuggcgcagggggucgcgacgcccgccaugcugcagcgaccucggcgacgcaagccggcgggcccggagcggcggaggcggaggcgguggcggcggccggggaggcgagcgggacccgguggcagcuccugcgggcggacgcggggcggggacugagcgcgggggcggggcggggugaggcuccgcccucagcgcgccgggaacaaagacgcuccuggggacgacccccgcccaccgccgcgccugcgccccgcaacccggggcaggccgcagcgggcggaccuggacaccucgguucggccgagcuuuccccgcgcaggccugacacaacgcggggcacggccgcccgucacgcacgcaaccccgcccacaggcugcggcccgucgguccgacgcgcgcacgggccuccggcccacacgggacccgccgcggcagugugcacgccucccagggagcgagggggcugcgcgacccccagcccucccgccgaacccgguuaccuggcaaggcugccgggcggagggagccgcgccagccuggccuccucacacccg

SEQ ID NO: 1243 - RNA, 7329 nt, Mus musculus
cagccgcgaguagccccggccacucggcgggacgcagcggccgcacagcuccaggcggccgaaccagcgcgcuccgggggucggucgcgaguggccgcgggagcccggagggcgagcggaggaucccccgcgggaggcaccccgagggacagagugacgaccgagcgcgaugggccgccgucuguccguguggcugugcaccgucgcggcgcugcucucgggggcgcaggccaagggcaccccucuccucgcgcggcccgcacagcccagugccucccguuacagccucuacaccaccggauggcguccgcggcugcgcccggggccacacaaguaagcgcggggccgggccacggcgggaacccgagggaggcccccgcguggcgcgccgccacucccaccugcccggaccggcgcggaggcgucgagauauggguaccccagccaccgauggggcgguucccccgacacgauucuuugcgcggguaggcgccccgccauccaggaggcugcgggguuggcgaagaacaagucagccgagggggccuggcgcggagacugggauccuggcagugcccguggaaaccuuuccagcgaaguaacauuuuccagcugcgcugugagcaaacuccaggcgcagcggaccagguggagggagaggaggaagggcuguccgcgccuggaacacacggggcuccccaguccaaugccuucugucucucuucugccuugcgugguuguagacagagccaugcuuauuuuagguaguugcuccuccccuccuauggucuggccccaauagcccugcgggagccccaaggugggugagaugcacagcuggugaggacuuguggguccugggcuuguacuguagaauggacagacuuccacagugguuuauacaggaauuugaauuccaaucgaauauaaaaccuugaaggcaaguacccagcccacaaccacauuccgugaauccaggagcaucagggcagauguccuauaagagaagacacgaguacugcucucgggagcaaggaaauggcaaagccgaggcuagagagcuuuuucacaggaggaaggaggaaagccugauuaaaaagaagccacuaaguugugcucuagaaaccuugaaggccaggauaaggaguuuagaaccagugaaggagcccgggugggggugggggugaauagaaagaaggccaagugguugagggagaagcugaggcggccuuuucagagugguguuggguagacacccaaucuucugguucaauugagcacguggcucaguagacaguagacacccaucaaggacacagaccccguucagaagauauggaccccaggcagagguccaagguuccaugaaacaaaaauaaaaaaauaaaauaaaauaaauaaaaaaagauacggggaacucugagagcaagaggugagcucgggccaaacauuccagagguguuccuuccccugcaggucucucugugccuaugugguacacagaaaugugaccugcguccuacaagaaggagcagagagcuauauaaaggcugaguaccggaacuguggguggggacccaacugcccuucaacagucaggugagugaguauuucccaggguauugccucagcugggaacagaaccacuucugcaaagggcugcaguacccugggcuucagagaaccuaucugggccacagugcuugcuagagaggaccaggaucccugaaagaggccucaagagaccccaaaauuuugagcuugcagcagauccucccccauagaggcaaggacaggcucaguuuggagcccagaagccucagggauacaagagggagucugggccagaagauaugacagaggcagaaaguauagggaaagagaggagaaguugauacuucaggggucccgaccagaagaagguggaagccagaggcccugguacaguucagacaggccgcccaggacauggcauauaacuaagucuguguuuggagagcuuaaauguguaugucugagaacagaccuaugccucauugugacagugagugaacagguauguggcugaucagguagagaagggguuccuggugagcucugccuguacccuuggccuucccuucccacccacgaucagagaugaccucacaccagccucugagaagaguccaguccccugacuaagcuagagaugggugcuaagagggaaagaagcuggugggagcuaagaguaccccggggcaguaaaaggggcugucggcccagcccugaugagguacuccuucuaauaucagaggcucaaaacuuugucaggauucugagaggcucccucggagccagaauggaaugucucuuggcagacggggaccuaguggucuugggaagauugggguuaaauccccgauagcuuucucuucaagcaagcaguaugguagggcuucuccauacguccuucacucccagggcucagagccgcuguaagaccugcucccuuguucucucugauccagguaccgcacaguguucagacccagauacaagauuggcuacaagaccgugacagaccuggcguggcgcugcugcccuggucuuacuggggaaagcugcccugaacaccucacagaccauggagccaccccaccccaccaggagccagagccucagauucccuuggggcagcugggcccaggucccaggccuucuccuuacagcagagaggccccgcgcccccguggugagucuguccauggauguccuccagggaggguuggguuucuuaggcuuaguggcaggguugggaugggggugggggugggggaggaacugaugcagacugacuaagcucucauaguugugugugugugugugggggggugcaucucaugugagccaugacuguaaaaccccaaccuuccccacccaaaccccaucuuaaagguggggggggggcuguguccagggauaaagauaacauguuggagggccaggccugcaaggcuccugggggucuuucuuccuccuuaggaagaaaaggccaagggccguuuggugagcggcuagaacagcgccugucgcaagcauauggcacccugaguggauugguagccagccacgagaaucccaauaggaucacuggugacuccagggccccugucguaccuauaggcuuuggggucauccccgagggucuuguggccccagaagacagaggcagaggaccacucaucccuccucugagugagauccugagcaaggucacagaggugagcaacacauuacagaccaaggugcagcuguuagaugaggugcgugggcuggcccuggggcaugaggcucaccugcagcggcuccgggaagccccgccauccccgcugaccuccuuagcgcuccuagaggaauacguggaccagcggcugcagcgacucugggggagccugcuggauggcuuugagcagaagcugcaagguguccagagcgagugugaccuucgggugcaagaggugcggcagcaaugugaggagggccaggcagccagccagcgcuugcaucagagccucgauggccgagagcuugccuugcgucgggagcucucccagcugggcacucagcugcagggcuugacucugacuggugggggcaccugcugcagccaacuggcuuugaucagugcccggguggacagccuugagaggaaccugcaggcugucacugagacccaagguggcccgggcacccuggccgcggaugagcuugcgcgccucucugcagcuaugcuucagggagguguggacgggcugcuugaaggccuugagacuaucaaugggacagagaauggagcaaggggcugcugucugagaauggagguggggggcuggggugucgguggcuucggguccacgcuggaacagcgagugcagagccuagaggagcggcuggcaacucugaccggagagcuaagccccgagagugccauaccagacagaucagcgcggccgcuuguucauucagaacuagcaguacuggaacaaaggcuggugucccuggagaccucgugcaccccaaguaccaccacagccauccuggacaaccucguggcagaggugaaggccuggcagagccggagcgaggcucuccuacaccagguggcucgucacacugcccugcuccaacagcucaauggcacgguagcugaaguccaggggcagcuggcagaagggacaggcagcucacugcaaggggagaucacucucuugaaagucaaccugaacucagugagcaagucacucacgggccucagcgacucugucagccaguacucugaugccuucucggcugccaacacaucccuggaugaacgagaacgaagaguggaagccgagguccacaccauccaggaacagaucagcagccagggcucacggcuucaggcuggccacaggcagguccugaaccugcgaggggagcuggagcaacucaaggcuggcauggccaauguggcuagaggguugagccgcugccgggacacagcccaggaacuccagcauacagugggccacuuugaccagaggguggcccaaguggaaggagcaugugagagguugggccuguuggcaacccaccugaacagucugccuacugagcagcugagguccagggagggccuguggggccacauagacaagcugaaccacacauuggcccagcacacgcaggauaucgcccggcuccgggaugaccuguuggacugcagagcucagcuggcugaggugaggccagggcgagcugacuaggaucgaugcacagaaagcgaaagugcagaucccaccaacccugggaauaucaucccagagaucaacucuaccuggaaacaccuuccagcccucccugacuguuucagccaucaaaagucacccucagagcugcagccuggacaauucaggguaacagucaaggugagcuacacgggaugcugucucaagagucaaggcaaggacgccaugcccgaacccaaagcugggcuucugagauggcacgcugcaucgucugcgcguccucuuauuugcagacacacuggaguuagcaacugugcaguuuccugaccaagucucagacaagcuugcccacuguucccuuuacuaaccagggaccagucacagcacucgggggguggggagguggggcaucucuuccuuugucccugagcuucuagccuuagauacuggaugagguuucuacaggaagaugaugcccacuggaccucucuggcaguuucauaggugcuauuucugaacuaaagaccagaggccaccugagguuuccagcuccccacacauccuucagaacagaacaaaagcccagcggcccagccaagagcgcuccauauuccuuuugaucuugccucgugaugagggugcaggcagcuguagaaucccaaagaagggauccaaacaauguuugaagaccccaccccaauuuaucuuuuuucuuugauuucacaaauacacccacccacacgguccucucuccaguuagaggaaaaucucucccacccacuauggucaguaccgcuugccaagggcagccuuagaguaugcugaggcagaccccaggaaaggggcuggcacugaaugaaaaggaagcuaagcuuuuaaacguccacgcaaaaccccagccucgcaaggaacuucacaaacuggagagaagcugggguggaagccauugaggaaaacacauguguuuagagagagacugaccauuucugcugaggcuccuggccucaguuucccccaaugcacccugggccugccgugcuguuugucucucccacugcccugcauucaguguuugcccuccacucugauguggauuggaaaacaggcuaaggauuaaaccuuuuaaccggucugaagguguuuucuucacuaauggcaaugggaggggaagcuaacugccauccuguguccuguggugccuuggacgguugcucucucagccagcuggccacaagacugagcugcagaggccagggcaggguggucagcaaacaccaucuguuguagcuaggauugggcuaagccccaggaaaggggugaagucaccaggggcaggcaggaaccacacgccaugagcccuuguacgaccuccaaaucauuuuccuuuuggucagaggggcuuuggccuauucaggcuuggagcugagauuucaagguagaggaagaaguaaugcuuagaucgagaccugcgggcagagagacaggaucaccuggcuuuggaggguagccugggcucccgaaaagucgucuucccagaugauacaucaaggaccgugguucucaaccuucuuaaaguugugauucuuuaauaccguuccucguguuguaaauaaaauuauuuucauugcuaccucguaacuguaguuuugcuacuguugugaaucauaauguaaauaucugacacacaggauaucugauauaaaaccccugagaaagggccauucaacccccaaaggggaugggacccacagacugagagccaauggccuaggagcuagcgaacccugcaagggucuagugacacauuuaauuguuagaggucagggcuguacugaggucuggggcagcugccucaccccugauagaaaagugggucccuggguccucuccaugcucccaacagccaccugggccucacuuggugauggugccaucugucgagauggcuacuuguuccaguucuucaaguaaauggccuugaaguggccaugccuugguaccgagcagucaaacugaugaacacggcauuuguguuucaagguggcgguaggggcggccgccaaucaacuugcuggguugacccccacggcaugcaucuucuaauccugacuguccuaaguacuccaucaguccugggucagaccaaggagacccggcaaggcaagcucaagccagggccucaaaguccacauacggcaguggcuuccgccaauagcugagguugcuguauucagggcuggccaggucugugcugggaccgcgcaccacaggugggaagagcagcucaaccaccucuccgagccgcugguaccugugggcagaaggggcugcacugagucagaguugucacgaggcaguggccuucacagcugggcuuacccaggagaggggguggaaucuggguccugggaggggccgggugugggggacauguggccuuacguggccuaacguggccuuacguggauuuguggcucuuuaugagcuccuggaugagcuccccccggggguugacugugaagauucgggacucagggaggcccaccugccuguaggc

SEQ ID NO: 1244 - RNA, 1110 nt, Mus musculus
uaaagaaauuacaggaggcgguggugcaugccuuuaaacccagcaggcagaggcagaaguaucucagugaguuugagcccagccaggucugcaaugcuagauccaggccacccuaggugacauccugacucaaaagagaaaggaagaaggagagggaggggagggguuggggaaggacacagagagcaggagcccauccuuuaucacaaauacuaauuuaauacauuuuuaaaucagagaaguauauacuccaaagugccuucauuuguuuuauuccaaaauucuuuuuaucugcuuucaggcuuugaaguucuuaggaauugcuuuuuuggcacaguuuaucugcuuugucccgaguggccuuggagaccucaucauuucgcuccggugaugaucauuuuuggcucuucgagacaaggagaaugucuuugguuucacuuugaagcuugcuagagaaaaaaauaucccgggacccuuaucaugagguaaggaaauuugaaacaagagauaauucagauuuggaaaccgugacuguaguuggcucccccugucgccggcaggaugugaagaguccuuuguggcagcggcucccuguaacuuaguaacaucugaugaagugguccauuugcagaggaugcugauggaggagaggccucauguguugugcaggaaagaguuccugcugccuccucaaacuucagcuucaccugccuccaggggcuugggaaaugcuuucuucuuaguaaggccaggaacagagcugaaagcaggguuuuuuucccccuucccuccccauagucaucuuugucacaaccacaagguauauaggagcucgccaagccgccugccugccacuuagugacccccauagagggguuuauucaaaucaacuacauuuuacccguuuggcuuuucuggcugguuuucuuuuucuuccuuuggugcugagauuugaacccaagcccaaccucaugcaugcugggcaaauacuccaccauggagucauaccccuagcuugguguauuuuuauaacccugggcuagaggguggaucguaccaacacuugugaacucaaaaagcucucucuaguuaaacaucucaacaauggca

SEQ ID NO: 1245 - RNA, 2008 nt, Mus musculus
cagauucucuuuacauguucucucuacccuuguucacagacaggcccuugagccugccaggccaagccacaguucugcaccuuuguauaacuccuuguguuucugguucccuugucucucauaaugaugaaaucuugguucuacuucaagaccacccucaguagagauaaucagcccuucaucuaugucacaucuagaccgaggggauccuuaaaauggcagcagguuacaauucucuacccaucucucauuuuagguauaguuuauuucagcccaugcucaucacagacaaaacaauaaugaauggggagggggaaaucaaagagggauagaggcuuaaacaaggagagagagagauucauccucccucgaagaauggaaagccguuucagacaauauagcccucaugaaugucuugcucagagucaugugucguggugccucuauucggguauuuggcuucauuuguuuaagggguugaauaaaaagauuauagugaucagucacggugauuucaaugggauugaauugcucugggaggccaggaacaagcucaguauagacaagacaaaaggaugaauaaauuagauggugcacaggagguucacaugcuccagaguccacugagccccucugagccagguaaccuguggagccucccgagaugguuccaccuuggcauacucagagcuguggaggaggaaggagcauccgugcccuccugcaggaggggugaguccucagaacucccuucuaaaacuuacacuaacuuccugcucuuuagaaacaccaucaugcugagcccucagcacaagacuucacgaugugauggagcugagccacucacggggcuccugucugcggaaguaaccucuguugucaccauuccuccgaggaagcucuuugaaagcucaucauccaagaucacugcacgcucccuguuccacacccaagcaacagggaacgugacugggugccaggcagugcuucucaggccucugugcagggaaagagcaugucugggaaccucugcuuaccuuaggucuauacguacugagaccuagcaacauucaccucacagauaaagaaacugaaagccaagugaggaagaugucagauucacaccugugccaugagagaguuggguaccaguccuuccagcccuguaucauugucacuuguugagagaugcuuugggcugggggaugaugaggaaucuuucugauuuuaaaagagacccaguuggaagucagcuugccaauccucuggucacacugcagagggaauguccuccucaaggauauaggugagcacccuguaucuucuacaacacuaucauuaauguugcuuugucccccaauacuggggcaguauaucccuccucugugaacaucaagcuuucuaccuauaaaauggcaggaaacgcugccucucagagccacuugccuuguggauucugcagaaaaauguuugucagagccucagguaggaugccggccaugaagaauuaccauugccuuucucucucucaucccccuccccaacuccagccuucugacauaaagggagaugaugacagcuccaugguccuuucacagaguacauuccgguuuauggcacuguucucaggcugcagaacaccccuuccauguaagacacugauaaugacccucaaauauuccuuucgggauggagagguggagguguuuugagacugaaagagacaauucguggccccgaggugaguuuaacuccaucgcuguggcuuaccgcacccaggucaagauggcuucauugcuaaccugauuccaaacagcacugcugugcauauugcacacccacuagucacagauucagggaggagcuaucccccugccuucucucuccugcauggaaaaagaaaaaaaaaggaaaaaaaaagcccaaaaagcccauccccaauccccugcaggaagcaagccugccuggugcaaccugccagccgacccagcaacacagccucagcuca

SEQ ID NO: 1246 - RNA, 1118 nt, Mus musculus
uuuuuuucuaauuuauuugaagagaaaagccaaaagcugccccagugccuggcccguuuccaggcuaacgcuguccuccauccuccucggaugagcucucaaugcucuauccaaacuugcucggcagaugcaucaggcuuuagaacaaacuaaaggaugcgucuucgucuuuuuuuauucagcuucugaaagugaagggggagucagugaacucacacguguuccagagcuaacuuccuuagacccuggcagaagguacauccuuaagugugcagaugugcgcaggcuuuuaaaggaggccuuucuggaugggggggggggggggggggggggcggggagaccuuccccguaauuuuuugcucaauuuguuuuaaguugguaaugaaaucugugauucugcguucucuuucuuggggggaaaauggaauuuugaucccuuuuaaaacucugaacgcgccgggauaauggagaaaucagacucaauagagcauuucuuauccauuucggagcgcucuguaaacaugaugaugcgacgcuuuaggagccuuugagacgucuuuugcuguaaacaccacggcagcucagguggguuccuggcuaauggcugacauuuuuggucaacacaucgccugucugcucuuuugaaauaaaguuaggaaguugauaccaacuucauacaaagagcaccggacuccaucugcccugggagagagccugcacacuaauccuuccuucucucccggaggagggagggagcccggagagugggaggaggaguuccuuuauagaggccucacaggugccaaaggcagcuacacgcaaaaggggguuugaauaagucucucccucccugugauccaggagucagagaugggaacagaacaccucugcucagccacaaaaucaauacaaacaaaaccccgcacacucauguuuuauucagcaccuuaauguguauacuuuguagacuccgcauucagaaaugcagaaaaagcugauaaaaaaaaaauaauaaugauccucaaaccauagcacccagagacagagcuuaccucuuucuagagagcauacuuaaaaaucucucacugcaccaagauuucagcuggccacaguguug

SEQ ID NO: 1247 - RNA, 1807 nt, Mus musculus
acucuccgguagagcugccuguagguugggcagggaacucuggggauggaacuucccugacuuauuuauugcccaucuugggguagguuucuugguaauggagcagauguugaaucacacaugguguugcaagccagccuuccccuaugcuucuguaaauaaacuaagcuagauuuggauggaguugugucuuugguuggccauuggugcccugucuggggcgaauagacauuuuucaugucucuccgugagaaaucacacaacagcaggugaugaauagaucuugugagagauggauuagcaaggauggauggaccgaccagggaagauuuuauuucucucuuuggguggggugagggagggaaaugucgcuucccuuuuauucucuucuggugacagcauggauauaauagagaauguuuacugaaggaagauagcaacgcgggacauuggaagaaaaucccucuggaguccaaauccacucccaguguccucgaucuguccucugggcuuaaaauaagacuuacuguguaagguggugcaggcauucauagagaucacaguucaagaacacacaugcugagaaauacuuucugcagagaagagugagucaaucgcuuucuucugugauucuuuaacucgguggccuuuaaaccguaguuucucuguacagaaggccauuucuuaucucuuccaaucugcacaggcagcucucucuggccccucuggggcucugggaagagauaggggagggcaccaggagaagaaguguaugaagaggguaaggggacagucaugcucccugcucugaauucagggccaggcugacaguaacugcaaacaaucagccauugccccgagggaggguuccgaguuggcuguaaagaauuaauggccaggaaaggugucugccaauuguuuuuccacccaaggugcagagauuacagacauucaguagcgcccaucucagauccaggcuggcuccuggugcuggcuggcaaucaaccccagagacaagcaucucugcagaguguuaggagucagagucucgagucuuuccggagggagcucccgaguagaugccaagauccgcagcgccucuucuuugaaccuuuucccaaccauuaaaaaaaaaaaaaaaaaaaaaaaaaaaggucccacgcuccuuuggcuuguggucuuucccuuuccugaugggcuuccggcgucucuccuuccccacugauuuuauuuuucuguuuccaaaucauaucugccugccugccuugucgaagccguaucagaggcgggaaaucucuucuuggcuggcccgaugguuccccaaagagccaaccaagccagugguggcacagaagacacacaucagauuggagcugguugcugggaaaaacuacaggugguguguauguggccgaagcaagaaucagcccuucugugauggcucccacuucuuccagcguacuggccuuucuccacucaaguucaagguccaagagacacgcacaguggcccuauguaccugcaaggccacucggcggcccccuuacugugacgguacccacaagagugagcagguacagaaagcagaaguagguuccccacucugaggggauacugugacuccaggcaguaaugcugagccacacauggaagggaaccuccaaggaccccaucuuguuagcaauuguacccugaaaaaccuguauucuccuguugggcagcugagagccagguccagcauccgguaaagcugucaauaaacacugaggccugcccucuaaaaaaaaaaaaaaaaaaaaaaaaaaag

SEQ ID NO: 1248 - RNA, 2573 nt, Mus musculus
ggaccguuacuuugcagguuuuuauucagaugagaugcgcgauccauccacgcauuugagagcccucuuccuccugcuagaaguuugccuuccugguccuagucugaggaucuucugggcauuggucuccuccccgugacucuuggaugucacuuucacaaacaaguuuuuggggaacaaaacucuuaaggacgaacauugggugacaguuggcgccgucaacauuccaaaugucaggguuggaaagccaacgaaccuguaguguguccugguucugcggcugugggaggcugacuugcagagggccuaauguguccucuuccuccacggagcuccuguugacacagguagcuucauguucagccagcuuucugaugggaaccacguggcaggcguuguauuuacagcuggccaucuuuuuggcuuucuugggguucuucuuccugcaugacgccaggugguacuggaaccugcugagcgggauucgguggugaggguuauaaggacaaauuucuauggauucuggcuccauccgggaguugacuugaagccaaguguccugcugcccaaaguguacgugguacaccucgaaaggaaaagccucuuccugugaaagauugugcugucuucugccaggcuuuggcucuugggucucuggagugaaauucucacucacguucugucagcaaucgcuaugcagagaaagccagaaaacagccaccagagacguuaacucaggcagguacaagagcccgaaacaguagcuuccaaggaggugaaguuagcagguuauaaugaugcuuugacgcuaagauacccuguguugucaaaggacagaacagguggucacaaugggcagcuuaugacaucagggacagacuguccacugggugggggaaguggcuugaggaaagcugcuguucaaauguaguuaugacacguacccggcccuuggcaguuucgggcuucauuagcauaaucaaaccccuuauucaucagcgucgguuguguggucuuuuaaaaacaucuuuuuuacaucauguguuuauuuguaaggagugacauuggggguacacuuagaagucggagaaagacuuguaggaaggaucaaauccagguuaucaggcuuggcagcaagcacuucuaccccaugagccuuccugacuccuuuucuuuuuuugucccucuacuuucccccucccuucucucuuuugaugcaaggucucauguagcacagguuggccuugaccuugauauguggcugaggauauaaucacaccuuauaaacugggauuauagacgcgggucuccguaucuaguuuagauggugcuggggacaaaguccagggccucaugcauuuguggcaaguuaucugucaacuaggcuauauccucuucuucucuccccccccccuccccuguagcucugguuguccuggaacucacucuguagaccaggcuggccucgaacucagaaaucugcccgccucugccucccaaguacuggguucaaaggcgugcgccaccacugcccggcauacuuauuuauuaugauaaaucuuugggcuggagugaagcagggccagagcgacuggggccaagcaaagcaagcaaucuucguuccuagaaaccacaugauggcucacaaccaucaguacagcuacaguguacucacaugcauaaaauaaauaaaucuuaaaaaaaaaauccucaugcugcaguccacacgugcuacaguuuccaagcacgcagcaugcuggguaucauuccuuauuuuaaguacacaguguuaaagaaauauuuccaccccuuccucagccucuacauuuuccaguugcguaguaauuacaaauugaaguauccauuuguaauuacuaauuggcuuuuuauuuuguguaugaguguuuuuccugcaugggugcaagugcgcucuguguguguguguguguguguguguguguguguguguguguguguagaggcuggaagagggcucuggaucugcuggaacuggaguuguugauagcuguaggccaccaugcaggugcugggaacugaacuugggucaucggccagaagagcaaguacucuuagccacugagaccuuucucugguccucgguuuaccagaauuucaaguuacuauuuuauccuuucuggaucaggugaagcuuucuuuuaauccacccucccucccucucuucccuuuagugcuggagaccgaacccgagcucuuacacuugccagacucuacuacccagcuaaauccucaaaucucugcauuuuaaaccugguuuuauuacuauuauuuaugaagcugagucaggauuuuauaaagacauuuuggaagacuguaguacaacuaacguaagcuuauccccaacuaacucacacauaaaugagacuuagaauaugguuauuuuauucggcuuugacaauuacugggggucaccccuaaucugcuuuucugcuggccuggcuaccuccccagcgggggguuccccagauaccugcuguuucuccuggguccccuccucucauggcgccuucucucucuccccucauggucucucu

SEQ ID NO: 1249 - RNA, 21938 nt, Mus musculus
cguccugcgaagggcgggcccuguuuccggcuugaggauccgucgcguuucugaggcgacgccucagucagcaguuaggauccgcucggagcggucggucucggccccggcgucaccaugggggccguccucggcgucuucucccucgccagcugggugagucccgaggccucggccguccggggccugaggcgcgcagggggugggugucgggccgcccgaggcggacccuccacucucugaggcuaacagagaggagcgggcaggcccaggguccaggcccgguagccgucgucccggagucggggugcggcggcucggcuggcucucgcugugggcggagggucgcgggaggccggaccgccauuguuuacaauuucgacgccccgcccccgccagccuuccggacccaggguucccgcggccaggcgacgccgagguuccacggcgcggguuccugaguggcuagaggauggcgucagggaauuuagggccacuguagucauuuuucuucauaguucggcauaugccagcgcuacugagugggguugggagcggggcuuuuaagucagcccugcugcaggucgcgagcaaaaggcguuuaauuagaagccccgcggccuaaauauuuucgaauuaaacacccuagcauuccucuccuccagaacuguugugaggauaaaguaaagaaauuaguccgauuccccuugucaaugguaaaacguuuuuagaaguuaauuuuaggaucucuuuaaccuaaggaauaaucuaacaaaucugccucagaggaacuugguagcuugaaccacagugccuaauuguuuucuccuucccgagcugauguaaugaaccaaggacucaggcucugcucaugucaauggcaugucucagggcagaaguaaugucgaagauaucuuguauauuuuucuccuccugguuuaaaaccauaauuugaaaauauccuauccagguguucauaucuagaaacuccuugcauauauuguuaauucaguuuuuacccaguaggggguuaggauaccagaguggaaugagagaagaguacgaaauuaaaggcuguggagggccauggcagaucauuuguuauuuguuuugagacccugucucaaaacagggaggugcaaauuacaguuuauggguagguuuuuagaggcuguggguuuagucuccaauugccacuauccacccccaucucccaucccacgccaaaaaagggggacagaauaucagggagccaaaucaugcagauacccacuguaugccuuuauuuuuuaggcaaucucuuuggucauucuggguguuuaagauugcacccaggaccuuguuuguccaaagcuuaucucugagagcuccuccagcuacaccuccaguccagucuggauuaaagauuucaaaggacuuuuguacguguuuaauuuuugccuuauugagauaggucaccagaucucccugaguaucccaugcuggccuuucauucacaguucuccuuauugggauuguaggaagguguuacuccuggcaaagaaguuuggccuuuacuuuuuuugaaauaugguuuuacguuguagcccagguuggccuugaacuuuuagcaauccuccuaccucagccuagugccgaaacuacagaugugaguccccacuacuggcaugucuuaguaaaaugcuucacauuauuauuacuuggggcggcggggugggggugggggcaggauuucacucuguuagcucagccugucuagaacugcagauccuucugccucagccuccugagugcugcgguuacagaaguaugccacuuuccuggcuuuuuuuuuuuuuuuuuuuuuccugaaaagaguguaucuguggaagacugaguuuuggugaugaguaacucaggugauuaggucuugcugaaagaccccccgagacggguagucgaucaaucugaggagacccucccaaggaacagcgagaccacgauucggaugcaaacaacaagaggcuuuauugguaacacggguacccgggcgacucagucuaucggaggacuggcgcgccgaguguggaguuuuuacuccuuuuauagggcuggggagcaaaaagcgcggguacagaagcgagaagcgagcugauugguuaguucaaauaaggcuaggggaaagucccggccauuuggggaaccuugaaacugauguggggcagucucgaaacuguugcugguuccgcucuaucuggguaccaucuguucuuggcugguggggcagucucgaaacuguugcugguuccgcucuaucuggguaccaucuguucuuggcccugagccggggcccaggugcuugaccauagauauccuguuuggccccugucccguuguuauuuagccuuaaacuuuaacugaacuuccuuguaacuuuugaggucucagcucuaguacuuuuccaugccuugcaaaauggcguuacuguagcuaacuugcuaagccuuaugguggggucuuucauugcugcuuguaugucugauuuaggagggaaagaagaagaggcaaaggaggauuuuagcaugaggauaaggacuuuugucuuuugaaaaagucagugggguagauauguguuguuguguugcauuggcaugagaaauacuuacccuaccuuuaaaacuucccuuuaaauggggcucuguggccguauuuucuaggaguugcuucuuuaagucagaugagggagacuuugaggcuagauuucuggccugaguucuucauuuaugaaauagagagaagauaaagcauauaguaacagguagauuacauaauaguuacugauuucuauguagagguauaaaguacagccuccucuaaaagguauuuguggcacagagaaauaaauagguauauugguuaggguuuuacugcuguaagagacaccaugaccaaggcaacuuuuuuuuuuuuuuuugagacagguuuucucuguguagcccuggcuguccuggaacucacuuuguagaccaggcuggccucaaacucagaaauccgccugccucugucuccugagugcugggacuaaaggugugcgccaccacgcccgguccaaggcaacucuuauaaggacaacauuuaaccagggcuaguuaugaagaaauacaguuucuagcuuaacugauguacaccaaagcuauuuacagagcuugcagcuuuugcuucccugucuccugcugcaagcuuucugcagcagcuucucccuaucuccugcugucuccugcugcuuaaagaauuuccccuuccccugccaguguaaacaaauucaagaccacugggccccuucccuaucuucagggacagacuaguggucauaaagaccacagcugccagaaauaaccguccuugagaaaacuucccuaccccuccucagucugaauucugaggaaaacuauaaacugcuuugaucuugcugauugcugacagaguuuucugccaaauuaaaauuauacuguugugccaggcggugguggcacacgccucuaaucccagcacuugggaggcagaggccagccuggucuacaaagucaguuccaggacagccagggcuauacagagaagcccugucucaaaaaaaccaaaaagaaaaacaaacaaacaaauaaauuauacgguugcuuuacuagccaauaauaauauagcuguguaaacaccuucaaaagaguauaaaauagcuguauuuuggacaaucaggguugacucucccugcaaggcugagcgaccccacgaaucggaauaaaaaccucuuguuauuacagcaaucugucauuaagcuguguuucugugggucacauucucuaccccuacagguucagaaguucagucuccuaucaaggugggagcauggcaguguccaggcaggcuagaugcagcaggagcugagaguuuuacaucuucauccaaaggcaaacaggagcugggcguggugcgccacaccuuuaaucccagcacucaggaggcagaggcaggcggauuucugaguucgaggcuagccuggucuacaaagugaguuccaggacagccagggcuauaaagagaaacccugucucgaaaaaaaacagaaacaaaaacaaaacaaaacaaaaaaacccaaaaaaaaccaaaggcaaacaggaaaagacuagcuucuaggcagcacgaaagagggucuuaaaucccaugcccguggugacacaccuacuccaacaaugcugcgccucuuauuagugcuucucccugggccaaguauaaacgaaccauuauaauuaguuugcucguacuuucaagcaaaguaucacaaaucaguauaagcuauagcaauggguggaagcuacagaucugacauuacuguggcucaggauuguuaaccuucugcaauugauuagagacguugugccuuugcccuguugguuugcugguaaucuuuacuuucuuuggcuuguagaugugggcuuggcaggccaauaaugcccaggaugggaauaauccaccaaagacagaagagggcaauagagagcuuauuagauucacucuuccuguuggacauacuuacucaauauauugagcccuuuguaggucaggaauugugcugguuacuuuauauucuagacaugcaugccauucuucacagugaccuuguucagaugauaaguggcauuaggcucauuuuacaucugagagaacuucuaaguuaaucagcuugcucuaauacaaauagucugauaugucuggaaaagcuguaaaagugguugcugagaccauguuauaagacuagaaccaucuucuuuuuuuuuguauuuaaauguuuuagauuauuuuauguguagaguguuuugccuacaucuccguauguacaccaccugcaugccuaguaccuacagaggucagaagagaagguuggauuccuggaacuggaguuaaggcugguagugagcuaccauguuggguaccggaaacugaacucuaguccucugcaagagaaacaacugcacuuaacugcuaagccaucucucuagcucuagucauccacuguuaauaguaauugguuaugaaucugcauuaacucauucuugugcugugauuugauaaucucaacuaucagcgcaaguuggguagucccaaacaagcauguaauguugucuuauuuugcugguggggcaauauugggagagggccucaccguauaacauuggcuggccugaaacuuacuauguaaaccacacuggcaucaaauucauagaaaucugccuauuuuucccuugcgaauacuaaaaggcaugagccaccgugccuggcuguaguaauguugccuuaugaugaaacaucauuuugggagcaaacaguaaaccaaaaguagagauguuuguauuuuucuuacauuguuuucacacaaaauaauguucucugugaauauauuuuagaagcucuuccuguuucaggcacgguaugguaggcucauuuauuguaguaaagucuaaaggaggaaauauuuuaaugaguccaugcuacaaaaagaaagcuaggguuaaaaacauuuuugcuaaagugguggaaauuauauugguucuaaagccucugcauuuuuacuuugucuuaaauuguuuuguguugggagacaggcuucuuauguagucccaguugucuucaaacgugugauacuuuuccauaagcuucuuaaaugccucugccuucuaagugcugggauuacugagaauugccauguuaaacggauucuguuaaaauuucuaagcccuaguuugccuccuaagagcagugaaggagcucucauggcccaugguguugcucuuaaaggucccgugccucuguaguggugcaucaugucugcugugcaguugcugucccaucaguaagaauuccacuguaacucggcucaucuacgcuuuuauccucuuccuuggcacuauugugucuugcaucaugaugacagaaggcauacaaacucaacugaagaagguaaguagaaguuauagcgucuuaccaugugguuguuuuuuaaaauuacuuuuuuauacuuuacaauacuuguaauuuuuuuacuguuauacuugaucaaggucauuuaaaauaguuuuuaaaaaauuuuauuuucuguguaugaguguucucaaaugugucaugaugccugcagaagccagaaagaggguguuguguccccuagaacuggaguuaugaaugguugugaaccuaccauaugaguucuggcauugcaaccuaauaggguuucuuguagccuagauugaccuuaaacuuacuguguaguuuaggcuaacuuugaacuggccucaugcuucaaaccccccauggcuuuugugguguauaucuggcagaccuaugcuuugccacuguaccuuucuuucuugaacccagucaaaccaccgcaugagggaaacaccacacaaagcuuaguucagaaacaaugguaacucagucgcuggguacaacaacuagaauccuaauguaagccauguuaaaucuaaauccucugguggcaaauccuugcagauucuccauagggcacacuaguagcuacaucuugcccucuuacuaucccuuuccaaaaggccccuaacucucucuccucuuccucucuuccucccucuaacccagaagucccaccuucucgcccagugauugauuccuuuauucauuaggggacccauuccccauuccccauucccugguccagacaacccuuucugggaaauggaaauuaacaucaaaauacaacaacuccccggccauccccaacaaccaaauuuagaaauuacucuuuuucuuguuuguguaagcuguaagcuauauuaguacuuuacuuuggaaggaguuuauuauagcugaaaaguuuuguggggaaaaaggagauaaccucgggaagauggguuauuuaagaacugaacuuauccugaguccugcccuguucagaaaauugcuuacugaagaaacacccggaagccugccucugcacuuucccaccacucaccacucgugcagagcuccccuccacucuucucccagcagaaaugccucuagccuuucagagggagcaaacagaaagagcccaaccuagcuccagaauauugcaaucccccuuuucauacauaucccagccuccugauagauaacugggacuuccuggguguagauagcuccuguccuugagaaaaaacaaaccaaacauccuugaaaaagauaagugccccacuuauuggccuugagaaaagggcaauuaaguguucccagacagcuguggccuguuguaaaaauacaccagcuucugauagcacaaguuacuuuucccaggucagaaaggucccuuuccagcugcacgguucugcccccacugucugaacaaacguuaucaggugugaaggacagcauuccuucacccucuugugcaaugccaaggcuggaaaacccccuucacuuagaccuggggguucacucuccuuccuuuuccaucaggaaggcugguggcccaagcucgagcuugaauaaagacccucaugcaauuacaacagguugugauuccugguggucucuuggguuuuuacaaucugggcacaacauucuaaaugacccaagcuagucuuaaacucaccauguaaucccaauuggcugggaacuuguggucaucuuacuucagccucccaaacuuuggaauuauagggucaacugucauaagcauugugugugugugguaugugugugguguacgaguuuuuuggcuucauguauguaugugcacaaugugugugcuuggugccuuuggaggugaaaagaaagcauggcuccccuggaacuguaguuacagauggacagcugugaacaaccaugugcguguuaggaacugagucuugguccucugcagaaaguacaaaguacaaagugcucuucauugauaagcagucucuucaucucagcuuuuaguuuuuaaaugugaucuguuguuuauguucuuagguaauaagauuguagucaguuggaagucaaagagaaaaaucucauaguuuugaaauugcuaagggggucuuauuuauuuuuaacaauucccugcuucauaguagguagcauuuuuugauuuugauauucucauugaaauuccuugccuccucagauuccuggauucugugaaggaggauuucaaaucaagaugguugauacaaaggcagagaaagauugugacgugcuggucgguuuuaaagcuguguaucggaucaacuuugcuguggccaucuuuuucuuugccuucuuuuugcucauguuaaaaguuaaaacaaguaaagaucccagagcagcagugcacaacggguaugugagauugucuuucaaugugugugguuccucucccucagcagauaauaugccauuggaauggagacaauggaauacuuacucaguggucagauggacacaugaacaauuguuuauugucaucauuuuuuauaacuuucuaaauuuuuauuuuaaaguaccuuguaaaauaggucaggcacagugcuuagacauuguauguuuucuucauucauagauaaguauguacuugauacauguaaucacacaugaguacacaggcagcagagauggaagauaaacaguaaaaaaaaagaaaaaccuccaugggcugcuuacuuauauauucuccugguuccccugcugacccuucaucucucacauguacuuuucagcuggaagcuaaugggagcuugguuaaauacuuuauuuauuuguuauuuuuauuuacuugguuuuucgagauaggguuucucuguguagccuuggcuggaacucagagacuaggguggccuugaacucagagauucaacugccucuucuauagcgcuaggauuaaaggugugagucaccauaacccagcaaauauugugguuuuuguauagauguuguaagugaaauccagagaaguuaaauauuuuaucuaauaucucuuagcugggaaagguugaagguaggauuuaaguucauguauguuccauucucaaagcuuaauacuucauguucugccaugcaggccacauugacuauuugguugguuugguuuuuuuucagacaagcccucuucagcucaggcuggccugaauccugauccucacaccuccaccucccuagcagggucacagguguauaccaucauagccggcucaagacaguaguaaaggcuguagauguaaaguuauauuuagcccuggccuuuuugcuaaugaguucuaucauuauggacaagguauuuguauccuauuuuguaaauguaggauuggggaauaauuucucccauaaacauaaugauuaaugaaugacuuuucauauagaacuguuagaacuaguaauucuaaaaaaaguauuaucuuuaugugcuaaaacucugaaauuuacucauaaaugugacuuaucuugcaugcuaauuguucucucccagaaaucauccaacucuucugaccccuggcucugccucucgcuuguagcuacuaacaagccacccuuccuugaauuaucagauuauuuuuaucuagugccauccugccuugugacuacuagugcauauacuaagucacuggguauugaagaaaccccuccaaauuucccaguaaccuaucuuccuacagugucuccucugucagggucccuucuuguaaugcuguaacucugucuucugggggaacuuaaggaaacugaugacuuucgcuuuuaggaccuccaucuugcaguccaugauuguugucucuuagggcugccuauggcuaugaugcuguaacgcuaaugaagcucaucugaaggguuauaagucucuuucugcuggaccaguauaacuugcuuauaauacuguguguguguguguguguguguguguguguguguguguguguguguggcagaggugagauugaaccuagggccuugcauguucugggcaaucauucuaccccugaacuccagccucagccuuuuuuuuuuuuuuuuugguuuuucaagacaggguuucucuguguagcccuggcuguccuggaacucacucuguagaccaggcuggccucgaacucagaaauccgccugccucugccucccgagugcugggauuaaaggcgugcgccaccacugccuggcuuacuuuuuuauuugcuuuacugaaacaggguuuguuuuugguuuuuuauuuauuuuuccaguuuguuugagccaggguuucucuguguagcccuggcugcccuggaacucacucuguagucaccagccuggccucgaacucagaaauuugccugccucugccucccaagugcugggauuaaagguguaugccaccacugcccugccagaaacaggguuuuguuuuauucuguagcccaugcuguccuggaauuugguaucuucauacuucagccccuugaguaacucggauuacaggcaugagucacaaggccuggcuuuuaauauauuuuguaugaaauauugaaugaaguauacuggaaucaaaugaagaaacaaaccuagauauuuauguugcaaaugcuaguuagguuuuauuuuuguaaucagaaauguacuuuucucaguguaagaaugaaaauucacauaagugaauuuauuuuaacagguuuugguucuucaaaaucgcugccauuauugguaucaugauuggaucuuucuacaucccugggggcaguuuuacugaagguaugacucacugcugagggguuaauauguacaacucuguggugacuaagagcugaauuucuguuagugauugguaggacuggccuuuaagaugugguguccaguuguauaacuacauauuaagacagugguagauuaaaaccaggagauaguccacgucucagcuuuucuagaacuauaugauaauuacuguuugccuuagucaggguuucuauuccugcacaaacaucaugaccaagaagcaaguuggagaggaaaggguuuauucggcuuacacuuccaugcugcuguucaucaccaaaggaagucaggacuggaacucaagcagggcagggagcaggagcugaugcagaggccauggagggauguuacuuacuggcuugcuucaccuggcuugcugagccugcucucuuauagaacccaagacuaccagcccagagauggucccacccacaaggggccuuucccccuugaucacuaauugagaaaaugccuuacaguuggaccucauggaggcauuuccucaacugaagcuccuuucucugugauagcuacagcugugucaaguugacacaaaacuaaccaguacacuguuuaauaguuuaucuucucauuugguaacaaaaaguuuaucagcuugucaauaugagaaccuaacauucucaugcugccuuuuccuugucuuaauuuacuuuuauaccauggcaacaggugacaucugacaaucuccaaugugguuuucccacacacacacacuaaaaauaaaggaaaaguugugaaguuauuuggaaugugagagccuauugaagucacuaacaccauccuguucuauguuagugucugccuggacaccccuguuucaccccaaauagccacaucuaccuuggaaacacauuuagacuguugauccugaccaugguucagauauauuagcugaaauaauuucauuuguacaaacuuaaaacuaaaacaauuagaggaaauaaaaauuaauugccauguguugucuggaaaauauugcuaagcucugcaaaaagacagauauuacuccaaucccaguguuaaaagcacuguaauugugguuuugucuuuuaaaauaauguacuggggcuggagagaugguuuagugguuaagagcacuagcugcucuuccagaggucauaaguucaauucccagcaaccacauggugacucaaaaccaucuauaaggggaucagauaagggcgugcagauguacacgcagcagagcacucauauauuaaauaaauagaauuuuuaaaaagggcaaaacaaaaaacccuccacacacacacaaaacaaaaaacaacaguguaccccugagcuugagcaucaagagacauuuuggaggcauuagccuaugcuuggucuguccauuuuuaaaggacuuuuauacucuguguguguguguguguguguguguguguguguuucaagacaggguuucucuguauagcccuggcuguccuggaacucauucuguagaccaggcuggccuccaacucagaaauuugccugccucugccucccaagugcugggauuaaaggcgugcgccacugugccuggcuaggacuuuuauacucuuaauuggcuaaugcauggucauggguaacuaaaguuuuaaaaggucucagggugaaagguaauugccaggaaaccugaugucuagccugagcuugaccccuguaaggaggaaacugaaucacagaaacaauucuuuggugucugugugugcugaugagcacgugugcgugcacacacacaaauagauaaacugaaaauguuucuaaaacaugaaauccagcacaacauuccucaaauaccuguaacuuugaaaugauaacaaucauacuguacagcuggagauagacucuucuacccuguugaugacugcucauaaaguuuggcagucauacugaaauguuauucuuuacugcauuguucuuuuuuuaaauguauuuuuauuuuaugugcauuggugucuagccucugugugugugaguguguguguguguguguguguguguguguguguguguauguaugccuguauguauguauguauguauguauaucagaccuuggaguuauacaguugugaguucccauguacaugcugggaauugugaaauguuauucuuauggugagaaauaacuucucuuucuuuacagucugguuuguugcuggaauguugggggccucuuucuucauuaucauccagcuggugcucuugguagacauggcucacucuuggaaugaauuauggguaaaucgaauggaggaaggaaacccaaggcucugguaugcugguagguaucuguacucaccucagagcaucauacugcuaccuuaaguaggauguauaguaacaucuucaguuuuaaauauauaagcucucaguguaagguuucuauuuuuuuuuuuuuaaaugcaugaggguguuuuaccugcauuuaugucugugcauuuugugcaugcagcaucuauggaugccagaagagggcaucagauuccccuggaacugaaacccaugaccucuggaagagcagagaaccuuuucuccagcucuagagcugccuuuauaaaguugagauuuguuaguugugccuguugugaauuguauacaucgcuggaagaugagcauacuccagucaguuguauucucucggucuguaaugcaacuacuucuguugagaugcucaacaagaacuuucagauucagaauuauacagcuaauagauuauccaugugaauguaaagggauauuucuauagauuauuugaaaguagcagacgaacuguuaucccagaccagggaggucaucucauuauuuguaaagggagccagguuaguguagccagugacuacagaaugaaauugucucagaaggggccuguuuuauuucccagacaucgucccuggcauauaguuacuaggagcucugaccuugugugaggagaugagcucuguguagcuuaggcuagccuugaacuucugauccuucugcuuuagcuuugccaauacuaggacuacaggaacccacccauuacgccuggcccugaacugcuguugaaagaccaggaaucaucuagaaacgcuucuauaugcauuuuuaccugguggauuuaggaguugaauggugaaucauuucaaaacuguaugaaacuuuaaccuuggggcauuucaguuuccuguggcuuacugcucaccauaggaaugaauuaagugucuucauuguacagcauggaagaagacugaugucacuuguagcugugauugacaugguggacacuguucaugcuguuucccccuuuucuagccuugcuguccuuuacaagccucuuuuacauccucuccaucgucuuugcugcgcugcucuacgucuucuacaccaagccugacgacugcacagaaaacaaggucuucaucagccucaaccugauuuuuuguguugcaguuucuauuguguccauccucccuaaaguucagguauggagguucucugcuuucucccguggaagaauuaaugcuagcuaagcuuaaauuccagacaggggcaacacugguauucaguccuuagugaauuggugaauuuauaucagugguuaacuacuuaauauuucuucauaucauaauuaaguuuuuguaauuauagcuuauuaagcagaagucgguaugugcuauugaguggcaauauuuuuuuccuuuuuuuuaauuuuuaauuuuauauuuugagauucucucacauuauaguccuagcuggccuaguucucaccauauacuccaggucuugaaccucagaaccuccuuguuggcauaugccaccauggcaaguugaguucuuccuauauuguguuaacauucauuuacugaucauuaaaaacuagguaacuuggggcuugugaggugccucagugguuuaguaaagauguucaguauccugaguuccauucccuggacccauaggguuaaugaggagaacugacuccugcauguugcccucugaccuucacacagcuucauacaagggugugauaauuucauaaggaauuggaggcugaucuagaaaacuguagugcagcccuuucucaagaaucaagaagaaguaucugagaugucucagccaguaaaggugcuugcaguugaccuuaguaccauaccuugaaccccuguaguggaaggagaaccaauucugaccuccauacuugagguaacacacacacacugaaaaagaacaugaaagcuuaggauauagcaugguugguugauagagagcuuucucagcuugcacaaagccccaaguuugaucagcauuaggcagggugcugcaugcccauaauuguagcauucuggagguggaagcuuaaggucaguuguucgucaucaucuuuggcuuacugaguucaaggccagccuuagauaacaugagauccugucucaaaauucuuuguuaacuuacauuuaauuacuugcuggacauggugcaucuccaacccagcaaugcuggagguugaagcaggacugaguuuggucaacaauaucuaaaagaauuaguacaaacaaagaaaacugaaguuuccaaaaagugguaggucauuuagcuaucuugugguagaguugagcagauuuuucuagaaagcuaggcaguggugguacacgccuuuaaucccaacacuugggagacaggucucugagauucaggacaaccagagccucauagugaaaucuuucuuuuuuuaagauuuauuuacuuaugugaguaugcaauagcuguuuucagacauaucagaagaggaaaucagaucccauuacagaugguugggagccaccaugugguugcuaggaauugaacucaggaccucuggaagagcagucagugcuuuuaaucccugagcccauagugaaauauugucucaaaaaaaaaaaaaaaacccuaaaaaaacaaaacagacuagaaacuuaagugucuuaaaaaccuuugugugauauacagaaguuuucaagauugugaaauguuuuuccaaaccaucaguaaguaagugcauugaguagaguaacucaaacugaagggcuaccugucaucuuuuagcugucaggaagaguaagauuucaauuuggcugcaucucguggaggcacacaggcuuucacaaggucacccuugcgauccaugacauuguuucuguuuugauuucacaggaacaucagccucgcucuggccuccugcaguccuccaucaucacucuguacacccuuuaccucacguggucagccaugaccaaugaaccugguaagggaauggcugacucuagauaaaguacucuugguaggugugcacacuagagcuggagcggauguggcacaagcaguauaguuuacuuugacugugguucggccugcuuacaccaacccauugcauaguguaggcuuuaucuaacuuagacuaagucacagaguuaagagugagcuuguuuggucuuuugguggaauaucuguuuucuguuuucuaccccacucccaucccccagugggauuugacuuaagucccuuuuuugcaguccuagcuguccuguagcuaguuauguagaaaggcugaucucacaaaagauucuccuuucuuuauccccagagugcugggauuaaggaauuacuucucaauagaauauucuacagaugaugaugaugaugaugaugauucuucuucuuccuucuuucuucuucuuuuuuucuuuuuguuuuuuucgagacaggguuucucuguauagcucuggcuguacuggaacucacuuuguagaccaggcuggccucgaacucagaaauccgccugccucugccucccuagugcuuugauuaaaggugugagccaccacgcccggccuuuauugagugacuggaauaagauaagaauaagcucccuuuuggaaaaccuaaacaccaugguaaaacugucaaaacagugaagucacaauagauaggggcuggagagagggcucaucgguuaagagcacugacugcucuuccaaaggcccugaguucaaaucccagcaaccacaugguagcucacaaccaucuguaaugggaucugaugcccucuucuggugcgucugaagacagcuacaguguacuuauauauaauaaacaucuuuaaaaaaaaaaaaaaaaacucgagauaguauuuuuuucuaaagcuagaucauugugauguaaauacaguauugacugcugaguuucagguucuaagcauaacuuuccuguguuuuaaauaaagcuaacugguguguggacaagcccucugauuuaugugaaaauaagagugugaauaagagugagcuguaacuaaugauaacaaacaauuacauuucagagcgguccugcaaucccucccuuaugagcaucaucacacacuuaacuucaccaacugugucuccugcaaauucaacuacucuugcuccugccuaugcuccgccgucacagagugggcacuuuaugaauuuggaugauauuuggggacugauuaucuuuguuuucugccuuauauauucuagguaaguucuagguaagaggugcuuacaguauccucaugaaagugaauaauagguuuuuuuuuuuuuaacgauuuauuaauauauguaagcacacuguagcugucuucagacacaccagaagagggcaucagaucucauuauagaugguugugagccaucaugugguugcugggaauugaacucaggaccuucagaagagcagucagugcucuuaaccacugagccaucucuccagcuccuaauauguugucuuuaaaccauugugaagaauuaaaacaguguaggguuuuuuguuuguauauuuuuguuuuuucaagauaggguuuuucuguguguugcuggcuguacuggaacucucuuuguguauguagaccaagcuggcuuggaacucacagagaucugccugccucuaccucacuaaagcugggauuaaaggcaugugccaccauaccugguucaauagaguucuuuuuaaugaaaaguuguuuacauaucuuugccaguccagcucuguaugccucuuuuugguauuucgagacaugguuucucuguguagcccuggcuauccuggaacucacucuguagaccaggcuggccuagaacucagaaaucugccugccuuugccucccaagugcugggauuaaaggcgugugccaccaugcucagcacugauggcucuuucagacauccugaguucaaaucccagcaaccacauagaggcucaugaucaucuguaauuggauccgaugcccucuucaagcgugucucaagagagugaugguguaaauaaagacuuauuuuacguaaguguagugggaggaguaccaaauuuugucaccuuuuucugccuguagaaaugaucauguaguuuuuguccucuuucuguauuuuuuuuuuacucauuaacuugaucuucuagugagcaucuacagugcuggcauccagaggugacuguagcuagcaaggcaggauuggcaaguguuggcaggacaccuagagagcugugagaaagaggugagaggaagcuccucacccagcuuagacaggggugaggucagaagaauuucacgaggcuauggcacugagaagagaugugacagauaagugaguuagccgggaaucgcugggugguacaggacaagcauagcugaggcacucguguaguaguagaauagccacuggaagugagcuguggagcagcaacuacuaagacuacuguccuggaguuagcaggcagcagguugcugggcagagcuuucauuaggcuuucuguguccaagguaggaauagcccagaaauaacuacacauuuguaggcaaaagaaucauuucaucuaaaacaguuccuuuuugaugugauuuuuuuuuuguggggggggcggauuauuuuccagcuuccguacuucgagcaacagccaaguuaacaagcugacccucucugggagugacaguguuauccuuggugauaccaccaauggagccaaugaugaagaggauggacagccacggagggcuguagacaaugagaaggagggggugcaguauagcuacuccuuuuuccacuugaugcucugcugugccuccuuguacaucaugaugaccauaaccagcugguacagguaagaggcauagacagagguagaagagcacucagcccuugggaauuccuauaacaucucugaaccaucuuuacuguggagcccuuugcugucucagagaaggaaguuucucugaaauccuuucgguuucuuugagauagacuagcuuugaacuuucccauuguucuaguucugcuguagcaaacuuacucugcgauuccaagcauguaucaacaugcugcuugaaauagagccugguuggaauuauugguggcuuucuagacuaguuauuugaaagaaaaucaugaccuaaaagccauucagugugaccuugauaauuuuuuucugugcuuuuagagaugccauauuaaaguaauaauguccuaaggaggaaccacuucagggacugcauuuccacuuugccaauaauuagaguaauucagauaguacugaauaacauugcugaaagaauaguuaggucuuagcaagaaggaaaaugcuugagagucacaguccuuuggccauaauaacugaaaguagcuucucagcuccguacuagaacaguacuaggguuaauggugccagcuaagccucacuguggggucuuuugguguuggucaggauggguggaaugggagggaugcagauuugcaauacuaaucucuuucucccucccuacucucuguuuucuuagcccugaugccaaauuccagaagguauccagcaaguggcuagcugugugguucaaaaugggcuccagcugguugugccuccuccuuuaccucuggacucuuguggcuccccugguccucacaggucgggacuucagcugagcucagugugucaaggacacugauaaagcugaccagagucuccuuuucugaaaaugcauauccauuuugcguuucaucaacgagacuauuaagugaacgcuuugcagauuuggcuguauucagguuuauaucaaaaggcaagauugaguaaugcuugaugcagaaucugagcuuucauauauauauauauauauauauauauauacacacacacacacacacauauauauguuuauuuguaaggcuauagcacaaagggaacauuuuuguguuuuaacaugaacuacagcugugcugugaagagaauucuuuauaaagaccuguagauuccuacaacuuugguuuaaguuuuaaguuagaagauuguuggauauuuaaggcuauuuuuaauuucuauuacagucuccuuaaaaaccaaaaaggaaugcauuaauccacauuucccuucuucagagguguaguguccuggcucuuggcaaggaauuauguauuuaggucaguccccagaaaugcagcugcucauacagcugagagaaggcuauuauugaguuccuuuacuuacuuuuuauacuacacugaugcugcuugauagaagucuguggcuuugucagauaugucacccaaguaaaugcuuuguagaucugauuaaaaugaaaagcucacuugagaaacacugcagaguuauguaaugaucuuguugugagugugugaaagucaaaggcaugucaguuuauuacauuugcaacauaaaaguacuuaauuaaaauagauauuuaguuucuuguuuguuuguguauuuguuuagaaagggucuuuuccacauaacccagacuugcuuggaaugcagaucauccuaucuccacuuccaaguacugaggaggagguuucuaucaccauagcuagucuuuucuuaaagauccuucugcagugggguugauagguuuucuuuuauuguuguuuucuuguuuagagagucccaaaucaaucugacauuucaggcaaaaugcuccucuucuaacacuuaagauuugacuagucaaguuuuuaaguucauuuagaaacuacccuaaauauuuucucuggggaagaucaaaguagguaagaaacaguuuaggcacugucaaaaaagauauuccugaaaagcagugugcaaaggagguaugauaaaacaggcuuuucaagagaaacuaguaucgguucugcacuaggcccuguuggggugaagacaagacagacauucuuccaucuaaggaaaaugagcggaccagccugguaaauuagugcugaaaacucauaaacagaaaucaguggauagaggcuagcacagugacuuccucgagagagugcuguuaggauuuguaacguagguucacaccagguaucagggcaguucaucugagauuugaacuaaagauguaaggggguuuggggaaaaauugacagcuuagagaauuuccacauugguguuuaaggggauaggaaaaacuuauuuccaguuuaaucuguguacauagguucugcuugggauccugguugggauggagguggucccuucauaugaugaauagguuugggagucagaccucuggggucugccugaccucugcuauuuucuagguugaguggcugucuaaugcucacugaguacaugcugugcuugugaccuugagcacucugccugggccucaugcagaacuuaguaccagagauuauuugaagauaaaguugucucagaauggauauguuguaaggauguuugacaguaagugccaaugucacuauggauuaaagcaagacuaaauguacuuaaaaggucagaaguguucagaaucugauagaggcuggguugaauguaguuuuagagaauuaaacauaguuguaauauagacagcuagguagagcuggaggcuagggaagcuggguuugauggguuguuggaacuacuguccuuuaggaucaugugucaaagcaaacuacaaaggauuugugaagcagauaauuguggcccuuaagcuuaacugugugagacaaauaccuguuuuuaacaguaggggaaccauaaauuucaaagcggauccuauucuuugucuuauaugauuaaaaauaaauggaguucuaaacuaccaaauaauguaauagaguucaauaaaggguuuuuuuuuuuuuucaccaugauaccuuagauuaauuugaaauaaguucucuuaaaaacagagcaauucuac

SEQ ID NO: 1250 - RNA, 1475 nt, Mus musculus
uuugaacuaguuuuauugggaaaauacguuuuugaaaaugggauuucuucuugaaggugcaaaguuuauccuuaaccaguagcagaacaccuuaagauucaaauguagcgcccagaagcucggaauacccaagguacaauucacaaaccacaagaaacucaagaagaaggaagaccauaguguguauacuucuauccaucuuagaaggggggaacaaaacacccauggaaggaguuaauagagacaaaguguggagcagagacugaaggaaaggccaucuagagacuugacucgccuggggauccaccccaaauacaaccaccaaacccagacacuguugagaaugccaacaagugcuugcugacaggagccugauauagcugucuccugagaggcucugccagugccugacaaauacagaaguggaugcucacagccacccauuggacugagcauaacguccccaauggaggagcuagagaaaaugaccuaaagagcugaagggguuugcagccccauaggaggaacaacaauaugaacuaaccaguacccccagaacucccagggacuaaaccaccaaccaaagagcacacauggugggacucauggcuccaguugcauaugcagcagaggauggcauuguuggacaucaaugcggggagaggcccuuuguccugugaaggcucuaugccccaguguaggggaaugccagggccaggaagcggguguggguggguuggcgagcaggugaaaggggauagggaaaggguguuuuccagaggggaaaccaggaaaggggacaacauuugaaauguaaauaaagaaaauauccaaaaaaguaaauaaaauuucacgccuggcggugguggcacacgccuuuaauccuagcacuugggaggcagagacaggcagauuucugaguucgaggccagccuggucuacaaagugaguucuaggauagccagggcuauacagagaaacccugucucgaaaaacauagauagauagauagauagauagauagauagauagauagauagauagauagauagauagauagauagauaaauuuucacguguagcaaccaugcuaagggaagugcccccgugguguuggaucugagaaagaguugauagacagcagauuccugugucucguuuagagcuugggguggggguggggagauguucugaccuuguaaaggggccuccacuccucgggugugagagaggaacagcuuggccuggccagacaccuguacuucguccuugccuuccagaauaaccagagcucucauggacucccugggaccugaguggcgccugaagcugcccccuaucccuguggugccuguuucagcccagaagagauggaauuccuugccuucagauaaccacaaagagacagcuaaaaccaaauccaaagaagccacagcuacgaagagcagaggugagcugggcuggggcuaaguuua

SEQ ID NO: 1251 - RNA, 12310 nt, Mus musculus
cgcugggagucccgggaccuugaagauaaggcuuggacaggauaaauccagugugaggaucggaucggggcuuagaugugugaacgguaucgaagucaguggcgguagaugugcccagagggcagcaagagagcggccugggccucgaugagcagccauggaccccagggagacaacaggugagcccucuccuuccuguguagccuaacuaggucccuugagaaccacuaagggaacacacacacuguacggauggaaaaugugcugcccaauaagacuacccagcugggcuccaggcacagaacuaaaccuagcucucaccccccuacaccccaccccugucucuuccuccagagaagccugguucccuugcaccuaagaaucacuaagccuuucuuccguuccccaccccacccccacacggcacacugagccugcucuauccauuuuucugugguuucuuggcagagcaggccaucgccccuuaacccacggcugccccucccucaaccccccaguuccuugaaugagcccauucugagcaaggccggugcguggcucugacuccagaccagcuuccuauccgagauucuucucccuucuggcuuuccagcgaggguagaagaacaaaaauccuucuggcagggucuguggugguaaggugacaagcuagcuagaugugccaguggcuugaugguggagguaggaggaaaggcaagccuuuucuagagugggccagagcggagccagcaccccagggcaaacaucugaguauagcuccaccgggccuuugaaacucaggguuggcucuugacuaagggcucccuuaagcuccucuuggcuuaagucaacacgcacuugaugucgcuugcaccucaggacucuuagaaagucaaaacagcugcccucucaauuucagcuuuccaaauccgcuguuccacggggggggggggggcggucuagggagggcaaagagagucaucaucguucaaaggcuugcuuugaaguaguggcccauuagagugagcccaggucuccugauaaggauccuugcauugaagaggaaauuucucggacgcccuuaggauagggaaagugcauucccaaggaaagugcgcuccaaagaggucugaguucaagagcuaauccggaaaggacacuuugggaaggugccaggcguggagggagauuagggaaggaggaccugcauuuuguuggccuugccagagggggaucggaaaagguacugcagguuagacguggacacguaggcuguuaagacuugucccccuacggguuuuacgcuggcuucccugcagaccccucguugcccccgggcccuuugacucaccugagccugccggacagcucagaggugcggcuacagagcgacgggcccagccuccuggggaguuggaccagguaacggcggcggcgugggcagguugcccuaaguggggaaugccagacagccagggcgagcccaagcggcagcugcauuuaaccuggagcgggaggguggggagggggagcgcgggcugcgaccccucccacuggcaggagcguucucccccuuccucucaacacucgggccccagcaagcacggcgccccuuuuuccugcugcucugggagcugcaggcgcgagcugcgggccggaauugggcuacagcuggagucgggcggcgacacuccgggcagccggaaugcucuggaauccuacacgagacacuucccagaggagagccccaagaggcggagcgguccugaccgccgccugccuggccugccugggcuuccaaggacgcgcccgacucuugcccuccucugucccuuccuggagugaugaaaggccgagacuugguccugccguaaagguaaaaggacucaaaaggacagccuuggaguucccagcucucuucagggcccaacuugcucauuucccaaauaaagacucaccacagacucuuuuucaugugcuccuuuuaauugcgcaggcuuugagagaacccauccucauuugucaaacucucggacugauaagcaacagaccccagagagcugacccgugcuacacucaaagaaaagaaaacccccguagcauuaagccaaggguguuguuugggcaucagaaagacucagauccgccgccucccccccaccccaauccugguaaugcaguuuggagccuuggucacauuuucaccggugcaugugccugcucgaauugagguugugcuccggaccuggagcuggcaaaggcuguuuccccuuaugaguugaaagcuuaauuacuauuuccacaaagcccaccuccaucugagaaccaaauguaggguuuuaaacacagcuauuccacuuggccccagacuacaacagccgggaagccacccacacaguguagcaccugggugauccuggugaggucugugcaggguucuuggaacacaaauauuuagcucauuucccaaguccuucuucccccagaucccuuggaggacauaaaucaaccccaucuccaacuucagcucacucagcuucaggggugggcuuugugccaacucaacccuugacucuccuuccuguggccccgugggcccaacccccauuccuaggucacccccagagcaugccaucauccuaagagaaggugugcgcacaugccugcagcaaagaugugagcagacuguguggauccugcaugccaagguggcucagaaauccuauggaaaugagaagcgguagguggcucccuaccccgacccaggucuccacagccuucagcccuaugccucccuccaaacccaccaccauuuagcuucuuugacaucuuggaggccucaaggcugacaccucagccauuguucagccaggguccuguuccccagccaacaacagcugccuacugggaucuagagcagaacuugacaguggcugucagauccccacauccccgaccaguauccauucauucugcugcguacuacaugucacgcaccagggucacugcugggcacuaagccuccagcuggaccaggcagauacagccucuacuuccauggcaucuccauucugguaggggacaugcagucaccuccccacaagccagcaaacaagguauuucagauugugaugagagccagagaaaaacagaguggagucacauaguagaccaaaggggauaccuuagcuugaaaggucaaggaggucaaagggcucuuuaagaagugacauuggagcugauguaccagugcugagauagagccaggcaugggaaaacuccaggaagcauucuaacuggaagcaauagaaaacgcaaggaccucaaggcuauauacucaguacuguaagaggaugaaagggggagacuggucagaagagggggacguuagagaagaugacaggagaagcaguguccaggucaugugaggauuugggauuuuaaaccacaagggauguugauaagaggacaucacaauuugauucauuuucauuauuauuaauaauaucguuuauuuuguuauauuuugggggggauaagacagacucuaacucuagcucaggcggaaccuauaccaauccuccugccucagaggccccaucccuuccguacuggguuuaggauuacaaacgugagccaccacacccaacuuaauuuaacuguuacuucuuuccagauuauuuauguauuuuauauauguguguguauuuugucuacaugcaugccuguacacuagaagagggcauuggaucccauuacagaugguugugagccaccaugugguugcugggaguugaacucagaaccucuggaagagcagccagggcucuuaacugcugagccgucucuccuaccccuugacuguuauuuuuguuguugauguugguggugguucuggugcugguggugauacuggugcuguguggauguauagaugccacgauuccuguggagguaagaggauaaugugugcaguuagguguacaguugguucucuuccuccuuuugauggguucugggcauugaagucaaguuaucaugcuugccucagcaagccuuuuauccacugagccaccuguuacuuaagaacuaaucuggggcuggagagacuacucaggguuaagagcacugguggcugcucuuccagaggaccugaguucaauuccucgcaacuacuugcuggcucacaaccaucuguaaugggaucugauguucucuucugucagauggucucuucugccaugcaggcauacaugcaaauagagcucucauauccauaaauaaauuuuuuaaaguaaucuaguugcugugugaaaaacaaacuaaaagaggcaucuguagcaagggagagacagauggaaggcugaguugggaaggcaagggauagugguuaggaccaaggugaaguugguaggaaucuaacggauuccagauguguuuugaagauggagcgggcaggacuuacugaugaggucuaauaaugcauuaacgguuucacucugggagaggggacacuaaaucaugauucuuuaaaaauuuaugccaccuugagacacuuuuaagacagugaaaaugauguuauguguucccagguucuucuguccuccacccugugucuaccucgcggguccuggcuggagggugaagccaaugcaagaccaaggugagagugcccugacgggcuguugcucgguucugcaggaaggaccaacugccucagcagggcccgggagcccagacgguugcaggcgcagucucgcugcgcccucuggcggcaagaacuaaguuugacccgcaccugagcuucccccagacuuccaggguuuaauucccguccuuuuucagcccuccaaucugcggagaccgggcccaccgucugcgguuacaugggacuggacggugcguccggcagcgcucccgagacccagaaguugaacuuugaagagcagccggacuccagggugaggcugcacuagagagcaucagauuccugcuccuggcguugccucuuuuuuuuuucuuuuuguagaggaggcaaaacuguagacuccccaaguccccuccagaagccaaaaggcaacuggggaggccagaggguggguucugaccuagucccuagauuaguacgguuucuuguccuaaugguaaggaugucauaacugcggaagguuggcucuuccgcuggcaaaguugagauaaggccugccgcauccccuugagccccguaggaauuugguugugccaagacccuguacaucucggacgccgauaagaggaagcacuuccggcuggugcugcgacuggugcugcgagggggccaggagcugggcacuuuccacagucgccucaucaaggugaucuccaagcccucgcagaagaagcagucgcugaaaaacacagaccgugagaggggcgagguggaagggugcaauucgaacccagagcugcaaaaaugggcggagggugcaaguguggaggagggggugagagguggagucuggguagaaagaagggaggagucuggguggaguggcuggccuagacuaagagaaaaggcacacagagauuucagacaggacacagguaagagauagauaucagauuugaagaugacagugggggacucagaacagacaaaagcugcagccaggugccaaauccggggcaaauuaaaaaugaccuuaaggaaguugcaucagccaaagauggugguucccauguguaauuccagugcuuagauaaaagaacucugaacucuuaucuaggucagccuaggagggagugaguggggaaaggaaagaaaaauggaucgggagagagaaggaaagagagaggguggguugauugguugauuucaguauagcauaccauguggcuugcuugagacugucugcccagaaagugucccccagucuggagguaaccacgacucagugugaucccggaauccagcuccuuggugucauugaaaaguccuguggaauaucccaguuccaagcaguguccuagcuggcaccuuggugcucaggaaaagugggggaccuagaguaaugguuaugcgugcagagucuggcagucuggcuucgaauccuguccuggagagugaacugagcugacauauguauuuagaaaagcaaaggauggggagauggcuugguggguaaagugcuugcaaggcaaacacaugagccuggguuugaauacccguaaaaauugaguguggcugcagaugucagugaucccagcucugagcaaauagacaauaggauccuccuccaacucucuggcuagaaagcucuagccaaagagcucucaauccagugagagccuuuguuucagagaauaagguagagcguaauagaauaaggugucgggagucuagcucuggccuccacacccacgcacacacagcuguguguguccagccacacgccugcacacacauacagaaaaagggaagagcagaagaaucuauuguauaguaaauuaaauggaaagggcuugggcuagguauaaauggaaggccagcagucuguccagcacggagaggagaugaacagcacuuggucagugccugauccccagcugguguaaguccaguaaaaaaaaaaaaugaagcugugacugagagcaugccaucggcuggaagacaagccaggcucuaggagagucccccuguucuuucagacucuagcagccaucuaugcaacucccaccugcuucacacuucccacccccaagaagccuuccuuagcuuagaccuuucccacacggaguuagcauuuuguauuuaugcccuccagaccaugaacuauuucagagcaaagcuggacccaguucacacaucaauacccaguacccgacgccgugccugccacaaagcagccccgagugacuugaugaacccagcucacaucacugaaggauguucauuuguaccagggagcuggcaagcucaaaaaucaagaccccaggcaaaaggcuaugaaaugcagauaaccauugagucuaggccagugggcauauuagccaggcuguuacaugggucagaagaugagcugaggcaucugagagaccacaucugagaggccuggguacugauuccacguuccccucgcaguaugcaucuccuccggcucaaaggucucccuuuucaaucgccugcgcucccagacaguguccacgcguuaccucucuguggaagauggggccuuuguggccagcgcaaggcagugggcugccuucacccuccaccuggguaaucucaugagcaggugcgggcugggugcuccguguguuagcauaguuaaucaacccuacaggaagaugaagcaguguaacugucccuuggggaggggggugaaggcuugcccuuggcccuagugagucggucaggaacccgaugucuucugaucccaguggcuagcuaugaccuuucuccuccagccaaucaguggcugcccccagggagcauaccuuacuguggaugaucacagacuagcucuccaggauuagaaccuuggucuuagcuuccuuucucauggcuagcugcguugugcguuaaagccagaggugaagagacaggguuugagaaguaaugaaccuuuguuucuuccuuccuuccuuucuuucaucuccagcugaugggcacuguucccaaggggacuucccaccccaggaagguuacauccgcuacggcucccuggugcagcuugucugcacugucacaggcauuacacugccgccuaugguaugggacuucauggcuaucaaagaauagagcugccuggcugggugaggagccucuggggaccccacacccugcuaccucacacacacacacacacacacacacccgcccgucacccuucugccgcagaucauccgaaaaguggccaagcagugugcccuccuugauguggaugaacccauaucccagcugcacaagugugccuuccaguuuccaagugacaccccaggaggggcuggcaccuacuuaugccuugccacagagaagguggugcgauuccaggugagaagcagagacuaccaagcaucccuggcagaacacagccauagaacauaagcucuucuccacaaagacugcuucuuaagggaacaguguugcccccuggaggaucaaaagucauagaaugcagaaaaaaugauguaauuacuauuauuaaauaauauuccuguucaggggcuuuaagacauugggaauacaaaauugcagaauauagagacuggagguggcucgguaguuaagagcguuuguugcucuuccaaguuccaaguuuauuuccuagcacccacacgguagcccacaacuucacaaccaccuguagcuccagcguuagaggaucugacaccucuuucuguccucugaacgucacacacguauggcauaaauucacauuuacauaaaugaaaagaaaacugcaggauauaaagaaaaucauaguaggaaaaaguacuggauaauguugaacacaguuacaggaugucaaggcacaaaaucaguguggaaaacaauaauuauuaaguaauauuccaagccggguguaguggcacaugccuuuaaucccagcacucgggaggcagaggcaggcagauuucugaguucgagcccagccugguguacaaagugaguuccaggucagccagggcuacacagaaaaacccugucucaaaaaaacaaaaacaaaaaaaccaccaccaacaaaaaaaguaauauuccuccuaaaauauuauucuggaauguuaguagauaaaauaaugaaauaauauagaaaauaauuauagccagguggcgcaugcuuauaaucccagcacuggggaggcagaggcaggaggaucucuaagauugaggccaaccuggucuauagagcaaaguccaggacagccaaggcuauauagagaaauccugucuuaaaaaagaaagaugggggggggagaggagagagaaggaaagaaaaaugauuauugaacaauauuuccucacagaaaguauuauaauuauuuuugguuuuguauauuuauuugaggcagguuuuauuuaaagacugaccuugaguucauaaucccccugccuccaccuaucaaauguaccacuagucccagcuaaaacuguagaauguuaaggcagagaaguucgcuuuguuuuuuggagucaggguuucucuguguaacccuagcuguuauggaauucccucuauagaccaggcuggucucaaacucacagagaucugccugccucugccuccccagugcuggguuugaaggugugcuccaccacacccugcuuaagguacaggauuguacaauguuaaaggauagaggauguggcuggaaagagagcucacuggguaaagagcaucugcagcucuuucagaccaaaguuuggucccuagcacccaugucaggcagcucacaacucucuguaauuccaguuccaggaaaucuggcacuccccuguggccugugcuaacaccugcacacauggcgcauauguucacacacacacacacacacacacacacacacacacaggcauguaaauaaaaauaauguuugcguagaggaaccugaugauguagguuguaacccuauuugugaggcugaggucgaagggcagaguauucaaggccuguugugcuacagugaguucaagaccagccggagcaauuucgugagaccuuccuugucugaaagagaggagaaauuccgcucacuggcaaagugagcgugugcagaauucuaggugaaguucccaaugccaagaaagaacgacuucagaaaacuaguuuauuagaaaguaagcugguucaaagauuuaguuuacucuaagugaaagaauguuaaaaucuugggaccggggaaaugcuaguugguaaagaaccuaccgcgccuggccuguacucgggagcccgacacucccgugccucucaucagcacucuggaggugaaucugcaggguagugugcagccuugccugucugccugcuugccugucugcuugccugccugccugccugucugcuugccugccugccugccugccugccugccugccugccugccugccugccugccugccugccugccugccugccugccugcuugccugucugccugccugccugccugccugccugccugccugccugccugccugccugccugccugccugccugccuguggcaucugaaucuaacacccuagaacucacauccuuuuuuuaaaauugaguaugauggccagagcuuguaauccuagcaccugggaggcaacgacaggagaaucccagggcuuuccuuagucacucgguauagccagaugagcuaaccucugguucaguaagagacucugccucaaaaaauaagguagagagcaacugaaaaagacaccucaauugauagccaccucuggccuccacaccuguacacacacacacacacacacacacacacucaggcacacuacaaauaaaaaaauauuuuuuucuaaaaaagaccuuugguuuuauagauguacauauaugcauacacacauauacaucuauguguauacgcauacauacguagcccauacaguguaugggucucacacaagcucccugaggcagauaaacugggaaacuuagaaggaaaacuugauaaagugggaccacuagcgaagcuucaguuccauccuuuggacuuccugccaggcuucccucugccccaaggaggccaacagggcgcugcucaacgacagcucuugcuggaccaucauuggcacggagucgguggaguucaccuucagcaccagccuggccuguacucgggagcccgucacuccggugccucucaucagcacucuggaggugaaucugcaggguggugugcagcccugccugccugccugccugccugccugccugccuaucugcucuaggaauggggaggcuguggaggaagggcaggaggcuccuucuaacccaccaccaucaccacucccucgucaccuacaucuggucccauccaccccccagcugagcgguggaggugauguggccacgcuggagcugcacggagaaaauuuccacgcugggcucaaggugugguucggagacguggaggcagaaaccauguacagguacagagaggcggugggaacagcuugggccaagggauccagagacuggaauguuuaugauuggcuucaaccuccaugccccgcccacaggagcccucguuccuuggugugcguagugccagacguggcggccuucggcagcgacuggcguuggcuccgcacccccaucaccgugcccgugagcuugcugcgcgcggaugcgcucuucuaccccagccccuucucuuucaccuacaccccggaauacagcgcgcugccacggcugcccaacgcgcaagagccugcccccgacgcggacacgcuccuggagagcauccaccacgaguucacacgcaccaacuuccaucucuucugccccaccuaggcagugccacugaggcugacuccaggcccgcagcugucccucagggaaaaagagcaggaaggagagagauagcucaccugaccucaggccacucacuguccucagacauacaguaacugucuucaaucaugagugacguucuaaugucuucacggcguggcgugcuuccuguuuuuguuaccuuauagauuuauucuuccgcuuuugucucuuucuggcucuuccugggucggugaccgguucugaggauccaagccuauuggggauuugcucuccagacaucuguguccccacuugaaaacaaguugcaugaaguaagacuagaaugucuagggcccugaucccaugaggucccucuuagagcuaggcgucuaucugccuguggugacacucucuauggcacccucgccuggguuuggucucugaucacuaucccaugacauuaaugucaggcagaggccuaggacggcucucuucacugucccaaggccacuucuccuucaggacccagaggaagagccuaaggcuaaagauccuccuguauccagguacaggugacugggaaacacugugcuggggacagggauggcaaggugcaaggcugagugcuccccggauuccauccaaaccagagucugauggagcuggcaccuuuaugacucucugcggagaagaaaugggguucuaaggcagcagauacccuaagccuagaggcuaccuuggcagccagcaacuagcuauacccccaugccaaguaucuuaguuaguuaggguuuuacugcugugaacagacaccaugaccaagg

SEQ ID NO: 1252 - RNA, 12310 nt, Mus musculus
ccuuggucauggugucuguucacagcaguaaaacccuaacuaacuaagauacuuggcauggggguauagcuaguugcuggcugccaagguagccucuaggcuuaggguaucugcugccuuagaaccccauuucuucuccgcagagagucauaaaggugccagcuccaucagacucugguuuggauggaauccggggagcacucagccuugcaccuugccaucccuguccccagcacaguguuucccagucaccuguaccuggauacaggaggaucuuuagccuuaggcucuuccucuggguccugaaggagaaguggccuugggacagugaagagagccguccuaggccucugccugacauuaaugucaugggauagugaucagagaccaaacccaggcgagggugccauagagagugucaccacaggcagauagacgccuagcucuaagagggaccucaugggaucagggcccuagacauucuagucuuacuucaugcaacuuguuuucaaguggggacacagaugucuggagagcaaauccccaauaggcuuggauccucagaaccggucaccgacccaggaagagccagaaagagacaaaagcggaagaauaaaucuauaagguaacaaaaacaggaagcacgccacgccgugaagacauuagaacgucacucaugauugaagacaguuacuguaugucugaggacagugaguggccugaggucaggugagcuaucucucuccuuccugcucuuuuucccugagggacagcugcgggccuggagucagccucaguggcacugccuagguggggcagaagagauggaaguuggugcgugugaacucgugguggaugcucuccaggagcguguccgcgucgggggcaggcucuugcgcguugggcagccguggcagcgcgcuguauuccgggguguaggugaaagagaaggggcugggguagaagagcgcauccgcgcgcagcaagcucacgggcacggugaugggggugcggagccaacgccagucgcugccgaaggccgccacgucuggcacuacgcacaccaaggaacgagggcuccugugggcggggcauggagguugaagccaaucauaaacauuccagucucuggaucccuuggcccaagcuguucccaccgccucucuguaccuguacaugguuucugccuccacgucuccgaaccacaccuugagcccagcguggaaauuuucuccgugcagcuccagcguggccacaucaccuccaccgcucagcugggggguggaugggaccagauguaggugacgagggaguggugauggugguggguuagaaggagccuccugcccuuccuccacagccuccccauuccuagagcagauaggcaggcaggcaggcaggcaggcaggcaggcagggcugcacaccacccugcagauucaccuccagagugcugaugagaggcaccggagugacgggcucccgaguacaggccaggcuggugcugaaggugaacuccaccgacuccgugccaaugaugguccagcaagagcugucguugagcagcgcccuguuggccuccuuggggcagagggaagccuggcaggaaguccaaaggauggaacugaagcuucgcuaguggucccacuuuaucaaguuuuccuucuaaguuucccaguuuaucugccucagggagcuugugugagacccauacacuguaugggcuacguauguaugcguauacacauagauguauauguguguaugcauauauguacaucuauaaaaccaaaggucuuuuuuagaaaaaaauauuuuuuuauuuguagugugccugaguguguguguguguguguguguguguguacagguguggaggccagagguggcuaucaauugaggugucuuuuucaguugcucucuaccuuauuuuuugaggcagagucucuuacugaaccagagguuagcucaucuggcuauaccgagugacuaaggaaagcccugggauucuccugucguugccucccaggugcuaggauuacaagcucuggccaucauacucaauuuuaaaaaaaggaugugaguucuaggguguuagauucagaugccacaggcaggcaggcaggcaggcaggcaggcaggcaggcaggcaggcaggcaggcaggcaggcaggcaggcagacaggcaagcaggcaggcaggcaggcaggcaggcaggcaggcaggcaggcaggcaggcaggcaggcaggcaggcaggcaggcaggcaagcagacaggcaggcaggcaggcaagcagacaggcaagcaggcagacaggcaaggcugcacacuacccugcagauucaccuccagagugcugaugagaggcacgggagugucgggcucccgaguacaggccaggcgcgguagguucuuuaccaacuagcauuuccccggucccaagauuuuaacauucuuucacuuagaguaaacuaaaucuuugaaccagcuuacuuucuaauaaacuaguuuucugaagucguucuuucuuggcauugggaacuucaccuagaauucugcacacgcucacuuugccagugagcggaauuucuccucucuuucagacaaggaaggucucacgaaauugcuccggcuggucuugaacucacuguagcacaacaggccuugaauacucugcccuucgaccucagccucacaaauaggguuacaaccuacaucaucagguuccucuacgcaaacauuauuuuuauuuacaugccugugugugugugugugugugugugugugugugugugaacauaugcgccaugugugcagguguuagcacaggccacaggggagugccagauuuccuggaacuggaauuacagagaguugugagcugccugacaugggugcuagggaccaaacuuuggucugaaagagcugcagaugcucuuuacccagugagcucucuuuccagccacauccucuauccuuuaacauuguacaauccuguaccuuaagcagggugugguggagcacaccuucaaacccagcacuggggaggcagaggcaggcagaucucugugaguuugagaccagccuggucuauagagggaauuccauaacagcuaggguuacacagagaaacccugacuccaaaaaacaaagcgaacuucucugccuuaacauucuacaguuuuagcugggacuagugguacauuugauagguggaggcagggggauuaugaacucaaggucagucuuuaaauaaaaccugccucaaauaaauauacaaaaccaaaaauaauuauaauacuuucugugaggaaauauuguucaauaaucauuuuucuuuccuucucucuccucucccccccccaucuuucuuuuuuaagacaggauuucucuauauagccuuggcuguccuggacuuugcucuauagaccagguuggccucaaucuuagagauccuccugccucugccuccccagugcugggauuauaagcaugcgccaccuggcuauaauuauuuucuauauuauuucauuauuuuaucuacuaacauuccagaauaauauuuuaggaggaauauuacuuuuuuuguugguggugguuuuuuuguuuuuguuuuuuugagacaggguuuuucuguguagcccuggcugaccuggaacucacuuuguacaccaggcugggcucgaacucagaaaucugccugccucugccucccgagugcugggauuaaaggcaugugccacuacacccggcuuggaauauuacuuaauaauuauuguuuuccacacugauuuugugccuugacauccuguaacuguguucaacauuauccaguacuuuuuccuacuaugauuuucuuuauauccugcaguuuucuuuucauuuauguaaaugugaauuuaugccauacgugugugacguucagaggacagaaagaggugucagauccucuaacgcuggagcuacaggugguugugaaguugugggcuaccgugugggugcuaggaaauaaacuuggaacuuggaagagcaacaaacgcucuuaacuaccgagccaccuccagucucuauauucugcaauuuuguauucccaaugucuuaaagccccugaacaggaauauuauuuaauaauaguaauuacaucauuuuuucugcauucuaugacuuuugauccuccagggggcaacacuguucccuuaagaagcagucuuuguggagaagagcuuauguucuauggcuguguucugccagggaugcuugguagucucugcuucucaccuggaaucgcaccaccuucucuguggcaaggcauaaguaggugccagccccuccuggggugucacuuggaaacuggaaggcacacuugugcagcugggauauggguucauccacaucaaggagggcacacugcuuggccacuuuucggaugaucugcggcagaagggugacgggcgggugugugugugugugugugugugugagguagcagggugugggguccccagaggcuccucacccagccaggcagcucuauucuuugauagccaugaagucccauaccauaggcggcaguguaaugccugugacagugcagacaagcugcaccagggagccguagcggauguaaccuuccuggggugggaaguccccuugggaacagugcccaucagcuggagaugaaagaaaggaaggaaggaagaaacaaagguucauuacuucucaaacccugucucuucaccucuggcuuuaacgcacaacgcagcuagccaugagaaaggaagcuaagaccaagguucuaauccuggagagcuagucugugaucauccacaguaagguaugcucccugggggcagccacugauuggcuggaggagaaaggucauagcuagccacugggaucagaagacaucggguuccugaccgacucacuagggccaagggcaagccuucaccccccuccccaagggacaguuacacugcuucaucuuccuguaggguugauuaacuaugcuaacacacggagcacccagcccgcaccugcucaugagauuacccagguggagggugaaggcagcccacugccuugcgcuggccacaaaggccccaucuuccacagagagguaacgcguggacacugucugggagcgcaggcgauugaaaagggagaccuuugagccggaggagaugcauacugcgaggggaacguggaaucaguacccaggccucucagauguggucucucagaugccucagcucaucuucugacccauguaacagccuggcuaauaugcccacuggccuagacucaaugguuaucugcauuucauagccuuuugccuggggucuugauuuuugagcuugccagcucccugguacaaaugaacauccuucagugaugugagcuggguucaucaagucacucggggcugcuuuguggcaggcacggcgucggguacuggguauugaugugugaacuggguccagcuuugcucugaaauaguucauggucuggagggcauaaauacaaaaugcuaacuccgugugggaaaggucuaagcuaaggaaggcuucuugggggugggaagugugaagcaggugggaguugcauagauggcugcuagagucugaaagaacagggggacucuccuagagccuggcuugucuuccagccgauggcaugcucucagucacagcuucauuuuuuuuuuuuacuggacuuacaccagcuggggaucaggcacugaccaagugcuguucaucuccucuccgugcuggacagacugcuggccuuccauuuauaccuagcccaagcccuuuccauuuaauuuacuauacaauagauucuucugcucuucccuuuuucuguaugugugugcaggcguguggcuggacacacacagcugugugugcguggguguggaggccagagcuagacucccgacaccuuauucuauuacgcucuaccuuauucucugaaacaaaggcucucacuggauugagagcucuuuggcuagagcuuucuagccagagaguuggaggaggauccuauugucuauuugcucagagcugggaucacugacaucugcagccacacucaauuuuuacggguauucaaacccaggcucauguguuugccuugcaagcacuuuacccaccaagccaucuccccauccuuugcuuuucuaaauacauaugucagcucaguucacucuccaggacaggauucgaagccagacugccagacucugcacgcauaaccauuacucuaggucccccacuuuuccugagcaccaaggugccagcuaggacacugcuuggaacugggauauuccacaggacuuuucaaugacaccaaggagcuggauuccgggaucacacugagucgugguuaccuccagacugggggacacuuucugggcagacagucucaagcaagccacaugguaugcuauacugaaaucaaccaaucaacccacccucucucuuuccuucucucucccgauccauuuuucuuuccuuuccccacucacucccuccuaggcugaccuagauaagaguucagaguucuuuuaucuaagcacuggaauuacacaugggaaccaccaucuuuggcugaugcaacuuccuuaaggucauuuuuaauuugccccggauuuggcaccuggcugcagcuuuugucuguucugagucccccacugucaucuucaaaucugauaucuaucucuuaccuguguccugucugaaaucucugugugccuuuucucuuagucuaggccagccacuccacccagacuccucccuucuuucuacccagacuccaccucucacccccuccuccacacuugcacccuccgcccauuuuugcagcucuggguucgaauugcacccuuccaccucgccccucucacggucuguguuuuucagcgacugcuucuucugcgagggcuuggagaucaccuugaugaggcgacuguggaaagugcccagcuccuggcccccucgcagcaccagucgcagcaccagccggaagugcuuccucuuaucggcguccgagauguacagggucuuggcacaaccaaauuccuacggggcucaaggggaugcggcaggccuuaucucaacuuugccagcggaagagccaaccuuccgcaguuaugacauccuuaccauuaggacaagaaaccguacuaaucuagggacuaggucagaacccacccucuggccuccccaguugccuuuuggcuucuggaggggacuuggggagucuacaguuuugccuccucuacaaaaagaaaaaaaaaagaggcaacgccaggagcaggaaucugaugcucucuagugcagccucacccuggaguccggcugcucuucaaaguucaacuucugggucucgggagcgcugccggacgcaccguccagucccauguaaccgcagacggugggcccggucuccgcagauuggagggcugaaaaaggacgggaauuaaacccuggaagucugggggaagcucaggugcgggucaaacuuaguucuugccgccagagggcgcagcgagacugcgccugcaaccgucugggcucccgggcccugcugaggcaguugguccuuccugcagaaccgagcaacagcccgucagggcacucucaccuuggucuugcauuggcuucacccuccagccaggacccgcgagguagacacaggguggaggacagaagaaccugggaacacauaacaucauuuucacugucuuaaaagugucucaagguggcauaaauuuuuaaagaaucaugauuuaguguccccucucccagagugaaaccguuaaugcauuauuagaccucaucaguaaguccugcccgcuccaucuucaaaacacaucuggaauccguuagauuccuaccaacuucaccuugguccuaaccacuaucccuugccuucccaacucagccuuccaucugucucucccuugcuacagaugccucuuuuaguuuguuuuucacacagcaacuagauuacuuuaaaaaauuuauuuauggauaugagagcucuauuugcauguaugccugcauggcagaagagaccaucugacagaagagaacaucagaucccauuacagaugguugugagccagcaaguaguugcgaggaauugaacucagguccucuggaagagcagccaccagugcucuuaacccugaguagucucuccagccccagauuaguucuuaaguaacagguggcucaguggauaaaaggcuugcugaggcaagcaugauaacuugacuucaaugcccagaacccaucaaaaggaggaagagaaccaacuguacaccuaacugcacacauuauccucuuaccuccacaggaaucguggcaucuauacauccacacagcaccaguaucaccaccagcaccagaaccaccaccaacaucaacaacaaaaauaacagucaagggguaggagagacggcucagcaguuaagagcccuggcugcucuuccagagguucugaguucaacucccagcaaccacaugguggcucacaaccaucuguaaugggauccaaugcccucuucuaguguacaggcaugcauguagacaaaauacacacacauauauaaaauacauaaauaaucuggaaagaaguaacaguuaaauuaaguugggugugguggcucacguuuguaauccuaaacccaguacggaagggauggggccucugaggcaggaggauugguauagguuccgccugagcuagaguuagagucugucuuaucccccccaaaauauaacaaaauaaacgauauuauuaauaauaaugaaaaugaaucaaauugugauguccucuuaucaacaucccuugugguuuaaaaucccaaauccucacaugaccuggacacugcuucuccugucaucuucucuaacgucccccucuucugaccagucucccccuuucauccucuuacaguacugaguauauagccuugagguccuugcguuuucuauugcuuccaguuagaaugcuuccuggaguuuucccaugccuggcucuaucucagcacugguacaucagcuccaaugucacuucuuaaagagcccuuugaccuccuugaccuuucaagcuaagguauccccuuuggucuacuaugugacuccacucuguuuuucucuggcucucaucacaaucugaaauaccuuguuugcuggcuuguggggaggugacugcauguccccuaccagaauggagaugccauggaaguagaggcuguaucugccugguccagcuggaggcuuagugcccagcagugacccuggugcgugacauguaguacgcagcagaaugaauggauacuggucggggauguggggaucugacagccacugucaaguucugcucuagaucccaguaggcagcuguuguuggcuggggaacaggacccuggcugaacaauggcugaggugucagccuugaggccuccaagaugucaaagaagcuaaauggugguggguuuggagggaggcauagggcugaaggcuguggagaccugggucgggguagggagccaccuaccgcuucucauuuccauaggauuucugagccaccuuggcaugcaggauccacacagucugcucacaucuuugcugcaggcaugugcgcacaccuucucuuaggaugauggcaugcucugggggugaccuaggaauggggguugggcccacggggccacaggaaggagagucaaggguugaguuggcacaaagcccaccccugaagcugagugagcugaaguuggagaugggguugauuuauguccuccaagggaucugggggaagaaggacuugggaaaugagcuaaauauuuguguuccaagaacccugcacagaccucaccaggaucacccaggugcuacacuguguggguggcuucccggcuguuguagucuggggccaaguggaauagcuguguuuaaaacccuacauuugguucucagauggaggugggcuuuguggaaauaguaauuaagcuuucaacucauaaggggaaacagccuuugccagcuccagguccggagcacaaccucaauucgagcaggcacaugcaccggugaaaaugugaccaaggcuccaaacugcauuaccaggauuggggugggggggaggcggcggaucugagucuuucugaugcccaaacaacacccuuggcuuaaugcuacggggguuuucuuuucuuugaguguagcacgggucagcucucuggggucuguugcuuaucaguccgagaguuugacaaaugaggauggguucucucaaagccugcgcaauuaaaaggagcacaugaaaaagagucuguggugagucuuuauuugggaaaugagcaaguugggcccugaagagagcugggaacuccaaggcuguccuuuugaguccuuuuaccuuuacggcaggaccaagucucggccuuucaucacuccaggaagggacagaggagggcaagagucgggcgcguccuuggaagcccaggcaggccaggcaggcggcggucaggaccgcuccgccucuuggggcucuccucugggaagugucucguguaggauuccagagcauuccggcugcccggagugucgccgcccgacuccagcuguagcccaauuccggcccgcagcucgcgccugcagcucccagagcagcaggaaaaaggggcgccgugcuugcuggggcccgaguguugagaggaagggggagaacgcuccugccagugggaggggucgcagcccgcgcucccccuccccacccucccgcuccagguuaaaugcagcugccgcuugggcucgcccuggcugucuggcauuccccacuuagggcaaccugcccacgccgccgccguuaccugguccaacuccccaggaggcugggcccgucgcucuguagccgcaccucugagcuguccggcaggcucaggugagucaaagggcccgggggcaacgaggggucugcagggaagccagcguaaaacccguagggggacaagucuuaacagccuacguguccacgucuaaccugcaguaccuuuuccgaucccccucuggcaaggccaacaaaaugcagguccuccuucccuaaucucccuccacgccuggcaccuucccaaaguguccuuuccggauuagcucuugaacucagaccucuuuggagcgcacuuuccuugggaaugcacuuucccuauccuaagggcguccgagaaauuuccucuucaaugcaaggauccuuaucaggagaccugggcucacucuaaugggccacuacuucaaagcaagccuuugaacgaugaugacucucuuugcccucccuagaccgccccccccccccccguggaacagcggauuuggaaagcugaaauugagagggcagcuguuuugacuuucuaagaguccugaggugcaagcgacaucaagugcguguugacuuaagccaagaggagcuuaagggagcccuuagucaagagccaacccugaguuucaaaggcccgguggagcuauacucagauguuugcccuggggugcuggcuccgcucuggcccacucuagaaaaggcuugccuuuccuccuaccuccaccaucaagccacuggcacaucuagcuagcuugucaccuuaccaccacagacccugccagaaggauuuuuguucuucuacccucgcuggaaagccagaagggagaagaaucucggauaggaagcuggucuggagucagagccacgcaccggccuugcucagaaugggcucauucaaggaacugggggguugagggaggggcagccguggguuaaggggcgauggccugcucugccaagaaaccacagaaaaauggauagagcaggcucagugugccgugugggggugggguggggaacggaagaaaggcuuagugauucuuaggugcaagggaaccaggcuucucuggaggaagagacaggggugggguguaggggggugagagcuagguuuaguucugugccuggagcccagcuggguagucuuauugggcagcacauuuuccauccguacaguguguguguucccuuagugguucucaagggaccuaguuaggcuacacaggaaggagagggcucaccuguugucucccugggguccauggcugcucaucgaggcccaggccgcucucuugcugcccucugggcacaucuaccgccacugacuucgauaccguucacacaucuaagccccgauccgauccucacacuggauuuauccuguccaagccuuaucuucaaggucccgggacucccagcg

SEQ ID NO: 1253 - RNA, 4169 nt, Mus musculus
gugccauaggggagauuuuauuuguagacuugcgacugucuugccuaucccuuccacuaagcugauagcacgaucucuacuucuuacaauucaaguucccgucuaggguuacacaccaccugaaagcagagcauccuguuaguuaugagaaccgccccuagagggagcuguuauucggugagcaagcacagggccugggcgcuuugguuuuuguggcaaguuggagcucuuugguuuucccaaagggaaacacauuaacguggacuucaugacacagucggccucuuccauucgugggaaccucaaccaacgaaggggagaguuucuugucuuugcuuuaagaacuuucucuguagcauaagucuuauuuaaaaugugaguaaaucagaguugauuuggucuaaagggaagugacgcaguuaagcccaguguggcuccuccucccgagguuuaaacaucaauugagcuucagagacagagugguuuccacucuccugaggccuccucauuugagauggugcauaucaggucucaaugccaucgcaccuugccuggagcucagagucagaccaagauguauccucagcccagcuuagccugcuguguggccugcuuccccucucuggaaauggagucucccaguacugccaaccacagucaccaagacccacagccccgagcaugagccuggcugagguggugucacacuuaccuaguguggaugguacguaggcagcucagagugaugcacagcagaaacgggugcaggagcgcuugaggcaccgguagguagacgaucuacacaugauccggcgcccugggauguguaugcgugugggaagccccucaaaccagaccaacuggucaguuauauccagugccuucaucuuccccaugguagugcugugaugguaggucuuuaagaagacaacucggggcuucuuaacguaggucuuccucuucugggcccuggcuugcaagccaccacucuuuauuaccuuggagauuuuaaauguuuccugcuuuuuucuccaugucacggcugcaggugaccccuuagauccuugcuugggcuuccacuuuuuggauguuuuuugcuuggguuccuuuacggacucugccuucuuagaauuuggucucauuucaaggacccuaaucucuuggaauuuuauauuauuuuguuucacuuuguccuugucccuggcagggagaagaaagaccaucagcagauuaaggcuaaaaggguccuucuaacccagcccugaggugguugcuauguagaguucuagcucuaccaggcucccugaaccagacugaaaagaaaugucucuggagccugggugugguguaagaguaguaugggcagaauggaugugagaccucgggaagucagauagcaggaccaguauuugaggagccuaaggauaguauguuguuggcaccugccaguauacuaggcuucugucucaacugagagggaagacuguccaguguuccuuucaaauuauauucugagaaaucauggcauuccaaggagccuucuccaguacccucaccugcccuggguagaaggcaggaugaagguaagaugccccucacauugaggguuaguuagggacaacuguuucuaagagauguuucugugcuuucagaaccaugguguucugugacccugagccacgugguucugggcuucccagucaccuguaucugggaggccacauuaaagaaagagccucaggaaggaauuaacagucucucucucucucucucucucucucucucucucucucucucucucucucucucuuucucucucucucucacucucucaccagaaaggagauuuccucaggaguacugcaccagcugggcaaaaccccacgcuagcucauccuagcugaugagagugaugccaguggauggcggcucucaggaucugccaaguaggaagcaguggagccgcagcagacugcagcagucuuuggagacagacaugcuagacucugaucauccagaugaggugagacauguaaccucccagagcccugggucuccaucauaaaaauggggcacacguaggauuguugugaagaaggaacuaaguaggggugccaagcagagagcagacacuuacacacauguucuucaaauucuagagugaccuacgaaugaucagggucugagcaagaugcaugggucaucagauucagagggcagucugugagugagucucugggcgaggcugccagggagaggaggcugccagggagaggaggcagagaaagcucccuagcacaugcacacucaguaccccagugaucagugggcccuucacugucacuaggugacugugaucgcuguuacagccacagcuuugcuaugaggugggaaugacuugagacagguacucuaccaauuaucaauucaacuggccaagcuaaaucacuucacuuccugggcuucaggcccuaucaguaaaauagcuugagugaauaccuguugcacagagcccuucuauaaagagggccacuguuuccaauccuuuacuacaauuucuguuccuggaaaagauagccauuggguccauuuuaugaguguauaaagagggggugugggcaagcuuaccuagaagagauuugcaggaucuuuggaacucugagcauugaauuccagcaccuucuggccagcuuauggaguucuuggauccggcuauuugagcucuugaauagcuucaagagggacaaguuuuuuaauaccugccagggucaagaaaccggaaagaggucuccagaucucccaggggagcccuucauccccuguguguugcuuggcucaucccagggaugagucugcuggcucccauggcacacccggucuagcacuuggggguggcacuucagguagggguuggcuucccuaagcaggggcuaaaauagaacaucucaccauuuuaagucgauuccgcucaaucacuuugcucacaugcuggguuaucuuguccugcaguuucucaucuugcaucugagggguaggaagaaagagagagagcuaguauaggggaauccccuugaguuccuguauugugccuuuccuguuugaguacggucugagcaguccuagacuggagucuuggcauguuggguuuggaacagaacugagagaguuuuagcucuaccggccucuauuucaccuuccccuuuccccuucccacaugacuggagagacugucuuugcuguggcuggauucucugguuagaccccuuuuauggggccugccggggcuccaggacaaggucugaccuuagaaggcacuuuaucccucggccucuucuuuguagauggacucaugcuggggcuguaggagcaagacuggaccagugcugccugcacccugcuccucgcacugcagcgcucggcugaguaacauaggauggugcuggagcugccaggcaggggagcugugacaucacugaaaugugcgacagcaucaggacugugucuccagggguaaagggugaaggggcaaaaggccacacccaucuguggagaagcucaguaugaggcagguggugaauaugaucaugaccucccuauaagauaagaagauggaccccucuuuuuaaaugaagcuaagauuuuuaaagguuauguaguuuauaaguucacaugacugguugcugguagagcugagaacaugauguaggcccgacaagucaauccaugaaaaggggaguucccaaacugcccaucuccagccaggccacauauguugacuggcaccugugaccuuuuuuucucuguauaauuccuagaauaaaaugagcuuauauucaguugaaaucaggcacaguuugggugguauggcuguagacuggcucacacuguaguggagacaaguaucccucaaauaguauauguguguauuauaaauuuuacugauagaaaucuaaaaauaaucuuauaaugcucuuauuauaaauuuuauuauucaguuacuauucuuuuguuuggcuuugguuuuggguuuuggagacagggugucuuggugugacagagcccuggcuguccuagaacucucuuuguagaccaggaugaucuugaacucacaagagaucugccugccucuacuguuuaaaggcugggauuaaagccaugcaccaccacau

SEQ ID NO: 1254 - RNA, 935 nt, Mus musculus
cggacuugcggggcaggcgaaaaguucccgcacgcaucccuccucgcuccgcccgcgcgaggcugcgcgcaccccgaggcacuugcggcacccccgcccggcgcacagcugcugcgggcacacgcgccggcuccggcccacgcacacuugaugcucuccgacuccagagcagcgcccacgcaacgaccacgcgcacgcgcucgcugcccgccucaccgcaccucgaucacccuggccacgguuacgcgcacacuucuccagaaggugcgagauggggaagcagggucagcugcugcccagcgagucaagugcauggaccuuggauucccucagcuggccuaaggaccacacagagccgucgcccuacgggucagcgcacugggcgagucagggcuggaggggaugcgccgcacccuacacgccggcaaggagccaacaccucgaggugcucuagagaugccagacguccagccaggcguaggugggcggcccagucggaaacagcccccuuucagcgucuccuggcucaaaccagggcuaggaguguccaguauagcaaccccuggaugaaggcucugucgccucccuccccaugcccuugucugggcucugaauacagcgugaggaugagccaugacugguguguguguguguguguguguguguguguguguguuuccauuagaaaucugugucggggccaagcuaccaggaaaccauccuugucaucucccuccccuuugagacccacauuaaaauacaccuccauuucacaucauuucuguucccacucuggcucagccucccacaguaguagccuccuucagaguuuccugcgcccucucuugccuaacuacauucugcacacaggacagcucgagagcacacgucucauguuuuaauguccuuuguuauaauaaaaucuacgcucuggu

SEQ ID NO: 1255 - RNA, 10974 nt, Mus musculus
ugggcgcgggcgaugcugggaggcggaagcggccgcagguauggcggcugccaugccgcucgguuugccguugcgguuacuggugcuguugcuggugggacggggcugcuguggcugcgcggagggcccacgcgacagccugcgagaagagcucguuaucacuccacugccuuccggcgacguggccgccacauuccaguuccgcacgcguugggauucggaucugcagcgggaaggaggugaguucaggaccccaggaaaaugucugcagcaccuugcucaguuccuaaagagagcuacucagggguggggcuugggucgccgcucaccugccuugcuuucuucagugucccauuacaggcucuucccuaaagcccugggacagcugaucuccaaguacucccugcgggagcuccaccugucguucacgcaaggcuuuuggaggacgcgauacugggggccacccuuccugcaggcuccgucaggugcagagcucugggucugguuccaagacacugucaccgagugaguuccuaacuugacaccugucacaggccauggaggggguguggcaggcaaaguguugucaucuugucauuggccuugggaucugcuacuccaguagguagcggucacaccaaguuaaaacugauuuuggaaguaaggauuaauauuacagggcuggagcgaugccccagucaguaaaaugcuugcuacucaagcuugacgaccugaguuucauuuuccagaaccuacauuaaaagucggguugcugcugccggcuucuaggcccauaacugaggagguggagacaggaggaacaggacugcuggaagccaguaugccugaaucagugacuuccaagaucagugacagaaguaccccccuacacacacacacacacacacacacacaaacaaaguacagagggaauaaaagagacauugguugcugauuucuggcccucacagcuauuugcaucaguaugcaugcacauacaacaugaagaaauuacauuauuauugagugaacaucgucuccugaaaacuuccaagucugagguacuacaugcauuucucgaggcaaagaguaggugguugguuccuauuauugggauauaaggucacagauaauuggcagacuagguguguuguuuuuguuuuuaagacauuuguuuguauuaaaaaaaaacaaacaauacccaugccuaacaaaacauuugugggauagcagugggcuacaggauggucuuugugaaauaaagcaagaguuucacuuuaaagcauaaucaaguuucuagcuguugucugugaacuacagaaaaucgcccaguagcugcugugaucuuccuagaguagaauuuuuuccaugcagagauugcaaacuuaucucagcauaggccacaaaauaccgaugacagagggaguuaaagcauuggugaaacccuggagugagaauuuaagggugucucauuugccucuuaacuacccugcaacaucaguaaugcagacauuaccagguuuagagcccugauagggaggguuaggguuaagagucugugugacgaucugaaauagucaccacucaguuccuauggauuguaaccuuaugacaguucugacugucacuuucaagagagaucagacuuuugcaugaggaaggacauguaaauaucaacaaguaguuuuaaaguuuuuggaaagcuguguagguugguauuaugcacagcagauguagcaggugcuuagggcgaugagcugcugccaccuagccaucgccuagaaggggcuuaaguggggucuuggacucucagaagcacaacacuacagaccgugcuugaggugagcagaaaaggcuccuuggguaagaccagauaagaccucucuggauaagaccagagcaggacuuugaaggcgacagaaccaugagcagaguguucccaggcaagauggacacuugaacaaagaccugcagggcugcugagaugcccagagagggcgcuaaggagguaaggcgaggcaggggcaucccugagcaucaucuggcuugucucaugguugagaugcagcuucacucuaccauagacuuggcagucagcuguggcuguauuaaggaggccacacaggauuugggguuccgaggcuguaaccccaggccagugaguagguuugucucugucuaguguggaucuguaaccacaggccagugaguagguuugucucugucuaguguggaucuguaaccacaggccagugaguagguuugucucugucuaguguggauaaguccuggagggagcucagcaauguccucucggggaucuucugugcaucccucaacuucaucgacgccaccaauaccgucacucccaccgccuccuucaaaccucugggacuggccaauggugagauagccccgggccuuuccuccuuguacccuccauguucgcauccuuccccuugggcuccucuuccacagcggggcuagaugcuaaaugugguggguguacaggucccagguagcuuccuaagacugcugucucugcauugcuuccucccuggagucccaccuggaggggggaccacuuggcgguaguacuagagugguccagcaguggguggaugaggucaccuacaucucggagggacaggacccagcucugucucccucagacacugacgacuacuuccugcgcuacgcugugcugccucgggagguugucugcacugagaaccucacgccauggaagaagcucuugcccugcaguuccaaggugagugaggacggguggggggauuggagagggcagaugugucccucacagccuggcagccaggguauaguuaagggaaucugugcccucaugucaagugggguacugaccagccccgugucucuuccugucuccuccaggccggucucucagugcuauugaaagcagaccgcuuguuccacaccaguuaccacucccaggcagugcacauccggccuaucugcagaguaagucauggggaguaaggauggguguuauccuuggcucagagaggcagcaaguuaaugugccugacuccggggcugaguagcgaguggcuggagugcuacucuggaugcggguauuggcucugcaccaggguaauugagcggcugucuggggagcauucaauaaaucuuccucauggagcacaaaaucaggagcagcagccugugaaugcagcgcuggcucggucacucgccagcuggcaugaccuugaggaagucauuucauuuccuugaacuucauucuuucaucugucacaugagaguaauagauucuacuuugagggugguuuuaaugcuucaucaaacugauguacauaaagcuguugacaugggaucuggcucagggucaagugcuccccagggaacgguagcaaggcagccaaagugaagauaugaagaaacagguguguguguguguguguguguguguguguggcggggggaugucuguccgagccaguccuuggagcuacauguuagaugagaguccggucccugacugaccauccggccccuaugacagaaugcucacuguaccagcaucuccugggagcugaggcagacccuuucgguugucuuugaugccuucaucacaggacaggggaagaaagguaagcuguccugacaccucaucucuaucucccugucgagguccugcucugacugcauggacgcaccuauccuagcccucgcucagcccuguucuuucuucucagacuggucccucuuccgcauguucucccggacucucacagaggccuguccauuggcgucucagagccuaguuuauguggacaucacaggcuacagccagguaccaaggugucuagccacacacacacacacacacacacacacacacacccuucuuccccaacaucagccugccccucugcuugcuucugaaugcugcucuuguauugcuaggauaaugaaacacuggaggugagcccucccccaacuuccacauaccaggaugucauuuugggcaccaggaagaccuaugccgucuaugacuuguuugacacagccaugaucaauaacucucgaaaccucaacauccagcucaaauggaagagacccccagauaauggugaguugauggggugggguuugcagcagauucagauacguuuuuuucuucaaauucauagggguucagacccaauucccugccuuaauauguuccugguucuaaacccacgucuuccaagccuuaugacugggcaaguuccuggcuccacuaggcauuacugucuguaacagaacagggccagaggucccuaguggauggauguaauaguaauguaaaagagaguucuuuugugcauucaguuggccaaacuguuuuagauguaugccaugcagcagacauggaguaguagguaagacuggcuuacuuaccacuccugugcuguaaaagagaagcuucaguuucugagcgcugucaccaagggaaagcaaagagcacccuggaguacugcuauggccggaagggacaccgugcuggacccaugagcccugguacuauacuagucaucaucucuguaagcgagggaagauggaugguuccagagcccaggcuucccagugcucgugccagagcuuuuucuuuucuuuuccuuucuuuuccuuucuuuuccuuucuuuuccuuucuuuucuuuucuuuucuuuucuuuuuccugguuuuuugagacaggguuucucuguguugcccuggcuguccuggaacucacuuuguagaccaggcuggccucgaacucagaaauccgccugccucugccucccgagugcugaaugccagagcuuuucugcaucuacucccugaccugggacucugagcacggcccagggagcuggggugggaagugagucucuguuaggagcaaugcaguguugauuccuuuuucucuucgcagaggcccuacccgugcccuuccugcaugcgcagcgguacgugaguggcuauggacugcagaagggagagcugaguacucugcuguacaacucccauccuuaucgggccuuccccgugcugcugcuggaugucgugcccugguaccugcggcuguaugugcacacgcucaccauuaccuccaagggcaaggagaauaaaccaagugaggagcgacccccccccccaccaccaccccccaacaccccccauucaccucagcuuuagguccuccagacucacuucucaacaguuuccaaaguaaaccugagggccugugcaggugggaaagagggguuaggaacagguuccaaaacugcagccgaaagcgucacugugucggauucagaaggaacuuacuaagcggccacaguuagaacgcacacucaugcugauuccuagcgccucuggggccagcagccuuguguguccccagugucuccuccugagccccuaagcacauucuugugcuucaugacaaagacucugagagagaguggauuggcccaggagaaacagguuguggaagaugagagggagguagaagugggguguggaguuucuucacuuucuugggagauuaaagaaguugacucgauaacacaaacacaucacuguuaaucauaaacuuuccuuucuuguucuuccccaaaucacacauugacaucagcauuccagauuuuaaagguuccacggucuuuaaauauucaaauguuuaaaaauucucuugguugggcagugguggcacaccuuaaugcaagcacuggagaggcauaagcaagcagaucucuguaaauuugaggccagccuagccuacagugcuagaucuagggcagccaagacuacacagagaaacuccgucuugaaaaacaaaacaaaaaaguaaauuaaaaaaaaaaaaaaggaaggaaggaaggaagaaggaaagagaaaguuccaugucuuuaagauacccagucuuaaaauucaaagucucagccagccuguaauggccuuuagaguuugagguuagcuuggucuacagagugaguuccaggauagccagggcuucacaaacccuguuucaaaaaaccaaacaaguccaagucucuccucuccuauaaaaucaaaaauaaauacuuucucauuuccaaggggaagaacucaggcccagucacaaucugaacaaaguaaaaccaaauccaacaauacgaacagcucagucuccagugucugggacucacucaugguugugugggcuccuuggaugagcuugggucacuucuuugacucugcccucugcaaccuugacucuaccccacugcugcugcuguucuugguggucauuccaugguacuggcauuuccaagaugcgggggucaucuccuguaacugggcugcucuuucaccaauagacuucccuaagcuuucuucagagauuccaauccuaccacauagugccaagccucaggugcucucaugacaccuucauaccuucagaaccagcuaggugacuaacucuuacacuaccaaauucugcugcccaacacuagguacaaccuuggcuaccucuggacacagcgucugugugcuaacucucagauaacacuuccagacuucaccucauaaugcuggucucuucucagucacagcuagagcuucagcucacugaccagcaucuacugucuagcaaagcauggguuuuacuuuagugcuucuggucuuuuguuaaucacaaaauucuugagcuccaguuggccagacaccucagauucuucacauagaugaccugguagagucuuuguuucccuuugaaacuucccaagccagaccuccacuaucuguacugcucccaacauucuuguccuccaagcuccugcagaacagcucgccaagcucucagcacucaaugguuuuuuuaccccaagguucuaaaguccuucugcaauccucuuuaaaacauggucaugugugucagagcaauaccccacuccugguacuaauuucuguccuaaucagguucucuguugcugugauggaacaccauuaccaaaaucaaguuggggaggaaagggcuuauuuggcuuacacccccacauugcaguccaucuugaaggacacgggcuuuauuuuuuagggaguuucagguccuguguucugcucacucaguucuguuacuacucacaugaugcauuuccugugcuuccuucccaacccccuggcauugcugugggugagggcuaagcccagggccuuuuuuguuuguuuguuuuuguuuuuuuucgagacaggguuucucuguguagcccuggcuguccuggaacucacucuguagaccaggcuguccucaaacuuagaaauccaccugucucuccugcccaagugcugggauuaaaggcgugcacuucuacugcccagcaagcccaggaccucguaugugugagccaaauguucugcugaguuccuuucuccccuuuuuaaaaaaaauaauggugcugcuggugggggcugcggagaaggcugagcaggcuaagaccacucaccacucuuugagcugaccuaaguuugguuucuugcauccauaucagguggcucauagcuccaacuccaggggaucuaaccccucuucuggcuucuuuggguacugcacucuugugcauauacccacucacagacauacacauaaacguaaaacaaaaaucauuuuaaaaagaacuacugaaaaacaugguugugcuugagauugaacccagaaccucaugcuugguaaguauuaacacucaccuauaacaggucacagcucuggguguugauccuauccauucaucuguccguccguccgucuguccguccauccauccauccauccaucuauccauccguguauuuauuugcuuugguuuuugaggcagggucucucuguguagcucuggcuguucuagaacuuacuauuuagaccaggcuggcccugaagauccaccugccuccuaaaugcugggaugagagguguacuccacuaccuccugacuuuauucacuuacaaaguaacagguuuucuuaaggcuuucucauacauacuuuuaaaaaaguauuguuugcuaaaacugggucaucuguuacauaacgugcgugaguuguguuugacauucuggguuuguccuuguggugcuauuuaauauguguaccucaccccugcauuccuugcaagcugguauuagauuuagaaaccugauuagauuuauguccuauauuuuuggcaagaauucccaaaugacuagacuuccucuuguauuauaucagacagugaagucugcugccccaguuuaaauuucaugauuucaucauuuguuuguuuuggggagggguguuuguucugaggcuugugucaggggucaaaggagagcuugcaggggaugauucucuucacagugugcuuccaaggauugaaacaagcaaaguugucaggcuggguggcagugucuuuaccugugagccaucucgccagccaagacgccaccguuuuaaagauggaugggggcuggagagaugacccagagguugagaucacugacugcucuuucagagguccugaguuuaauucccaccaaccacaugguggcucaugaccaucaauaaugagaucuggugcccucuucugauaugcaggcauauaugcagggagaacacuguacauaauaaauaaaucuuaaaaaaaaaaaagagggaugggcugcaguauccauggcagccucuuuugacuguacccugggauacaggaaacauucuccaauuuuugagaaccuauuuguuucccuagcuugacugccuuuuuugcccuaaggcagauagucugaguuuagaaacaguuagauggcucuugccuccauccagguuacauccacuaccaaccugcucaggacaggcagcagccccaccuccuggagaugcucauucagcugccagccaacuccgucaccaaggucuccauccaguuugaacgagcccugcucaaguggacagaguacacaccagaccccaaccacggcuucuaugucaggugggaucuaccccaguaaacugcccccccccccaccuaccuccuacccuuuggugggaggagcuagugaagaacacgcccgucugucugcuucucuguagcccaucuguccucagcgcccuugugcccagugugguggcagccaaaccaguggacugggaagggagcccucucuucaacaccuuguaagugugaccacacccuuccgcucucccacagucaugugagauuuagcaggcccucuugaaauccuaguggccuaugacauugguaaagauguauaaaaggcuaagacaaaaaggugagaguaguugcagguaccuaccaaaccuaacaucaguggaacgcuuaccuagugucagggacuaaagagagauagaagauagacaacguggccuguccccugugcucagccgugggcagauuguucuagauagcuaugaugguggaagcgguggugguggaggagguggugguggcgguggcggcaugcaguaaguuagcuauuuugaggagagccauuaaggcugagacuaaggcaguagacaaggcggcccuuugcuuccgugcuggugcucuccuuugaucugaucaggugagccugcgcucucuggugaggugauccuuauugggugucagcacuaggaccugcagcacaagcuguggagaguagggagacggaggguggggcagcaguccugucucagcccuccuucccaucccuagguucccggugucugauggcuccagcuacuuuguccgacucuacacagagcccuugcuagugaaccugcccaccccggacuucagcaugcccuacaaugugaucugccuuacgugcacggugguggccgugugcuauggcuccuucuacaaucuccucacccgaaccuuucacaucgaagagcccaagucgggcggccuggccaagcggcuggcuaaccucauccgccgugcccguggugugcccccucucuaguccggcgugcccgugguguacccccucucuaguccugugagcccgugguguacccccucucuaguccggcgcgcccguggugugcccccucucuaguccggcgcgcccguggugugcccccucucuaguccggcgagcccguggugugcccccucucuaguccggcgagcccguggugugcccccucucuaguccggcgugcccgugguguacccccucucuaguccugugagcccgugguguacccccucucuaguccggcgcgcccguggugugcccccucucuaguccggcgcucccauggugugcccccucucuaguccggcgcucccguggugugcccccucucuaguccggcgagcccguggugugcccccucucuaguccucccuuuccccagcaacugcagcugcacucguccgacccgagggagcagggcagggcuuuuucugccacccgcugugucuccagaguuagcuuuugaggcuaacucccucuggagcuggucugggccaaggcgugguuuccagugugguagacuugagccaaaucccuucccauccucuccuguggcagccgugcuucugccuacaaggggcucgugcugcaguauaccggacagccuagcgaugcuuccgucuuuacuggacauucugauggcccaggcaaugggcgcaguagagcuguggugcuguuugggggugggguggggugggguggggugggggugagugucugugaacuuacugauguaauaaaguggcagccuuccuaggucguugcuuccuuccuaaggccugggaagaguucccagcuaaagccugugaugccuaugggcccaccccagacagaaaugccuucucgucuguguaucucccaccccucucguaaugacuccccaacucugguuuuggcugggagauuuucuguaaauauaaccuaugaucaugaaaauccuccuagca

SEQ ID NO: 1256 - RNA, 6135 nt, Mus musculus
uaaaacugaucccagggagcuuucagcucucacugcccugccuugcccucaggccuuagaaagguaggaagagagggagggguggacaaguguccggcugcagccggcuuggaagcugucucgguuccugguucccaccagagccaagaaugacaccugauccagggggauugugaaauggcgugagguggcagggcgcccgcgcugcccgcugugcuuccuacccgccuccuguaccccucacucggccccgccccccuccccgcgcgagugcuuaaaucccccccauccuggcugcaggucacaccugcaccaugccugccugucgccucugcuugcuggccgcuggccuccuacuaggguugcuacuguucacccccaucucagccacaggugagugcagcccagagugccggagucucagaagccgggguucugggacuaaggugagaggccagugaauauuuaauuuuugcaacucuggggccuacagcuaguuauccuugaagcuuaggguccggggaauguacugggaaggggggagggggaaucaaugaaggcuuaaaguuggaagggcgggggcucucucagcucugaaagcagagaccugaugaagaggagcgggaaacucccgggauggcggaagcuuccaagcagaggcucaagucccagaggacuggggacuuugaagccaagcauuggggaguucucuagugucagagaccccuggcucgggggugaggcucucugggaugauauuaugggggccccugggccaaagaauccgaaauccuugggguugaaauuuggggaucucggagcagggagaggauaugcgggugggacugggcucgguucucccugacaagucucugcucccacccacccaucccaaggcaccgaugcagagaaacccggcgagugcccccagcuugaaccaauuacggacuguguguuggagugcacuuuggacaaggacugugcggacaaccgcaagugcugccaggcgggcugcagcucugucugcuccaagccuaaugguagccccggggugaccuggcggggacagggcgggguugugagaggugggagcggcccggguuuggguuuggcgaagaagggcaucccagauccagggagcccgaaaagcgguggaaacccgauccacacgugccucccuugucuggccugggguaaaugcgagggacaaaggcgucacagaggcgcggcccaggggaaggagccccccucccccccauuccuggcuggauucgauucucuggugcaugaagggcuuccgggcacgcacagcgagacuuuguuccgggaccugagagcaguggcuuccuaggcuggaguuggagggcaaacccuggguggcgucagugccgggacccgagccuuagggaccuguugccccuugggguucuucccgcagggcccucaacggucuggccuagcaagacucaagauuuguaccugagggagggagaaaucuuuugccacauccuaagguuguggaagugagccgccaaaauaaauguucucgcacaaaguuacaccgccauccuguggcuggcagagguuccguuucuuucuuugacacuggauuuuccucuuguaucuuuauuuccacaaccuuuaggaccgagcgaaggagagcucucagggacagauacuaaacucucagagacugggacuacuacucaaucagcgggccuugaccacacuacuaaaccaccgggaggucaagucuccacgaagccaccagcugugaccagggaaggcuuagguguccgagguguggaaucuaagcaucuuauuuccaagagggaaaagcugaggcuaggagguggggugggggaacagaaaccaaaguuuguaauuucuggucuuuugggggggcuacagccccugccccucuuuugccuuuauuauuuuucucaaagaugccaggaaugacuggaagcaauuuauacuuaggaguccuaaggugcuaugaacaggaagguggaagggggaaaugagacuugcccacggagggcagauuuuggcuguggaugugcuauggacggaccuggacaaagagggaccaggaaagauggaguugagccaacuggcacauccagcugucagguggauaaagauauugcuuccuugugucagauggacagggcagauggucuccugagcccgggaggagccuggaggcuugaaucauagccauuuccuaagugcgugagccugaauaaucugcucuuugaaacucugccugcucaucugcaaagugggcacguuaauacccaccuguaggugugggggcuaaaugcaaugguacucaagaugcgaagguucucaaaagagugcgaauucugcacaagauagcuugcuuccuucuguacuacauucucuccugguuauucucauucugucucaggguagccaccaagagcaccuguacuagcaaggccaggaugcuguccaccucuccuuuaccugccuacacacuucacuguaugcaucuuuccuuucgcugggccugccucccaccugguacuucuauggaauggaacauggugugggguugguguguguggagugugguggugguuuuugcauaugcaugggugaccauguacguauggagggccguggcucugagugaguguaccuggcgguggacuuauaggagucauuguggggaaugugugucaccucucucaugggcacugcacuuuauagcuuauaaaguagcacagagccugguggcaaaugcauacacccuggagccagaucugugguucaaauccugccucuguccuccauggccuuaggcaaaacacuuaacccuuuacugcuuccguuuccagccacaauggaaggaaggauuagcagaaccauuagcuguuuuaagauucuugggugaacuggaugaacucgggccucaucggugucuggcucaccacaggagcugguuaggugggggcacuuaugaauacucagaccaaggaguuugaucuuucugggugggcugugggggggggggacaauugcuuuugugacaaccccacagugugcugacagagauuccaugcgacaucuaaagacugcugcucugggagauuuguacucuaagccaccaggauagaaaauggcugaggugggacucaaacugagguucugugauuucaaaguuaucuuggagcaggaauagagguuuguagauagucucucccugggaccccugagagcagcucagggucccaugaugaacucagauaggcagcucugcuguuggugaaccaggguggugcucagccgggcuuugcugguugucucccuggaucccucaguuucuccuuacucccuuguuuaccuagaaaagcagggcaccugccccagcguggacauacccaagcucggccucugugaggaccagugucagguggacagccaguguucuggcaacaugaaaugcugccgcaauggaugugggaagauggccugcaccacacccaaauucugagguaggugggaacaggagagaagguucagaaacgccuagguauggggcccuuacaguaaguugaaaaggaagaggcugauaacagaccuguccacccauuucauuaauuuaacuacuauuuaucuacacuaugcggauaaugugcaagccgacgaagcagacuagagaggcuggcugcuagguuuucuugucuaguggugaggagagaaagaagcaagcuguuucuauagcgugucacaggaaggugcaugcugugugacaggagaacaggagcgaaguguacccggggcagggggacgaaaggggcaucacuguaacuuguacgugggacagugggugaagccucaccaagaaggcgugaaacaaaagaaggaaugugagcacacucaggcagaggaggcagcgaucgagaugaagucaagagcauugcuggggcauuuaaggaagaacaggaaggcuggcuggauagauguguaaaaggaaaucaaagguauauggggccugggacaguuaucuuagagccuuaaaggucauugucucgaggcacacccagagaggugaguccuuagaaagacacucgucccaauguuuccaaaggacucuccuagaguaugcuaccauguagcuagacuguagaggacaggagaagauucccagacucaccagagaacggacagaugagaggguccucaggauggaggcagggaagagcaguggccaguucaccauuucaugaugaacaauggggguuugcugauaaguaucagaacuuccuuuuuguuuaacaggacuugaguaaguuacgaugugguaguggguagcuguguccuaggggaggggacaauggcugguggaguugaggagaugguaucccuuugcaagguuagugagagucagaagggucgaucugcauuuccuccaaaggcccaccuuuguggacaaauguggucaaggucgcuaauguugguugcauuuauuaguugugucugauaaugggcuaaguauuuaaucugagauagcuaggacuaaauucaguaccuuuagugucucaggcacuaaaaggagaaauuugugagucacccuucacuuuguaugugauuaaacuaaauacuaaaauacuguuaauugggcuagagaggugaugugggugcuuaaaaacacuuacugcucuugcagagaacauagguuugguucccaguacccacccaguggcugacaaccaucucuaacucccguugaggggcucagaugcccucugcugguuuccaaggguacugcauacacaugagguacccacagauacacacaggaaaaacauacauucacugaaaauaaccacagaauaggaauuaugccacacggcaaguguuaaaaagggagaaacugagacagauacuugguugucccauuaggugauccugcagugugauugucugaguuccuaggacagaaaggugaccauucuucuccccucccccccagcuugcagugcagugauuggugacacggucugugucaucaaugagugcaucagugcccacuauugugggaaacagaugaggaaaugucacccaggcuugagcgagggaggauggaguagaagcagccagagaaagcuucccggggggggggggguuaucgugagcuggcaucaaagugugaggcaaugauuguugguuuggugagauucagggcggggaugcugucugaggcugagggagcagguugagcaagaacuuggacaagccuuugguugcaaacacagagugcuggacucccuuagugcacacagagauaacugaaacccaaagagggggagcgugcccaaggccucaugccuguuauuucaugccugauaugcuuuucaguggguaggagagagcuauaguuuuccugaacucugcuaugaggcuaauggucucuuaucuccuucaaugccaaacugcacagugggcauugcaaguaggaugaccacaaugcagacuccagcucugacccuuaccuagccucuuuaucuccuugcccacaguuaugugcuuucgguauggggauaaagagcaucuauuuggucaauuuaacucagcucaaucuaaggaaugaaggcaugguggggcuuuuuggugauagaagaaagauucuuagggaaauaaauauuuaugggucuccagagaggccacaacggucauuaggaccauuguauauccaaguagguccuggaacagguuugauuugaagcauaagaggcaagccuggaacuugcugggagaugcagacagaggccacaagaagguagugcuuugcugugugugcaagugugacaggcuuggugggagcugggugacccuugggucuaguaugacauguuauugaugacagcgccauggucucucccuccagcuucagccuccagcagccugaggaauggagagagguuguuucugccggacugugcaucuggagucguuccuguggccuccuuucucucuggucuuugcauuucuuccugguccgaugaaagcaucuccuuuuucuaaccaauaaagugaucgcuuucagcaauggagaagcuauaacaccugcuugccucacuuucuucuguuucucuugac

SEQ ID NO: 1257 - RNA, 4104 nt, Mus musculus
gugcauucuugacaauccucuagauacuguuuauucuuucuguagcauuuucuuacauuugaaaagacccuuacaaacccccaaacaauggacugaauccuagugacaagcaggugauguuuaagaggagagcuuauuuagagcaagcaaugccuucuuccauuucugaaucauugcuguagccaucuuuacguaagaugucacguucguggacuaauuaaaaacggaaguagcuuguggggaaccuaugagaaucaagggccugagauagucuuagaagggauauacccaggcacggugaauucaaaguaacaguauccucguuggccaaaaagaaugcuucccccaucccauauaagcaguuuucuccucauuaugucaugucaauaagcagagacaaauaggucuaggagucugggugaaagagacuagacugcuaaagggugggaagguaggaaaaaucuaaacuaggagguagggguuaggggcuggggggggagggggggaguuagagaaaguacuugggguagcaacaguccuguaacuauagacaaaaguggggccuccguuccuggaacagcuuauggggaaggagguaggcagggaagacauugucugggcacccucaccccuacccacaccugauucaagaggacgguccaacaggagguuggucuuccaacacuuuccgaguggcuuguaacgaugacgauuuaugguacaacugugcucaccgaguuccugauuguaugguuuggcuuugcgcccucuagaggagaaaaugauaggacgcuagugaucacaccauguagacagacuucucuaggggugaucacaauugauucccuaacuccugggucacuaaugggguuuguggcauaagagaugcccacauauagcuucuccuacgggaugauaaaccacugggcauagacacagaugccagauuuucuggggcuuggcaaaaucagguaggccugcaagaucagaccggguaccugaaaccaggacggagaaacagagguccucugaggggauuggauguaggaacugagaggcacagugccaugcugucucucuucccacagaguggguuuccaaggucuuuguaaccuggacgaagaggggacgugcucuucagaaccuacccgccucuuccggacucaugcagacguugccgcagaaggagcggcagcagugaaaguccugcucacaguccaggugagcccugcaguagcuugugcacugggugcuggucggccgcgucaggcaggggggcaguuugggccuuguuaaaacugaaaaggaauacauaagcaagcauuccccuaaccaagagcauuuccucacuacugccagcagcuccagcgcucggggguccccuucugcuuccucuccucgcccaauagccuagcgguuucuuuuugguucuuggacgaaagggccacucccugaugcccuccuuaaucccacaaggcacuguaauguuauccauauggacuuuaaacccacaaacuuaagucuaauucucaaagcaaaaaguccuucauuuucacuuuauuucacagggugggagguauugggucccaggguaggaaaucacccggccucuuggcaguugacuuuuugguuuuuuuuuuuuaauaugguuacacacucuggauacuaaacccuugucagaggaguaggcugcagaaguuuccucacaaccuuugggcugucucuuccuuuaauuuugcugugccaaaagcuuuagaauuugagguccucuccugaguuuuuccuuuaugucccgaacuaguggaguccucuucagaaaguuguugccuaagccugcagccucaagugucuuccccacgguuuccucuagaaccacuuucucaaucuucccaacgcugcgacccuucaauacaguuccucauauuguggugacccccccaccauaaaauuauuuuuacugcuacuucauaauuaauuuugcuacugcuaugaaccuuaauauaaauaucugauaugcaggcucucugauaugcagccacuguggaagagauauuugacucuucaaaggggucgagacccacagguugagaaccacugcucuaggcguuucaucaccuccugcauuacaauaaacaucccaaagaugaauacucuacucagaugaauaacagaaguaagaaugacugauaaugcauggaagaauguuaugcaaccccugccaaaucagcaaacacuggcuagaaaggugaggcggaggaaggggccuuuaaaguggguuaguggaaaggggguguggcucagcugccaugagaaucagaagggagacuccacaaaacuaauagaaugaccacagcaccccaccauauuauccuuggaaauaucucccaggaaucagagcaccauacaauaaauacugcauacccguguucaugccagcaacauucacaauguauagaauuagccuagucagcccaucaaugaauaaauaaacuguauauacagagauaugauaauauauaauaauuauauaauauacauauaauaauguguauauguguauguacacacacuauauguguguguguguauauauauauguauauauauauauuucauucuuagaaaggaugacaugaauggaggcagacaucaucaugcuaaacaacagaaguacaacucagaaagaccagugaugucuauuuucucucauaugaaccuaguuguuuuaaagagaugaaguuggagugucuuacuugggggaaagagacccugugggaggaaggauggagagaagcugggggcagggagcaauaugaauaaaguaccucaccuaucaugugaaaacgucaugucaaaaccuauguuuuguacaaauagcauauguuaacuuuuuaauacaaagaaucaggggcuauuucagaaaaucagaguuaagagucucagcccccaauaugacagcucacaacugucucuaacuccaguuguggggcaucuaaugcccucuucuggccucugugggcacugcacacaugcggugcacagccauucauagaggcaaaacacccauacacaauaaauaagaacaaaaaggaaagagccugccuuccaccuccacuucuccauuucuggcugaaacagcugcccagaaacucggcuuucucuugaacacguuccuccuuucaguccuuacccaucucccuuccacucaguagaauucaaaacaaaaacaaaaacaaaacccuacaggacuucuacaaagcucacauauucauuuuucucaguaugaccaagguucuaaaacacccaauucccuuuaaauggugggggcacauaguaagaaaucauuagaaacccuuuguccauguguggucugucucugaagcucauaacugagaauaccggcucccagcagcuagagcuagaugccuccaggcagccucuaaaccuccuggaacugccuagaugaguguuuuccuggauaaaaacacagcguggcugccacaaccccccccccgccccccgcccaacagacauaaaaacaaugucuuacuugcagcaucaagauacccuccagguugagaccuaaacauucgguuuccuuccagcauccuggcuuucaaaaugagggauguucuggggugccccagcccaccccugcuuccucccugcaaugguacuagagaaggguuaggguuauucacuuucugcccaguccccacuuugaagcccauccaaaauaccuacuguaaucuugaauuuggauuucagaaaaauaucuguccuuccaucuugccaacacuggcaggccuaacgugccaaggaguaauagcaucuggagagugacuugccacuucaugaggccaaccggggacaucaggcugcaaggcuggcaggagacucaguguugcaacaggaccugugaggggcacaaagccuuccugguggggaggugggaacacccaugccugccuggccucccagcacccugccugguuugguaccauguucccccuccguccacacuaccaucuugccugaggucagcucuucacaauguccucucaccuucuuuuccguugcccaguggagccacucacaccuuca

SEQ ID NO: 1258 - RNA, 2602 nt, Mus musculus
uacagccaucuccuuacagccaucucugagccucuuucccucucuucucccggcagaguuuggaccaaccuaaccacccucggccaggauucaccacacaucgagccagcaucaugagaccugugucaccuuugcagcuccugcuggugcucagccuagcaccacagccagugcuuggaagucccaagcaauacuuucugaguaggugcugggucugugcuccaggggagggacgggguuagcgccuguggagaagggacuaucucgggggacaccgcuagagaauuucacagugaauagaacaguacaacauccaaggauccgaaggguguggucagaaaacucuaggucagaauucuuguucugugugcuuauaucacagggcuccaaacucucugaggacagggggcuuugcuuuguuuucaaaugugacguuauaauguaaauaacgauauugagacaagaagaaaagagaaacaagcuggugcauucaggcuaggagcugucuuacuagaccaugaggcgcaucccacuaaauauuaguuacagucaacgucguaagccucgucuuccugguuaaguuugcuguccccaauuccaucauggaggaaacccuggccccacucuucaagcaugaagacagacaggaaaaugaaauugguagaaaucaugauucaaccugcaccaagguuggccuuggaggauacauggggaggaagggaagggacugcacauuuuauuuuaugcuugguaaaaaucuagaggcacugcacaauuaccagugacuagcauccacuagagucugucucauuggcuacgaaugccccuuagcccgacaggggcaggaaugccuauccugggccaauaugcaguaggacaagagcuguuuugugugcauucuucuauauuuggggcucagucagaggauaugauugauggcucauguuccuguggaggcucaguucuguuugcagagcuucggaaaggaaaagcuggauauuggcaucccauucugaaauucccacccuccuuaccaugaaaaaaaaaaauccacccugaacugugaauuggagcccaccuucuagcccagcucuuacaguuuguugguucauuguugugcuauacuucuguuuauguuuccucuuuuuuaagaauauuauuuguuuaauauauaugaguacacuguagcugucuucagacgcaccagaagagggcaucagaucagaucccauugcagaugguugugagccaccauaugguuacugggaauugaacucaggaccucuggaagaacagucagugcucuuaaccacugagccaucucuccaguccauuuaggcuucuuaauauauauauuccacacaaauaacugauguucaguugacucuagaacaaauuuaaauuacuauaaauuaggugacuaauaccuuuuuuuaaacuucacacacacacacacacacacacacacacacauuccuacccuugaaacagacccuaccagggucgauagggucucaauaucugauccauaaggauuaugcauagacgugaguccaagguuccaccuaauagucucagaucugacauccagcccuaguucacuaaccagaacccagaggaacaugggcgcuaggggcgaaaccaauucccaucccuggaaagcagcaaggggagaugagguugcugcugccuguucuuucaaccacucucuuaccacuucauuccagaguacauccuggaaccuccaccgugcagaucggagcccggagcgugcaacauguucuguacgcagcaggaggaaugcccugaaccgcuucagugcuguuccgccuacugugggauaguguguaccucaaaccaagccccaguacuagggcucuccuaaggcuccccucucccagcccuggcaccagagcugcuggcagaggccaacagcagaggcuguugcccacgacugugaugaguguccuuuccuuuuucuuucuucuugcugguucugccauauugccauccuugucucucucuuuaccaaggaugauuuccacagaacuccuaauuaaaaaagcaucuucaaaucucaucaucccuccaccacugaagcugugaaucucugccccugucucucugaacguacucauaguugccucugacucuauucuggggccuuccuggucccagaagaaccgaggacacugaugagacacugccgcuccucucacacggcaugucuguugccuuuaauacgacagucccucuuuuucuuucuuuuuucuuuuucucuguuugaauagaugaugauucugcuuguccaugucucacaauauccaaaugaagucuagaccaaagaucagcagcagggcguucaacagcugagugucuugaggaaagauugaaaugccucguucuuugcuaagucccgugcccugagcaaauguccagcuguguagacuauguucagagugaugguguacaucuggacucucaaucucucucucucucucucucucucucucccucucucucucucucucuggaucagcuugcucaucauuaagacaagaauaaacaugagacuaaaauaaauaucacaaaugagcugaag

SEQ ID NO: 1259 - RNA, 22627 nt, Mus musculus
cugauggugcucaacgccuuuaaucucaacaaaggcgagaccucugagcucaaggucagccaggguguauguaagagauacugucucaaccccaaaaagcacaaaaaaguucauacucuccaguaaauuuccuguacaaccuuagcagucagucaguguacuagcacguaacacugggaaaauaaaaggcaaccgcauuuucccuuugguaggccaucaaacccucugggccagucuucaccuugugcaacauuccuaaacuggaacaaggccagggcagccuggcagagaacacagaugggggcggguaggcgggcaggugggcaggugguccuuuucuggugugcauacuucuuuggcagacauuauagcaggcucacuaccuguguuuauuacaaacuguuuaauugcuucuuauuccaauaacuuuagaaacagaaccacaugccagucuggggugcucugcagugagucacuacaaacuagcucauguacagcuuaaugcuguuaagagucaacuagaccaaauccccaugauggccucagccggguggggaaagagggucuuggaggcaggccgccaaguguaguagccaggacacccggcucaggucuggggaggcgcuuccgcagcgcggugcucauuuucuguccgcagugucuccauguauuuccgcaucuucucaaccauccaggauggcagaacaaaggauuucagcuccuccaacuucagguccaagcauccucugaaggagacaugggauggacauuaaagggagggugacggucucguccaugugccuagugaggcagaaggcaggauggggaaaggggucuucguuguaccuguagucaucgcuggcagccaagucccggaugucuucuucaaugagaagguacgccuaagggcaagggagagugagggagggagggaggccuuugauucauuucacaccaaauauuaguaauguccugggaagaugaugcaggaugcagcuuacagauaccagggaggaguccgcaggaagacacuggggauggucccuugagagcaccuuucacucagaaacuuuacagguggaugagucaauuccauugauuaagaaaaaaaaauugcgggguuggggauuuagcucagugguagagcgcuugcuaaggcccuggguucaguccucagcucuggggaaaaaauaaaagugcccaggcuguaccugaacuuccuguccccucagccucaugaguagcuagauuacaggcacuugccauggagccuggcuuuggugauuggcuacaaucuuccuauuaaacgaugaugauacuugaugugauuuauagcagaugguaagagcuagcagaacacagagaggagaguaggaaguguacacccugggacucagacagugguauaaggauuuggucaacagugcugcugugcaguggcuguagcacugaguucuccugggucuguacaaggccacaggcugugguccuugagcucauauacacugucaguuuuuguuuuuauagcugggauuggcuuguaauucuuguagcccaggcuaaccuuaaacucaccacaccacaacugcuuuguaagugcagggguuauaggcgugugucacacacacagacagguacaacauacacuaaauaauacaauaauuaaaaaaauaaauaguagcugggcgugguggcgcaugcuuuuaaucccagcauucgggaggcagaggcaggcggauuucugaguucgaggccagccuggucuacaaagugaguuucaggacagccagggcuauauagagaaaccugucucgaaaaaacaaaaacaaaaauaaauaguauuggggauuaaaccuggggccuuccacaagucagauaagcuacucugcuccugagccauauauauccccagcagccugccuuaccuucgccuuuaauugauuuuuuuugagaugggguuuguguagcccaggcuagcuuuaaacuugccagauaauacaggcugucguuaaacgccugcucuugccucaaccucucaagugcugggauuacagauguacaacauuccuggccuuuuggaaagccuauuuuaaaaauuugagacaagcacuaagccuggccucgaacuuguucuguagccuaguaggcuuugauuaaaaauccuccuggucaggcugguggcaccuuuaaucccagcacuugacauauugggacuauaucucaaaagaaagcaaacaacaaagaaaaacaaacacaaaaauccccugccucaacuuccugagucgaugggauaacaggcucaugucaccaggccuggccaccuccagcuuuaaaaagacuuguugcugccccucuuucuccccuccuucuucuggggcagggucucacugugaagcuauggcuggcuuggaacuuacaaugcucuggcuuccucugccuuccaagugcugggaugacagacguguacagcacacccagcucugcucauguuucuacuucaagcuaugcugcauccuauguuguaagugggacaauuuggaacuauuuauaagaggguggcaagucacaacauaaaagcaagcucucacugccaaaaagcagauggcaugcacaggaauucaaggcccugagagucuuaugagcaguuccaacagugcucacguagagaacacugccuguggagaaagccaucacagucgucucaggacacacagcuauccugacugcugcuggauuugagcugaguuggcuuggaguagacaugaauguggaaagugcugcuagguuucuuuuuccuuuuuuuuuuuuguuauuuuuugagacagggucuuucuguuauguaguccuggcuguggcugccuuguacucacagagauccaccuaccucuccuuccaaagugcugggauuaacggugucugccacuaugccuggcuguuagcaucuuuaacuugugccccuacuguguugagaaggcauucuauagcuguaucugugauuucuuguaucccuacuaugcugucuggaaaaugcuguggucaauggacaaaaaaucuuauguacagacauauuuggaaagaagcauugcugggcagugaguuccaggacagccagggcuguuauacagggaaacaaacaaacagccuuuucuauggucaucuaauaacgauucaaaacuugcaggaguggguuggaaaaugaggggggagagagggaguccuaggaauugaagucugcucuucagcaugaaggagcaggucucaggccucccuucccauaguccugauguuuagguagucuacaagcuguggccaagagcuggacucacggucccugacuaggugcgacuuuggcagcgcuacaucaagccgagcucaccaucuuuccgccuguugcccgcaugugaugcugcucagccagccagugcuuguccugaggaucugcugcauacugugagggauaaaguuagugggagaacauguuaggcuuagugggaaggguucuucucuuggccccugaccaguucuuaccaguggaccuuguccuagacagguaugucuaaccgagggcucaugaaucucuacaguacaggcugacccaugcccagggagccugggguggcaaccuaguugccagaguucagguacauggccacucuucccaguuccccuuucuuaaaauauagcaucccuggaaacaagugagaguuauuuuagagacuauuuaaaauugaccacaggugccuucuaacaccuauuauuaucaugggcucaguauuuuccugauuuuugguuucugauagggcaucacucuguagcccaggcuaggauuacuucuggaucccucugucucugcuucugaggacugagguuaugagcaugugcuguuacuggcaggacuguauuuucuuuucuuuuuuuuuuuccauuuuuuauuagguauuuagcucauuuacauuuccaaugcuaucccaaaagucccccauacccaccuccccccuacccacccacucccccuuuuuggcccuggcguuccccuguacuggggcauauaaaguuugcaaguccaaugggucucucuuuccagugauggccgacuaggccaucuuuugauacauaugcagcuagagacacgagcuacgggguacugguuaguucauauuguuguuccaccuacaggguugcaguucccuuuagcuccuugggugcuuucucuaguuccuccauugggggcccugugguccauucaauagcugacugugagcauccacuucuguguuugcuaggcccuggcauagucucacaagagacagcuauaucuggguccuuucagcaaaaucuugcuaguguaugcaauggugucagcguuuggaagcugaucaugggauggaucucuggauauggcaaucacuauaugguccauccuuuugucacacuuccaaauuuugucucuguaacuccuuccauggguguaggacuguauuuucuaaaacaaagucaagaaauagccccaucuaaaguucuagaguucaacaucaagacaaauaaggcuaggcuuccaccacuugguagauacacaagucugggugauaauuuccucauuuauagaauggagagugcugucagcaggcauggcacugcaugccuguaauccuagcacuuggugaguggaggcaggagggccuggagugacugagcucagccugggcaacaugagacccugugugaaaaccaauccucucaauuccauugcuaaaaguaagaugagggagagcuacuuguguaggacagauaagccaucaaaauaucauugacaauagguuuuucuguaaaaguaccagucauuugguggugcuggcacaugccuuugaucccaguacucagaagguugaggcaggauaucucugaauuugaggccagccuggucuacagagccaguucucagacagccaggacuacacagagaaaccuugucuccaaaaacaaacaaaacuccacaagacuaaaaagcagaaaagacacugggcaggguagauggugcuuguguuccagucuuagcuugagaggcacagugcagggggcugcagguugcaccuggcuacacuaccauuccaggaacaaucccaugaagcaggcaagcggagcucuaagcugggcuggguauagcuggguaaaaggugcaggugcuagcuaaagggaaguaaaucccagauguuuugacuaccaggucacugcaugucccagcuucucugccucacaguuuccaaggccaucuacaaccacacaggggcauggauggcucucuccccuccagcguucaguucaccuaccuuaaagaggugugggugcuugauguagauucucccucuggugccucccauccccaaggcccuaaaaaugaaggaagcguggcaguaggcucagacccugacagugagccgugagccaaccccuccccaucaguaccaagggucucagacuuacuuguuggcucgagaccccaaaacaaaggugguagauucauucagccgagcugggucccacugaaagaaacaggccaguaaaggguguuuaaugugcugggcagggccgugacacuccuccccuguccuuuccuccucucuccuuauccauuauucgacagauaaugcaggaaauagaguacuuauaauguuaggcucugugcuagacagaggauagagaugaguuaagacauggacuguuccccaggaguuccagauacacauacugacugaaaggccacuaucugauggaccaucgauggggccaugacauggcugggugcggggcaugagaggugucuaaaggacggauggaacaggcagaaagucucucuugaagagcuaacccuugaaguuacuucuggaagagugagugcaaaucaaacgguaggggagggaaagggcauccuacagagugcaguauguaaagcugaugcauugguuuggaacacugaacaaaccaauuucuguguugccccaggaaugacgugagugcgaggcagcugagaaagcacagacaacuggagcuccuagccacacugacggguuuguauuguaugaccuacagaucacaaggaaccacuaaaguagcuacuggaauaagccugaugugcgcuaaggacaguuuacuccuuuagcaauguggauggcagacaggagaguagcucacaggcugcuauaacaaaugagaaugucaagcaaugacaggccuaggcuguggcaacagugaggagaaagaggggacaggagcuguaguacauucacaggguaagggcuugacuggaugcagagaggucaaggaaggcaacaggcaaagauggcuaagguaagaaauaagcaggaucugaaaagugggcagagcgcgguuugccuggcauaugcaaggccccguguuuagucccuggcacauaugaggccccauguucagucccuggcacauacaaagcccuauguucaguccuuggcacaugcaaggcacuguguucugucccugguacaaucaucagcacauaaaguagagcucacuuuuugucacagugguacacaccugugaggcccagaccugugaggcugagaaagauccugaguucaaggcuagcccgggcuagagugagagccuaucucagaauaacaaaaccacgaaaacaaaugguuuuugaagaaagauccucauuacaguuuggaucugcugugucugagagcuuguuuggagguucuggcuggggggcacagcaccuguacaccugaccaaaaauggccgugcucugccaagaaagucauucucuugagaugagaugcaguuuuaggaggggugcacuuggaguggugagggugggauaggucacaugccuagccugacagaucacuguaguacacaacuccaggcaccacugggguggcaucuguuguagccagauggcccucauauccuagauaagcuguguuugacaugccugggcaacuucaggcagcaagcaggaagguguuucaagguugaaagcugaaggugugagaaggacaaagaaaccugggaagccuucggaagaccugguccugaaguccuguggaugagaaagaucccugugcccacgguggucacgaggcaccagaggucuuacagaggaugaguuucaauucuagcauucauaccaggcagcuuacaaucaccuauaauuccagcuucaagggaauauaaugcucuucugaucuucauaagcauccacacacauacucacacacacacacacacagacauagauuuauaguaauagaccccagagagcuagugggugggggcaggugcacgugcccaagccggaugaugugcaucugauccccaagacccacacagugcaaggaaggaaccaacuccccugggaugaccucugaccuucacaugaucuugugcacccccacacaauaaugaauguauuaguagucagaggagcuuccagugaagugggccugggaaguaguugagggaugccuaccacacgggucaugcugggaagaccucucaggacugagaagggggcuuggagagaacagagauucaggagaaugugcgucaccagcucuauguuuuagagcucuagaaauuucuugaagauuuuagaagaaaccucaugacaauucuagggaaaguaaagagggcuggaugagauggcuguguucaaugucaacauuugggaagagggacucuuuuuaacugagaaaaugucccucuccaccugcagacaagucuguagagcauuucuguaauuagugauuuauggagaggucccugcccauugugugugccauugccucugggcaggugguccuagguucuacaagaaagguaggcucauggcuuuaaucacagcacuugggaggcaaaagcaggcagauaucugaguucaaaaggggggagggaaggaaguaggcuaagugggccacaaggagcaagucagcaagcagcacccuucuauggccucugaguccacuuccugcccugaguuccuauuccgacuucccuuuccugauagacuguaaugugcaaguauaagaugaaauuaacccuuuacucguugcuuuuggccauagcauuuuaccacagcaauagaaaccguaacaaagacaguagcuagcuuauuuuuaauaaaguucuacuaaggaaagggaauaacuuuauguuauucccuucacugggcauccacauuucaauaaauaaugaucauaaaagggauugcaaaaauaucuuggagguggcagaguuggcuaaaggcaucaacagauuuugggccucacacugggcuuuaucaccagccagcuguaugccaggcaagcuucaaauguauugggagcgugagauaaugccaggaaagaagauuacaccugcucuacagggagauggcuggaaaggaagcucaagucccaaacagaaucacaaagaauaagggagccagcagaccauaacauucugggcagugucuucacauacaaaauaguaaguguuggcagcuaccaguuaaaaacuuaacucucccuuuuagagacuugaacuugcaguggucuuccugccucugccucguaaguguugggaauacaggugucagcacugugcugaguuuuaaaauuaucuauuaaaaacuaagucaaacccagggccucaucccugccagacaaguguucuacuauggggcugugcuuccagcccaaccuuuuagcuucccucuaauuccaguaaagaaggaagucauuccaccugcaggaaaacgaugcagcugcaggggucacauuaaauuaaucaccuaagucucagaaggacaauacuauauguuuucucaagugcagcuucuagauuucauauaugcauauaaaaucacauauggauauaugccacgaauguagacaggaaguuuaggggaacaaagggaacugauggagggccagacaggaaagggaacacagcagaggauggagggggacauguccucaguacagcacacguguguaccaggaggaaagacugaacacaacacaacaguuuuuccauguuagggauucaccuaggaccuuccuuacgccaggcaguaucugcugccaugcuaucccaaguccagcucuuuauuuugcuucuaauuccaguucuuccuuggaauacugucuggaggccaaagaggcagaggcagaggcagagacagggaagauggcuuuggaauggugugaacauaucauguaucauuuccaaccucuuugccucacaggggcccagagucucggccacugucaauguucacacaagcauaccuuggggccuucucggcgaauugguucacaggauuuuuguuuccaucugcucagaaggaaaaaagacaggugaguucuccaagugaucgggggagggacugagcuuggagauuuacuggagacacuggagacacaguucacaacuaucugcaacucuagugucagggcauccaacacacggacauacauucaggcaaaccaccaauguccauaaaaauacaacccuaauuuaaaaacaaaauacaaagaaaaaaaaaaaaggccuggagcagaaacucccuuagaaccuagcaaugggcaaguccaggaauguccaguugcagcuuucucaucugccagaaggagauaaggccagcagcugcccugcccaccuuguguucaugagggaugaaaaugccuggucuacucugugaguuucaggucaaaaauaguuuagaguaagacccugucuccaagacaggacaaaaaggcuucaggaaggaugcuguaacuugauacagaucagacucacaacgccaggaaugaagcccacagcagcccacagguccagugauggccuuaagcugaggcagucaucaacuguaacaaaugugucauucuagugucagguguugcuaaugagugcacauagaugggguagggcugcaucucuguauccucuacucagucugugauguaucuaaagccauucuauaacuauaacuuaaaagagcuccuugaaaacaaccauccuguagucucuaaagugcuuuuaaugacuguaagaucaguguuuuguuuugugacagugucucauguaguccagacuggccuuccagucacucgcgucacuauguagcugaggauaaccaauaacuccugaucauccugaccucgccuccuaagcacagagaucucaggugccugcugcuguacccuaauagggcagguaauucugacucuguuuuuuugaaaucugcuaacuguuguguucuuuagaguaguuguaggcuuguacuuagaccagcucugaacacucaaacauggaucagggcugcugguuaaucaagcuggaacucugcuggguuuuauaaaggcaggaugaagcaacugcaucucauggccccuucacuacccuacaucagggauccucucccacaguagcuuacaccaguggacccgaguucaccugccucuuucuucccacucacgccccccaggcccccucagcucuuacagcacugguaaccccuacucacaccaugccagcagcugcgcggucauuugacaggacguguccaggaggccgaccuuuccucugcacagagaagagcugucagagcccuggccugugguagcaucccuggucuagucuguuggggccgggucaguuaguggagacaguuguucagagagaacaaaugaucuugggagugccccggagagcaacugucgucgugucguucccccccccccccccccccggcaaugccuggaaaagcccaaaggucuuccuuuggaacaggagggcccuuucccagcugguguccaauaaggaccuacuugcuuauuacuugcuuaccuuuuugggaauggggcuuccucggugggacuccucuucugcuugccggccccgcugcaggaacagggagagagucagugaagcugcaguuuuagaggcugcaggaaacagggacccuggacccaagccucuggccaccacccgacccaggucucacaagucuugaguggugccuuuuggcuggcucuaggaugcugcugugucauuccccggguccacauauuuuaccuaccucccacuugacuccccuccuaugggcccagggcauugauucucaccuugaucccuggaagcucaugggccaaucuggguaucacuuucucuccaucagaaaagagcagcuuugccugaaagggagagaccagcgcugccagucaguagcuggguggggaagggcagcaguuuguaaacacaacuucagaauggguuggcuuuccuggaagacacucacauuuauguucagagaugaacaagccagagaaauaucagcccauauauucauuuauaaaaaguagcuaugaaagaaagagaaggagcuagugaggcaccaaaggcuggacugugcucgguguguauaaggcucugaaccugguucgaagcacaauagccagcucacauuaauccccacuaacccacaagggcugcugcauguucaugggacucuagggaaaaaaaaagguguguguggaguguguguggaagucaaaccuguccgcugucuuucccauguguugucaggcaagcaccuuuaauuacugagccaucuugccagccuguguuuugagaaagggucuuuccaugaagccaagcucagcuaggacuugcuagguagccaugcuggcaucuaacuuaaaacugcuaugccucaggcuggagagauggcucagagguuaaaagcacugacugcucuuccaacgguccugaguuugauucucagcaaccacaugguggcucauaaccaucuauaaugggaucugaugcccucuucugguguaucugaagacagcuacaguguacacauauaaauaaaaucuuuaaaaaacaaaacaaaagaaaacaaaaggacaggaucuuauccuguagcacaggcuggucuagacuucacuaugucuucaccaggcuggccucaaucucacagagauccucuugucucuguuucacgagcccugggacuacauguauaugcuaccacaccugguauucaaguguagguuuugugaggaagaauccuuccugauauuuaugaauggaacugcaauguaguuaacaucuuauaugucuguguugcccaugcugggcuaaguuuaaacacacucuuccauccaaggcccccagcaaagcacuggugguagggaguggcucuauucccaucuucagagaugagaacacugaagcuuagaaccuacaggaacuugcucugggcuuuagcucacucugcucugaugccaaguucugcacccaggcuucucagcaguucagccacauagcaugcauggggaucaggagaacagaagcagggggcaaugagcgcaggccaugccuacuuaacuuucuaagagaauuauuacuagcguguuuguggauguggcauacaugcuuccacacacacgagggagucagaggcggacuuuaugggguugguuuacuccccuuuagguggguuuggggguuaaaccucagguugucaggcuuuucugacaagcacuuugcccacugagccaucccuccugacccuucuuuaucuuuacaucuuaucugaacuccucaagagucuccuaaauucuuuuccaaucuaauguuccugaagcagccagagcaaugucucuguuaucuuuuguauuguuggggauggaccucaggcugccuggcugcugagcucuacuccaguugagaagaaucuugcuaaaaugcaaaugauguuaggccucacccacaucauccacugggccugugagcacugccuauagcagccauguauguacuaagccuuuacccuguggaacuaguaacacucuccucacccauuccuaagacacaggcacugcuucuuccccuggacgcuucaucuucuagcaagcuuucuuacuggacaacuaucugucgaguacugucaagagagggggcugggcucacagugcauauugcuggggccugauacuaagaagcacauaguaggcccccaauaaauaacaaguguuauuuaaauaacacuuaaguaauaauaaguagaaagauagggaccagugagcuagcucaggagguaaaugcauuugcggcuugaugaucugagugaguuccgugcucaggaacuacuugguggaaggaagaacuucagacagcugucuucugacuuuuuacacuugccauggaccauuugcacaaacacccugaggagagggauuugagaugcaggugaaugaagaccuuuuuaauuuacccugcuucagaucaacauuaugagagcacuauuagcaaaugucuguugcuagcaacuguuagaauuguucaucuaugugcuccuuccuggaggaaagaauccggccucuuaggaagucuccaagaagcaggucaguuuccaguguucugcaggguggagcuguggcucccagagcuggaguucaggcagugccuuugcuccuuccugaggcucuucacagucaagcaaggcauaguuaacaaaaucacacucaagcaaggagccugcuggaugccgacagucucuauuaauagcacagcugacacaggcaaacagguucucuagugucugagauagucauuuauagaacugaugucaacucuccugaccacaccugagauguaggaggacaaaaagggugccaggccccaugacccccaaagagucuaugacaacuuaaaggggauucacuaaccacuuguagagaugaggcacaucuuaaacuacaauuuguucuccuaguuugccuuuuuaaaaagugacagaauuguauuuauuuauugacugcauguguauguguguggacacucauauaaaggucagaggacagcuugugggaguggguucuggguaauuaaacucaggccauuugguuuggcagcaaacaucuaauuggcccuuguuuguucuagcuuuaguguggcaaaacugacaaacagauauuacauacaagaggggguacaauguguugguuuauaucaucacaauacgguguuagcacuguguuuaugcacauguguguacaauuuagaaguacugucacuauucuguguacgagaccccagacugaauccaccuucuaacugcaggcuucugcagcuuccagcuaacuaccauuuccuucuguuucugucaguuugcuaagcaguuucuucauuggucaaacaggggugaacauacgcgaccugugugguuccuggcgcauauuuauguuacuucucuuccugcuuugucagcagcugcccugagcucaacccggauguaaguggcuuccugaugucccccaaguaccacuaaugaaagagcacguucuuagccgacuuggcccucaccugcuccaggcagcugcggcaggccuccugaaucaacugcucugcguccacuucuuccccaacauugucucgcacauucagcgcugccuucuggaagaacuaggggagaacaucagcacagucacaagucuuucaggucugcauuaaccaaagggaacacguauguaauguggcaacaucaugggugacuguuggcuuugcuuaugcacagcucucaaugucauaauuacagguaaagaaaaacugcuaugucugaagcaaaugggccaacauaagcagaaaccaucucgacaauggcaaaccaugacuggauucucauuagucaaucccuuaccuucgggacagggaaggugauccaggaccccagcaacaccaacagacagaggcugagcagggcuuagggguaaaagggagagcuugguucuaaaaaugucaaggaagugcaucauggccaaaacaucccagggccugagaacacauuuauuuaaguguccagauggaccaaggagauacuucaguggguuauaaguguccagacuaucucuaaaagacaguaucaguucucucuuggaaacuauaaucaguguuccuguugugagaggcagcugaugcagugccacuuuuuauuuuuguuuuguuuuucgagacaggguuucucuguguagcccuggcuguccuggaacucacuuuguggaccaggcuggccucgaacucagaaauccaccugccucugccuccugagugcugggaucaaaggcgugcgccaccacugcccagcuugcauugccacuuuuaaaugagcaaguccagugccucuguuguuaauauaaaaaucagggagagugcaggcaugguguugcacgccuuaagcccccagcacuuggcagaggcagaggcaggcagaguuccaggacagccaggacuauguagaaagaccuuguuucaaaacaaaacaacaaacucagggagagcacaugaaaggauuguacauagcaccaccuuucuggagaacaacuuucuuucccucacauccuuuaauucuaucucaaggaacugacuccucagaaauccucaugugaauaaagauguacacuuacagugucaucgaaguauaauucuuuuuaauuaaaaaacuacgugaacuguuuauuuacuaugaagauggacagcuugcaggugcuggaugcuuuccuuccauucgagucuugggauuugaacucaggucuucaggcuugaugacaagugccuuuaucugcugagccaucucaauagccaccccaccccccgccccugaaguauuucuuguaacauucgaaaaacuguaaaugaccucaacaaauguccuaggcacuagcuaauuaaauuauggcauguugaugaaagacacuauuguaacuauuaugaagaaucagaaugagcuauuacaugaugaucuagaaacaugacucacauauaccaagugaagucugucaaggugaugagguuugugcaagugacacagcuggaaggcugcacagccacuguuggcaucagcucuacuguguaugugugcacacgcaugcacauuggugccacaguguguacagaggucagagggcauucuguggagccaggacuugccuuccaucacguggguucuggaucuaccucuaaggugucaggcuucacuaaaguaccuuacccacucagcugccucacuggcccuguugucugauucuagaaggaggccucacagaccccaggcugaccucuaacuaguggaggaugagucuggacuccugaucuucuggucucuaccuucuaagugcuauuacagguaugugccacaccuuaucaaaaacugaaacaggaaagugaaauuuuugaguaaaaaccuaacagccuccacacagacaguccaaaguccuaccguguguguuuacuauguacucauucuucugcccaucaauccagcaacucaaugguauuccauaucauuaucauuauuauuugcaauguuaaggugcgaacccagggucaguguaugcuaggcaggcuuauccacacugcuaaucuuaaacaauagcauuauauuuauacauacauauaguguguguaugugugcaugugggcacacaugccaugcauggcacaugguagaggucagagcacugucugugggguugggucuuuccuuccaccauguguguacuggggauuauauucaggucauuaggcuuggaggcaaguaccuuaagccccugagcuacuucaauggcucccgccuuuaauucuuuuuuuuuuccccgagacaggguuucucugcauagcccuggcuguccugaaacucacucuguagaccaggcuguccuggaacucagaaauccaccugccucugccucccaagugcugggugcgccgccaccaccaccaccaccaccaccaccaccaccaccgccuggcucugccuuuaauucuuugagacagagucuuggguagcucagguuggcuuugaauucacuauuuuccugcuuccaucucugaguacugggguuacaagcaugugcuuaaaugccaggccuguuacuaaguaucauaauauuaaauauucuauauuauaauucuuugaaaaaguuuaaaaacacuuuuuagauuuauuguuuguguauguuguaucugcauacuugucuguguaccacauguaugccugcuuccugaggaaccagaagagguuguuggucucaaacuggaguuaguuguggaugguugugggcuaccaugugggugcgaggaacugaacucuggguccucaguaagagcaacaagugcucuuaaucagccuugaauuguuuuauuuuuauuguuaacaccuaugcauuguuuuguggacacacuccauggcauacaguggaagucagaggguaacuugggaaacucagcugucacucuuggugggaagggccuucacucgcuuagccaucuucugguccuggaauaucuuuuuuaaaagcauaauacauuuaauagauauaaagacucacagugccuugagcaagaucagacuuaacuaaaacuuaguauuuuaagaagguuaaagagauagacuggaagagaucgcucagcgguuaagaccucuuccagagguucugaguucaauccccagcaacuacauggugguucacaaccaucuguaaugagauccaaugcccucuacuggugugucugaagacagcuauaguguacucacagacauacaauuaaaaaaacaaaaacaaaaccuuuaaggggauugacagcugagaucuguggacacugcucagguggggccaggcaucacaggagugacaccacuggauuuauuuuuauuucagagguuucucugacuauuguauggaggguagauuuaaagaaugaaagaccaggcagagcuggacaacaguaagagccuggaugagaaacaaugaagguaucaaccagaauggggcauggacucugcagcagaccacugcacauggaagacagcagguagguuucuacaugaaugaccugaaacuuaggucugauuccguuuguuccugcccuccucacaguauaccaguagcagcucuguuuucguagcugcccaggacaaaugaguuaggagguacacguguccuuuucucucagcccacaucacagucauggcugcugccgccucacugcugaggcucacgcacugucacccccugcugggauuaucgcugguuccuagccagucccccugcagucuaugcucuacacgauagucaggaauucuguuuuuaauagaaaauuaacuacuuaacuucuuucuuuauuucucacuauguauguauucucauuauguagcccuggcucaucuacacagauuaucugccugccucugccuuccgaggacugggauuaaagguuaugugcauacuaucaugcguggcuuauaaaauuauuuuuaauuauguuuauguguucaaauaugcuugcagaagccagaggugcugaagcuuccagagcuggauuuacagccaaauguaagccaccuuccccgaaugcugagacacagugugcgcuuacugcucagucucccaaccccucccuaaaaaaaauaaaucagugauuauuuuaaagcauuacauauagaagcaggaaaaucauggguuugaagccauccugggcuauguaguggagauuuuaagccucuuugagcuacuuuaaaaacaaaaccaaacaaacaaaaaaaaugguuggggcuggagagauggcucagggguuaagagcacugacugcucuuccagagaaccaguguucaguuccaggaacccacaugauagcuuacaaccacccauuaaacuccagcucuaggggauccaacaccauuuucugaccucugugcacaccaggcacacacaaaguaccuaucuauacaugcaggcagaauacucaugaacauaaaauaaaacaaacccauaacaaaaaccaaagcccaacaaaauccccaaaacaauucagaaaacaaaaacccaaaguggccucaaagccuuuacaugaucugcaguuauuucuuuuuaugaaguccgaauuauccugauaccaaaauagaauaaagaaaauuauaugccaagcuccuugaagaacauagaagaauaauucucaacaaaagaguugcauacuagccgggcaugguggcgcacaccuuuaaucccagcacucgggaggcagaggcaggcgcauuucugaguucaaggccauccuggucuacaaagugaguuccaggacagguagggcuacacagagaaacccugucucaaaaaccaaaaagaguugcauacugauuucaagaaaacaugguagggcuggagagauggcucaggagcuaagagcacugccugcucuuccagaggucccgaguucaauuuccagcaaccacaugguggcucacaaccaucuguaaugggaucugaugcccucuucugaugugucugaaucacaugaaugauucagcgaugaaucacagggaugauucacguuugcaaaucaauaauggaauucauuaaacaacagacuucagacagaaaucaaaucaucauuucucagaugcggaaaaggcuucugacaaaaucaaacaucauuuugugauaaaaguccuggaagagagagaauguaccuccacguaacaaaggcuacagaugacggauuacagccaacauauuaccuacagaaaacucaaaacugaaaucaggaacaagacgggugucaggaguccacuuuccccacuccuacucagugcaguaaagccuuagcuacagcaaccagacaagagacacaaacaagaaaggaaggaaggcgccacaggagcucacuugcaaaugacauucuacacaccagaaagacgugacaauggacaagcgcuuucaacaaagaggcagaauaaaaaaucagcaugcaaaacccuacagucuuccucugcacuggcagcaaacagguugaggaagagcucagagaaagcauuccauucacaacugccacaaaauaaaccuuccaguaaacaugccuguaagaaaagcuuuaaaaacugaaggaaauuggugaagacccuacaggauggggugacaccacucccccacccccccaucauggauuggaaaaucaauacugugaacuggcauuaccaaaagcaacccccaucaaaugcaugagugucucuaauaacacagacacccuagcucuguucucgaggaagcccgguggugagcuaccucuuuuuuucacuccuucccucacacuguuugaagcgagcaggggcacuaucuguuuuacacacugccacaggcccagucauggcuggcaauguguuaaucaugaauugggcucuguacucacgagcuaaguaagugcuucacuaagcuacacauaaccccaaggcaucucaaugaugcuaaugguauuugugaaaaugaauuuuaaaaaggucuaacuuuucauggucuaaauaagggugcugaacacaugaaaaugaaaccaucuggcaaagaaagguauugaaaucacccccaagcagugaaaaagugauugggguguauaaaccuguuauaucuguguagcaagaauaucaagagagacuguugacaggacuauccugcuugcaagucuccucuauccucccuccccuuuccuuucuuuucagagagggucucacucugcagaccaggcuggccucaaacuccaaagaucugcuugcuucuuucuccugggugcugggauuaaagguauaugccaccaugccuguuuuuuucuaagauuuaaaaaaaauauauuuauguguacauaccuguggaauuuauacucugguuauaaucugcagaggucagaagagggcacuggagccugcaccugaguuacaggaggcugggaguggccugaugugagugcuaggaacuacaauugaguccugugcaggagcagcaagcaccccuaaccacugaggcuguauuuuccagccuccauucuguuuuuucuugucuaaggggucuuacugugcuguccaggcuggcugucagcugccucagccuccugaguggucgggcacguacgcugcagcaccuggcuguacagucuuguuuaguaguacaguuggcuuuagucaccagguccucaccuucauguacuuguugaagacacccuggaucuccucauugaugcuaggcugcaggacagcacggaggagauccauagagauggcugggucugugaaacugggguuguuggggagacagagucaggggaguguuccaaacagaccuucccagacuacucagcuaguuagcaacaugggauucuaaaauuuauuucauuauaacucugugaaauaggaauuauuuuccaaguauuuuaugaaauauaauacacacauauuuuuucuuuuccuuuuuuagagacagagucucacuauguagucugguugucuuggaacucacuacauagaucaggcuggccuuaaacucacagaggucugccugccucugccaaguauuguaauuaauaaaugauuaucacuaucccaggucaaaaauacaagaagaauucccaaggcccaucccuuccccaggcuggaugccccaugucaaagcugagaaaacagagucuaagaaaagcuaaaggcuuguguuaacaaacaucucagucugcauuagaacagaugucuguaaucuugaauucacauccucugacuuacagacuucaaucacggagacagacuagacguucauuccuucccugcuugguuaggauguggaccugacaaggugacaggaaguuacagccuccccacuccugugcucuuuacgggcuguugaucucagacuccuacagugggguucccaaagcacucacugcaguccacacaacuggaucucaggucucacccaggucgagccuuaccuuguggucaucugagaucggcggccccuucgcugcaccugccgauguuuuaucauuauguuccaaggguucuguuggggaccaagugggcaaaugucaccgaggcuucucauagugaggaugaggagaaagugaguauggcgcuaaaccuagacguuccugcuucucacuucucccaccuuggggugaaggggaauuaauucaguggcuggaagacccugucaggguggaggaacugggaaaauguuuucugucaccaauguccaaagcucgcuuuuucuggaagagcaagaggaagggcagcaguguuuaccuagggucuacuaugaggcgggugacgagucagggcguucuacccgccuuuaucagcccaucccaccacaacuccagcaagcucggguuauugcuguucauuucacagaagagaaaccuggcgcucagagggugucacaucaggcccacgucaccuagcuacaaucugaauccagcuuguagcggcacugagaaaacgacauucccagggccgcacggccgccgcguucuuucgcccgcgggcccggggcccgggagcccgaggcccugcccggcccgagccccggccucgcccgggcgcccucaccgugagaaccggcuggcccgccgcgcccgcgucgcccagcuccaggccaccucgcuccgccccgccggggccccgcggcugcucggugucgccagucgcccccauggcgccccccggcccacaacaaccucagcucgacucagccaccggaaagcggcgccgugacgucacgggagc

SEQ ID NO: 1260 - RNA, 15427 nt, Mus musculus
caaggaccgguccacguguauucgccgccccucccccgccgggucucuuuggaaccccgacuccugucgcuggccugugauuuggcugugcagccagguaugaauuugacuucuugaucccuccugcuuucacugccaaguguugagauuucacgaacgagugcucacacaccgggcggugguuggacuuccguccaaauucgcugguccguccagggacacgcccagcagggggcacaucuucuggaauaggaagcauuuuucuccucacccuauuaaaauguuaguuacuuuggguucccaagaacuuaagccgggcgugguggcgcacgccuuuaaucccagcacugggaggcagaggcaggcggauuucugaguucgaggccagccuggucuacaaagugaguuccaggacagccagggcuauacagagaaacccugucucgaaaaccaaaaaccaaaaaaaaaaaaaaaaaaaaaaggggggggggccuggagagauggcucagcgguuaagagcacugauugcucuuccaaagauccugaguucaaaucccagcaaccacaugguagcucacaacuauccuuaacgcgaucugacucccucuucuggagugucugaagacagcguacuuacauauaauaaauaaaucuuuuuuuuuuuuuuuaagauuuuauuuauuuauuuauuauauguaaguacacugucgcuaucuucagacacuccagaagagguagucagaucucgugaucggaugguugugaaccaccaugugguugcugggauuugaacuccugaccuucggaagagcagucgggugcucuuacccacugagccaucucaccagcccaauaaauaaaucuuaaaaaaaaaaaaaaaaaaaaaaagaacuuaaacaaccuaggcaggugagacagcagacucccgauuaguaaacguggguucagggggugcaugccuauaauuucuuggaaggugguaacaggcaggaguugaaggucaucucuaaguuagguugggcuauaugagaauguaccuuaaagaaacaaaaacaggaucugauggugcucaacgccuuuaaucucaacaaaggcgagaccucugagcucaaggucagccaggguguauguaagagauacugucucaaccccaaaaagcacaaaaaaguucauacucuccaguaaauuuccuguacaaccuuagcagucagucaguguacuagcacguaacacugggaaaauaaaaggcaaccgcauuuucccuuugguaggccaucaaacccucugggccagucuucaccuugugcaacauuccuaaacuggaacaaggccagggcagccuggcagagaacacagaugggggcggguaggcgggcaggugggcaggugguccuuuucuggugugcauacuucuuuggcagacauuauagcaggcucacuaccuguguuuauuacaaacuguuuaauugcuucuuauuccaauaacuuuagaaacagaaccacaugccagucuggggugcucugcagugagucacuacaaacuagcucauguacagcuuaaugcuguuaagagucaacuagaccaaauccccaugauggccucagccggguggggaaagagggucuuggaggcaggccgccaaguguaguagccaggacacccggcucaggucuggggaggcgcuuccgcagcgcggugcucauuuucuguccgcagugucuccauguauuuccgcaucuucucaaccauccaggauggcagaacaaaggauuucagcuccuccaacuucagguccaagcauccucugaaggagacaugggauggacauuaaagggagggugacggucucguccaugugccuagugaggcagaaggcaggauggggaaaggggucuucguuguaccuguagucaucgcuggcagccaagucccggaugucuucuucaaugagaagguacgccuaagggcaagggagagugagggagggagggaggccuuugauucauuucacaccaaauauuaguaauguccugggaagaugaugcaggaugcagcuuacagauaccagggaggaguccgcaggaagacacuggggauggucccuugagagcaccuuucacucagaaacuuuacagguggaugagucaauuccauugauuaagaaaaaaaaauugcgggguuggggauuuagcucagugguagagcgcuugcuaaggcccuggguucaguccucagcucuggggaaaaaauaaaagugcccaggcuguaccugaacuuccuguccccucagccucaugaguagcuagauuacaggcacuugccauggagccuggcuuuggugauuggcuacaaucuuccuauuaaacgaugaugauacuugaugugauuuauagcagaugguaagagcuagcagaacacagagaggagaguaggaaguguacacccugggacucagacagugguauaaggauuuggucaacagugcugcugugcaguggcuguagcacugaguucuccugggucuguacaaggccacaggcugugguccuugagcucauauacacugucaguuuuuguuuuuauagcugggauuggcuuguaauucuuguagcccaggcuaaccuuaaacucaccacaccacaacugcuuuguaagugcagggguuauaggcgugugucacacacacagacagguacaacauacacuaaauaauacaauaauuaaaaaaauaaauaguagcugggcgugguggcgcaugcuuuuaaucccagcauucgggaggcagaggcaggcggauuucugaguucgaggccagccuggucuacaaagugaguuucaggacagccagggcuauauagagaaaccugucucgaaaaaacaaaaacaaaaauaaauaguauuggggauuaaaccuggggccuuccacaagucagauaagcuacucugcuccugagccauauauauccccagcagccugccuuaccuucgccuuuaauugauuuuuuuugagaugggguuuguguagcccaggcuagcuuuaaacuugccagauaauacaggcugucguuaaacgccugcucuugccucaaccucucaagugcugggauuacagauguacaacauuccuggccuuuuggaaagccuauuuuaaaaauuugagacaagcacuaagccuggccucgaacuuguucuguagccuaguaggcuuugauuaaaaauccuccuggucaggcugguggcaccuuuaaucccagcacuugacauauugggacuauaucucaaaagaaagcaaacaacaaagaaaaacaaacacaaaaauccccugccucaacuuccugagucgaugggauaacaggcucaugucaccaggccuggccaccuccagcuuuaaaaagacuuguugcugccccucuuucuccccuccuucuucuggggcagggucucacugugaagcuauggcuggcuuggaacuuacaaugcucuggcuuccucugccuuccaagugcugggaugacagacguguacagcacacccagcucugcucauguuucuacuucaagcuaugcugcauccuauguuguaagugggacaauuuggaacuauuuauaagaggguggcaagucacaacauaaaagcaagcucucacugccaaaaagcagauggcaugcacaggaauucaaggcccugagagucuuaugagcaguuccaacagugcucacguagagaacacugccuguggagaaagccaucacagucgucucaggacacacagcuauccugacugcugcuggauuugagcugaguuggcuuggaguagacaugaauguggaaagugcugcuagguuucuuuuuccuuuuuuuuuuuuguuauuuuuugagacagggucuuucuguuauguaguccuggcuguggcugccuuguacucacagagauccaccuaccucuccuuccaaagugcugggauuaacggugucugccacuaugccuggcuguuagcaucuuuaacuugugccccuacuguguugagaaggcauucuauagcuguaucugugauuucuuguaucccuacuaugcugucuggaaaaugcuguggucaauggacaaaaaaucuuauguacagacauauuuggaaagaagcauugcugggcagugaguuccaggacagccagggcuguuauacagggaaacaaacaaacagccuuuucuauggucaucuaauaacgauucaaaacuugcaggaguggguuggaaaaugaggggggagagagggaguccuaggaauugaagucugcucuucagcaugaaggagcaggucucaggccucccuucccauaguccugauguuuagguagucuacaagcuguggccaagagcuggacucacggucccugacuaggugcgacuuuggcagcgcuacaucaagccgagcucaccaucuuuccgccuguugcccgcaugugaugcugcucagccagccagugcuuguccugaggaucugcugcauacugugagggauaaaguuagugggagaacauguuaggcuuagugggaaggguucuucucuuggccccugaccaguucuuaccaguggaccuuguccuagacagguaugucuaaccgagggcucaugaaucucuacaguacaggcugacccaugcccagggagccugggguggcaaccuaguugccagaguucagguacauggccacucuucccaguuccccuuucuuaaaauauagcaucccuggaaacaagugagaguuauuuuagagacuauuuaaaauugaccacaggugccuucuaacaccuauuauuaucaugggcucaguauuuuccugauuuuugguuucugauagggcaucacucuguagcccaggcuaggauuacuucuggaucccucugucucugcuucugaggacugagguuaugagcaugugcuguuacuggcaggacuguauuuucuuuucuuuuuuuuuuuccauuuuuuauuagguauuuagcucauuuacauuuccaaugcuaucccaaaagucccccauacccaccuccccccuacccacccacucccccuuuuuggcccuggcguuccccuguacuggggcauauaaaguuugcaaguccaaugggucucucuuuccagugauggccgacuaggccaucuuuugauacauaugcagcuagagacacgagcuacgggguacugguuaguucauauuguuguuccaccuacaggguugcaguucccuuuagcuccuugggugcuuucucuaguuccuccauugggggcccugugguccauucaauagcugacugugagcauccacuucuguguuugcuaggcccuggcauagucucacaagagacagcuauaucuggguccuuucagcaaaaucuugcuaguguaugcaauggugucagcguuuggaagcugaucaugggauggaucucuggauauggcaaucacuauaugguccauccuuuugucacacuuccaaauuuugucucuguaacuccuuccauggguguaggacuguauuuucuaaaacaaagucaagaaauagccccaucuaaaguucuagaguucaacaucaagacaaauaaggcuaggcuuccaccacuugguagauacacaagucugggugauaauuuccucauuuauagaauggagagugcugucagcaggcauggcacugcaugccuguaauccuagcacuuggugaguggaggcaggagggccuggagugacugagcucagccugggcaacaugagacccugugugaaaaccaauccucucaauuccauugcuaaaaguaagaugagggagagcuacuuguguaggacagauaagccaucaaaauaucauugacaauagguuuuucuguaaaaguaccagucauuugguggugcuggcacaugccuuugaucccaguacucagaagguugaggcaggauaucucugaauuugaggccagccuggucuacagagccaguucucagacagccaggacuacacagagaaaccuugucuccaaaaacaaacaaaacuccacaagacuaaaaagcagaaaagacacugggcaggguagauggugcuuguguuccagucuuagcuugagaggcacagugcagggggcugcagguugcaccuggcuacacuaccauuccaggaacaaucccaugaagcaggcaagcggagcucuaagcugggcuggguauagcuggguaaaaggugcaggugcuagcuaaagggaaguaaaucccagauguuuugacuaccaggucacugcaugucccagcuucucugccucacaguuuccaaggccaucuacaaccacacaggggcauggauggcucucuccccuccagcguucaguucaccuaccuuaaagaggugugggugcuugauguagauucucccucuggugccucccauccccaaggcccuaaaaaugaaggaagcguggcaguaggcucagacccugacagugagccgugagccaaccccuccccaucaguaccaagggucucagacuuacuuguuggcucgagaccccaaaacaaaggugguagauucauucagccgagcugggucccacugaaagaaacaggccaguaaaggguguuuaaugugcugggcagggccgugacacuccuccccuguccuuuccuccucucuccuuauccauuauucgacagauaaugcaggaaauagaguacuuauaauguuaggcucugugcuagacagaggauagagaugaguuaagacauggacuguuccccaggaguuccagauacacauacugacugaaaggccacuaucugauggaccaucgauggggccaugacauggcugggugcggggcaugagaggugucuaaaggacggauggaacaggcagaaagucucucuugaagagcuaacccuugaaguuacuucuggaagagugagugcaaaucaaacgguaggggagggaaagggcauccuacagagugcaguauguaaagcugaugcauugguuuggaacacugaacaaaccaauuucuguguugccccaggaaugacgugagugcgaggcagcugagaaagcacagacaacuggagcuccuagccacacugacggguuuguauuguaugaccuacagaucacaaggaaccacuaaaguagcuacuggaauaagccugaugugcgcuaaggacaguuuacuccuuuagcaauguggauggcagacaggagaguagcucacaggcugcuauaacaaaugagaaugucaagcaaugacaggccuaggcuguggcaacagugaggagaaagaggggacaggagcuguaguacauucacaggguaagggcuugacuggaugcagagaggucaaggaaggcaacaggcaaagauggcuaagguaagaaauaagcaggaucugaaaagugggcagagcgcgguuugccuggcauaugcaaggccccguguuuagucccuggcacauaugaggccccauguucagucccuggcacauacaaagcccuauguucaguccuuggcacaugcaaggcacuguguucugucccugguacaaucaucagcacauaaaguagagcucacuuuuugucacagugguacacaccugugaggcccagaccugugaggcugagaaagauccugaguucaaggcuagcccgggcuagagugagagccuaucucagaauaacaaaaccacgaaaacaaaugguuuuugaagaaagauccucauuacaguuuggaucugcugugucugagagcuuguuuggagguucuggcuggggggcacagcaccuguacaccugaccaaaaauggccgugcucugccaagaaagucauucucuugagaugagaugcaguuuuaggaggggugcacuuggaguggugagggugggauaggucacaugccuagccugacagaucacuguaguacacaacuccaggcaccacugggguggcaucuguuguagccagauggcccucauauccuagauaagcuguguuugacaugccugggcaacuucaggcagcaagcaggaagguguuucaagguugaaagcugaaggugugagaaggacaaagaaaccugggaagccuucggaagaccugguccugaaguccuguggaugagaaagaucccugugcccacgguggucacgaggcaccagaggucuuacagaggaugaguuucaauucuagcauucauaccaggcagcuuacaaucaccuauaauuccagcuucaagggaauauaaugcucuucugaucuucauaagcauccacacacauacucacacacacacacacacagacauagauuuauaguaauagaccccagagagcuagugggugggggcaggugcacgugcccaagccggaugaugugcaucugauccccaagacccacacagugcaaggaaggaaccaacuccccugggaugaccucugaccuucacaugaucuugugcacccccacacaauaaugaauguauuaguagucagaggagcuuccagugaagugggccugggaaguaguugagggaugccuaccacacgggucaugcugggaagaccucucaggacugagaagggggcuuggagagaacagagauucaggagaaugugcgucaccagcucuauguuuuagagcucuagaaauuucuugaagauuuuagaagaaaccucaugacaauucuagggaaaguaaagagggcuggaugagauggcuguguucaaugucaacauuugggaagagggacucuuuuuaacugagaaaaugucccucuccaccugcagacaagucuguagagcauuucuguaauuagugauuuauggagaggucccugcccauugugugugccauugccucugggcaggugguccuagguucuacaagaaagguaggcucauggcuuuaaucacagcacuugggaggcaaaagcaggcagauaucugaguucaaaaggggggagggaaggaaguaggcuaagugggccacaaggagcaagucagcaagcagcacccuucuauggccucugaguccacuuccugcccugaguuccuauuccgacuucccuuuccugauagacuguaaugugcaaguauaagaugaaauuaacccuuuacucguugcuuuuggccauagcauuuuaccacagcaauagaaaccguaacaaagacaguagcuagcuuauuuuuaauaaaguucuacuaaggaaagggaauaacuuuauguuauucccuucacugggcauccacauuucaauaaauaaugaucauaaaagggauugcaaaaauaucuuggagguggcagaguuggcuaaaggcaucaacagauuuugggccucacacugggcuuuaucaccagccagcuguaugccaggcaagcuucaaauguauugggagcgugagauaaugccaggaaagaagauuacaccugcucuacagggagauggcuggaaaggaagcucaagucccaaacagaaucacaaagaauaagggagccagcagaccauaacauucugggcagugucuucacauacaaaauaguaaguguuggcagcuaccaguuaaaaacuuaacucucccuuuuagagacuugaacuugcaguggucuuccugccucugccucguaaguguugggaauacaggugucagcacugugcugaguuuuaaaauuaucuauuaaaaacuaagucaaacccagggccucaucccugccagacaaguguucuacuauggggcugugcuuccagcccaaccuuuuagcuucccucuaauuccaguaaagaaggaagucauuccaccugcaggaaaacgaugcagcugcaggggucacauuaaauuaaucaccuaagucucagaaggacaauacuauauguuuucucaagugcagcuucuagauuucauauaugcauauaaaaucacauauggauauaugccacgaauguagacaggaaguuuaggggaacaaagggaacugauggagggccagacaggaaagggaacacagcagaggauggagggggacauguccucaguacagcacacguguguaccaggaggaaagacugaacacaacacaacaguuuuuccauguuagggauucaccuaggaccuuccuuacgccaggcaguaucugcugccaugcuaucccaaguccagcucuuuauuuugcuucuaauuccaguucuuccuuggaauacugucuggaggccaaagaggcagaggcagaggcagagacagggaagauggcuuuggaauggugugaacauaucauguaucauuuccaaccucuuugccucacaggggcccagagucucggccacugucaauguucacacaagcauaccuuggggccuucucggcgaauugguucacaggauuuuuguuuccaucugcucagaaggaaaaaagacaggugaguucuccaagugaucgggggagggacugagcuuggagauuuacuggagacacuggagacacaguucacaacuaucugcaacucuagugucagggcauccaacacacggacauacauucaggcaaaccaccaauguccauaaaaauacaacccuaauuuaaaaacaaaauacaaagaaaaaaaaaaaaggccuggagcagaaacucccuuagaaccuagcaaugggcaaguccaggaauguccaguugcagcuuucucaucugccagaaggagauaaggccagcagcugcccugcccaccuuguguucaugagggaugaaaaugccuggucuacucugugaguuucaggucaaaaauaguuuagaguaagacccugucuccaagacaggacaaaaaggcuucaggaaggaugcuguaacuugauacagaucagacucacaacgccaggaaugaagcccacagcagcccacagguccagugauggccuuaagcugaggcagucaucaacuguaacaaaugugucauucuagugucagguguugcuaaugagugcacauagaugggguagggcugcaucucuguauccucuacucagucugugauguaucuaaagccauucuauaacuauaacuuaaaagagcuccuugaaaacaaccauccuguagucucuaaagugcuuuuaaugacuguaagaucaguguuuuguuuugugacagugucucauguaguccagacuggccuuccagucacucgcgucacuauguagcugaggauaaccaauaacuccugaucauccugaccucgccuccuaagcacagagaucucaggugccugcugcuguacccuaauagggcagguaauucugacucuguuuuuuugaaaucugcuaacuguuguguucuuuagaguaguuguaggcuuguacuuagaccagcucugaacacucaaacauggaucagggcugcugguuaaucaagcuggaacucugcuggguuuuauaaaggcaggaugaagcaacugcaucucauggccccuucacuacccuacaucagggauccucucccacaguagcuuacaccaguggacccgaguucaccugccucuuucuucccacucacgccccccaggcccccucagcucuuacagcacugguaaccccuacucacaccaugccagcagcugcgcggucauuugacaggacguguccaggaggccgaccuuuccucugcacagagaagagcugucagagcccuggccugugguagcaucccuggucuagucuguuggggccgggucaguuaguggagacaguuguucagagagaacaaaugaucuugggagugccccggagagcaacugucgucgugucguucccccccccccccccccccggcaaugccuggaaaagcccaaaggucuuccuuuggaacaggagggcccuuucccagcugguguccaauaaggaccuacuugcuuauuacuugcuuaccuuuuugggaauggggcuuccucggugggacuccucuucugcuugccggccccgcugcaggaacagggagagagucagugaagcugcaguuuuagaggcugcaggaaacagggacccuggacccaagccucuggccaccacccgacccaggucucacaagucuugaguggugccuuuuggcuggcucuaggaugcugcugugucauuccccggguccacauauuuuaccuaccucccacuugacuccccuccuaugggcccagggcauugauucucaccuugaucccuggaagcucaugggccaaucuggguaucacuuucucuccaucagaaaagagcagcuuugccugaaagggagagaccagcgcugccagucaguagcuggguggggaagggcagcaguuuguaaacacaacuucagaauggguuggcuuuccuggaagacacucacauuuauguucagagaugaacaagccagagaaauaucagcccauauauucauuuauaaaaaguagcuaugaaagaaagagaaggagcuagugaggcaccaaaggcuggacugugcucgguguguauaaggcucugaaccugguucgaagcacaauagccagcucacauuaauccccacuaacccacaagggcugcugcauguucaugggacucuagggaaaaaaaaagguguguguggaguguguguggaagucaaaccuguccgcugucuuucccauguguugucaggcaagcaccuuuaauuacugagccaucuugccagccuguguuuugagaaagggucuuuccaugaagccaagcucagcuaggacuugcuagguagccaugcuggcaucuaacuuaaaacugcuaugccucaggcuggagagauggcucagagguuaaaagcacugacugcucuuccaacgguccugaguuugauucucagcaaccacaugguggcucauaaccaucuauaaugggaucugaugcccucuucugguguaucugaagacagcuacaguguacacauauaaauaaaaucuuuaaaaaacaaaacaaaagaaaacaaaaggacaggaucuuauccuguagcacaggcuggucuagacuucacuaugucuucaccaggcuggccucaaucucacagagauccucuugucucuguuucacgagcccugggacuacauguauaugcuaccacaccugguauucaaguguagguuuugugaggaagaauccuuccugauauuuaugaauggaacugcaauguaguuaacaucuuauaugucuguguugcccaugcugggcuaaguuuaaacacacucuuccauccaaggcccccagcaaagcacuggugguagggaguggcucuauucccaucuucagagaugagaacacugaagcuuagaaccuacaggaacuugcucugggcuuuagcucacucugcucugaugccaaguucugcacccaggcuucucagcaguucagccacauagcaugcauggggaucaggagaacagaagcagggggcaaugagcgcaggccaugccuacuuaacuuucuaagagaauuauuacuagcguguuuguggauguggcauacaugcuuccacacacacgagggagucagaggcggacuuuaugggguugguuuacuccccuuuagguggguuuggggguuaaaccucagguugucaggcuuuucugacaagcacuuugcccacugagccaucccuccugacccuucuuuaucuuuacaucuuaucugaacuccucaagagucuccuaaauucuuuuccaaucuaauguuccugaagcagccagagcaaugucucuguuaucuuuuguauuguuggggauggaccucaggcugccuggcugcugagcucuacuccaguugagaagaaucuugcuaaaaugcaaaugauguuaggccucacccacaucauccacugggccugugagcacugccuauagcagccauguauguacuaagccuuuacccuguggaacuaguaacacucuccucacccauuccuaagacacaggcacugcuucuuccccuggacgcuucaucuucuagcaagcuuucuuacuggacaacuaucugucgaguacugucaagagagggggcugggcucacagugcauauugcuggggccugauacuaagaagcacauaguaggcccccaauaaauaacaaguguuauuuaaauaacacuuaaguaauaauaaguagaaagauagggaccagugagcuagcucaggagguaaaugcauuugcggcuugaugaucugagugaguuccgugcucaggaacuacuugguggaaggaagaacuucagacagcugucuucugacuuuuuacacuugccauggaccauuugcacaaacacccugaggagagggauuugagaugcaggugaaugaagaccuuuuuaauuuacccugcuucagaucaacauuaugagagcacuauuagcaaaugucuguugcuagcaacuguuagaauuguucaucuaugugcuccuuccuggaggaaagaauccggccucuuaggaagucuccaagaagcaggucaguuuccaguguucugcaggguggagcuguggcucccagagcuggaguucaggcagugccuuugcuccuuccugaggcucuucacagucaagcaaggcauaguuaacaaaaucacacucaagcaaggagccugcuggaugccgacagucucuauuaauagcacagcugacacaggcaaacagguucucuagugucugagauagucauuuauagaacugaugucaacucuccugaccacaccugagauguaggaggacaaaaagggugccaggccccaugacccccaaagagucuaugacaacuuaaaggggauucacuaaccacuuguagagaugaggcacaucuuaaacuacaauuuguucuccuaguuugccuuuuuaaaaagugacagaauuguauuuauuuauugacugcauguguauguguguggacacucauauaaaggucagaggacagcuugugggaguggguucuggguaauuaaacucaggccauuugguuuggcagcaaacaucuaauuggcccuuguuuguucuagcuuuaguguggcaaaacugacaaacagauauuacauacaagaggggguacaauguguugguuuauaucaucacaauacgguguuagcacuguguuuaugcacauguguguacaauuuagaaguacugucacuauucuguguacgagaccccagacugaauccaccuucuaacugcaggcuucugcagcuuccagcuaacuaccauuuccuucuguuucugucaguuugcuaagcaguuucuucauuggucaaacaggggugaacauacgcgaccugugugguuccuggcgcauauuuauguuacuucucuuccugcuuugucagcagcugcccugagcucaacccggauguaaguggcuuccugaugucccccaaguaccacuaauga

SEQ ID NO: 1261 - RNA, 8927 nt, Mus musculus
caauucaaacgcgggcggcggcccgcagccccgcaguugcccuuuccucuccacacuccugucucggugccaguaccucugggauggccucacaaaaccgcgacccagcugcugccagcguugccgcgguucgaaaaggagccgagcccugcgggggcgccgcccgaggcccugugggcaagcggugaguggugcggaggucaccccggggcuuugggacaaaugaggggguaccaggaacgcaggaaauggaaggcugauggcgcugccaggcagcucucauagguugcccugcgagcgcugggguuaacauggggucgaaggcucaccuggguccucuaauugagugccagagcugaaccugccuuugaagaagggguaaggccuccacgacaggauagucgugugggaagugauauauuuccucgacaguauccauugccccgaguaaccccgacuucuccuugcaggcuacagcaggaacugaugauccucaugguaaguguguucuaagaucaauugaccuaccuucccaucccccaccccguuauccguaacuuccuuuacuacuucaggccaccugcuaguaugggugcaauguacucacuuauggaagcccuuugaacgcccaccgucacgagcuccgcagcugucgggcuuaucugggcucaucgaugcuuaccuuuucaggccccagcucuaaccuugcccagccccacccuucuuggaauugcuggucccaucaccuucgaauucucuccucuggucguccuuugcuacauuaccccuaaauagcaaucugcauguuuuagugacacuuaaauuccuggugaaaaccagauuuuggagggaaacuuuggaagcacgggaggugccuccuguugccuccuagccuggcgaucagccugagaguuggcucuaacugcuuuauucagaggcagaguaugcugcgggcagugcaggcucucacccagugauugacccggucaaucaacagguucagucaacagggucugcaagagagagaguggagauggaggggcaagagaugcaaagaauggggacaagacaguuucaagucucauuuauuggaaggcaacuauagguguauaagcacaggcuggggagugcagcuggagacacuuagccaguccaggauguguuugggaaaaacaggaugauauuagaguguguucagcuguggugagcuucuugcaaaagcagcauugucucucgucaggguggaaaaguaccaaccuguaaguaaauagccugagauggcugcagagaugauagccgcuuucugcuaagagugggcucccaacaagugaccccuuuggcugugccugaaaguguacacuggaacccagcaguugaguguuguuuccuuccucagacaucuggugacaaaggaaucuccgccuucccugagucagacaaccuguucaaguggguggggaccauccacggagcagccggcaccguaagugggcagcacuuugccugggcacaggcucugagcccuguggccauguucuuuuaguaugagagggacucuucaggcagugccgucuauagaccacgauaaaguaggguagaggaccuuagcuugagggagggcacaaacagcuuccuguuaaugcagauaugguuuuaaaucaucagaaauugagucuaaagucucacuuuagcaauugagauacuauucggaccacucugguagcccucggaaugccgggucacaaucuuuggaccggaaggucacugacaucacuagaagaaagcaccauuggccaacuuaacgucuagcuugcuagucagaugcagaagcacacagaaguuccuaccugcauggcccuuauuuggggcuuggauggaaugugggcugcaggaugggauggcggcagugcacaaggugagcgggggacuuacucuccauucuuuccccaaaugccagguauaugaagaccugagguacaaacucucccuagaguuccccagcggcuacccuuacaacgcacccacagugaaguuccucacacccugcuaccaccccaacguggacacccagggcaacaucugccuggacauccucaaggauaaguggucugcacuauaugaugucaggacuaucuugcucucuauccagagccugcuaggagguaacuucugagacgccaccaccaccaucccuacacacccugggcguuugccagggagccccugaaugagccucuuaaucccucugacuguucugacucuguccacagaacccaacaucgauagcccuuugaacacacacgcugcggaacucuggaaaaaccccacagguaggaccuuguccagcucagggugauccuugccagcauucagagagacccugagggccggguuggcuucucccacauccguccugcuagugcuuccauucucacauagauagaugaaggggucuaugaauagaauauaucuccugauccuucccuggacucuggaaaccaccagacggcaacauggguaucugcuggacagggagaaugggcccugccgccccuucccccacgccccaauccaucacucacucgagccccauuuguucucuuccagcauuuaagaaauaccugcaagaaaccuauucaaagcaggucuccagccaagaucccugaugcaagcuggccgcccugccccucuuuuguguugucuuuuuucuuagacuaucuguccuuucuccuugauuucuaaacuauguuauuuuuguuuuguuucguuuuuaaauuaagucugcuugacuagccgggcgugguggcgcucgccuuuaaucccagcacucgggaggcagaggcaggcggauuucugaguucaaggccaaccuggucuacaaaguaagcuccaggacagccagggcuauacagagaaacccugucucgaaaaacaaaaaauaaauaaauuaagucugcuugaacccuuaacaauguauauuaaauaaauacacauugauuguuuuguauaaauuguuuucucaaguuacccucagccagaggaugcaggggggggguagcuuaaaucuguguucuggcccauugucuacaguguugguuggaagcagcugauugacagugggagucacauacuguguauuugccuagagguauagcucccuggcagagagccuguuugauccgagugagguaccagauucaaucccagcaccaaaacugguguccacuuguaaggaguuagagcaugcgcuaggaacacacagugaccaucggggacaguuccaguugggauacagaugcgacuaaaccagacccuaagcucaagaaucuauagaagugccagacacucacuuucauguuaaagaucugggggguggggggccugacuccgguugcccuguagcaggcccaagcucuggaggauagaaagguuggcucuggacccgggugggugauuucaucuccuacuccaucuccacgaggucuuaugggcccugcccaaguugucagcucauugagcaguugugcagcccugugggaagagggaggggaagcaaagggccuggccugaccugucuggaaguuucugggcagccccuguuaacuacuguuagcuccuacucuuccuaggcgacuucuagcagccaugaguaaaaaaaugaguugucagcucagaaguuagugguggucuuaguuuucccuugggcauagagcuuuauaguccaucuuaaugugggcaaacccauuuaggaucuuguuaaacuacgauuucugcuaggaggaguggcagaagaguuguguuuccggugaucuccagguuacuuucacugcucuaguuaacauacguguuguuccgcaaaggcugggcuuuaguuggaagagcugucgccugucauucaugagacccuguauucaguccuuagaaccacaggaaccuaggguaugacuguccucaccgcgcuccaagagguacaggcagagaguucaagaucgucuuuaagguccuaguuugaggccagccugagcuauacccuaucuagggaagguaaaucgagccgggugcugguagugacuuauuuaauuccagcacuuggaaguagaggcaggaggacagcuaaaaguucaaggccagccuggucuacauagauccuuaguauuauauuaucgaggcucuaucucagaggucuaaauucaacaggguggaacaagccuguaauucuagcaaaggaaaagggcguaguccuugaagcagcccgggcaccacccagaacugauuagaacagagggugccugagaacaggcgugcucugaaacuggaacuaaacauauuccggauaaauacugaagcagugggguaguguuugugucugucuugggaggcuguaacaugugguccucaaggauggccuuuaguccucuguggucaaccaaccuacccaguuccaaggacucaguuguaacuaguuaaaagccaaauaaggaccuggguggaucuauaguaucuauccugaugagcugagcuccaucaagucagaacauucucugaccucccuaugugcacuguagcauaaacacacaccaccaccaucauacacauaacauccaagguuucuacauaugugcacuguagcaugcauaaacacacaccaccaccaucauacacauaacauccaagguuucuacauaugugcacuguagcaugcauaaacacacaccaccaccaucauacacauaacauccaagguuucuacauaugugcacuguagcaugcauaaacacacaccaccaccacccucauucacauaacauccaagguuucuccauaugugcacuguagcaugcauaaacacacaccaccaccaucauacacauaacauccaagguuucuacauaugugcacuguagcaugcauaaacacacaccaccaccacccucauacacauaacauccaagguuucuccauaugugcacuguagcaugcauaaacauacaccaccaccauuauacacauaacacacacgaccaccaucauacacauaacauccaagguuucuacauaugugcacuguagcaugcauaaacacacaccaccaccaucauacacauaacauccaaguuuucuacacagaaugcaaauguuuacuagugggauugccgaaagagaugcuccagagauggagcaaaggagcagguacuguagcagacaccuguaaucccaucauucagcagacugaggcaggaggauugagaguuggagcccagcuugggcuacagagugagaucuucucuuaauacguguagggacucaguguaagaugcuguagagcaagcacugcagugggaggaaagggggguguuuccggggguacaagcauuccggggaagagcacuuccucggggcucgcagccacaucaaaaugcuuagguggcuggaagaguccaggggcaaaaugccuguuacugagaaucuaguucaguccccaggacugcagagaggagugggucgggcagcagauuaagacucaucuugaagguaacagaggcuaaagaauccuugggcacagcagcggcaugagagguguagaacgaacggauccucuuggcuguaguuuagagcaggggagacauuaccuguuauaagaaccaggcaagcaauggcuugaguuauaaggcugacagcacauaguaggcccuuggugauuucuagaccccagcaccaggcugggcugaagacagaagcugugaaguauaugaugaaggaggaagaggugcuguaccaugcuugcccgcaagccagauugaguucaaucccaguccccacaaagugcaaagggaaaauggcccccagaaguuguccucuagcuucuaccuggggguacaccauggguacacaccagcaaacacauguaacagacaugucauuuucaaguaguuuuaaguugaggggcaagagagagaauucagagguuaaggacacuuguugcucuugcaagaggaccuggguuugguucccaaucacccauuugauggcucauaacaucuuuaacuccaguuccagaggauucaaugccauuguccggcuuccucgggcaccagguaaaacauuuacacaccuaaauaaaucuaaaaagagguuuugguuuuuuuuaauguuuauguggggggaagaggacaggacagggauggaaggggugggcuaaaguaugaaugaaguaagaaaauuccaaguuucaagaaugauggcagacuggguguauuaauuaauuaaauaauuaaucccagcacccaggaggcagagguugguaaguuuaaggccagccuggucuacauagugaguuccaaaguagccagggcugcauaaagugauccugucuuuaaaaaaauaaaaaagggaaugugacucagcggccgagcauuugccuagcauuccuuuguugguuccaucuuccagagccaaguaagugccagcauuuauuaaaugacagucgcuauauggcggugcuaagcacuuuacacacaagucuucucggaguccugcccuccacuaaauauuccauaccuucguuuuacagauguggaaacugaggcacagagagguugaaguugucauaggccaugaggauucaaacccaaacaaccugacuccgaggcuaaaguacuacacucauuuagggaggacucgaaucuaccagguccacccuaccucaggauaacuuucauuuagcuagaucaugccccuuggcccucuggagcacaauggaaggaugcugaaggaggggagauggggacaggggcaggaaucaugcuccuucccagcuuugggccuggaacgcugcauccuacuuguguguaaagugcauccauuugggauggauggacaaacucuccucggcagggcggccugcagagggugaacguaccacacccaagauccaagagguuccagaaaugguggggggaaagaagcguugccucuuaccugguuccagcuuccgcacacccuuacccuauccgucccagguaacaggcggccggcucaccuugggaccucccucuuccagcgccaagcgcaaggguggaccauuuguccaguugcccacugcuagcuccagcugcugguagccggcugcgaaccugcgagcuccgcccagcucucugccgcccaagccuccggcucgcguggccccuccuucuuuucauacccagcugcucugugccaggcagucccuaagaucccuugcccucaaucagucggucaagccagcuuuacauugucaacuuuuauuccuuccagucacagagcccaaaggagcagccuuucccgugugaggcagggaaagcaaagguggagcugcccacgcccaggggaccugcagucuggauggacacgaacaaagaccgucuccuuacugaacgcccuccaucaucuucagaaacucugcgaagaagagggacuaggucaggcguaccguucagggcacagcgggugccuacucguuaccgucaauagaaugagaaggaauuuagucuauucccagccccacccacaaagccaagagcaccagcuggcccucaccaucaaagucaaugcggccgucguuguuuuuaucaccauccuucaucagggauucgaucuccucuucugucacaugcuccccagaagcccggaaaaucucagcuagcuccucagcaucaauguagccgucugcguuccuuugggagggaaggacagagaaggacacagggucaaccucacccuggccagccugcuucuucacuucaggcccacgggcuccaucugcucucagguccaggaucccggaagccccacgcaccugucaaagaugcggaagcacucagccaguuccucuucgcucuuccccuucgcauccucuuucaucuggcgcaccaucaugaccaagaacucuucaaagucgauaguaccgcugccugcaaggaucgggguuggcagauguggggccugcuuagcccaaggugcccugugccucucuccucccgguccccugcccuggaggagcccaacucaccauccucguccaccuccucgaugauggcauccaauuccucuuuggugggugucugcccuagcauccucaucacggugcccaacucuuuaacgcugauguccccaccgccaucagcaucgaacaugucaaaggcagccuugaacucuagcggggagacaggaggagcgaugggugaggccaguuggauugucagccucacaccgcaucucucccaauggcuagcucuacucaccagcgaucaucuccucgcugagguaggaccuggccucagccuguugguccgucuguagaaagcagagagaaucagagcguagaagggcagacucucaccccagcuucagccucccuagcccccucuuguauuaggaagagccccuggguccuccagaaccacuccaaaccagcaguaccucccagguacccguuggugcccauccccagugccaaagggacacagguuauacccacaguuucuucagagaguagucggggaacccccaccccaacagugaccuuuggcaagucacucuuccuaugacuuuguagagauaauaagaaaucaggauugagagagggcuugaguguguuagugccauucacuggugaucuuuuaguuucccugucuccuauugcugccugggacuugaccaguuggucaaugaauauuuguccucaacuaaauaacggaaugcaaaagucacagaacaucugccaagcgcuuggacgcugagaccacaagaagagaugggcagcuuugccucagacaguucucagaggcaagacuucccacucggucaucggcguaaacaccucucuugaugucaaaugugacggagccuugcccuggugugaaaauaaaaacccuuuguuccauuucaac

SEQ ID NO: 1262 - RNA, 8927 nt, Mus musculus
guugaaauggaacaaaggguuuuuauuuucacaccagggcaaggcuccgucacauuugacaucaagagagguguuuacgccgaugaccgagugggaagucuugccucugagaacugucugaggcaaagcugcccaucucuucuuguggucucagcguccaagcgcuuggcagauguucugugacuuuugcauuccguuauuuaguugaggacaaauauucauugaccaacuggucaagucccaggcagcaauaggagacagggaaacuaaaagaucaccagugaauggcacuaacacacucaagcccucucucaauccugauuucuuauuaucucuacaaagucauaggaagagugacuugccaaaggucacuguugggguggggguuccccgacuacucucugaagaaacuguggguauaaccugugucccuuuggcacuggggaugggcaccaacggguaccugggagguacugcugguuuggagugguucuggaggacccaggggcucuuccuaauacaagagggggcuagggaggcugaagcuggggugagagucugcccuucuacgcucugauucucucugcuuucuacagacggaccaacaggcugaggccagguccuaccucagcgaggagaugaucgcuggugaguagagcuagccauugggagagaugcggugugaggcugacaauccaacuggccucacccaucgcuccuccugucuccccgcuagaguucaaggcugccuuugacauguucgaugcugauggcgguggggacaucagcguuaaagaguugggcaccgugaugaggaugcuagggcagacacccaccaaagaggaauuggaugccaucaucgaggagguggacgaggauggugaguugggcuccuccagggcaggggaccgggaggagagaggcacagggcaccuugggcuaagcaggccccacaucugccaaccccgauccuugcaggcagcgguacuaucgacuuugaagaguucuuggucaugauggugcgccagaugaaagaggaugcgaaggggaagagcgaagaggaacuggcugagugcuuccgcaucuuugacaggugcguggggcuuccgggauccuggaccugagagcagauggagcccgugggccugaagugaagaagcaggcuggccagggugagguugacccuguguccuucucuguccuucccucccaaaggaacgcagacggcuacauugaugcugaggagcuagcugagauuuuccgggcuucuggggagcaugugacagaagaggagaucgaaucccugaugaaggauggugauaaaaacaacgacggccgcauugacuuugauggugagggccagcuggugcucuuggcuuuguggguggggcugggaauagacuaaauuccuucucauucuauugacgguaacgaguaggcacccgcugugcccugaacgguacgccugaccuagucccucuucuucgcagaguuucugaagaugauggagggcguucaguaaggagacggucuuuguucguguccauccagacugcagguccccugggcgugggcagcuccaccuuugcuuucccugccucacacgggaaaggcugcuccuuugggcucugugacuggaaggaauaaaaguugacaauguaaagcuggcuugaccgacugauugagggcaagggaucuuagggacugccuggcacagagcagcuggguaugaaaagaaggaggggccacgcgagccggaggcuugggcggcagagagcugggcggagcucgcagguucgcagccggcuaccagcagcuggagcuagcagugggcaacuggacaaaugguccacccuugcgcuuggcgcuggaagagggaggucccaaggugagccggccgccuguuaccugggacggauaggguaagggugugcggaagcuggaaccagguaagaggcaacgcuucuuuccccccaccauuucuggaaccucuuggaucuugggugugguacguucacccucugcaggccgcccugccgaggagaguuuguccauccaucccaaauggaugcacuuuacacacaaguaggaugcagcguuccaggcccaaagcugggaaggagcaugauuccugccccuguccccaucuccccuccuucagcauccuuccauugugcuccagagggccaaggggcaugaucuagcuaaaugaaaguuauccugagguaggguggaccugguagauucgaguccucccuaaaugaguguaguacuuuagccucggagucagguuguuuggguuugaauccucauggccuaugacaacuucaaccucucugugccucaguuuccacaucuguaaaacgaagguauggaauauuuaguggagggcaggacuccgagaagacuuguguguaaagugcuuagcaccgccauauagcgacugucauuuaauaaaugcuggcacuuacuuggcucuggaagauggaaccaacaaaggaaugcuaggcaaaugcucggccgcugagucacauucccuuuuuuauuuuuuuaaagacaggaucacuuuaugcagcccuggcuacuuuggaacucacuauguagaccaggcuggccuuaaacuuaccaaccucugccuccugggugcugggauuaauuauuuaauuaauuaauacacccagucugccaucauucuugaaacuuggaauuuucuuacuucauucauacuuuagcccaccccuuccaucccuguccuguccucuuccccccacauaaacauuaaaaaaaaccaaaaccucuuuuuagauuuauuuagguguguaaauguuuuaccuggugcccgaggaagccggacaauggcauugaauccucuggaacuggaguuaaagauguuaugagccaucaaaugggugauugggaaccaaacccagguccucuugcaagagcaacaaguguccuuaaccucugaauucucucucuugccccucaacuuaaaacuacuugaaaaugacaugucuguuacauguguuugcugguguguacccaugguguacccccagguagaagcuagaggacaacuucugggggccauuuucccuuugcacuuuguggggacugggauugaacucaaucuggcuugcgggcaagcaugguacagcaccucuuccuccuucaucauauacuucacagcuucugucuucagcccagccuggugcuggggucuagaaaucaccaagggccuacuaugugcugucagccuuauaacucaagccauugcuugccugguucuuauaacagguaaugucuccccugcucuaaacuacagccaagaggauccguucguucuacaccucucaugccgcugcugugcccaaggauucuuuagccucuguuaccuucaagaugagucuuaaucugcugcccgacccacuccucucugcaguccuggggacugaacuagauucucaguaacaggcauuuugccccuggacucuuccagccaccuaagcauuuugauguggcugcgagccccgaggaagugcucuuccccggaaugcuuguacccccggaaacaccccccuuuccucccacugcagugcuugcucuacagcaucuuacacugagucccuacacguauuaagagaagaucucacucuguagcccaagcugggcuccaacucucaauccuccugccucagucugcugaaugaugggauuacaggugucugcuacaguaccugcuccuuugcuccaucucuggagcaucucuuucggcaaucccacuaguaaacauuugcauucuguguagaaaacuuggauguuauguguaugaugguggugguguguguuuaugcaugcuacagugcacauauguagaaaccuuggauguuauguguaugaugguggucguguguguuauguguauaaugguggugguguauguuuaugcaugcuacagugcacauauggagaaaccuuggauguuauguguaugagggugguggugguguguguuuaugcaugcuacagugcacauauguagaaaccuuggauguuauguguaugaugguggugguguguguuuaugcaugcuacagugcacauauggagaaaccuuggauguuaugugaaugagggugguggugguguguguuuaugcaugcuacagugcacauauguagaaaccuuggauguuauguguaugaugguggugguguguguuuaugcaugcuacagugcacauauguagaaaccuuggauguuauguguaugaugguggugguguguguuuaugcaugcuacagugcacauauguagaaaccuuggauguuauguguaugaugguggugguguguguuuaugcuacagugcacauagggaggucagagaauguucugacuugauggagcucagcucaucaggauagauacuauagauccacccagguccuuauuuggcuuuuaacuaguuacaacugaguccuuggaacuggguagguugguugaccacagaggacuaaaggccauccuugaggaccacauguuacagccucccaagacagacacaaacacuaccccacugcuucaguauuuauccggaauauguuuaguuccaguuucagagcacgccuguucucaggcacccucuguucuaaucaguucuggguggugcccgggcugcuucaaggacuacgcccuuuuccuuugcuagaauuacaggcuuguuccacccuguugaauuuagaccucugagauagagccucgauaauauaauacuaaggaucuauguagaccaggcuggccuugaacuuuuagcuguccuccugccucuacuuccaagugcuggaauuaaauaagucacuaccagcacccggcucgauuuaccuucccuagauaggguauagcucaggcuggccucaaacuaggaccuuaaagacgaucuugaacucucugccuguaccucuuggagcgcggugaggacagucauacccuagguuccugugguucuaaggacugaauacagggucucaugaaugacaggcgacagcucuuccaacuaaagcccagccuuugcggaacaacacguauguuaacuagagcagugaaaguaaccuggagaucaccggaaacacaacucuucugccacuccuccuagcagaaaucguaguuuaacaagauccuaaauggguuugcccacauuaagauggacuauaaagcucuaugcccaagggaaaacuaagaccaccacuaacuucugagcugacaacucauuuuuuuacucauggcugcuagaagucgccuaggaagaguaggagcuaacaguaguuaacaggggcugcccagaaacuuccagacaggucaggccaggcccuuugcuuccccucccucuucccacagggcugcacaacugcucaaugagcugacaacuugggcagggcccauaagaccucguggagauggaguaggagaugaaaucacccacccggguccagagccaaccuuucuauccuccagagcuugggccugcuacagggcaaccggagucaggccccccaccccccagaucuuuaacaugaaagugagugucuggcacuucuauagauucuugagcuuagggucugguuuagucgcaucuguaucccaacuggaacuguccccgauggucacuguguguuccuagcgcaugcucuaacuccuuacaaguggacaccaguuuuggugcugggauugaaucugguaccucacucggaucaaacaggcucucugccagggagcuauaccucuaggcaaauacacaguaugugacucccacugucaaucagcugcuuccaaccaacacuguagacaaugggccagaacacagauuuaagcuacccccccccugcauccucuggcugaggguaacuugagaaaacaauuuauacaaaacaaucaauguguauuuauuuaauauacauuguuaaggguucaagcagacuuaauuuauuuauuuuuuguuuuucgagacaggguuucucuguauagcccuggcuguccuggagcuuacuuuguagaccagguuggccuugaacucagaaauccgccugccucugccucccgagugcugggauuaaaggcgagcgccaccacgcccggcuagucaagcagacuuaauuuaaaaacgaaacaaaacaaaaauaacauaguuuagaaaucaaggagaaaggacagauagucuaagaaaaaagacaacacaaaagaggggcagggcggccagcuugcaucagggaucuuggcuggagaccugcuuugaauagguuucuugcagguauuucuuaaaugcuggaagagaacaaauggggcucgagugagugauggauuggggcgugggggaaggggcggcagggcccauucucccuguccagcagauacccauguugccgucuggugguuuccagaguccagggaaggaucaggagauauauucuauucauagaccccuucaucuaucuaugugagaauggaagcacuagcaggacggaugugggagaagccaacccggcccucagggucucucugaaugcuggcaaggaucacccugagcuggacaagguccuaccugugggguuuuuccagaguuccgcagcguguguguucaaagggcuaucgauguuggguucuguggacagagucagaacagucagagggauuaagaggcucauucaggggcucccuggcaaacgcccaggguguguagggaugguggugguggcgucucagaaguuaccuccuagcaggcucuggauagagagcaagauaguccugacaucauauagugcagaccacuuauccuugaggauguccaggcagauguugcccuggguguccacguuggggugguagcagggugugaggaacuucacugugggugcguuguaaggguagccgcuggggaacucuagggagaguuuguaccucaggucuucauauaccuggcauuuggggaaagaauggagaguaagucccccgcucaccuugugcacugccgccaucccauccugcagcccacauuccauccaagccccaaauaagggccaugcagguaggaacuucugugugcuucugcaucugacuagcaagcuagacguuaaguuggccaauggugcuuucuucuagugaugucagugaccuuccgguccaaagauugugacccggcauuccgagggcuaccagagugguccgaauaguaucucaauugcuaaagugagacuuuagacucaauuucugaugauuuaaaaccauaucugcauuaacaggaagcuguuugugcccucccucaagcuaagguccucuacccuacuuuaucguggucuauagacggcacugccugaagagucccucucauacuaaaagaacauggccacagggcucagagccugugcccaggcaaagugcugcccacuuacggugccggcugcuccguggaugguccccacccacuugaacagguugucugacucagggaaggcggagauuccuuugucaccagaugucugaggaaggaaacaacacucaacugcuggguuccaguguacacuuucaggcacagccaaaggggucacuuguugggagcccacucuuagcagaaagcggcuaucaucucugcagccaucucaggcuauuuacuuacagguugguacuuuuccacccugacgagagacaaugcugcuuuugcaagaagcucaccacagcugaacacacucuaauaucauccuguuuuucccaaacacauccuggacuggcuaagugucuccagcugcacuccccagccugugcuuauacaccuauaguugccuuccaauaaaugagacuugaaacugucuuguccccauucuuugcaucucuugccccuccaucuccacucucucucuugcagacccuguugacugaaccuguugauugaccgggucaaucacugggugagagccugcacugcccgcagcauacucugccucugaauaaagcaguuagagccaacucucaggcugaucgccaggcuaggaggcaacaggaggcaccucccgugcuuccaaaguuucccuccaaaaucugguuuucaccaggaauuuaagugucacuaaaacaugcagauugcuauuuagggguaauguagcaaaggacgaccagaggagagaauucgaaggugaugggaccagcaauuccaagaaggguggggcugggcaagguuagagcuggggccugaaaagguaagcaucgaugagcccagauaagcccgacagcugcggagcucgugacggugggcguucaaagggcuuccauaagugaguacauugcacccauacuagcagguggccugaaguaguaaaggaaguuacggauaacggggugggggaugggaagguaggucaauugaucuuagaacacacuuaccaugaggaucaucaguuccugcuguagccugcaaggagaagucgggguuacucggggcaauggauacugucgaggaaauauaucacuucccacacgacuauccugucguggaggccuuaccccuucuucaaaggcagguucagcucuggcacucaauuagaggacccaggugagccuucgaccccauguuaaccccagcgcucgcagggcaaccuaugagagcugccuggcagcgccaucagccuuccauuuccugcguuccugguacccccucauuugucccaaagccccggggugaccuccgcaccacucaccgcuugcccacagggccucgggcggcgcccccgcagggcucggcuccuuuucgaaccgcggcaacgcuggcagcagcugggucgcgguuuugugaggccaucccagagguacuggcaccgagacaggaguguggagaggaaagggcaacugcggggcugcgggccgccgcccgcguuugaauug

SEQ ID NO: 1263 - RNA, 2587 nt, Mus musculus
ccagcuuuacauugucaacuuuuauuccuuccagucacagagcccaaaggagcagccuuucccgugugaggcagggaaagcaaagguggagcugcccacgcccaggggaccugcagucuggauggacacgaacaaagaccgucuccuuacugaacgcccuccaucaucuucagaaacucugcgaagaagagggacuaggucaggcguaccguucagggcacagcgggugccuacucguuaccgucaauagaaugagaaggaauuuagucuauucccagccccacccacaaagccaagagcaccagcuggcccucaccaucaaagucaaugcggccgucguuguuuuuaucaccauccuucaucagggauucgaucuccucuucugucacaugcuccccagaagcccggaaaaucucagcuagcuccucagcaucaauguagccgucugcguuccuuugggagggaaggacagagaaggacacagggucaaccucacccuggccagccugcuucuucacuucaggcccacgggcuccaucugcucucagguccaggaucccggaagccccacgcaccugucaaagaugcggaagcacucagccaguuccucuucgcucuuccccuucgcauccucuuucaucuggcgcaccaucaugaccaagaacucuucaaagucgauaguaccgcugccugcaaggaucgggguuggcagauguggggccugcuuagcccaaggugcccugugccucucuccucccgguccccugcccuggaggagcccaacucaccauccucguccaccuccucgaugauggcauccaauuccucuuuggugggugucugcccuagcauccucaucacggugcccaacucuuuaacgcugauguccccaccgccaucagcaucgaacaugucaaaggcagccuugaacucuagcggggagacaggaggagcgaugggugaggccaguuggauugucagccucacaccgcaucucucccaauggcuagcucuacucaccagcgaucaucuccucgcugagguaggaccuggccucagccuguugguccgucuguagaaagcagagagaaucagagcguagaagggcagacucucaccccagcuucagccucccuagcccccucuuguauuaggaagagccccuggguccuccagaaccacuccaaaccagcaguaccucccagguacccguuggugcccauccccagugccaaagggacacagguuauacccacaguuucuucagagaguagucggggaacccccaccccaacagugaccuuuggcaagucacucuuccuaugacuuuguagagauaauaagaaaucaggauugagagagggcuugaguguguuagugccauucacuggugaucuuuuaguuucccugucuccuauugcugccugggacuugaccaguuggucaaugaauauuuguccucaacuaaauaacggaaugcaaaagucacagaacaucugccaagcgcuuggacgcugagaccacaagaagagaugggcagcuuugccucagacaguucucagaggcaagacuucccacucggucaucggcguaaacaccucucuugaugucaaaugugacggagccuugcccuggugugaaaauaaaaacccuuuguuccauuucaacguucuggcuuugguguuuagagagucuugcuauguagcucacucggguuggccuggcaugccacaugugagcauguaaguaagauuucugugaauuucucugggacacauccaagccaggccaucugggucagggcuuuggacucgggauggugaagaaggggugacgagucccaagacauccuucagccagcuggcccaguuccuccuucccuccuccggcccuuggccugauccaggaggauaggcuauuuuuaguugggcaugggcaauggcagcuggucucuggaguccaauuacuucuucaagucaaguaggagggguacgcagaagaaaguggcagguccagaucagacccccucuguggcuggucagaggcucuaacgcuggccggguacccacccuacuaaccauccuccucaggauucuuagaggaagccuuccuucuugggucgccacaggcuuggcugagccuaugaagccuacucugugucugcccugcugggucacuuuucugcccucgugcucuccaucucuccguggaagcagacaggcuaagaccuuuccacacagcucuggcugcacaauagcacuguuccaaaccucaagguggccaggaacucauaaaccuugaagauuaauuccugaacuauccuggccagccuuccccacccaagagaagucauagccuuuauaggacaucuccucgggacuugaguucuggcaacccuuccaccuucagauguccauauuccugcccacagaacacacaguucuaggacagagaggggccuagaaguagccuggggacaaaagugugaagacccuucuuguccuuaccaugguugcuggcgacugggacuccuccgcuguggguugucuccuccgcacuccaccacccaaaggugccccagaucucu

SEQ ID NO: 1264 - RNA, 2587 nt, Mus musculus
agagaucuggggcaccuuugggugguggagugcggaggagacaacccacagcggaggagucccagucgccagcaaccaugguaaggacaagaagggucuucacacuuuuguccccaggcuacuucuaggccccucucuguccuagaacuguguguucugugggcaggaauauggacaucugaagguggaaggguugccagaacucaagucccgaggagauguccuauaaaggcuaugacuucucuuggguggggaaggcuggccaggauaguucaggaauuaaucuucaagguuuaugaguuccuggccaccuugagguuuggaacagugcuauugugcagccagagcuguguggaaaggucuuagccugucugcuuccacggagagauggagagcacgagggcagaaaagugacccagcagggcagacacagaguaggcuucauaggcucagccaagccuguggcgacccaagaaggaaggcuuccucuaagaauccugaggaggaugguuaguaggguggguacccggccagcguuagagccucugaccagccacagagggggucugaucuggaccugccacuuucuucugcguaccccuccuacuugacuugaagaaguaauuggacuccagagaccagcugccauugcccaugcccaacuaaaaauagccuauccuccuggaucaggccaagggccggaggagggaaggaggaacugggccagcuggcugaaggaugucuugggacucgucaccccuucuucaccaucccgaguccaaagcccugacccagauggccuggcuuggaugugucccagagaaauucacagaaaucuuacuuacaugcucacauguggcaugccaggccaacccgagugagcuacauagcaagacucucuaaacaccaaagccagaacguugaaauggaacaaaggguuuuuauuuucacaccagggcaaggcuccgucacauuugacaucaagagagguguuuacgccgaugaccgagugggaagucuugccucugagaacugucugaggcaaagcugcccaucucuucuuguggucucagcguccaagcgcuuggcagauguucugugacuuuugcauuccguuauuuaguugaggacaaauauucauugaccaacuggucaagucccaggcagcaauaggagacagggaaacuaaaagaucaccagugaauggcacuaacacacucaagcccucucucaauccugauuucuuauuaucucuacaaagucauaggaagagugacuugccaaaggucacuguugggguggggguuccccgacuacucucugaagaaacuguggguauaaccugugucccuuuggcacuggggaugggcaccaacggguaccugggagguacugcugguuuggagugguucuggaggacccaggggcucuuccuaauacaagagggggcuagggaggcugaagcuggggugagagucugcccuucuacgcucugauucucucugcuuucuacagacggaccaacaggcugaggccagguccuaccucagcgaggagaugaucgcuggugaguagagcuagccauugggagagaugcggugugaggcugacaauccaacuggccucacccaucgcuccuccugucuccccgcuagaguucaaggcugccuuugacauguucgaugcugauggcgguggggacaucagcguuaaagaguugggcaccgugaugaggaugcuagggcagacacccaccaaagaggaauuggaugccaucaucgaggagguggacgaggauggugaguugggcuccuccagggcaggggaccgggaggagagaggcacagggcaccuugggcuaagcaggccccacaucugccaaccccgauccuugcaggcagcgguacuaucgacuuugaagaguucuuggucaugauggugcgccagaugaaagaggaugcgaaggggaagagcgaagaggaacuggcugagugcuuccgcaucuuugacaggugcguggggcuuccgggauccuggaccugagagcagauggagcccgugggccugaagugaagaagcaggcuggccagggugagguugacccuguguccuucucuguccuucccucccaaaggaacgcagacggcuacauugaugcugaggagcuagcugagauuuuccgggcuucuggggagcaugugacagaagaggagaucgaaucccugaugaaggauggugauaaaaacaacgacggccgcauugacuuugauggugagggccagcuggugcucuuggcuuuguggguggggcugggaauagacuaaauuccuucucauucuauugacgguaacgaguaggcacccgcugugcccugaacgguacgccugaccuagucccucuucuucgcagaguuucugaagaugauggagggcguucaguaaggagacggucuuuguucguguccauccagacugcagguccccugggcgugggcagcuccaccuuugcuuucccugccucacacgggaaaggcugcuccuuugggcucugugacuggaaggaauaaaaguugacaauguaaagcugg

SEQ ID NO: 1265 - RNA, 17035 nt, Mus musculus
uucugucacugagcaaagucgccccuagguugcuguuaccggucuccuccuguucugggcuccucccaagcgcccuguaagccacucacucgggaccgcagcugggcccgugccagccguuacccagugaccucugaccccugccgugguucuagguucuaggagggccaguccccggccauggagcuaggcagcugcuuuaagaccuacgaggacuucaaggaguguuucagcgccuacaaaaaggagaccaggugcuccuucauugucagggacugcaucuccguccgcuuccauaaccucaacaacggcaccucuuuccgcgaggauauccuguaagggcggggcaggaggguggggaggagggcugccuggaggaggagggcgugcauggaggagccacguuccccgugccugcggaaaaacgagggaaaccucaccggcguggccuuugcuacccgccgcgcuugcucccacuccuucauucacgagcuuuccugggaauucgcaguaacugcaucuuguuguuuuuccguuuuauuuguuuguugagagaaucuaucucaagcgcaaggcugguugaggagugaauugaaacgccuuaguaauaauuuccuccauuagccuccucuuuacaaagcaguaauggugcucauugguugguugguugguucuuuucggugauugauuuuguaaaugauucuugagcuccagauacagccguuuucaaacaccuuccuuauccaagguggugcucccugagugccuuucuuacucugcagggcugugugucagaauuauuggugguagcucccugacucauuugacuuuaggggcuaaaagcugaugaaaacgccagggcuuuuaggguucaggugaaacagccuacuauaaauuuagcuuuuaguuuuucuuugaaagaaagaauaagggugcagguuuagaagcccaaugcgaaaagguugaggccggcgggucaugaguuugagacaaaucaguuugguuuaaaaaaaaaaauacagggaaaggggguuggugguggaagccuuuaaucccagcacucaggaggcagaggcaggcagaucucugugaguucgacgccagucuggucuacagagcagcuuccaggacagucagggcuacacagagaaaaccugucuugaaaaaccaaaguggggaguuggggggcgggagggagagacagagagaaaugggaagcagccccgccccuucguaaaaaggaagguuugugugcccagucuuuugcugugaaaucuaaucauaugaaucaauuugaaagucaauucaaguuuuaauuacaacauauaggccaacugagugucaaaauauaccaaaguuugagucagggauugagcucuuuggacaguacuuuccagacuauagagccuggcuguguucuggcuccauucugaaguccagggucacucuuggguacacauaaagaugaauaagugucccuaaggaguuacuuggacuuagaaacuaauauggaugaaaauaacaaauggggggcuggacugauagcucguggggaagaggacugaggcucacgcaugguggauuggcagcaccuguaacuccagaucuaggaauccuuuaagggcuccugcaagcacacagcacacguacauucucaggcccacacguaugcauugaaugucugucagguguggugguguaugccuuuaagucccagaacuuggaagacagaggcgggucugugccuguggguugaaggucagcguggccuaaguaaugaguuccagggcagcaaagacuccuaucucaaaaaaaaaaaguuaauauuauaaaggaaacuaaacgucuccugaaaauacacuuuuugauuguuuguuuuuuuacacaagcccucuuuauauagccugaguagcccccaacccauggggauucucuuaucucagacucccaagugcuggggaugacagacgugaaccgccaugucugacugagacauuuuccuuugucuuucuuucccuaccagcacagccaaacuauuuaccuaggauuuacaugcauugguuaguauaaccuagagaugauugaaaauguaugggaggcuauaugcaaacagcaucuguguuauguaagagguuugaacagcugcguguuggggaaucuggaaaccaugccucuaaggggcagaugccuucaaagagauguucaaaaggggggaugugguagcucuugcccuauaaucccagcacucaaaaggaugggacuugaaggcagccaacaauacauagugaacuccaaagcagcccagacuacagggugaaacccuucuccaaaaaccaaauagguaaaauauaaaagaauuauacagggcuggagagauggcucagugguuaagagaacugacugcucuuccagaguuccugaguucaaaucccagcaacuacccaucuguaaugaaaucugaugcccucuucuggugugucugaagacagcuacaguguacuuuaaauaaauaaauaaguggguuauacaaaggaaaaucaggcauggugguauacaccugagaucccagcacuagagagcuggugggucucucugacuucaaggccagccugucuacauagugaauuccagaccuaccagggcugaauagagagacccuguccccucucccccaagagagagauacaaaagaaauaaguaacaaauacuggagaugcauacaaggcuucccacugaaauagcuccuuuccccugggccuaugaaugaauagaggccagcaguaggagagcagugguugagcacugaguggcaggcauuugaugagacagacccaugggagugaagacacagaucugugaagaagauggcauccuguagcaacugggcugccgugcuuggcagaaggcgagggcaguugcaaucugucagaaaguccuucccacaacugaggcgccuggacuccgugcuuuguggugguaccuugcuaagcuaccccacaagcagguugucuagcacccagcauggcaguuguucgugguaggcauugauuguugaguaaaugaguugucaaggguuaaacaugauuuagggaaauggguacugcucuaaaaaaauaugaauuuaggccuuuauuuucaucuuuaagguuuuuuugguuuuuggguuuuuuuaaagauuuauuuucuuuuuaagauuuauuuauuuauuuacuauauguaaguccacuguagcuguccucagauacuccagaagagggcaucagauuucguuacugaugguugugagccaccaugugguugcugggauuugaacuugggaccuucggaagagcagucggcacucuuaaccacugagccaucccaccagccccaagauuuauuuauuuuauguuuaugaauacacuguugcugucuucagacacaccagaagagggcaucagaccccauuacagaugguugugagccaccaugugguugcugggaauuaaacuagggaccucuggaagagcagucagugcuccuaacuacugagucaucucuccauccucaucuuuaaguuuuaaagacucauuuuuauuuauauuucugucuaugaaggccagaagaggacauuggauccgauggagguggagucacgggcaguugaggaccaccauauguguacugggcacugaagucagguccccuggaagagcagcaaguguucuuaacugcagagccaucucuccagccccaagauaaauaggggcaagggaaguuguucaggcaagaaaaugucugccacacaagcacggggaacugaguucgaauccccaguucugcuuaaaggcugggcgcugucaugugcucuggguccccagugucgggugggcaaagacaggugguggauucccagaguucucugccuggcuaaccuagcuggaucugugagcuucaguugagugagaagcccugucucagaaaacauggcagaaaggcaggacauacugaugcacgccuuuaaucucagcaccacagaggcagaggcaggcagaucccuguuucagacagccugguuuacauauuaagcugcuacaaaccagcuaggcggcuaagauggggagucacagaggaagauacccaguguugaccugacaugcacuucacauguauacauguccuccugucccuaccucccaauccgcuccacucugaaagccugguuaccugaauugugauacuugggaagaugccaaagggaggccaggugagagaacugaaguaacaaugacagagaagagagaaguagcaagccaaagcacuagugacagaaaggagagcauuuaauugaggcugacuuacaauuuaaagguuuagcucauuauugucaugguaggaaacaugguaacauucaggcagacauggugauggagaaggagcagagaauucuacauuuugagccucaggcaacaggcugagaacugccacagaaagccuagcuuugagcaugugagaccuuaaagcccaccucugcggugacacacuuucuccagcaagaccacaccuacuccagcaaggccacaccuccuaauaccauucccuauagccaagcauuuaaacacaugagucuaugggagcccuuccuauucaagccaccacauauacuaaugaagaggugauuuuaauaagaacuucuccacuauauucacaugagcuuccuuacuaaacagaguaaacauggcagguugauuuaaagggcauccucugaggguuggagcaugucacagaagcuaagagcacuugcuguucuucaaguagacuuggguucaaugcccagucuguaacucuaguuccagggcaucuggugcccucuucugaccuccauaggcaccaggcaugccagcggugcacccauacaugcaaaauaauuuuaaaauuuuaugugaaacuaauaauacagagauuauauggauagcaauggcagguacacauacaggaaguuaggaauucaagaugaacaacaggcauaaggauuagggcaggcauaaggauuggagguugacagaucuggaaucagcuagccuuuguccaugaccuaggacaagaguucuaaccuccacagcaaaauuuuguccuuuaggaaaugaggagcugguucaguaguuaggagcccuugcugcucuugaaaggaaauucaacuauaguuuuuagcacccuugucagacagcucacaacugccuguuguccaacuccgggggaucugaugcccuuugcaggacucugagggcacuguacucagucaaauggacauauacagacaugcacauaacuaaagcuacaauuacuuaagucucuuugagauuuuauuuuuauuuuauauguauucguguuugccugaguguauuucuguguaccaugugcaggcagugcccacagcuuacgagagagugucaauuccacugguagguucaguugugagcuuccauguggaagcuaagaauugaaccugaguccucuggaagagcagcaaaugcucuuaacugcugagcuacugagccaucuuucuaguccuaaaaguaaaucuuacaaacauaaaagggaaaggaaaaggagguagaguggggaaauauagcugagaguuaggugcuuaucuguggagcauauggaaagcccuggguuugagccccagcacugggagaguuugaugagaagugagaugcauguagcauccgaaucagugacuguuugcugaagcuguaacuacaguggcccagagaaagugauagguaggaaagaaucucgcaggaccagcagcacagacuguaaacucagcacuugggaggcuaggacaagaauagugccaugaguuugagaccagccucagcaacauaaugaguucaaagagccugggcuacagguaguguccugucucaaaaaaaaaaaaaaaggaaggcgaugugagaaggcaaggaccguggcucagugguaaagcgaggaacuucuuugagcaagguccucgguuuaauaccagcaccacaaagagaaggggacaggaugguuucauuuaugaacuguggguggcagaacauuugccuggcgcucuuaagggacuagguuaaauacucagcaccacagaaaagaaaaacaagagagggagggagaggcagccugggaaagcagcccaguugacuagaaugcuugccuagcaugcacagaguuccggguucugucucuaguuccacaucaaccaagugugguguacacuccuauaaauccagcacucggaaggcuaacacagggaauuacugcaagugacaggcuagccugggcuacaguauaagacccagccucaaaaacacuagugaauacauauauaaaugaagucaauaugguacauauaaugguauauauguuugaauggcauauuguauuacacuauuuuguauaauaauuagaaauauaaaauaagccgggcgugguggcacacgccuuuaaucccagcacucaggaggcagaggcagguggauuucugaguucgaggccagcuuggucuacaaaguaaguggcaggacagccagggcuacacagagaaacccugucucaaacccaaaaaaaaaaaaaaaaaaaaaaaaaagaacacuuguuuuguuuguuuuuucgagagaggguuucucuguguggcccuggcuguccuggaacucacuuuguagaccaggcuggacucaaacuaagaaaucugccugccucugccucccgagugcugggauuaaaggugugcuccaccacugcccgacuuucuuuguuuuguuuuuguguuuuuuguuuuuggaagaacacuuuuuuugguuuguuuugguuuuauuauuuauuuauuuauuuauuuauuuauucauucuauguaaguacgcaguagcugucuucagacacuccagaagagagagucagaucuuguuaccaauggcugugagccaccauguaguuacugggaauugaacucaggacccucggaagagcagucagugcucuuaaccacugagccaucucuccagccccagaauaacacuuguuaucugugcaaaagauccagguuugauucccagcucacaaccauccaugacuccaauuccaggggauccagccucuucuggccuccagggcacugcaugcauguggcacacagccauacaugcacacagaacauccacauauaauguaauaaaauaagauugaaauagauaucaauuagaaauuuccauuuuuggaaauuuguuuuuguauucuauuuauguggagguaaaagggaaaacuuuuggguguauuucucuccuucuaccaugaggcucccagggauggaaaucaccucagccaucucacuggcucccuaguuagaaaaguccccagguucauguggcaaagaauuuacgaauggagacuucagccggaugugguggugcguauccuuaccuccuuacuagggcucugugaguucaaagccagccugaucuauauagagagcuccagguaagcaggacuacacagugaaagccugucuggaaaacagacagucaagacuucuucaagcccaguuuguaagagacccucuugcaggucauggcagcagcuggugaaggagagaauauggagaccgcguuuucuugguuggcugcccuucguuccugugcuuuuuacuguaauuggggcuguuuugucuuuguuagguuuugugugguuuugcuuuugagacagagucucacuguguggcuggccuggagcuccauguagaacaagcuggacuugaaccugagggacacucuucacucugcuucuugaaugcugggauuacaagcacccaccacggugcccagcaggagagccgggguuuguugcuguugaguucgaggacaacugggcugcauuguaaguuacccuggccuguaaugaauuuuccagugaguaaccuccagccuucagugguucauuggccuauauaaagacacuuaucguuuugaaaacuaaaagcaauuuaggcauauagaccaggaagcaggacaaaggccaaguacauauuuccuaguaacacaaaucuaucaagacuucuguuuuuauuuuucucuaagacaacucuaucaagugagaaagucugugauuuuuuuuuaaugcacuuuacagacugagccugccccagccccucuguuugggaguuuauguucuuuagaguccaugagacacuccagcgauucugugcauugcucuccaguucaguaacuacccuuuucaaacaaguugucuggaauuacauauuccagguucuaugcuaggaaguuuagacuuguuuuuguaaguauuugugugagcauguguuuuuguguggguuccucuguccacugcacgugcugaagcuagaaggcuaccuugggucgcucugagcuaggauucacaguacaugggugcuggggucugaacugcaacccucaucaggcacuauuuaccccuaacuucgucucugucucugugagaggacacugugaccaaaagcagcuggagggggaaaguguuucuuuccaauagcagcagcucuacagucaucacaguguguuguuaagucagggcaggaggucaaggagugacccuggaggacagagcugaugcagaggccugcucuucagggccugcucagucugcugucuuccaccauccaggaacaccuguucaggguagcagcacccacaguucaugggccuuuucauaucaaucauuaaucaagaaaauuuacugcagguuugcugccugcaguccaauuuuauggagguauugucucaguuaagagccucucuuccucguccaguauggugucucacuccuuuaaucccaacauucaggaaacaaaggcagguggaucucugaguuugaggucaacuuggucucuauggcaaguuccaggacagggagggcuacacugagagacugucuccacaaagaaaaaaaaucccucuucccagauguaucuggguuugugucaaguuggcaagguucuugccccgcucugcuucuuuugagguaucucugccuacccgaggcuagcuguauuguccugcuuggcuuugaauuuccaaggcuugugugagagggcaucagauccccuggaacuggauuuaguaauuauugugggugcuaggaacugcaagagcaacugaccaccuguuguaggauuuaucuaaucccaaucuaggagugucuaccccaccuuugaucauucagaucccagauuaaaaaacacacacaacuuuuaucacuuacaauaagccuuaaacagcacacguccugggcagauaucuccccucuaugcuguuagaaucuacuuucuuauagauaacccugaguuacuaauuacugcauuucaucugucgucuccaaccccccaaaccuaggggcccugaaccccaccuaugucucuucuacccagcuauuggccaucaacauuuuuauuuacucaucagaaauaacuuggggcaaggucacauagugucacuugggucugcauguacacucucccugucuugagaaaccaguauuagcauuaaaauagaagcagccucaugccaacccacugcagccaccuccccagccccuauccuguaguauucucauuuuuuuguuguuguuuuguuuuuguuuuuguuuuuguuuuuguuuuuuugagacaggguuucucuguauagccuuggcuggccuggaauuucacucuauagaccaggcuggccucgaacucagaaaucugccugccucugccucccaagugcugggauuaaaggcauguaccaccaccucccagcuuauagucucaguuuuguuuuuuguuuuuuuuaaagauuuauuuauuuauuuauuuauuuauuauauguaaguacacuguagcuguccucagacacuccagaagaggaagucagaucucguuauggaugguugugagccaccaugugguugcugggauuugaacuccugaccuucagaagagcagucuggugcucuuacccacugagccaucucaccagcccagucucaguuuuuaagguaaacuuuuauucagcucuuuuuuuucuuauuaauuucuauaaaauauuucuacaauaccuuuuuguuuuauguguguguugagagaggggaauuggacuguuucuuuauguacuacauaacccacccaaacuggcccugaauuccugacaguccugcuucagccuccugagugcuggaaauugucaugugcuacuacacccagucaguuuauuggauccuuuaguccucaguuaacuaacaacuaacuuaaaauugcuuaggaguugcuacuacguaguucagagugagccugcaaaugugaucgugucucuggccgggcucuuugcauccuucaguucuacauccucaagccugaggucuccccacaugacacgacacaaaugcagaagucacacccaaaagaggagcccuuccugggcuuccuguuguagcucuuucuccauaauuggacaaguguccuugcccagucuuuacaacguuaccuuaauuggcuuaagugacuguugcugcucuaagcaaguagcuguguuggggaggaacaacaacauggauaaaacuggcucuuuuuggcagggagacuggaggauguuggguugacaagcaacagcuuuuggauuagaugaaauuaugauuguguccgucccccuccacacacacacacaaacaugucaggagguggguaggcucugggaugccccucacacacaugucaggagguggguaggcucuggaaugccccucacacagcaaaaccauuggccucucaagccucugaucuaaaguggcauaguucucacauauacuguccgcguaaccgccgccgugcaccguggagauagccauuauagugcacucuagugacuagugauaagggaagcaucugucuauuuucagaacaaguacaaacugguuuuguuucucguuuuuugguuguauuggggauuaaaccuagggcuucauacaaucaagauaaggaggguucuaccacugagcuguauagcuccauacuuuuuuuguuuugguuuguuuugguuuugguuuuucgagacaggguuucucuguguagcccuggcuguccuggaacucacucuuuagaccaggcuggccuugaauucagaaauucuccugccucugccucccuaaugcugggauaaaaggcauucgccaccacugccuggcuauuuuuguuuguuuuugagacagagucuugcuuucuagucuagacuagcccaugauucccuauguagcccaggcuggugucaaacauguguuagucuuucugcuucaguuucccaagugcugggaccacaggcauagucuccauaccaccauuagauuuucgguugguauguguacaguauguguaggcaguagggcauucguguguauggaucagaggacgacuuuguaaaguucuuuacuugaugagcuaucuugauuagagagcuauaagggcuuguugaaccuaaccaauguggucaaggucagguaaggauugggaacucagagacaaauuuuuuuuaaagaaaaugagcgccaggcgugggggcccacaccuuuaaucccagcacucgggaggcagaggcaggcggauuucugaguucgaggccagccuggucuacggagugaguuccaggacagccagggcuauacagagaaacccugucucaaaaaaccaaaagaaagaaaggaaggaaggaaggaaggaaggaaggaaggaaggaaggaaggaaggaaggaaggaaaaugagcaaaauaauggcuaacuaguuagacuguagacaagcaaacuugguucagaccucagaugugcugguauuggcuagcagaguaaaucuuagaugcucauacuccauauagaucccccuuauagccaucucccucuguaaaaugaggacaaacuagaauucuugcuagugugaacuuagcaggaucuucuaugcauguagugacacuggggcagcaucuaaagucuuguugugcacauaguagguacagguuagagucaggccgcuggcagaauagcagccucgcugugcaaaggccuagguucaaucccuagcacagugggaaagaaaagaagggaggaagaugcugggcaaggccgucgugccuggaauucagcacucaguaggcaaagacaggaagauggccaugaagugaggcccuguuccccacccccaaagauagaagcaaggaaaggagggaaucuggauaaagaaugagaaggaagaauucaaagaaugcccaggacuccaagcugacuguguaguagaguuaggaauagggaaaaaaagcuuugugguuggcaauggcuuccggaaacugucacuaaauacacagcaaucgauguaaucagaugacuagaggggggcuaagauguugagcuagcagaaggguaggaccuggcuuucuagaaaagaugauggcuccgugcauccugaacggugaaugugcucugagaugaagagugggagggucuuucaaacaaagggacaaacauaagccacugccagaagacacuuuauagugggcaccagaagccaugggcaguguguuguccuaagacacaagaaggcggagaagggugggaacuaagauucuuugguccuuacgugcuggccuggacugcuccaagcccuuccugaccaaaacuagagauggcgccaccucugcacugugcucauaacagacacagauguucucagccccaggccccuccaccuuguuaucauaagacugacauauccuguuuuccuaaacuugccccacagggugggcgaacuggaccagcuggaugaguguuuggaaaagaguaggcggagcucccaggcugccugucaagcuagaggcugagaguucuuuucccuucuccuugggguuucagcugggccacucccugaggaggcagggguguggcccaucccacccacugguggcccuugacucauucauccacuauaucucugauaagcaucuucuaaaggugcagcauuguguuaagucugaggagcacauugaggaaugauuuagucuuggcacaugagacauccccacuaaauguugcuggguaugggaacugcaaaagcagcuggcuuuagcucuagcauaaacaaaagcccaaggcaggcucugggcuagauguuuuagcugugguucauuuagucuuacgauaagccuaaugagcuugucccguuuuacaaugggcauacuguauccacagaggugaagaggcuuccugguggcagccaggauuuaaaaaacucaacuuggccugcaguguuucccauuuuaccuuuacuuguauugauaucgucaggucuguaagaccucuuaaucaaauacaguaaaucagauucgagaguacuggaucuuagggucauucauaaagguugaugagaaggaagaaccccuuuuuaaaauagauuuauuuauuauuauaucuaaguacacuguaccugucuucagacacaccagaagagggugucagaucucauuacgggugguugugagccaccaugugguugcugggauuuguacucaggaccuucggaagagcagucagugcucuuacccacugagccauuuugccagcccaaaagaacccuuaagcccaggaguugaauggaaugagagagagagagagagagagagagagagagagagagaggagagagagagagagaacgcagauaauuugaugacuauccccuuggaauuacccuucuccauccagagugcugaagcuacaggagggagucuuucuuagauguucacucucuccaucacagaccccaaaacauagacaccugagaacauggccauuucuccuuacaggaacaaucagaaauguucucuccuacgaaugagcccaggcacaugcuaucuccagaggacccuggagagcucagugggcaguccuggcccucagaauguugcuguggagguuaagacaauagugucccgaaugaaggaaaaggauuuugguuuuuuuugagaaaaggccuugcugcauaggccuagagucguccuagagccuagauccucgugccauggccccuggugcucagacuagauauugcacaguuaggacuggcuaagcaagcagugacuagcugagcccuccacugcuggugucagcuuccccuuacauccugcaucagagcggguuguuggcagcaaaaaauggcaacagacagaaugacaguaauugggccuuuaggccagguauaguacauagcucacuuuuguaaccgcaguucaugggagguagagccagcaaggcuguggcaaguucaaggccagcugggacuacaucaugagcucccuuccacuccccaaacuaaaaaaaaaaaaaaaagaaccaacacaaauacaaacaaauagauaagcuuguagaagaaacuaagggguguuguaauagggacagucuugaagggggagccgaaagugcugugacuacagagucacugcacauucuucuccucacacucuagacggcuuuguggucucuaagaaauguauuggucaauauaaauggcuaccaggucuuaucuuacaagaggggcaaccagcaccuuucucauugucaccucuaccuucccuagauaugugcaggugaaauuugucuguauucggacgcagucaaacaggaagaaaacucggaagguggacagguguccagcguaucugcugcugcaauacaacgagacucuagauagacuguuuaucagugaguugaauacccagcacauucaugcugacucuaaugcuucuggaggaaucccugcuagcaagccucaggcaauaugucuacacaaacucccgccggugcagcucagcaucaggaaagaccuugauacagcagagaagcccucaguagagccgucauuuugccucgauaagauacacaagcccucaaauccagaacaggagggcaucaguccuucugauauggccaagauagcaaaagugaugaagaacuuucuuaccguggacgagggcucaauggccuccuucagugugggcaccagccaagaccuagaccgacucagcuuccagagcagcaagaugagugaccuguucgcccgauucccagagacacucuugcugcaccggguggaaaacagccagggccauauucuguaugcuuucuugguggagaacaaggagcgagagagucgaguggugcacuucgcugugcucaaggcugagacagcgccuucuguggccaagaugcucaauaucuuuacagaauucaacucugauuggcccaaggucaagauggucuuuguggacccuucauucccucaccgagcgaucuuacaggagaucuuccccucugcccgcacucuccucucuaucuaccacaccacucgucucuuggagaagaaguuacaccagaguucaguaaaugcgucuuuuaaaaggcucaugaaagaagcucugcgggaagcuguguuugucucuucugaugcaagccuaaaaaaucucugugagaugucccaaguccuacuagaugaggaacucuucaguuuccuccaggcccauugguucuccugugaacugcugugguacauacaugugaggaagggccugcaugcauguaacaccuacauggacagccuagacauagucaccagcaaggugucaagccucuuucgggaacagcggucucugcuggacugcauccuucacuuuguggauuacauagacuucuuuaauaccaaaggucugaagagcuugcccacaaaugcucccaaguuaaggagaacucggcucccaagcacgccuccaaggcccaagaagccuuuuagaauuuguggugggggugacaccaggcucccuguggaagagguagaagagacaaaggcagacucagcacagucucaguugccacagccccaggaucaguccuccaaggcuggcaugcuagacaucuugcaccagaguggcucugaacuagccuacaaguugugucauaaugagugggaggugguacagaauuccacccaccugguagacgaggccggcuccucaguggcuguucagcugcuagagaacucacaccaggugagcaaagauggcuguagcugcagcugcuccuuucaacagugcuaccaucugccaugccgccacauuuuggcucuguugcauaccagccagcagccaguaggggaagccauggugugcugccgguggcagaagaaauaccagcaccuccuugaccccaauggggagcugcaagaccguggaaucaucccaaacacagaucagccugaaaagcaaggucagaaccacaugauucgggaccuaagcagggagcuggcaaaccugcugaugcagaccgaggggccagagcuggaggagcgcugcuccacccugcgcaagauuguggacaucugggcagaccccuaucagcugccugaguccagucagcagccaguugacuucagagacgugggcugccucccuuuccucuggggaaagcuagaggaagcagacagccccccucuugcugaagccaugguucaugauugaaguguuuguacuagugaacccaucucagaaccaccuugggacaguucaaaguggugggucagacuguaggucaguauuuuuaucagugucuuccuagguaagggcuaagaagaucuuaaaacucgggggagagggacuccacugugacaauccuuugacccugccucauuucagcccuaccuuuggcguucuguagacaccuuguucauuguucaaagccaaaguuauuccauaugaaagggcaugcuccuuucuucccagccuacacagacgaacccuugcccagguuaggauaaacacaaugggcccggaaaggagcuuuguguccagagacagagggggaggaggguagcccuugauugucaacuguugcugcucuuuagaaaauaccuguuacguauuuuuauucacacuaauaaagucgguuuuuguuuuguuucac

SEQ ID NO: 1266 - RNA, 4190 nt, Mus musculus
cuugacagcucgauagccgacaaacuaaauguuguccguauaaaacacugcucuuuuuuauuuuuauuuuggccuuuaaaaggugccgccuuuccagcccccuagaccgaagggaggcuucgcccucgggcggccuguuccgggcuugaacauccuuccacaagcucucauuggugauuucuggccgagccucuguaacccuggcaacagccccguccaggagcugccaguccaggauugguccguaacucccaaguuccacagcgagcuccuuuggucugagucauugugaagcuggcguggugauuggcgaggcuggacgucagucagucggaggcgggcccagugggaggaauggcugccgcgucugccggugcgcgaauggucucggccguggaggcgugaagccgggucucagcgacuagugcauucagcuuccaccaguggaagguggauuucggcuccgcugggcuugaacacgaaccucagccuuccgcgucccccaccgguguucaggugaggucagaggccgccuucccuuccugauccauaauuugggacucuauaggaugccaucaggaucuggagccaaagcucggcuuccagcuguuguaaugauggacagauagccuaugcuuucuaccucagucuuucaugugucuuugaaccugagucuuucaucggcgaaauggggacagugaauggagccaaaugggaaacauuugcauaaagcauuacauccaaucaggauauguguaggcgcaggagagguuacacacaugcuagcccccuuaaagugaaaggaauugccggccagugguggcgcaugccucuaaucccagcacuugggaggcagaggcaggcagauuuuagaguucgagguccacagagugaguuccuggacagccagggcuauacagagaaaccgucucgaaaaaagccaaaagaaaaaaauaaauaaagugaaaggaaucaaguuucagagaaggcaauuggcuugcucaauauuucacagcaaauuuugagcaguuuuuuuuuccugguauauaccaggaccaaagaaaaaguugguaagaauuauaagaauuugugaacagaaaggccaugcaaauauuuagaaugauuuuuaaaaaagaauuaaauguugacacaugccuuauuugcagcacuuggaagcugaggugagaggauugcuguggacaagucagagcuacacagcagaauccuucuguagaaaaagaagguccacaugccauauggguuuuuuuguuuuguuuuuugagacagagggguacucuguguaacagcccuggcucgccuagaacucacagagaucagccugcuucugccucccaagugcuaggauuggccauguguuuucaauccucuauacugccagugagcuauuaugaucuccuauugucuagaaugaccuugaacugacccugcugccuccaccucccaggugcugggauuacagguguuggugccacacccaauucccuaguucuuuuguuugguugguucgggauuuuugcaugcaugaguguguggugguuguuagggguuuuguuuuuguuuuuuguuuuuuuaagacagguucucucuaaauugccugugcuggucuugagcugauccagugacgccuggugacgcuucugucucagcauuuuagguagcuuagaucacaaagguacaccacugcaugugacuuccugcccuuuuuaguuccugggcuggcuuguuauuuaucccucauauccggggaaaucucccucagugucccacuguagcccaugugccuugcccuccgcagcaugcucucuggccucuuucucauuuuuaugguuuuuauaaucaaccaauguguccuuaugugcuuguuguauaucugccccuggaagauauauaguguuugauaaguguugagauauuguccagauagauaguuaaaaacccagguaccuacucucuuaagugucucuuccuuucccuaggcccauccaaaaccguaccuaaaacuacagucuagcuucaagcaucaaauuacguggcacuugagaaacguagugcuucccugacggccgucgaucuugcagaggaaggauccuagccugggcuuuagacgcuugccagcagcacuccauggcccucacgaugcugaauggucuacucauuaaggacuccagcccaccuaugcugcaccagauuagcaagacuccucagcuagaugccuucaacuaccaaagcugcuucaugcaagaccucuuugcucauuucccugaggucuuauuuauccaccggaccuauaacccaagaggcaagguguuguacaccuuccugguagauggaccccggguccagguugaggguccucuugcccgagcuguguacuuugccaucccuaccaaugaagaugccagaggccuggcccagauguuccagguguucaaaaaguuuaacccagcaugggagagagucaauaccauccugguggacccccacuuccuccugcugcccacccugaccauggaguuccccaccgcugaggucuugcucucugccuuccacaucugcaaguuccuccaggguaaauucuaucagcugccguuggagcagccuguccagaggcugcuucuguccucccugcagagcacgaugugcucagccacagcuggcaaccugaggaagcuguacacgcuccugaauaacugcauccccuccagcaggcugccggagcuccacucacacuggcugcucaaugaccgcaucuggcuggcccaccgcuggaggagccgcgcccagagcagccgcuacuuccagagucuggagaucauggcccacauccucagccaguuuuuuggcaccaccccauuugagaaacaggguauggcgucuguguuccgauacaugcagcagaacucuucggacaaagccagccucagccuggccgagacaccccaggacagucacacuccuucagaggccagcgcugaaaaccccaacacagagcaguugguggaagcccguauccagcacucccucaacgccaucugcacggggccagccgcccagcuuugccuaggcgagcuugcggucguccagaaauccaugcaccucauuggcuccggcuccgagaagaugagcauccagauucuggaggacacgcacaccguccagccccagccccccgccagcugcagcugcuacuuuaaccaagccuuccaccugcccugccgccacauccuagccaugcucagugcccgccagcagguacuccagcccgacaugcugcccgcucaguggaccucgggcugugccuccagucuagacaguauccuaggcagcaaguggagugccagccuggauaagcaccuggcugugacucugcucacugaagaggugggucggcucuuacagcacugcagcgaggaggaguucgagcgucgcuacagcacccuccgggaacuggccgacaacuggaucggcccuuaugagcagguacagcucuaaucacguguacacgcccaguacuaggaacugaacccagaggagucgacggguuaggcaggcucuacuacugccucuuuuuaugucuuauucugagauagccucucacuagguugcccaggcuacucuugaacucacucuguagacaggcuggcuuugaacuugugagucuccuagcuaaccugcagaguaagugggauuauagccugagucaguaggcucaacuucugauuguauuugugcucugaguucacacacauacgagcauucacguccuucccucugugcuugcuuccaaaggcuucugcucugccccagccucuugucuagaacgugucagggagucagaaaauccuuucugcuaagggcucaguaguaaauauguaggcuuugauggccaaauacagucugcugugcauucuggcuucauuuuugacaacugaaaaggaaaaaugauuuguagcuccagaaauuucuggaaacaggugauuccuuaagagaaauaguggguggugaggcugaagguucuguguugguaacuccugcucacccgugaugugauucaccugacacuggcccuggagccuccccacaaaggcagagacuauggugaggccgucaagcuucccaguucuccugucccaccugggaucaauaaagugaauguccuguccccacuc

SEQ ID NO: 1267 - RNA, 4190 nt, Mus musculus
gaguggggacaggacauucacuuuauugaucccaggugggacaggagaacugggaagcuugacggccucaccauagucucugccuuuguggggaggcuccagggccagugucaggugaaucacaucacgggugagcaggaguuaccaacacagaaccuucagccucaccacccacuauuucucuuaaggaaucaccuguuuccagaaauuucuggagcuacaaaucauuuuuccuuuucaguugucaaaaaugaagccagaaugcacagcagacuguauuuggccaucaaagccuacauauuuacuacugagcccuuagcagaaaggauuuucugacucccugacacguucuagacaagaggcuggggcagagcagaagccuuuggaagcaagcacagagggaaggacgugaaugcucguaugugugugaacucagagcacaaauacaaucagaaguugagccuacugacucaggcuauaaucccacuuacucugcagguuagcuaggagacucacaaguucaaagccagccugucuacagagugaguucaagaguagccugggcaaccuagugagaggcuaucucagaauaagacauaaaaagaggcaguaguagagccugccuaacccgucgacuccucuggguucaguuccuaguacugggcguguacacgugauuagagcuguaccugcucauaagggccgauccaguugucggccaguucccggagggugcuguagcgacgcucgaacuccuccucgcugcagugcuguaagagccgacccaccucuucagugagcagagucacagccaggugcuuauccaggcuggcacuccacuugcugccuaggauacugucuagacuggaggcacagcccgagguccacugagcgggcagcaugucgggcuggaguaccugcuggcgggcacugagcauggcuaggauguggcggcagggcagguggaaggcuugguuaaaguagcagcugcagcuggcggggggcuggggcuggacggugugcguguccuccagaaucuggaugcucaucuucucggagccggagccaaugaggugcauggauuucuggacgaccgcaagcucgccuaggcaaagcugggcggcuggccccgugcagauggcguugagggagugcuggauacgggcuuccaccaacugcucuguguugggguuuucagcgcuggccucugaaggagugugacuguccuggggugucucggccaggcugaggcuggcuuuguccgaagaguucugcugcauguaucggaacacagacgccauacccuguuucucaaaugggguggugccaaaaaacuggcugaggaugugggccaugaucuccagacucuggaaguagcggcugcucugggcgcggcuccuccagcggugggccagccagaugcggucauugagcagccagugugaguggagcuccggcagccugcuggaggggaugcaguuauucaggagcguguacagcuuccucagguugccagcuguggcugagcacaucgugcucugcagggaggacagaagcagccucuggacaggcugcuccaacggcagcugauagaauuuacccuggaggaacuugcagauguggaaggcagagagcaagaccucagcgguggggaacuccauggucagggugggcagcaggaggaaguggggguccaccaggaugguauugacucucucccaugcuggguuaaacuuuuugaacaccuggaacaucugggccaggccucuggcaucuucauugguagggauggcaaaguacacagcucgggcaagaggacccucaaccuggacccgggguccaucuaccaggaagguguacaacaccuugccucuuggguuauagguccgguggauaaauaagaccucagggaaaugagcaaagaggucuugcaugaagcagcuuugguaguugaaggcaucuagcugaggagucuugcuaaucuggugcagcauaggugggcuggaguccuuaaugaguagaccauucagcaucgugagggccauggagugcugcuggcaagcgucuaaagcccaggcuaggauccuuccucugcaagaucgacggccgucagggaagcacuacguuucucaagugccacguaauuugaugcuugaagcuagacuguaguuuuagguacgguuuuggaugggccuagggaaaggaagagacacuuaagagaguagguaccuggguuuuuaacuaucuaucuggacaauaucucaacacuuaucaaacacuauauaucuuccaggggcagauauacaacaagcacauaaggacacauugguugauuauaaaaaccauaaaaaugagaaagaggccagagagcaugcugcggagggcaaggcacaugggcuacagugggacacugagggagauuuccccggauaugagggauaaauaacaagccagcccaggaacuaaaaagggcaggaagucacaugcagugguguaccuuugugaucuaagcuaccuaaaaugcugagacagaagcgucaccaggcgucacuggaucagcucaagaccagcacaggcaauuuagagagaaccugucuuaaaaaaacaaaaaacaaaaacaaaaccccuaacaaccaccacacacucaugcaugcaaaaaucccgaaccaaccaaacaaaagaacuagggaauuggguguggcaccaacaccuguaaucccagcaccugggagguggaggcagcagggucaguucaaggucauucuagacaauaggagaucauaauagcucacuggcaguauagaggauugaaaacacauggccaauccuagcacuugggaggcagaagcaggcugaucucugugaguucuaggcgagccagggcuguuacacagaguaccccucugucucaaaaaacaaaacaaaaaaacccauauggcauguggaccuucuuuuucuacagaaggauucugcuguguagcucugacuuguccacagcaauccucucaccucagcuuccaagugcugcaaauaaggcaugugucaacauuuaauucuuuuuuaaaaaucauucuaaauauuugcauggccuuucuguucacaaauucuuauaauucuuaccaacuuuuucuuugguccugguauauaccaggaaaaaaaaacugcucaaaauuugcugugaaauauugagcaagccaauugccuucucugaaacuugauuccuuucacuuuauuuauuuuuuucuuuuggcuuuuuucgagacgguuucucuguauagcccuggcuguccaggaacucacucuguggaccucgaacucuaaaaucugccugccucugccucccaagugcugggauuagaggcaugcgccaccacuggccggcaauuccuuucacuuuaagggggcuagcauguguguaaccucuccugcgccuacacauauccugauuggauguaaugcuuuaugcaaauguuucccauuuggcuccauucacuguccccauuucgccgaugaaagacucagguucaaagacacaugaaagacugagguagaaagcauaggcuaucuguccaucauuacaacagcuggaagccgagcuuuggcuccagauccugauggcauccuauagagucccaaauuauggaucaggaagggaaggcggccucugaccucaccugaacaccggugggggacgcggaaggcugagguucguguucaagcccagcggagccgaaauccaccuuccacugguggaagcugaaugcacuagucgcugagacccggcuucacgccuccacggccgagaccauucgcgcaccggcagacgcggcagccauuccucccacugggcccgccuccgacugacugacguccagccucgccaaucaccacgccagcuucacaaugacucagaccaaaggagcucgcuguggaacuugggaguuacggaccaauccuggacuggcagcuccuggacggggcuguugccaggguuacagaggcucggccagaaaucaccaaugagagcuuguggaaggauguucaagcccggaacaggccgcccgagggcgaagccucccuucggucuagggggcuggaaaggcggcaccuuuuaaaggccaaaauaaaaauaaaaaagagcaguguuuuauacggacaacauuuaguuugucggcuaucgagcugucaag

SEQ ID NO: 1268 - RNA, 8163 nt, Mus musculus
caagcggcuucggcgcgcuguaggaggcagcacguuuuguucauagagcugaucuaagagguggcuauaaagcccuggccggcugcggcccaccagacggucccggggaauucggaacugcucgaugcgcagauaggguucaaccaguagggcuuggggaccacuggggaccgcugccuccgcuucugguugaccuucccggggcacacgguugugguggcgugugauagcgaagacccaacuguggccaaggcugaccaagucaggcagugaaaacucggguacagcggccagacuggcgggauccagagcggucaggccaagacguaagugcccgcaccagcccagcucuuuuuccucaauuuccacuagaaauaccuggccgggggccaggggcucacgacugaagcacacaccgugggcgaaacucuccacgcguguggcucgcguuccugagggguccaugcggauguuggcuccaugcacuugguggaagcgggugggagggggcucugggcgcgcagggcuccgugggccacccaguccuacguguucggagggagcagccaucuccaagccgugcaacagggcagcucaugccaagggcuauuuugggcagcgggcucagauugugaccgcgggggcgggguggaugaaccauguaaggcauuucccccuucucuaacuucccccagcucugccuggggguccuagcgccgcuuucucgcuugucaccaguaagggguccccaggagccuggggaacccuucugucaacaccaagaucaccugaucucuggcacccugacuaauaaccuucagggccacgcacuuugaccacucccgacccucaggcccacagauuaaaaaagugaacaaugagcaaacugucacgugaugcagaugcucacgugaccagagcuacacaugacuuccaguccaaaggcgccuccuggagagcaaggacgcaaggaagcagagguacggagaugcccaaacuggugggcagcgaagguggcucuguggcccggaguuggauccgagcgggggcuucucccggagaugugcgccaucgucuccccaggaacugcugcaccgaagcgcaagggaucuggggggacugguaaacaaacauccuccaccgaugcuuccuccugcagaugcccggaaccgcgcugucuccacugcucuuguugcugcuccuguccugggcgucccggaacgaagcagcuccggaccaggaugaaaucgauugucuccccggccuggccaagcagcccucuuuccggcaauacuccggcuaccucagagcaucggacuccaagcacuuccacuacuggugcuuggcuuggcccuaaaguuccuaggagggcaugauaacuggacgagcgaauucuaacgaccccaggcaggaccuggacucacaccaauccuuuccuauccuucccagguuuguggagucgcagaacgacccaaagaacagccccguggugcuuuggcuuaacgggggucccggcugcagcucgcucgaugggcugcuuacagagcacggccccuuucuggugaguugaccacuaucccccucccccaugagagagggcaggagacuaguuagagacagcucaaggaaaaggcaggaaggggaaggggagaaggaaccuguggccuaaguuugcuuuccuuaacaauucuguuuuaugugguggcccuugcccuaacuuuccguaccucucauggagugugagaauacggaaacgcacuguggcucuuucucuccacccagcugcuaaccggcacccucacaggccucucugucuuuccuccccagauccagccagauggugucacccuggaguacaaccccuaugcuuggaaccugguacuccuggagcugugggucucuuagggaugucuggguacuugaaggguuggggacccccucuucugcucauucccuccucccccuagauugccaacgugcuguauaucgaguccccagcuggggugggcuucuccuacucggaugacaagauguacgugaccaaugacacagaggugagucuguugccugaccaccugccccauuccccguuuccccagagauggcuugauuaggaggagagcauggccucagaguccacuuugagcccugucaugugcucugguaaacucaaccaguccacuuccucuuauacaaaauaaaauggguugaacucauuaucucugaagcgcuuucuaacuuaaacguccucgggucuccugacucuuccaucuuggcauccucagguggcggagaacaauuaugaagcccuuaaagacuucuuccgccucuuuccggaauacaaggacaacaaacuuuuccugacaggagagagcuaugcuggcaucuacauccccaccuuggcuguacuggucaugcaggauccuagcaugaaucuucaggugcagggcagcuaccugagggaagggaggccccacagugcugugaccuaggauuagggaggucagccuggccgcucccucacagccuacuggcuggccacuggcuacuccgauagcuugcuuugccucccaccacaggaagcucaccugucugucugucagggugccacuucuguucuuuagagugaaugaccuuccccacccacccacccccacaaacuacucagcuucuagauugcaggucuggguuguaggucaagggaggcucccccucgcucucgcccuucggaugagccgagcaugcuucguguuucgcaggggcuggcugugggcaauggacuugccuccuaugagcagaacgacaacucccuggucuacuuugccuacuaccauggccuucuggggaacagguaaaggaagagggaccguugggcaaugucuaaggcggggcaggucauacgaucucagcacaggauucccacucugguuuauguguaggccggagcuggaauugaccaaagggcuugaugcuuuaaaggccaagccuaggguuuaaagaaacuaaggcagcuagacauggugauacacaccuguaaccuggcacuugaaaacgggcagaagaauccugacuuuuaggcuagccugugcuacauagugaguuuaguauuugagcccagguuauguaaaaaaaaaaacucucaagaacauuuuuuuucuacuuuuuaaaaaaggcacugggagggcuggcgagauggcuuagugguuaagagcacccgacugcucuucugaagguccagaguucaaaucccagcaaccacaugguggcucacaaccauccguaaugagaucugacucccucuucuggagugucugaagauagcuacaguguacuuacauauaauaaauaaauaaaucuuuuaaaaaaaaaaaaaaaaaaaaaaaggcacugggaggggcuacuucuaugaacuagggggcaaaucguuggaaacuagguuugguagccuccacaucuuuccuaccugccuccagaggucaggguaugaugggagggaggccacugcaucuccuagcaucucgagccagccucagccucagcccuuucugauccacagacuuuggacuucacugcagacccacugcugcgcucagaacaaguguaacuucuaugacaacaaagacccagaguguguaaacaaugugagcuccugcccuuggaccccaguccugagaaagggaucccacaagccccuccuuggcaaccucgcuccccagcuccauggcuucccuuuauggcaguacuuggggauugaacacggggccucaugcaugcaagacaagcacucuaccaacugggcuaucgcuccagcucaucccgucggcuuuucugucccaaaccuuccgauacugcggccuccucugggaaguccagugaggaaacuggagucaaggcugcuucagccgcuugcuugccuuaagucacguggcagggaauagucgaguuagggcuggacccagaucugggagauuccuuccaugaccauucuaccugagaaaaacaguaggugaaggguggugucgggagaugagguagggagacacuuaauccugagagugagcaggggagguccggagggacauggauucgacaaacagggccguuugucuucacagcuccuggaagugucucgaauugugggcaaaucuggccucaacaucuacaaucucuaugcuccgugugcugguggggugcccggcagacauagguaggugcugcuggguaugccuugggcuaauaccugcugccucuagaggcccggaacccauccuaccauuuuuguccguuugucucucugucuauuucugacagauaugaggacacacuuguaguccaggauuuuggcaacaucuucacucgccugccacuuaagcggagauuuccugagguaugcggggguaugagcucucccuugggggagcuggugggcuagagaauuaaagccccucucauccuauguccaugcccucccuacccccccccccaggcacugaugcguucuggggacaagguacgcuuggauccucccugcaccaacaccacagccccuuccaacuaccucaacaaccccuauguucggaaggcucuccacauccccgagucgcugccccgcugggacaugugcaagugagcuucuuuggccacucacggugcaggugauggccaccagcugggcuucuguaaauagggcuucucggggggggagggggccgggggggcgggggugugugugauauggacauugggaugagaaugaguuguucaggauguuuaacagccuugacccccagcugauugacaaccaguuaucucugacauuuaaugaguaggcgcuguccccaauauggcuccauugccaccuggagcugcccaguucauccuauggcccauuuaaguaaaaggguaacccuagcucaucagagcccaguuaaguguuuccugauggacagugccuugcuccgucauuaccugccguuacacugacaccugccggucccuaaacacuaagcacugguuguaucccagucacugaaacaaccaaaaaaauuaugcccacguaucuccagcucugguucagauaagcaaguccuagagagcugauacacccaaaguugggaacuggggaggucccaccuguugacugucccccucauuucccuguuuuguucuuuuucccccccgcauccuaugcacauguccccggcagcuucuuggugaauuuacaguaccgccgccucuaccaaagcaugaacucccaguaccugaagcugcucaguucacagguaugugugcgcaacacagcaggacccagcuauauuguguagcgcaucuguagagcuugcccuaccacacccugguuguuauucugagacggucuugcucuguagcccaggcuggcuuugaacacguaacaauuccuaucuuggugccaacgacuggcucuggggaagaguucucagcuguguuuucccucuguaagaugaggcuaauccgcuggccaugaugagucauagcugcaagcucagcccuggggagacuaagagaccccaguucuaagccagccugggcuccauugucuuauuugggguaccgugauccuccuauacaugaaaucaucucguuggugcguacuggacaugugguauacagccugagaauuucagguugcuguucuuagcuucugcaucccuggaaaguagggcuugaaccugggaagggcugggggccuggauccagcccacgcuucaguuuuccccuuguccuauuccagaaauaccagauccugcucuacaacggagauguggacauggccugcaacuucaugggcgaugagugguuuguggauucgcucaaccagaagguaaaguugccagggagcugggcuggcuagggugccaggagagggcaaaacuggagagcagcuuugagcaaggauggggguugccacuggcuaucgucuuucccgaugggacagauggaggugcagcgccggcccuggcuaguggacuacggggagagcggagaacagguagcugguuucgugaaggaguguucacacaucaccuuccucaccaucaagguaggacuuugugccuagugagggacagccggggccagagcgggggaguggugugacuuccccgucucucucugaugauucugggucacccuugaugcauugggcgagcuugcagggugaggaggugaagaaggaagcggcuggaagugaggggugaugcauguuggggauccagaucucucauaaagcuuugcuccccagggugccggacacaugguccccacggacaagccucgagcugcuuuuaccauguucucgagguuccugaacaaagagccuuacugauagcuuccgcugcaacccauggaaauccucaguaccugaucagccccucucggccucucucagcagagaggaguccuccgcuaaugcucccguggggcaaguccuguacuaaaacugcccagacuucucacagccuggugcaucccagccugggccucagggcgucacagacagccuaggaccaagugagcacuuuguuccggccaucgugggguggccugaccuccccgacugcauaaaaacugaccaccccaggaccccaacagagcuagagaaacccaaggagggggguggauggauucuaauugaugguugacuaauucuggaauuaaaucggguauagcuuccaacugggcucuucucuguggcaccgggaccacuaacacuguagaugggaagggguuggcagggggugcagagaagacuucaguuagguuccugaaugccagccacccagguggggugaugggcucaggcagcugcagcagaggguggggggacaugggaggccgcaacgucugcaggacgguucuugucaaucacuucucgaagcccuuuggcaaaguggaggucagccccaacagugacgaagcccugcgggaggggacagggagccuggcugguucaguuguuuggaaacagccuccaaacaaacacaagacucuugagcaaauccccucaggggccccagcugcuuugcggcguggcguauguucucuggagcauggcccugcuucuaaguuaaaucuuuacuacuuaaauaauauauaugugaaggagcaacuaguguaaagggguuucgggaaaacagacaagcacugggguguuguagggacaggaaugcccuggucuacggccuccuuuccacaauguacuuaccgcgugguuggucaccaccucacgcacgaaguugauacccucaggaagggggaucugcaccccacgccagguacgcucuguggaugagagaggcaagcucagccuggguguccaucaguccaucugugucgucauguccaccauccaccgccguccccccuuuguuaguccguguccccacuccauccucccacccucagucccuaccguucagcaaaggcaucacuccgauuugcagcagugucuucaguggggccugcagugggaucagcugagggggaaaaaaaaggcaggggggggcgacagacagugcauacagguuugagugagcggccaacuugccccgaggccuggacccacccuuugccauccccaacucaccgccagagacuccagcgcagacugauuugaguagauuugaaaccugugggagagaaauacaccgugaaaccugggaacacccuuuccuugggcccuaccuaaaagauggcagcaagugacagccuucccaguucuauccaaucauccuucagguagcugccauuucccaggugugcaucccugagugccuuuggucucuggagcccccuuucuuuaagccuacugcuuuucuuuuuuuuuuucuuuugucuuuuuuuuuuuuuuugagacagggcuucucuguguagcccuggcuguccuggaacucacucuguagaccagguuggccuggagcucugaaauccgccugccucagagugcuggaauuaaaggcgugcgccaccacugcccggcgccugcuguuuuucauuugucaggaaugccuaugugccacgcucugcggcuagguaaauaaguaugguuuuaucuaaggaaauuccaacaaucuuuacucucugucagauaccaaacuuauucaaaagaauuaaaauggcucugca

SEQ ID NO: 1269 - RNA, 8163 nt, Mus musculus
ugcagagccauuuuaauucuuuugaauaaguuugguaucugacagagaguaaagauuguuggaauuuccuuagauaaaaccauacuuauuuaccuagccgcagagcguggcacauaggcauuccugacaaaugaaaaacagcaggcgccgggcagugguggcgcacgccuuuaauuccagcacucugaggcaggcggauuucagagcuccaggccaaccuggucuacagagugaguuccaggacagccagggcuacacagagaagcccugucucaaaaaaaaaaaaaaagacaaaagaaaaaaaaaaagaaaagcaguaggcuuaaagaaagggggcuccagagaccaaaggcacucagggaugcacaccugggaaauggcagcuaccugaaggaugauuggauagaacugggaaggcugucacuugcugccaucuuuuagguagggcccaaggaaaggguguucccagguuucacgguguauuucucucccacagguuucaaaucuacucaaaucagucugcgcuggagucucuggcggugaguuggggauggcaaaggguggguccaggccucggggcaaguuggccgcucacucaaaccuguaugcacugucugucgccccccccugccuuuuuuuucccccucagcugaucccacugcaggccccacugaagacacugcugcaaaucggagugaugccuuugcugaacgguagggacugagggugggaggauggaguggggacacggacuaacaaaggggggacggcgguggaugguggacaugacgacacagauggacugauggacacccaggcugagcuugccucucucauccacagagcguaccuggcguggggugcagaucccccuuccugaggguaucaacuucgugcgugagguggugaccaaccacgcgguaaguacauuguggaaaggaggccguagaccagggcauuccugucccuacaacaccccagugcuugucuguuuucccgaaaccccuuuacacuaguugcuccuucacauauauauuauuuaaguaguaaagauuuaacuuagaagcagggccaugcuccagagaacauacgccacgccgcaaagcagcuggggccccugaggggauuugcucaagagucuuguguuuguuuggaggcuguuuccaaacaacugaaccagccaggcucccuguccccucccgcagggcuucgucacuguuggggcugaccuccacuuugccaaagggcuucgagaagugauugacaagaaccguccugcagacguugcggccucccauguccccccacccucugcugcagcugccugagcccaucaccccaccuggguggcuggcauucaggaaccuaacugaagucuucucugcacccccugccaaccccuucccaucuacaguguuaguggucccggugccacagagaagagcccaguuggaagcuauacccgauuuaauuccagaauuagucaaccaucaauuagaauccauccaccccccuccuuggguuucucuagcucuguugggguccugggguggucaguuuuuaugcagucggggaggucaggccaccccacgauggccggaacaaagugcucacuugguccuaggcugucugugacgcccugaggcccaggcugggaugcaccaggcugugagaagucugggcaguuuuaguacaggacuugccccacgggagcauuagcggaggacuccucucugcugagagaggccgagaggggcugaucagguacugaggauuuccauggguugcagcggaagcuaucaguaaggcucuuuguucaggaaccucgagaacaugguaaaagcagcucgaggcuuguccguggggaccauguguccggcacccuggggagcaaagcuuuaugagagaucuggauccccaacaugcaucaccccucacuuccagccgcuuccuucuucaccuccucacccugcaagcucgcccaaugcaucaagggugacccagaaucaucagagagagacggggaagucacaccacucccccgcucuggccccggcugucccucacuaggcacaaaguccuaccuugauggugaggaaggugaugugugaacacuccuucacgaaaccagcuaccuguucuccgcucuccccguaguccacuagccagggccggcgcugcaccuccaucugucccaucgggaaagacgauagccaguggcaacccccauccuugcucaaagcugcucuccaguuuugcccucuccuggcacccuagccagcccagcucccuggcaacuuuaccuucugguugagcgaauccacaaaccacucaucgcccaugaaguugcaggccauguccacaucuccguuguagagcaggaucugguauuucuggaauaggacaaggggaaaacugaagcgugggcuggauccaggcccccagcccuucccagguucaagcccuacuuuccagggaugcagaagcuaagaacagcaaccugaaauucucaggcuguauaccacauguccaguacgcaccaacgagaugauuucauguauaggaggaucacgguaccccaaauaagacaauggagcccaggcuggcuuagaacuggggucucuuagucuccccagggcugagcuugcagcuaugacucaucauggccagcggauuagccucaucuuacagagggaaaacacagcugagaacucuuccccagagccagucguuggcaccaagauaggaauuguuacguguucaaagccagccugggcuacagagcaagaccgucucagaauaacaaccagggugugguagggcaagcucuacagaugcgcuacacaauauagcuggguccugcuguguugcgcacacauaccugugaacugagcagcuucagguacugggaguucaugcuuugguagaggcggcgguacuguaaauucaccaagaagcugccggggacaugugcauaggaugcgggggggaaaaagaacaaaacagggaaaugagggggacagucaacaggugggaccuccccaguucccaacuuuggguguaucagcucucuaggacuugcuuaucugaaccagagcuggagauacgugggcauaauuuuuuugguuguuucagugacugggauacaaccagugcuuaguguuuagggaccggcaggugucaguguaacggcagguaaugacggagcaaggcacuguccaucaggaaacacuuaacugggcucugaugagcuaggguuacccuuuuacuuaaaugggccauaggaugaacugggcagcuccagguggcaauggagccauauuggggacagcgccuacucauuaaaugucagagauaacugguugucaaucagcugggggucaaggcuguuaaacauccugaacaacucauucucaucccaauguccauaucacacacacccccgcccccccggcccccuccccccccgagaagcccuauuuacagaagcccagcugguggccaucaccugcaccgugaguggccaaagaagcucacuugcacaugucccagcggggcagcgacucggggauguggagagccuuccgaacauagggguuguugagguaguuggaaggggcugugguguuggugcagggaggauccaagcguaccuuguccccagaacgcaucagugccuggggggggggguagggagggcauggacauaggaugagaggggcuuuaauucucuagcccaccagcucccccaagggagagcucauacccccgcauaccucaggaaaucuccgcuuaaguggcaggcgagugaagauguugccaaaauccuggacuacaaguguguccucauaucugucagaaauagacagagagacaaacggacaaaaaugguaggauggguuccgggccucuagaggcagcagguauuagcccaaggcauacccagcagcaccuaccuaugucugccgggcaccccaccagcacacggagcauagagauuguagauguugaggccagauuugcccacaauucgagacacuuccaggagcugugaagacaaacggcccuguuugucgaauccaugucccuccggaccuccccugcucacucucaggauuaagugucucccuaccucaucucccgacaccacccuucaccuacuguuuuucucagguagaauggucauggaaggaaucucccagaucuggguccagcccuaacucgacuauucccugccacgugacuuaaggcaagcaagcggcugaagcagccuugacuccaguuuccucacuggacuucccagaggaggccgcaguaucggaagguuugggacagaaaagccgacgggaugagcuggagcgauagcccaguugguagagugcuugucuugcaugcaugaggccccguguucaauccccaaguacugccauaaagggaagccauggagcuggggagcgagguugccaaggaggggcuugugggaucccuuucucaggacugggguccaagggcaggagcucacauuguuuacacacucugggucuuuguugucauagaaguuacacuuguucugagcgcagcagugggucugcagugaaguccaaagucuguggaucagaaagggcugaggcugaggcuggcucgagaugcuaggagaugcaguggccucccucccaucauacccugaccucuggaggcagguaggaaagauguggaggcuaccaaaccuaguuuccaacgauuugcccccuaguucauagaaguagccccucccagugccuuuuuuuuuuuuuuuuuuuuuuuaaaagauuuauuuauuuauuauauguaaguacacuguagcuaucuucagacacuccagaagagggagucagaucucauuacggaugguugugagccaccaugugguugcugggauuugaacucuggaccuucagaagagcagucgggugcucuuaaccacuaagccaucucgccagcccucccagugccuuuuuuaaaaaguagaaaaaaaauguucuugagaguuuuuuuuuuuacauaaccugggcucaaauacuaaacucacuauguagcacaggcuagccuaaaagucaggauucuucugcccguuuucaagugccagguuacagguguguaucaccaugucuagcugccuuaguuucuuuaaacccuaggcuuggccuuuaaagcaucaagcccuuuggucaauuccagcuccggccuacacauaaaccagagugggaauccugugcugagaucguaugaccugccccgccuuagacauugcccaacggucccucuuccuuuaccuguuccccagaaggccaugguaguaggcaaaguagaccagggaguugucguucugcucauaggaggcaaguccauugcccacagccagccccugcgaaacacgaagcaugcucggcucauccgaagggcgagagcgagggggagccucccuugaccuacaacccagaccugcaaucuagaagcugaguaguuuguggggguggguggguggggaaggucauucacucuaaagaacagaaguggcacccugacagacagacaggugagcuuccuguggugggaggcaaagcaagcuaucggaguagccaguggccagccaguaggcugugagggagcggccaggcugaccucccuaauccuaggucacagcacuguggggccucccuucccucagguagcugcccugcaccugaagauucaugcuaggauccugcaugaccaguacagccaagguggggauguagaugccagcauagcucucuccugucaggaaaaguuuguuguccuuguauuccggaaagaggcggaagaagucuuuaagggcuucauaauuguucuccgccaccugaggaugccaagauggaagagucaggagacccgaggacguuuaaguuagaaagcgcuucagagauaaugaguucaacccauuuuauuuuguauaagaggaaguggacugguugaguuuaccagagcacaugacagggcucaaaguggacucugaggccaugcucuccuccuaaucaagccaucucuggggaaacggggaauggggcagguggucaggcaacagacucaccucugugucauuggucacguacaucuugucauccgaguaggagaagcccaccccagcuggggacucgauauacagcacguuggcaaucuagggggaggagggaaugagcagaagaggggguccccaacccuucaaguacccagacaucccuaagagacccacagcuccaggaguaccagguuccaagcauagggguuguacuccagggugacaccaucuggcuggaucuggggaggaaagacagagaggccugugagggugccgguuagcagcuggguggagagaaagagccacagugcguuuccguauucucacacuccaugagagguacggaaaguuagggcaagggccaccacauaaaacagaauuguuaaggaaagcaaacuuaggccacagguuccuucuccccuuccccuuccugccuuuuccuugagcugucucuaacuagucuccugcccucucucaugggggagggggauaguggucaacucaccagaaaggggccgugcucuguaagcagcccaucgagcgagcugcagccgggacccccguuaagccaaagcaccacggggcuguucuuugggucguucugcgacuccacaaaccugggaaggauaggaaaggauuggugugaguccagguccugccuggggucguuagaauucgcucguccaguuaucaugcccuccuaggaacuuuagggccaagccaagcaccaguaguggaagugcuuggaguccgaugcucugagguagccggaguauugccggaaagagggcugcuuggccaggccggggagacaaucgauuucauccugguccggagcugcuucguuccgggacgcccaggacaggagcagcaacaagagcaguggagacagcgcgguuccgggcaucugcaggaggaagcaucgguggaggauguuuguuuaccaguccccccagaucccuugcgcuucggugcagcaguuccuggggagacgauggcgcacaucuccgggagaagcccccgcucggauccaacuccgggccacagagccaccuucgcugcccaccaguuugggcaucuccguaccucugcuuccuugcguccuugcucuccaggaggcgccuuuggacuggaagucauguguagcucuggucacgugagcaucugcaucacgugacaguuugcucauuguucacuuuuuuaaucugugggccugagggucgggaguggucaaagugcguggcccugaagguuauuagucagggugccagagaucaggugaucuugguguugacagaaggguuccccaggcuccuggggaccccuuacuggugacaagcgagaaagcggcgcuaggacccccaggcagagcugggggaaguuagagaagggggaaaugccuuacaugguucauccaccccgcccccgcggucacaaucugagcccgcugcccaaaauagcccuuggcaugagcugcccuguugcacggcuuggagauggcugcucccuccgaacacguaggacuggguggcccacggagcccugcgcgcccagagcccccucccacccgcuuccaccaagugcauggagccaacauccgcauggaccccucaggaacgcgagccacacgcguggagaguuucgcccacggugugugcuucagucgugagccccuggcccccggccagguauuucuaguggaaauugaggaaaaagagcugggcuggugcgggcacuuacgucuuggccugaccgcucuggaucccgccagucuggccgcuguacccgaguuuucacugccugacuuggucagccuuggccacaguugggucuucgcuaucacacgccaccacaaccgugugccccgggaaggucaaccagaagcggaggcagcgguccccagugguccccaagcccuacugguugaacccuaucugcgcaucgagcaguuccgaauuccccgggaccgucuggugggccgcagccggccagggcuuuauagccaccucuuagaucagcucuaugaacaaaacgugcugccuccuacagcgcgccgaagccgcuug

SEQ ID NO: 1270 - RNA, 18579 nt, Mus musculus
caaggaggagggaagaaccgcggcgaggaggggggucggaggcccagacuuauaaaggcugcuggacccgcgcuacccgccagaccccgccgcccggaucccccgcgcugccugucgccccacgugaccacacuacuaagugaguuggggcgcguccccaucgcauccccagacccucgugaguuguguggcucacuaaauccagguggggaggagagcggaugaaggagggcuccgggauggggcaccagacagaaugcguuauagcggagucuuaggagcuaggggagcggagggacucaggggauagcgcucagucgggccauccccgcgcgcggccugggagaccucaagcuacucagcaggaaugcgcuuguggucgucgccauaccaacgcacaagucagcacacgcccuccucugaaggaaaagagaaaguguuggugggggauggggggcuguucauccuccugagauccaaacuugucacgaggcaguugcacgggggaaccgagccccaaauccuuuggaagcagggcgcaagucuuaucgugcuucggaaccucgguuuugcaucaggcaaagacaagaugauugguuccgagugccccaaacacuuuacgggcaguaacgguccgggccagcacuccguucuaguugcaugaccaaagagugguuuugagccucucagaugacaccugcgacucgaccccacccugcccccaggcuuggucgccaugguccugcucugggcccucuuccuagcgcuccuggcaggugcccacgccgagcucccgggcugcaagauccgcgucaccuccgcggcucuggaucuggguaaggcgcgcggcgggagccguggaccggguggggugcucuggccccgggcgcgggaccugagugucuccaugcuaucucagugaagcaggaaggccugcgcuuucuggaacaagagcuggagaccaucaccaucccagacguguacggcgcaaagggccacuuuuacuacaauaucucggaguaaguaaggcucggggggccggggucucaaagguggugggaugaccugggacaccgccccagacugggcgggucugggcguggccaauuaaaugaggugggauccauaauaacgaguaaggcuacuagguaaaaagacuggagguaggcggguccaagaaaggggaauacgaaccagcagaauuguagcuuggaccaaagaacaccgcgaugauacacuggaagaauuuaccugugggugagaguggagucuauccagaggguggcgccaaaaagagggaagcccaggauaggagagauagaggugaggcgauguggggugaguuaaagugauggaggcaaagucaaaggaccagguggaaagcucagucuggcgcacgccugccaaaaacaaaacaacaacaaaacagaaaccaaaaagacgaaaacagaucuagcaaucacaauguggacagaacacggagguguaagcaagaccauaguuuuuacuuauuuauuuuuaagauuuuauuuaauuuuaauguaugugcauugguguuuugucugcauguacgucuuugugagagugucggguccccuuggaacuauaguuacagacaguugugagauacuuugugggugcugggaauuaaagaggagucuuuuugaagaggagccagugcucugaaccgcugagcugucucuccagccccuauuuauuuauucuuaaagauuuauuuguuuuuauuuauaugaguacacuguagcugucuucagacacacaccaaaaggggacauuggaucuuauuacagaagguugugagccaccaugugguugcugggaauugaacucaggagcuuuggaagagcagucagugcucuuaaccacugagcuaucucuccagcccuauuuauuuaugcuugaggcaugaucuuauuacguagcccuggcuggccagaauucauuuuguaaccaggcuggccuuuaacccagagacugaucggcuuuugccuccugagugcuaggauuaaaguuguguguguguguguguguguguguguguguguguguguguguauguauaucuauauauguguguguaugcgugcgcguauguguauguauauguaugaaaccauacccagcuuuuaaauuuuuuaaaacaaauuuuguguguguguaaaauauaauauaaauauauauguaauuccugcaaaaggaucacuugggcucacaaauucaagguuagucugaaugacacugaaugacaaaaggacacucucagucuuuuaucuuguuuuguuuugaggcgguuuccucugaguagcgcuggcugucuuagaacucacacagaaaucaggaggcuaccucugcccccugagugcugggauuaaaggugugugugggccaccaugcccaguaauucccuaucuuuuaaauauuaaaugcguuaaaaaauaaaugaggaaggcaguauucaacuccuggguucagagaacaaaucucuugaguuacccaauacaugucgggcucuugaggggcaagggaaaauuccagaccacccaccuagauugcccagcuugcaguuagaggagggaugggucccugcggcugggugaguugguccccuuuggcccccacgcugacccugaccccugcucucugcagcgugagggucacacagcugcaccugauauccucggaacuccacuuccagccagaccaagaucugcugcugaacaucuccaacgcauccuuggggcugcacuuccggaggcagcuacucuacugguucuugugaggacgcugagcucucagggguggggcugguggcugggcuggagaaguccuuuaaccucccaggcuucaauuucuccauucaagaggaggguuuggaagguugugugacaaagaucaagaagagauuucaagagggcuuaugagucuccaccccuagcugaggucuaggcagugaaugucugugagggagggugagucauuuuucuaaagugguguagacacugguacuuugcccauucuccacuucauaacuucgaacccaugcuuauacaaaugaacuccuuggaucauucaaaacaaaaaacaaaacuaaaagucaaggugcggcauauugggaagaaagguucaggcacagaagagaaugagaacaacgggaguauauaugaucacaaacauuuuguacacacuugaaaaaauaagguaucauguuguaugggguaaagagagggguagaaacgucaguuaucucccacuggggugaccaugagccugccuuucacagauaugaugggggcuacaucaaugccucggcggaggguguguccauccgaacaggucuacagcucucccaggauuccaguggucggauuaaaguguccaaugucuccugcgaggccucugugucuaaaaugaauauggccuucgggggaaccuucaggugagugucagccccaggacacacguccugagccccacaguucaauuuucuggggcagaaaaggaaagugcuaagguugggagucccacugaauccaaccaaauccuacuuccuccacaucuggacucugugaaccugggcaagucacugacgcucagagaaugaaaucuauuuuagcagauacuugugagcacuguguuguuagauauagaauauuuagacagucccuggcauaugauaaauaucuaaguguuaggauuaguaugucugcagcugaagcuggcucagugguagagagccugucuaguaugcaugagguccuggguucguuccucaguaccugaguuuagaaaauaaaauggggcuggagagauggcucagcaguuaaaagcacugacuucucuucugaagguccugauuucaaaucccagcaaccacaugguggcucacaaccauccguaaugagaucugaugcccucuucugugucugaagacagcugcaguguacauacauauaguaaauaaaucagaaaagaaaagaaaagaaaaggaaaggaaagaaaagaaaaaagugcugggcgugguagcacacaccuuuaaucccagcacucgggaggcagaggcaggcugaguuugaggccagccuggucuacagaaugaguuccaggacagccagagcuuuacagagaaacccugucucgaaaaacaaaaacaaaaacaaaacagaaaagaaaagaaaagaaaagaaaagaaaagaaaagaaaagaaaagaaaagaaaaggaaagaaaaaaaacuuguagcagguuuggagggccacacguuuaaaaccccagcacucaggaggcagacaggugggucucugagucagaggccagccuggacuaggucauaaauucuaggucagccagggcuauagagugagaaacugucaaaccaaacccaacacauccugagacucacaggcucagugugcacuguugggucugcauugcauucucaauuauaauaacacaaaaccccaugguggcuccuggaucccuggcucugguuguuugagguaaaaaccugguagacuugucauccaguguuuacacauugucagauuuuguuuguuucccaaguguagcauguuccaggcccugaggauuuagaaaguauucagagcucagcuagaaggauucaaacaguugucgugaggaacuagaagugggaccaagguagcuuucagggugguaagauuuagauggagggugaucugagaagccugccuggaaggggaggcaucugagcccagucaggaggccacagagggcaggaacacuggggagggcaucacgaguauauagaauauggggggcgggaucucugggaggcuugagaaugugaggcgggugacaggagagggucaggggucugugaggcuugagggucaggggcuggggcucggcuccuggagaguucuauugaggagcuaccuggaaccaaggagacccuguugcaccuguuucuuuugggcacugucauuucuccugggccuggcucaugggcagggcaggguuaacccaggcucuccucucuuugcaggaggauguauaacuuuuucuccacguucaucacuucugggaugcgguuccuccucaaccagcaggugugggcgguggcaggccuggggagcagaggagggguggccugguucugagacucccugacucuggccugguccuccagaucugcccugugcucuaccaugcugggacgguguugcucaacucccuccuggacacagugcccggugagucaggguggggacuggagcuggggccggggauagaaggaagcugugugcugcuaucauacagcgucucagagaguccccuucccgguccagccauggaacuguccuggguucagaggugucauugacuugcuguguagccuuagguaaguaaagucuucucuugggguucugguguccuccuuggacuggugaccccucccccaggaguugucgagguguuaaauacaugcuugcugaccacagggccuuguuugucuucaucagcuugcauuucaugcauuucaauuaacaugaaucccuuucuaugccaccaugugugucuacuguuggucagugaucuugaccuaucgggcccguuggguaaaggggguuaaaaaggaaggcaggggaaaugacuccuuagucaucuuaaacacguaaaacgcguuuuaacugugugugcaugcaugcacgugcgugugugcguaucugcauccugguguauguguggaggucagaggacaacacuguggagucgauugucuccuuccuaugaguucuggggauugaacuugggcagcacaguuuuggaggcaagcuccuuuaccugacgaagccauuucgccagccccuccuuuucagucuugcuuagugauuugaugaaaaccuuacaguagucuuaguaguagauggagcuaaccauggccuccugauugagccccuacagcacaccaggcucuagcugcuucccauggaaagccaauuugaucuucguaagaccucugugaggggcgugucacuacuuaugaaugaaaggcacagagagguuaagcacugggcccaaugccacccagcuuggacugacccgagccccuucccgcagugcgcaguucuguggaugaucucgugggcaucgauuacucccuucugaaggauccuguggucuccaacggcaaccuggauauggaauuccgggugagcugccuguguuagugccugugaccucugacugcugauggguuucccucgucuuuggggcugagcacggcucugaaaggucacucugaccugcggugacuccugcguccacugcaggguuagguucagccuccuagaucggagguagaguccuaccuuucuauuucuuuaaagauuuuuuuucaagauuaauuaauuuauuuuguguaugugagugcacuguagcugucuucagaugcaccagaagagggcacuggaccccauuacagaugguugugagucaccauguaggugcugggaauugaacucaggaccucugaaagagcagccagugcucuuaaccucugagccacuucucuagccccagcucuacuuuccuaacugcauucugcaucucuguagcuccccagaaguccuuacgccagggacuugcuuacgccuugccugucuccugccugccccagccccugccccugccccugugagucagcugcuaauagucuucuuucgguuucugagggggauggaauccaagcccuccuuggucaccacaaucucaggauguucaaguucauuauugaaaauggugucccaugugugggacauauaaucuucaaacauccauugggagauguguguguguguguguguguguguguguguguaguacacauguggagguuagaggacagcuugcaagaguugauucuccccucccaucuaggauccuggggaucaaacuaggauccucaggauuggccgcaagcucccuuaccugcugagccaucuuguaggccugacaaugcugauuguuuguuugaggcaagguuucuuuauguagcccuggcuguucuggaacuaacucuguagacuaggcugacuuuaaagucacagaaguccucuugccucugccccaaaaugguggaauugaaggcacaaaugcuucuuuuucucuuuuucuuuuuucuuuuuuuuaauuuauuuugguuuuugagacaggguuucucuguguagcccuggcuguccuggaacucacucuguagaccaggccggccucaaacucagaaaucugccugccuuuaccucccaagugcugggauuaaaggcgugugccaccaccgcccggcucucuuuuucuuuuaaagguuuauuuucuuuucuguguguggguggcuuugcgugcauguauugaaugugugaggagagugucagauaccccgcacuuggagaauagacagcugugagcugucauaugguugcugggaacugaacccacauccucuggaggaaccgcuagugcucuuaaccacugagccaucucuucagcccguaacugcuauuuuuaauuaugguugaauuuguggguauguuaauuucaauuuuuuuaauuuuuuuuuuucauuuugaguucagaaauaaguauuuuagcugggcugggugguaguggugagcgccuuuauucccagcacucacugagugaggccagccugcuguacacaccagaagaaucaaggcuacucagagaaauccugucucaaaaaaguauuuuauuuuagggaauuuaagagaaagaguaaggcauucccggcuaauaggaugggacccuggaaguacaguacugucuagcugcuagucugaggccuuuuuacaggacugguggccgagaccagggugaggagagaggaaggagcuggucggucaggguggcucacccaugagguguccaggagccauuuuguuuucagucuccucaaguauagcuucaaggcaggagugacagauaaccaggaagcaggaaucgagcagcuccugguguuccugcccccagcuaggacuuacucacugcuggggcaguguguguguguguguguguguguguguguguauguguguguguguguguguguguuucuguuccaccuggccuguuucuaccuucucaucccuuccuaccccaagggguaagugccuuuagggaaggaauuugggagccaucagucuggcuccuuggaacugaguaaguugucagguguggcaguuggaguaccccuccagugggccccauuuagaugggaccuggagagugaucaguagcucuguuuguuuagcaucgggguguagugaggguccuugacugaugguugguuagugaugugauagggaagggaagacgagaaagggaccagggacccuugaguggaggaaacaauucccucccagugggaacaagcagcguuuauagaacuuagcaguccaagcccuaggcagagaaccagaauaaggcugaaaguagggcacguucaucaagauggucagugguggcacacgccuuuuaucccagcauuugagaggcagaggcugguggaucucugugaguucgaggccagccugguuuacauaguacguuucagaacagccagggcugcacagagagacccugcuucaagagacaaaaacaaaacaaaacaaaaaaccaacaagcugggcaugguggcgcacgccuuuaaucccagcacuugggaggcagaggcaggcagauuucugaguucaaggccagccuggucuacaaagugaguuccaggacagccaggacuacacagagaaacccugucucaaaaaaacaaacaaacaaacaaacaaacaacaaaccccaaaaaaaucugaaucaaagcccauuagcauccuuaacaggcucagacaagcaucuauccacaauuagcuuaguggacguucucuucucuggccuucgagugaugaacccacucugccuuccagcguuuuugacaucugggacaucaggugaggucgcucccagcuggauuacucccccuucagucccuggccaggaaaucaggaauuacuggggugucuuugaauuggauugaggccuuuucuuuugcucaacaugugcuuagaaguagggggggccauccugagcccauaauuuucagggcuuguuuuuuuuuuuuuuuuuagacguagucucacucuguagugcuagauggcuggagcuccuauguagaccaggcuggccucaaauucauagagauuuaugugcaaaaagcacacccaccaggccuggcagcuucagguucuuauuucacaaauuugaagaaugaaauguuggaccacagcggggacuuuuauuaguauuuuauuauagggagaugaauagaaggcagggugccuacugaguaggagugggucccaggaaauagggcaccugcugucccugcuguauucauuuuaaggaugugaagacuugcacaaggucagcaguugcuaugugaccaccucugcuguggucggcagcagaauguucuaaagagucugcagcucaaauauccuaacuucuaauccugaucccaccccuggcaggcugcauguccuuaggcaaaggguuucucccugcccccacccccaccccacacacaccugggcuccuuaccugauauguagguacaaaggacagcuugagagaacaugccuuccagggcugugguguggacacacuuucuguuagaaacacuccuggugguacaugcugguauguuccaacacacaaaagacugaggcaggaggauugcccugaaguugaggccagccagggcuacaucucaaaaucauacaaauagagaugggcagugaguaccuggaacuggguagccaugauggauauguaagugcugcugugauucaaaccccucauuuacccgguuacacacuuuaccuucuucuuucuucuucuucuucuucuucuucuucuucuucuucuucuucuucuucuucuucuucuucuuccuccuccuccuccuccuccuccucuuccuccuccuccucuucuucuucuuccucuuccucuuccuccuccucuucuucuucuuccucuuccuccuccuccuccuccuccuccuccuccuccucuucuucuucuucuucuucuucuucuucuucuucuucuucuucuucuucuucuucuucuucuagauuuaucuauuuauuauauguaaguacacuguagcugucuucagacacguuuucuucuccacucccacucucucgcugucuucagacaccccagaagagggcaucagaucucauuaccaauggcugugagccaucaugugguuucugggauuugagcucaggaccuucagaagagcagucagugcucuuaacuucaguccucuuuguuucuuucuggacuuaaucauguuuaucaauguguugcccacuggauguagguguaccaauggguaugcagugccagggaggacagaagguggagucauauccccuggaacgggcagacuguugagccacucgcuauguggguacugggaauugugcccaguacucugggagagcagcacaucuggagcuuaacaucuggaccaggucuccagcuccaugccuugcuucucgugcucccugcccugcuccucugcccuccaagccucuuugcaaugcuuuuugagagauggguuugugagccccuccagagcagccauagaguccauuuccgguggcuccuggcugugccuggcgcggauccaaucugccuugacccugaucuugcguucccaaucccagggagcauucuucccucugaaggaggacaacuggagccuccccaacagggcgguggagccucagcuggaggacgacgagaggaugguguacguggccuuuuccgaguucuucuuugacucugccauggagagcuacuuccaggcuggagcgcugcagcugacacuuguuggggacaagguauagcagggccugucugaggguggguuaagaacggcccacgauagaguccaauuucccugucucauuucuacuuccccguucaggugccgagugaccuggacaugcuucugagggccaccuacuuugggagcauuguucuccuggugaguguuggccagaggcugggguguggccagaggcuggguuguggccagaguuggaaguuaccccacauacacaacagugagguggcagguggaggguauguaggaguucuuuggugguggcaggcuguggaggagacggacgccuuuugccugcggccaagucccccagccuugccaggucuaucucccacucugugaagcaggguuggcacuucuugcccccucgccuucacagagcagcugugagguugggagagacccagagucucugcaaugauuaggcugcucauuugcuuacaucaucauuauuauuauuauuauuauuauuauuauuauuauuauuauuuuacacaggaggagaaaggaaauuaaaauuuuuuaacaggagguuagagauauauuucaguuaguagaauagcauagcaugccuaaagcccugaguuccaucucuagucugaaaauuuuguaaaaaaaaaaaauauauauauauacuccauggggcuggaaagaugcagugaucuugcugcucucaaagaugguuugguuucuagcaccuaugugaugauuaacaacugucugcaauuuuaguuccagaggacccagcgcccucuucuggccucugagggcacugcauguauguaauauacagcucuacauucgagcaaaacuacccauauacauggaaauaacaaauauauauaucuauuccaugugccauuagugaacauaaucuuaguucaauuuuguacaugacagaaaucccggucaugcuagccuucccuacauacaaccuuguaagccugucaugaguuuccaaugagguaacacauguaauuagcagagcacugcuacagagcgcguguccccugaaacagcugguguuguuacugccgucggugucuuugucaugcgacugcugaguaguuagaagcacagauugugucgucaaggcugccugcauucgucugucagcucugcagcugaacaaccucacgaccuugcacaaccuuagccugucugccucaguuucccaggcugaaucagugagcuccaguuucagagcaaugcucugucucaagaaauaauguugguuauguaaaagugacaaaggaagccaccuagaauugaccuuuagcaggguauauguacauacgaauagauacauacacacacacagaguggggauaauaguaccugaaauacuugguuguuugagacuuaaaugagcgaauacauaugcuguggucagaaucaugcuuaagggaauguuuguuuuugagaccggaucucauuaucccaggcuaaaauacauacauauaaaucugaaaguugccugauccuccugucuguacucccaaagacugggauuacagguuuugcuaccacacccagcucagcaucauguuuagcaauaaguaagcuuaugcauuuaauaguauuacauggcccauagagcggccgggagaugagggggccagggcugggauguuuaagcaaaaaggccauaccuagggagucccaacuggggucugagucagagugggaugcgugcuauaacuucagcauuugaaggcugagccacaggagcaccaccgcuguccaggguuucaggaccagcuaggcaacaaagcaagagcccaucucaagagaaggaaggaaagaugccauuugacuaauucuuggggucaggguguaggucagaagcggggugagguggcaccccaucaucugaacuugcaaccccuugccuccgaaagggcugaggcuuugucccgugacaccaccccagugcucccaccgugaucugccuuccuaacucugccuccuccagaguccgacagugauuaacuccccacugaagcugaagcuagaggccacgagcccuccacguuguaccaucaagccgucaggcaccaccaucuccaucaccgccagcgucaccaucaccuuggccccgcccauguugcccgaaguggagcuguccaagaugaucaugguauggaccccaggaccaggguaccugggguucggugagaagugggcuguggaucuuuccuguuuaaaacauccccaugcccuuuccuucaggaaggccgucucagugcuaaguugacacuccggggcaaggcgcugcgagugaagcuggaccuucgaagguauucccagccuuagcaucucuaggauagugguaccugcucaacagaacugcagggcuaaagcugggcuagaacuccuguaaggcuauccagaguuauauagugagacuaugcugagagagagagagagagagagagagagagagagagagagagagagagagagcgcgagagagagcgcgaguaaacaugacacauaccuuuaaucccggggauggugaccagagauagguggauccuugcaaucuuagaggagagcuagccugcccuagguggugaauuuccaggcugaugaaacaccagucucaaacaaaaggagggaagggcuaugaacaaauacccugaaugcuguccucuaaccuuuacaugcaugccaaggacacacguaccugcaccuacacauccaaaaucuaucugaccauguagccaaagacgauccugcuugcaucuccagugugcugggauuacaggcacauacuaccauguccugucuauauaaugcucagggacggaacccagagccuagugccuggcgacuggcgacacuauaccaacugaacuacaacucccagcucucaaagcacuuuuuaucucuuuuuuucccccccaagacaggguuucucgugcagccuuggcuguccuggaacucacucuguagaccaggcuggccuugaacucagaaaucugccugccucugucucccaagugcugggauuaaaggcggucaccaccaccgcccggcuuuuuuuguuuguuuguuuuucaaggcagaguuucucuguauagcccuggaugucuggaacucacucuguagaccaggcuggccuugaacucagaaaucugccugccucugccucccaagugcugggauuaaaggcaugggccaccacugcccauaucucuauuuuucuuuuaagacaaugucucacuauguugcacuagguagacuggcaguggauguauagaccaggcuggcuucaaacucaaacucagagaagaucuaagaucugccucuagagugcugggauuacaggcgugugucaccacuccuggcuaacagugguuuguuucuuaaaccaacucccuugcauucucuugccuucuagaagcaggcaaagcagguauucuuagagacaagcaaauugcuucaguaagggcaaacgacacgccugcagucacauagcagagaggauggagacauugguuugaguaucaaccucagcucagcucagcaggaaucuggaagucauugcaucuuuccaaggcucauuuccuccugugcuaaauacaggugaauaccuuguacuuccgagggcugcguaguuaauggcaucgccucaggaugugccaguggcuacauuuguauaauuauaauucaacagcuguugggcugcagaagucacaguucauuaacuaguggcuacagaguggacaguguagauacagaaguuguacugugcugcuuccagguugaagugagacaaagguagggucuagcccacacagccauguaacuucaagcuacuuacuugaucaacuucaguuucgucauccguaacaauuucuaauagucccagauucucagggcugugagugagggcugagucacuaggugguuuacaguguugcagcucggccagguaauucuagcaccagggaggcugagauaggacauuugaggugaauuugaagccagccaagacuaaccuauguagcaagacacuguuucaagcaaacaccauaacuccaaaaaacaaaacaacccccccaaacaaaacaaaacaccccaaggacugaagaguugauuugaaggaauuugagaaugaguguaugaguccuaaaacucagaguagaggcaauggcuugugaccccaacaguggggaaagauagaagaucccuggggcuaacuccccagucagcuuagccaaacgcuggagcuuugggccaauaagagauucuggcucaaaacaugguggauggugugaccauccccauccuucacaugcacauguccaaauccacuccuacacacguggaccuucaugcagacagucucucucucuccccacuccccaaguggcacauauauuuauguggcccugggaauggaacccgggcucuguaccugcucuucaucuccaguccagcauuucagcuuuuccccuuuuccuugcuuauuguucuucuguuuuacuuuguuuuuguuguuuuucgagacaggguuucucuauguagcccuggcuguccuggaacucacucuagaccaggcuggucacaaacucagaaauccaccugccugucuucugagugcugggauuaaaggcaugcgccaccacugccuguuuuuguuuugaaugagacagggucuuaauauguagaccaggcuagccuggaacucacagagacccccugcgucuggagauuaauggcaggauguugagauuaaaggucugugccaccuuggcagcucucaaauuuguauguguggguaugugugugugcauguaggugcaaaaguaaugcccucuccuggaguuccaggacgucgucaauugugugucaugggugcugguucccccgagaaguaugagcucuuagacacugaaccauccaucaacuuucuccuguccucuuauuugauaagugugugguauguguguggaauguguguaugcaugguguguaugugguguggugugcgaugugugugauguaugcaugugguguguauguguguguguggugugguguguaauauguauauguacgggagccuggagagaucagaaugcuucagauacccugaagcuggaguuauaagccaugugagcugccagaugugggcacugggaaccgaauucagauccgcuagaagagcagcaagccuccucccccccccccccuuuuuguuuuguuuuucaagacaggauuucucuguguaguccugacugucuuggaacuuacucuguagaccaggcuggccucgaacucagaaauccgccugccucugccucccaagugcguguuccaccacugcccagcuagcagcaagcccucuaagccaucucuucaguauugugccccuccucaaacccauuuugagacaaaaaaaaaaaaaaaucucacuggggcuguuugcaaacucaaagaaagccaccugccucugccuccugagugcugggauuaaagaaaugggccaacacagcuggcaggcuuuccuuuuuguaauuaacucgugugugugagcuuaugaacauaugcauuuaugugugagggcacucacgugucacacagugcauugauggucaaaggucaaccuguccagucuccccucuaccaugugugcccuagggaucaaacucaagcagucgggcccuuuacccaccacacugagccauuuugcagagccauuuuaauucuuuugaauaaguuugguaucugacagagaguaaagauuguuggaauuuccuuagauaaaaccauacuuauuuaccuagccgcagagcguggcacauaggcauuccugacaaaugaaaaacagcaggcgccgggcagugguggcgcacgccuuuaauuccagcacucugaggcaggcggauuucagagcuccaggccaaccuggucuacagagugaguuccaggacagccagggcuacacagagaagcccugucucaaaaaaaaaaaaaaagacaaaagaaaaaaaaaaagaaaagcaguaggcuuaaagaaagggggcuccagagaccaaaggcacucagggaugcacaccugggaaauggcagcuaccugaaggaugauuggauagaacugggaaggcugucacuugcugccaucuuuuagguagggcccaaggaaaggguguucccagguuucacgguguauuucucucccacagguuucaaaucuacucaaaucagucugcgcuggagucucuggcggugaguuggggauggcaaaggguggguccaggccucggggcaaguuggccgcucacucaaaccuguaugcacugucugucgccccccccugccuuuuuuuucccccucagcugaucccacugcaggccccacugaagacacugcugcaaaucggagugaugccuuugcugaacgguagggacugagggugggaggauggaguggggacacggacuaacaaaggggggacggcgguggaugguggacaugacgacacagauggacugauggacacccaggcugagcuugccucucucauccacagagcguaccuggcguggggugcagaucccccuuccugaggguaucaacuucgugcgugagguggugaccaaccacgcgguaaguacauuguggaaaggaggccguagaccagggcauuccugucccuacaacaccccagugcuugucuguuuucccgaaaccccuuuacacuaguugcuccuucacauauauauuauuuaaguaguaaagauuuaacuuagaagcagggccaugcuccagagaacauacgccacgccgcaaagcagcuggggccccugaggggauuugcucaagagucuuguguuuguuuggaggcuguuuccaaacaacugaaccagccaggcucccuguccccucccgcagggcuucgucacuguuggggcugaccuccacuuugccaaagggcuucgagaagugauugacaagaaccguccugcagacguugcggccucccauguccccccacccucugcugcagcugccugagcccaucaccccaccuggguggcuggcauucaggaaccuaacugaagucuucucugcacccccugccaaccccuucccaucuacaguguuaguggucccggugccacagagaagagcccaguuggaagcuauacccgauuuaauuccagaauuagucaaccaucaauuagaauccauccaccccccuccuuggguuucucuagcucuguugggguccugggguggucaguuuuuaugcagucggggaggucaggccaccccacgauggccggaacaaagugcucacuugguccuaggcugucugugacgcccugaggcccaggcugggaugcaccaggcugugagaagucugggcaguuuuaguacaggacuugccccacgggagcauuagcggaggacuccucucugcugagagaggccgagaggggcugaucagguacugaggauuuccauggguugcagcggaagcuaucaguaaggcucuuuguucaggaaccucgagaacaugguaaaagcagcucgaggcuuguccguggggaccauguguccggcacccugggga

SEQ ID NO: 1271 - RNA, 38451 nt, Mus musculus
cagacggggccaguggagcggcggcgggacgcgggcgcggagcugggccucggcgggugccgggugagugagggacgcucggggcucgaggcagagagacagaguguugaggguugggagccggggaccgagguugggguugaggcggagggcagcgucugcccgaccuccaagcccgggcacggugccgauccgguaaucccccugcggucgguaccggcccucuuuccuucuccacugcccggcuucgguccaggccgcucucauucgcuucuucccgcagcauugcaaugcccggggugcuccggugcugguuuccacccuccccuuuuuccgggcccugcagaucugguccuucgccgcccucccuaggcuuaggcugcucccggccugguucuguuccuucuccaucccucgcucuggccacccucagaguccgccgccccuacgucuagucuaguaaacuuuuuuucaucuucccagucuuccuuccgaaggcuuccggggucccgaguucugacccuggugcgacacucugaacauucuggugucccuacacaucaguagcuuucaacaguuugaaaguguugauugacgucugccugucccagcagguaggaaugcccaggaggaagaagaccuuaccugauguugcuccaugcacccacagcgucucagcaggccagacacuauagauguuuacuaaaugaaugaacgaagggcuagaguuugccugggggaugcagccgcagccccugacaucccaucuguuguggguggaagccaccuuuuggaaugcuuucugugugccgggcacuaggccaaccugggcucuccaaaagagaaauaaugcaagucacauuuguuaauuaaacuuuucuaacagucacaucucaggaauguaaaauauguaaguggaauaauuuacucaugcuuuaguuaauacauuucagauuauaauuaggaauucacauaaccaauguaaaaucacguuaauggaguuguugacuguuugugugugugugugcuaacuucuugagcucuggugugccucacucuugggacagcacuucuugcuucucagaagaagcacggcagccauuugucaaguggucggucaguaaccacauugcuaggguggcugccuuggcugugaagugcucaguagugugcaaaugugagggcguuuaguucgaguuguggucuuuugaggagacuaucauuauuugcauuuacagauuaaaaauagcaaagauccuaaaagaguuuaccugcccagauucauucuaccguuuggagcaaaagagacagggcugguucaagaagggguuucucuguguagcccuggcuguccuggaacaaucucuguagaccaagcuggccucugauuaagggcauguucuaccaugcccagcuugucuguugcucuugaaucuuguuauucuuuuuauguuugaugcugcuucuaagaggugccaagaaaguuuggggugcaggguaugaagacuagacugcuuuuaaaaaugaugauaccaguauuuagcauacucugacacgcucugugccuaggucauaucuuccuggguggcucacgagcaaacauagguaagaaauaccugcccuggguuuggagguaugcaccgguagccagagcacuguaaaggcuagcuagggcagaaggaucccuugaauacaggaguucaaaaccagccugggcaguggagugagacuccagcucaaaaagaaaaacccaccaggcaagaccuccucugaccaagucaccgacgaucccuuggcucacccacccgcauuaaugcauccuggucccaggguuggagcagaaaaccuguggccuguaagagcucagagaugcuggggauacugggacuggaguugccagcagggcggguuaauucucagucgcuccacaagggaguuuucuccaugaggucaguacuuggccccuugaggccccuuggacagugaagugacagcccuagucuucaggaugcccaggguggucuuggaaagacaagaucauguuucguaagaggacgagcauacguguaggaaagcgcauggugggagaggagugucagaaguugccaagcggcaucuuggcccagcugcaugaagaaauguaucugucuccccugccccccacccccccaacuaagcuugaacuucuaugcuggguagcacuucuuagcuugcugggucccugugugugagcugcaugguuuauuuaccugccuggcugcuuaaggcucuugaauuccucaacccucugggagugcucacugaauuggagcggcucugaccuauuggcugaguaaccguauguacgucauugugcugggcugcuacggaaaacagcauguuuucugugggguuuccucccccacggccugagggcuccucagugcuggccugugugguugcaguguuucuguucacaugguuagaauccuucuuacucugugcuagguacuguaugcagggccuugcagguauuaucccauuucauggucacagggcuuuuacagggagcaguugguucuaauccuuggcuugacuauaauagggagguugucagaacugggauccaaaugcaggucuccaggaugcaagccccuaaccacucaaugcuauugcugugugacggggucaaggcugauaaacagcccauucccugccuccacagccagugcagagacacucgugcuugcagcagagcuguguggcaggagaggacugacccagaaguggaggcugggccuuuuuugcugucccuaacuggugucccggccuggccuugccaauuccucuggaccucaguucccuucuuuaugaaaugagaggaaaggcuuggccucauucuuagagaacaaugcuguguuuuuauggccucuauugaaggaguugggcccguagccugcaguuugagggacagcccaggccacucuuagccugcugcgccccacccuuuccaggcuccuccuccugcugugccccacccuauccaggcuccuccucuuccuugugugaccacccugaucuguuggugagaaggauuuaaaaugugaauuuauuuuuauuuuguguguguggauguuuugcuugccugcagguauguauguguacccuaugcgugccuguggaagccagaagagggugucggauccccagaacugaaguuacagacuguuguuagcugccaugugggguguugggaguugagccaaaguccgguauaagagcagucaccgcucucaaccacugaggcauccuuccaggccaaagaagcaguuucuuagaguucauccugucuuuuccuguucccucuuaaaucugacccuuugugacucaauuguauaauuguagucagggaugugcaaguucuuggacguggauagaauagucacugaugguucaugacuuuaaucacaguuaggccggagggcguuuuagauggaauucuguagacacagcuuugugcugcaaacuaagggccaguagguagggacuagguauaccauucagagcucugugcucaggccauuucccuuccuggaccagggucuccagcucagccuccaggaaaaucauuuggggaggcuucagcagcccagcuagcuacggggguauacacggccaccauggggagcuggagcaugaguggcucucaaccucgcuaaugcugugaccuuuaauacaguucuucauguugccgugacccccaaccauaugaguaucuucauauuuauaacuaauguugcuacuuuaugaaucguaauggaaguaaguguuugauaugcaggguggccuuaggugaccucggugaaaggaucauucaagacccucaaaggggucaugacccacagguugagaaccacugaucuagugccuucuucaugaccccauggugcaugugaaccgcccugaguagaugugaaggcugguccugauccagaggaugugggcuggagggccgcuucccauuaguacugauuccuaagggguacccugcguguccaguuaccaggcaagaggcuucagagacaagguuguaaaagcuggagauucacgcucaucaaaaggugcccaucaaggccuggcaugugcuggcgucaccagugccugaugacugaggaugaggaagccagaagggagggcuugucugagcacguacuaguuggccguuuggauugggcguuggagcuaguggacagcgaaggugcagagucagcgugguuuucaggggagggggcaggugagcgguauguggcauccgcagggauaagaguagacaccguggggcuggcccagguuuagauaucccgauaagaccguuaauguaguguccucuaaggacuugaguuccacaagggaugcguuccuuaacgcauacuuugucucugcaguggcucucagccauacuugggcgaggccuguguucuguagccaguacggaggagaacuuucuucugcguuucuuguccucaccuucuauccuguggcauuuccucuccugcaccucuucgacaccucagggccucacgccagcucagggagggugaacugagggaaacugagucauucuuccaaugaaaagaucacagggggaagccuccacugagauugugaucuugauuaaaaagagggugugaccuccacucaccuccgcugugaggcagcacucugucacaggaagcauaaaccacucgccaggccucccccacuguguggcaagcagaggagaagggaaggcacacagggacacuacaagcuggggucaggcgaggcugggaaccuuguggccuccucuguccccuguaccuccugggaaggauugccuuuccucuucugaaguugggcuccaguucugcuggcaaguucagccugaagcuucccugcuggggggguggacagaacuccgcggggccuuuccugauggcacaccccuuccagaagcugcuuggagaccguuccacuggacagcauccauugccacccgucccgcuucucuggcuauucaguuggaggacagcauuaauacuguccuugcauggcucuugaaucugugugggccuccuucuguuugccucaucgccuuuguauuuguggugccuucaaggcggcugcaggggacuagggccuugcucagucccaaaggcuugccuagcaucccggagguagugaauaaagaaagugggggcggggugggauggagugggguaggaugguggugguagaggaggaggaggaggaagaggaggaagaggaggaagagaagggucauugguguuggaaggggcuguggacugagagugggacuccagugcacuuacacuggacgauugcuaaugaacugagugcaguacucugagugguggagcugguggcuauuuauagcccugagaauuuugcaauguuauugaauugcuucgaccuaauuucccacuuccuuucuaagaugaaaauggagaguaagcacaugcgugcuagagggcuucccuacgaggggauccuucauccccgagugcucccugucugggaaguccuguuaaaucuccucccuuccuugguuuccaggggagggagaagagauuguuuccccuaaggagauucucggggaaggcuugcucuaagcuacuccugacaacagaauuguguggggacacuguguugcaaggcuuccggaccuggugggagcaguuccugccucccgccuguuggaagccagcucugcucuguaggaguggaagaagccagaaccauggggcuucagugugcagguccuucucugcaggaggauguggugagggcguuugugauuccauaacuauacuagaccuacaacagaaugugggaacgggauaugcaugugaaagaaugauaccaaccggaggugagguccaaacuggucuuugacgcuugaguaggaaguuucugacagcugguaauagggacuuggcaaagcugcaggagaagugaggaagcuuggccucaaacagccagaaaggggcugccucaacuggcccgaacacacucgagggaguguggguggccuucuguagacuguggagggccccuuccuuccuuccuuccuuccuuccuuccuuccuuccuuucuuucuuucuuucuuucuuucuuucuuucuuucuuucuuucuugguuuucgagacaggguuucucuguauagcccuggcuguccuggaacucacuuuguaccaggcuggucucgaacucagaaauccaggagggccauuuucuguuagauggguccccaagcaucucuggcuuugccuuuggguaauaccgaccugaagucucccuugaguagcugugauggucguguaccaggcugccuucuccgauguggguuucuaacauuccaggugggugacugaggacgccccugacuccucuugucuagagagcacacaccuacaggcuugcuauaugggccagguggcacaggucugacacugcagcaacucaggaggcugaggcaggaggauuacaaguuggacccgggcaacuuuuugaaaccccugccuuaaaauaaaaauaaaauauaaaauaagguuaaaauagagcugggugguauggaguguucuccuagcaagcccagagcccuaauuagcugagaagcucaguuguaagugaaggagacagauagggggugggagggaggcuuugaguggugccuucgaaugaugucauuguuagcuaaugcuauccucaucacaggaaggacaguguggagggagacugaacucuggcaucguugagacucaguucugauauaauucacuucccucuugucaucaccccaccccgagccccggcacccacaugccccuccuucccuuccagucagaugaugaguuucucugaacuuucaccuccuugcugguaaaaaagggcuguuuucaggguuccugaggcaccagcuauaaaaugauaugggagcagugaguuagaggcuguucuugacuaucaugucugaagaccccagagucacccuguaagugcucugcuguaagcaaacagguucucccuaaguggguuuugcucaugaauguagccagcguuagguaagugcccacuggacacuucugucaccuuaugccaugacaccccugucuauucuggucuccauuguaguuucuuaagcuugggacgguuggucuuggacuauuccuucgcagcgagcagaaauacuggcuagcgggaaaugucaccuggacucugggaaggggucagacucugcccaucucuugggauuuuucucauugcugguuuuaggccuccugucagcuguauggcauagcuuucucugcagggcucuuggcuuuucccguggcguuggcuugugaguggcucuggcuggcccugacacaguagaagcugugacuuuccuguccucauguuuguugucucucagccucucaagucagcgucuuucaaguucagaaauggaauuagaguuguccaacuagaccugaguguuacuucccuucccucuagcuguggccgcuggcugucacuugccaccaauaaauugcuugacugugggaagacagucuggacugcaggccuguuacuaucuuggguggccaggguggcuggagacguucuugcuauaugcgacauggguugaaaugaaugauccacgaccagcuuugauaaaugaugcgauggccuagagcaaguuauuugggaccaaaaacaaagugaccacacucagcggguccaccuccaaaggaagugcucaggaagaaguucaggaagugagcuguguuuccuaauggcagaguaaggguuaacuucuuugaggaacuuuaaaaaugucguucgcauuucgcgcaguuuuauguucugcuuuggaaucaugaacuugccauucagagggcacccagagcacuuuagaacgagcauucacauuucaagaacagaagacugagacuuggguaaggaagggacucguagaagccacgccacucagugggcugucagccuaccugauuucuucagugggaacaguguccuagcccgcagcacuuuucaaggugccugcuguucacugugugcaugugugugcaugugcaugcacguaugcuuugacccucugagccaucuucccagcccucaauaauuuugaaaaguuaaaaauaaaaccaaacaaacuacaaaacaacaacccagauugacaaaugcccugggaggcuguacugcacacguccauuuagaggaagcacaaacccaggcccagcuccuugauggcagucaugucuguaggaacagaauuggaggcugguacauugugugccguggugaacgcguccccuguccugggcggaggcuuaagggagacauguguuucuauuuuuauuaucuguguacguaugcacaaauguguagauaugcuuccggucccugcauuucacuguagauuacaucaguugagagcaaugccccaccucagaugagacacccugcugucagggucacagcaccacccuggcauagcacacucugccuugcugccacuggaauagcaccuuauucagagguuagccucaugaggcagguuuccuuucagggguucguuuugggccuagguaugcaagggcuacaugcaaagagccgcagaggcagaggcagaggcagccgcccgcugccguuuccugaggccucguguacuuagcaggcaggaguucagaccugcgcaggguaaagggaauugcuggcugggcucuaagcccuagccaccuuuccuacuuacuagccgggucaaccaggacuugacaagugucaguccugaccucaguaagucgggugcugcccugccucuuucucagggcugcugggaagcagaaguggguguccucucccggccugauggguuugacagcugacucuugaagggcacagcccaccccucaggaaaugacccaguaagccuccuucucuccgccuggggguguagaggacacacuucaccccuauacacuagagagguuugcccccaccaggcugugagaaccugcauccgcugggccuggaaaacugauagcacacacgauuaacagcuuagccacagugguguugcacacgcugacagaggcaggugguccccauuagccaggcgugaacugcaggcgaguggcugaacccugaggaggcaaaaggucuuuuucauuaagagagcgccugcucccaaaccuguaggcaaggaguguaaauauacauugaacuaauccaucagcagggugacugccuuccucagacacuggagagagccucagcacugcccagaauaccacuaagccaccagaguugccuaggagaccagucacaugaguccaucucccagacucgccccagcugauuuauuucccuuuauucugaagagcagugggggcgggacuuagaugcuguucccagccccgcccuguagaggggccuuugugugagagcauccuuaggccugcacuugcaccccuggcaacccuugcccuuggcacuggggaccaaaauagcauuuccugucucaguucucuucccaguguuuggaacuccccaccaucccacagggaggaggcuccacauuguguccuuugcagggacuggaguggcagccgcggguggggaagagagagcguggcuggggcugccgacacugggaucuucccgagugugacugcuaagcagaaguggccuggccccuucagcuacccguucaaccaagaaaagacugucuagucuucucuguuccagggcaugugugucucucuucccgaggccccgagaugaggauuuacacuaugugagcuccgccccccaccccaggcccgaugacccucacacugucugucugucacacugguggaucuugcugcugcccgagcugcagaugauagagaggcuugcccuguuucucuugcugauugaaucuaaggagacagcagcccaaggagaggcugcagcaggagcuggagaagugcaugccgaguaguucacaugucacuucagaugcugucuucagagcuccaaagugcacugugagaacgagcaggaaggcacugucugaccucuccuuuacggcucucucuccaggcagcugugucuugaagaagggcccgccgggaacaaugccgccuccgucugacauugucaaaguggccaucgaguggccaggugcuaacgcccagcuccuugaaauugaccagguaugccccucccaugagagucagggcugucaggagagggucagguccauaaugggggauguguuuaggccuggaggccccuggcaucguaaguaaggguggcaacaggagggcugaguccccguccuccccgggaaaacagucacugugguucccucaucagaagcacguggugaagaaucuccuccccucucuuucagaaacggccgcuggcauccaucaucaaggaggugugcgauggguagguggaugugacuucuuuccacagugacagcugagaggcugcgucuuaucagggaaggacagccgaugaggucccugaggccuccugagguccucauuuguuccugggccucggaguuccugggccucccaugccccucugccuccugccccugcuucuguguugcugacccucagggacucagccaaagcuuuguuuggaucccacugugcugcaaaccggcgggcaagucccugggugacuucugaaaaccauuucacugcugcucuggacaagacagaggagaaggcagcaggguauacuguucucuccccacagguggucacugccgaacccggaguacuacacccuccgcuaugcagaugggccucagcucuacgucacggagcaggcaaguccaggaaagccgagggcagggcaagccuugcuugcagugaccuguccaagggaccugcacacucugacucuuacuguccagguggcgccaggucucgauuuaaagaguugcccuuuagguagugaggaguauaccagcugguucccugguggcugagguugcucuugagcaaaaucuugagaaucucuuuguaagaagcaaauaggaggaggccuagcugcagaagaaccuccaagugcuacaggugucccuccguagccauggagaggggucccuagaagcccugggcaccaagucuguagaggugcagauggcacagcuagccaccugucacccagacacaugccugucacccaggcacaccccugucaccuaggcacaugcuugucacccaggcacaucucugucacuuaggcacaucccugucaucuaggcacauaccugucacccaggcacaccccuguuacccaggcacacuccugucacccagacacaucccugucacccaggcacaccccugucaccuaggcacauccccucacauuaaaauccucccuaaacugugccccaugcagugggugggccauggcuguaccugcucuccagcaaugcuuaggggaccagacaagaacaacaggcagaaauguucaaagcaaaccccucccccuguagauuucuucaguucacugcuagcugaauccucugcagacgaggaaagucacugugaaaauggccaccaguccuuccugguucaccuccaugcacuguuuuaauauugucuuuuuguuuuguucuguuuuauucuuugcuacccagacccgaaaugacauuaagaacgggacaaucuuacaacuggccgucuccccgguagguauuccagucguccuggcacaggagcgccugugguggcauggacacugcccuacauugagaagaagucccucgcccucacagcccagcuggcagcucacaagcaggggcagcagacagccgccuggcuguagggugucugagagggaccaccuuccccagcguaggggcuuccagaaugcuuucccagagauggggacccugagcauagaggcuaacgcugugggugacuggaggaagaagaaaugugguuccuuucuaguguagaagccagagcugugagguaugugggggagaccaguccugaaggcacucgcauggccgcccaugcgugggcuuagacuuuacucagaaagaaauagauuccaugagaaaugugcccugugcguccuauugaguguuagaaaggccacauucacaggcaagcaagagagacugguggaagagugaucucucagagacugguaaggaugaggucucagcagaggcagugggauggcgggauugacagacacgaggaagccuuaagagauaaccuuggugaaugagugccagggguaggagcagaggggcgggaccuuggggacccucccauucuguauaagcagcccaucaaggcgaguaaaggacgcagcuggaaaggaagugagaagcaggcgacaggaacaguagaccaggccugggaucccagcacuugagaggcagaggcugaggaucaugaauucaaagucugcaguuacagucuggccaaagcuaauguaggcuccagagaccgugucucaagacaacagggcauagaccgugucucaagacaacgggggggggggggagggagccgugaggauuaucccgaagauuaucgguacagaccaccaaggugccucagccccaccucccacagcaagccagcagccagagagcagucucugaaaguugagggcacaguggagacgcuuaggucugcuacugucuugggagcucagucuccaagggagggaggggggacaggcacgugggagaugugggagccaaaagacguuugucugaaacauaggcgcagcauguuuaaugcguuucaagucucgugacauuuggcagugaaguggaaggcucucugguccuuguguccuacccuccagccugaggcccuuuguuucuccugcaguuuuucaugugucccaugcaugagcucagaugggagagggugaaaguucagggaagggguaaggguucgguccguaucagggcaaggagcaggcuugagacaggcacggucacccgggcucagccuuugucacacuugugggaaauuaaggccauguuuuauuguugaggaaggacccacuuaucuggagaggggauguguagcggagugccagccagcacuugccuuguguuuugcugacucuuccugacugcaucaguucaaccgagagggacacaaggagaccaaggacuaaggaugaauaucuugccaccugcgaaacugaaaaaguagccaagccagguucagacucgggccugugagccucagccaguucacuuagcagcuuguucaucuuccuucuccccugaaggagcuucucggagcaaagaccucaaccuccccauguccccacaaacgugagccaggcucugcugacuucacgugacagucugaggaagggcagaccucaguauaaaguggagcaggggacagcagcuggaaaggcugucucuggagggagacugacauuuggccuggaaguuucuaagcuccaugcaaaccagugcuugcagauugucucauugacgaccuuuucucaggcacacccuuccuccacugugggauuaggaggaucugugucucgcugagagcccugggcagguaugggccucucuguaacaguuaggcaagggagggggagccagccgcacucccuggccucuggucacuuccugacccugagcagacagggaggcccgcggcacucugcuucuccugcaucucuccagagagaaugucccguucagagcaggggcaugacgaaacagugaacuggagucugacugugugcagugaacuggagucugacugugugguaguaagcuuugcacagggagugacaguggacaggcaccugugcuaggcugcuggaggcaggcacccugcuggggaagggcccacacuagggagcauccguccucagcagccaucacauccaggaagcuguucauaagcucggccucccacuccuucauugcuuccugauugcccacugugcuuuggggaagggugaucaagaacagcaaagguuugucaggcuuaucacacuuuagaauuaaaaggguccuucggggccaucagguuaaguucuagugcaagguccucagcuucuggcagaugcugucacguuccccucaguugcuuggggguagggggucucagcucuucagugggaacuccgucacugacagguaaugcuccccaaaguaaggcggaucugcuucugaggacucgcaguuaggagaugcccuuucuuuauguucuugauaggaauuaaaaagaaaaaucuguagaacaagauggcucgguggguuaagacacuuguccccacgccugauggcuugaguuuuauccccuggacccauaugguagaaggagagaaccaacucugucagauuaacugaugcucugaccuucucacucaggguauagcaugcacacguaugcacacacacacacacuaaacauaauuuuuaaaauagagucauaggcuagagaaauacagaaaagauacagaucagucucggcauguuggaaacucucuuccugguccauaaacauuuauuuagcaguuccuaagccaugugaaaccccaacugcccacaguaguaaccugugcaggagcagauggcaucucuuuugucccuggcuucacagucccgggcugcacgccagcugauggaaaggacccagucaucuaguauggagacccggcuggaugccaugaaggaguuggcuaagcucucagcugacgugacuuucgccacggaguucauuaacauggacggcaucauugugcugacgaggcucguggagagugggaccaagcuccugucccagugaguaucaccagcggcccgugaccagcagggcuccuguucucacucccacgguuuaccccugcacucacggacgcucauguccacauccagagaggucucgucccuguggggggccugcaucucagaguccaggggacucugugacccagugcugugcuaggcgaguacugaaaguagagccuugccgucagcaaggacggcagugcugcacagcagaccuggcaaguuauaggaaaugcuuggccugaugagggucagggaagagaugggaacuguucguggugcucuuuagugaugcugugucacuaaaugugcaugccucacccgaugugcaugccucccucugaaugccacaggucucucccauuugccaucucccugccccacacugucaaggaggagccaggccuuggcaccacuccucagcaccuccacggcccuucaggugguuguggugggaagcugagccuuaucugugaugagcagugagugacagaugcccaggucucuaccuaagccuguagagccuaagcugcaggcaggcagucaaagaucucacaggcgaugggugagcugaagcugucagccaagccaggcagcuaaucccggguauuugcuuuaaagucucggaucuuccagcugcugccauugggagaguuuuggcagcaacagaccagccuuagucuccuccgcucugaaauggggauaacgcucagcucagaguucggugagcagcgucauuaccuccggcaaagggggccuggcuuguuaacuguagagcaccgugccccugcaugaaugauuaaaccuguaaggagaaacaaaaggcagccguuuaaucccugcgccacguuauuguaagggcacugcagaccucuucagucugcccuccccacagcccugugagacuaaugcugugagacuaacucgauuuuccagagcaggaagcuagaguuggagaagauaaaaugagcaacugcucagacggaaaccacaccuggacggcucccucgcccuggggccucuuggccuaaaggcuaaugggagauguaugcucucuuuggucccccugcaagcuucaguuugacaaaggccuuuguuuuugggagauagauaacugacuaagccaggaaagaagcaagacggagaagagcagcuaggagccugcagcccuccggcuuucuaguguaaggaccugggcuguguccacucugcaccgcgcuuggugugcuucaggcacugacugccgccuccaaagauucccauggguguuuacugagcucugucccucuugcgcucccuggcucugaaucucuguauuuugugugugucgcacaugucucagcuacagugagaugcuggcauucacccugacugccuucuuagagcucauggaucauggcauugucuccugggacaugguuucagucaccuuuauuaagcaggugaggcauccaacauucaguucguccccuccucucccucgcagcucucugggcauaaggggagaguagacgcugcagucuggagucucuggcaggaauggccuuugcguuccccggggcugggugugcauccucgagcggcgaucuucccaggacuccugaaagguuuaugcagaugcucucugguugucaguaguucuuaccugauaaacccaucuuauuauguuggaaaugucaccagauuaaagaugaguucgcuuuccuuggccucugaacauccucaugguggcuucuuuguugccuccuggccaccuucacgggaggugugacucaguguccacagccuggucucaagagagguccuugucacuuguccaggaaaaaaauaucucaauucacaauuugccuucucuggagaccugcaccaagaguggggcucagagcagaacugguugucagcgaggcuggcacagagcagcuccucgucagcccugagugaccugcuuccucagcccucugagagacaacugcgucucguuugcauaugugcuuccucuguacaaaucugccaaguagcuugcuugguuuaucagauuaaauggagggguagaagggcccuucucccugcucucagaagaggcagucucagcucagcaggcugaauggaaaccagugacuacccugcugucuacugaccagcgcuucucacugagaacgcuccugcuagaagcauucgggcaaaagugagguggcugugugugggggauuacaacaggacuugagaagaggggugggucuacgggauucuccaggucuggugaagauaaaauaagauacaagaaucaguaggcccacugcaugcugaccccuuauuugauaaggauuaauuuauuacauucuuacauuuugaagaaacacaguugaguggauacugccaccuaagguggaggcauccugcugagggaauccccgcccucucaccagggcagccauaaaccgaaugagagcugccugggcacugcucacaugcagacaggaugcugaggagagagcgccagggcuuuccuuggcucagugcuuuccauccagugcgccucucucugggucuagauugcaggguacgugagccagcccauggucgauguguccauccuccagcggucccuggccauccuagagagcaugguacuaaacagccagagccuguaccagaagauagcggaggagaucaccgugggacagcucaucucccaccugcaggugugaguaagggccccgcccucgcuuggccaguguguucucugaugguucugccuggcccugcacauuccuucagcuccuccuccuccuccuccuccuccuccuccuccccuggcaauuccugucauacguaguacagaccuuagcugccaggcaagguuagacgcuuccucuucugugggccuauuagucuuguuuguacauguuuacguauguguguauguguaaguauauauauauguguacacauacacacacacacacacacacacacacaucacuuguuucccaucugagcuuucuggaaacaaggacucagccauuuuugacccucucucccuccugacgguugguugaucacuuacuaagccaacagugugguggcaacaauaagaaguguaggcuucgugaguuuguguugccggcucggauccaggcucuggugugccaggguuuggccuuaaacuuccugcuccagcuguuggucucacuuuccucaucucuagagauguaagucuucuccaccuucucuacccauucggcucaaaggagaguuaaauacuaguacaguggccggcccagauuaucacccaacucaaaagcuggguuuuaguguguguguguguguguguguguguguguguguguguguguguguguguguuuugcaagcuuaccuuaucaggauauauuuuuuagccuguaauaaagccaggugccacacagguaccucugggagccuguccgugauggugggggcgggacuucugcauagaaggguggucacacaguugauuggcuaacacugacucuuacaccuuccugccugcuggacucaacuggaauggcccaguuccccuauggggcccugaggaugcagagcuccaagacagucucccagaugcaaggcggacguggcuucccccaggagcagcucaggaguggcagcgcccucaaugagcugggccccuaaguccucaaugucaaugauuaauuaagaaaaugcaccacuggcuugcuuacagccugaucuugggaaggcgguuuuccaagugaagcucccuccucucagaugaguguagcuugugucaaguagacauaagacuggacagcacaacugacuacgugucaccuuaaaagacaaacacaucaucaccaugaagccaccuuucccuucuuguucaucccaagaucacacauuaauaaaggcaccacaaucgaaaacacuuuacaaacuuaaaagcuccacagccuuacaaaauucaaacacuuuaaaguugccccuuuaaaaauauccagucucuuuaaaaguccaaagucuguguaaugcucucaaaucuuuuagguuuaaagccucucaacugugcacuccuguaaaaaugaaugcuucccuaugucaagagggaagaaccagggcagucacagacugaacuguaaauaacccggugcccagugucugggguuccauccucugagggguugggucagcucucuggcuccuuccucugcaacgcacacagcuuguuuccuaagcuccuaccugcccacagcuucccuguugcuauuagugauggucaucugcgguccuggcaucucuaaaaugcugggaucugcagccgggcugcacuuucaccaauaguuccuccugcgcucaucauggugcccagccuccgcuucucugcacgaccacuucaugucuucacaacucaugucaccaccugggugacucuuacacuaccaaguucagcugccagagggagggaggggcagccuuggcugccucuucugugugaggcauuucccagauuucaccucagugaugcuggucucuucuuaaucgccgcugguuucucagcggcagcagaccagcaucauuagucccaguaagacaaagguuuuacuuuagcgguucugguuucuuguuagucacagcuccagcugaccagcucagagucuucacacaaauggacuggcggagucuuugcuucccucugaaacuucacaagccaggcuccauccucugaacguucuuaaccuccgaccucccacagaacggcuacccaagcuuugagcacucgauggcuucucuagcccaaaguuucaaaguccuuccccaguccucccaaaaccccauggucaggucuguccuaacaauaccccagaccugggaccaaguucuauccuaguuacaguuucuacugcugcaauaaaacgccaggaccaaaagcaaguuggggaguauaggguucauuuggcuuagaccacugcucaucaccaaaggaagucaggacaggaacucaaacagggcaggaaccuggaggcagaaacugaagcagggccauggaggggagcugcuuauuggcuuggcuugcuccuccuggcucacucagccuguuuuccuguagaacccaggaccaccagcccagagauggcaccacccacagugcgcuggguccuuccccaucaaucaauuaagaaaaugcccuacaggcuuucauacagcccgaucuuauggaggcauuucucaacugggguucccaccuguccacuuaugcuuuagcuuaugucaaguugacauaaaacugggauagcacagcccaauagugcuuccagcccacuucccccauuaaucugauuuuuaaaaaaccaaaugugacuucuuuucccacuggucucgcccugucacugaugagcugagaggaggggugggucuucugcuguccaggcuggccuuggacuguccaccccucacggucugggcuggcaggugugcaccacaccuggcuuccccuugucaguuuuaaagaauucuucugcccagcuguuauauugauaugccagggugggauggagauuacaggcucugcauagggaggauuuugguccuggcgacuucucuguacucuucucugaauuggaggugaccucagcugccucccugagaacaacagaagaaugugacauuucucaggcuucucucaugaauauuuagcccacacugucaccaguguacauauguucagugagggaccugccugaccaagaagcuguuagcccucuggaggaagcuacaggaggcacucacaauauggcagacaaaagccccgagugccagcuaugucaaaaucugaggaaaugcuaguggcuguuuuguuuacuuaaaguagaauacauuuguagucaaaacuuugaaaauaugggaaacugugaauagcguaauauuugcucagcauugcgcucagagccgcuguuaaacauuagcuugaaugucccuccagccuucgccuuugcauggucuggccagcauucagacuaaacacucuuauguguuaaacacucuuaugugcuaagcacucugaugugcaccgugcuuagaaccuucuuuccuggcugaguaaugaaugcaucgugaaugcuuucccaugucaugcucuuccucagagaugcuuccgacuuccccagacaccugugggagcccagagccacccaagccucccucuccuugaggacguccacauagucagccaggugcuuucagggccuuauccaggccucacugguacucaagcccaucucugagucccagguuaauaauccucacucccaaagcgugaccuuucggaggcccuuaggaucucccauauuaagcagccccuagcgagagcaucuggauuacuuaacauugucgucuccuucacaggacuccagcguaacagcuugucacuaagucacacagagcuuucugauuacugucuuggaugcaucccuuucguggaauaguggggucaagcgugugccugcucggaaugcucuucugacgccgucccccgcuuguccuuugaucacaaugugguuuaagcugugugugagcgucaugagcgccgucaucuugcucuuugguccucugacccccugccuccaucucuguugacacagcuccaaccaggagauccagaccuacgccauugcucugauuaacgcgcuguuccugaaggcccccgaagacaagagacaggucuguggcugccuuuccaaccuuuccucugggucggcuaagagaaccgccgcagugcagagcaggcacugcggggcgaagagcagagaucuagcagugccccuggagcucccuccucaccuucccuggccagaacccagcagguuguuuuuccuaaguuagggaagccuuaggaaugaacugggagugggagaccugaugcuuccugggucagagcagauuucugcaggcuuuuccucugauuggccaggaagucaaugcuuuucacuucuuguagcagcgcuucagcuucagcuguuguaggcaaaagcagcugccgacaagagguaaacagugguacggcuguccccagucacagucacacuguuuacccagacaacacaccaauaugccugcagugugcuaacuccugaguuagaggaagaagagggaggggagccccucuaccacuguuguggucugaaggcaaugggacuuaggaacaggcuucaccugugcagucucugguccacacccucggccaccuuccucugguagcagcugugugcuccgugcaguccuggcaagcucuuccugucccagcucgaggccucaccuauauguuggcaguuacagcaucugcccugaccacucacucaugaugagguaggucauuaggucacaugaggccccuauuuuaauagugugggaccugaauggaggaccugggcagagugcuuguccuuccucuggcugggugacuguaucagccuuccagucugaguucaucuuucuaugaagguaaaggacaaagucaagcagccucuaagccuccuaccacacuagaucucugguaaaagcacacauaguacauggaaguaaggcuuucugauugucaguaauaaaggccaacuaaaugaagcccauguggggucacccaccagacucucaagaguuccuuuacuagaagggaggaacagagcauccauaguuugucugucuuaccugucuggauguguggcucugugagcaucuccuucugucuggaugggguggcucugugagcgucuccuucugucuggaugggguggcucugugaucaucuccuucugucuggaugggguggcuccgugagcaucuccuuccugucucuguuucauuguaagccaaaagcucauccugucugcuucucucugugcuuuuugcuuucugcuggcaggacaagcaccuuaacccucuagaccugcccgucacuguaaguagcaccucuguuguugagggccggcucuucugguggggaggucaaagcuuggcaggaagcauacaggcuggacuggcugcucagggaaccaggcccaugggaagauagcauauguccaucauauuggaaugccagaaagccacuggaggugacagucauggaagggagaguggccaggcuuuccgucaugaugccuuugagggagucugggaugagcuuggugucagaugcagaggcagccugacuuucuucaguaugaucccaauaacacggagccuccuggcugccaaagcuggagugaggguuuccaggccuuuucuggauuuuccuaauagauaauugaguaggguuauacaguuuacuuacacccucuucuggcucucucagguaacacacacacacacacacacacacacacacacacacacacauacacagagucaaaacacacauucacaugaacuuuuaagaucacgaaggauuuggguguuuauucuuaguuagggggacacuggagaaggccaccuugugaggacaugcaggaguguguugcuccccaccccagcaccaaggagaagcucaccacaggcuuucacaucucagcuucugcuggcaggugccuaucugagacuuguccacccaggguuuagucccaucugguaucugggaaguauccaggcaccaucuuccucuucuagccaaaauaugcucaggggugaacaauaaaccuggaugcucuuggccaggcaucuauaacaucgacagagguuuagaaauauaggagagaggucacuggacagcagccaccccacccacccagacccacuaauucaccgccaucaauaaaggugacugaaggcagugucuuagaagggaguugucacuguaacuaacaucauuaagacagguugcugacaucagaaggaacggacugaaaaaauugagaaaaguugucagaaaauuagaaacauccugauaugggugaaauuuaacagccccucagagcgagugucacugcagagcgacccccagcaggcuuggaaaaggcuugaaugauaaccacugcauuccuucuugugucuuuuuaaaagauggucaaaauggugcugaugggacccuuagaucucuguggaggacucaaguauuacuagaauacuuuauuuccuggauacuuaauaacuaaaauguugcuguugaaguuugagccaaauaugauggacaggugaaucugaugugaaauguuacccaaaggcccacaacacgugacucucgcagugaggucugagcaaccauacccccgucucacagcccagucugcugcccaggguucuucagcuguggccaucugccuggaguggugcauguccugccgugugcucugcgugcagugucugucaccagcaugcuuguaacacaugugucuuguccucaagcaauccaagucucaugaagacacgaggcguuauugugccccgaggaagggaaacugaguucauuugcauucaugaaaaaagcagggaaaguuuuagaguaaaacacauuugauggucaguggauuucuucaccguucauuugaaaggagcgcauucgagcugugaggaccuuuccccugacagcagucacagaugccaccugccuugccuuacguguguugguuucccucccuaggacauggccaaugccuuugcacagaagcaccuucgguccauaauccugaacgugaguucccagugacugccuuuuguuaaugcuucuuccugcugcuggugguccucaccaucccuaggaugccgggcugugacugucaccacugggggugggggagggggcuuacuaacagacgccgggcacuucacuucggaauacugagcuuuuuuuuggacuccucugagccaagcugcaucugggaagccaucccccaugguccccaagagauugcagccccuccagggagaaggggaaggccuucuccacugccuguuacaauauagaccuguuaaaccagcugagugggcugagaccuggagcacgcagagcuccugaagccuugugcucugcuggggaagguggggcccagcacagcucuggccaggagagggagggcaggaccagggagaucugcuuugcagggaaagucaagaagccuuuccagaagcuggcugcuucucaaguauuaggcacccaggcaagacaccagcuuagaccuuagucucccucccucccagcacagcccugggagggucaggcugcggcacagguacagcuggacucuagaguacuugcuggagggcucgagaggagucuggaaaggucuucuucacucuuauuacuguagcgaugguagggguugugugaaggcagcgaguggagugaggacaggagccaaacccaaaaggaaaagaguuuauuaguugucaaaaacagaggaaaauccagagacagcagugaagguaauagacagaacaucagagucaagcgugaaagauucgacgcugacaguggcuuuggccguuuuccagucugccuugauccugagcaguugacccugugucccugggcuuugauuuugcuuagcugagugugaagacugaaggagcuaauacauagaccaugccugacagcgugcauggcagcugugggcagcaaguguguguguguguguguguguguguguacauuuguguuugugcauguauaugguaacagagcucuagaagaaaacucuaagcaaaccugcagaguccgauggcuuuaccuugagugacuugauccccaagucacugcaacccugcuuccuuccaacagauguggaauggggagugcccaugcugugggaacuccagaacugcugcuuagguacccgcucuacaugugggcacggggaggcauuucugggaaaaaucugaguuugaggcuuagcuugauggaugagaagagggucccaccgaguagacagcugagccucgggccuuaacugacuuggcaggcagugccuacauaugcugucuaaugaagccagagagcugcagccauggcugguagaacacuuccucccccucgccugagaaccgugagcaaaacccaggagccacugccgcuucccuuucuacauagccaucuugugagccgugaggaggaaggacuagagguggacuuucagagcaguggguggaggggguagagagcaguugacagggguuuggagcaagguggaggaugagcuguaauggaggccagcaggaggccaagccccaggcugugagagcacaggagaaggacaggagugugggggcugaagagggccccugauuuugaacuagcaagagacaugcuggagagguagagagggcaugcggaugucagcaggagcuggggugcaggagccaccucaguucuguucugagggcagcugggcagggcaggcucugugcguguucagcuugcggaaguucuguccagagaggacgcuuccuggaaagacugggggccugagugggugauaauuucagugggauucauccugugugcagcuuugggaacuguacugggcagcagagaugagcagaaagcccgagggccaagcugagggugaggccuagguaggguaggguugguggggaaguacaacucagaucuggcaugcaugggcuuagagaugguccaucagcagggcuaaaggaauagggaaaugaagguugacggccaggaaauguaacccaugauacaaagacauuucaguaugcaacagauugauucauggcgcaucagggacacagucagccuucucacuucacacuaaggcucccaggacugguguguuguagacagcacguacuguaguuuagaccuggcuaguaucuaccagccaugugagccuaggaucaucaacuuguauggcacagguugacaaaaggcuggucucgaggcaaggcagggguggacgggccaacuccggggagcucugcagagauguagcacucagugcugugcugccggcccuggccauguuaggcacacaaaugcccacaagugacuagcggcugcuacacuguccagggagguucuagagucagggcuacugaguaagaccugaaggacacggguagggacauggcagaagcugcacaggaaccccaggugacaggauucacgacacguagguugggaaguccaggaagccaggaggaaaagcaggcuguugugggguuaaggacagguuggagacccacguaagacacccaaagugauuagccaagguagccagggagagagagaaacagucagaaggugagaagaugagggaggcuggggcgccaggucagagggauuugcugagcuagcauugggaggauaaggggauggcuaaaggacaggcaggggcugacauggggugacaggaaaggaaaggauggggagggcgugugagggugccuaggaaagccaguggccuuccuuauagguggcuccaugucacuuaggguggccuagccucgagccugucuagcaguggcccuuuuccacgugcucgcuggugcuuuggcuuuaguccugugaggggcaagccuggcuggguuuagcucugcuggccugcucucucccugacccccucucucucugggcccccucccgcccccaccucugguguccgagguugaaccgucauucucuguuccacuuccccugcccaagaguggagaggaaggccugugugaaccuacucuggccgagucuagcccccuuccacucaagaacaugcaggcaccaugacuggaaggaaaagaucccuguccaguguacuuaacacacacacacacacacacacacacacacacacacacacacacacacacacacacacggcacuuuaggaaagacagugcacugagucugugccuccuucugccuuucuuucucuagcaugugaucagagggaaucguccaaucaaaacagagauggcccaucagcuguauguccuucaggucuugaccuuuaaccuucuggaagaaagaaugaugaccaagauggaucccaaugaccaggcaggugcugggggccauccugguauaagcugugcuguuucuucauggcuguggucuuuccgccuacagugugugcugagaaugcugugugaaguggucuccucaaaacuggugugggccacaucucccgaggacuugggacaaaggccucuucuguccuuccauccucccgcugguccaucccuggagacuggcuugggagcacgugcccugcucucucucuucccugcuucucuugggagcugaucgcccugccuacugcguucucccucccaggcucagagagacauuauauuugaacugaggaggauugccuucgacgcagagucugaccccagcaacguccccgggagugggacugaaaagcgcaaggccauguauaccaaggacuauaaaaugcugggcuucaccguaaguaccgaagugucuucuccgcccuggcaacucccccuccauagugacagcccuggaguggcagacacaaagagaugagggccuuuggcuugccuuggcuguggccacuuggugggcguaaaccagauccaucaauuacaggcccaggaagccagccucgagggaaaggggaccauaugccugcaguggguaaaguucugguguugucuucucaccuuaauggugccaagguuuagccuccaccuuucauuucccuaccccugucccacaguggagaggaagggguggcacccgccgcagccugugugaaucaacucagcaaggcagcuugcuugucacacagcugccguugacuguggucagguuaaacacggcucagcugggaaugaggcugguuuaacuguacuguguaccuacgugguaggaugaagcagccuuaguccagugcuccaggagccagacgagcuaggguggagccgagagaaagggaggacaggcugcccccaggucacuccacacaaggacucccaaguucacacccgcucuccuggauucuccagaaccauaucaacccagccuuggacuucacccagacuccuccuggaaugcuggcgcuggacaacaugcuguaccuggcuaaaguccaccaggacaccuacauccggguaaagagcaggcggggcagccccucacuccugggacccauccacacccgccuccccucaccccccacguccucucugcuuguagaucgugcuggagaacagcagucgggaggacaaacacgaguguccguucggccgcagugccaucgagcucaccaagaugcucugugagauccugcaggucggggagcuccguaagucugcagcagccagucuccagcuagaggugacaacagccagaugucaggagggaccggagggccuuaggcgggggacauuguucuuacucccacccccauccguggugaucguagcugcuguucugugagcucaugaucuaaggugucuccaaagcuccccagugcuguguguaagggcuggcugaguuuguaacagggcagagagcuaagggcuugaggaaagccccuucugcuccuugauggcugucaucauggccuguuuucuuuguccucaugacuugagugcagggaauucagaguugccagaugggugcccuagugccugagggccgagccuucgugcuuacaguuucuucuccacagcuaaugaagggcgcaaugacuaccaccccauguucuucacccacgaccgagccuucgaggaacucuucgggaucugcauccagcugcugaacaagaccuggaaggagaugagggcgacagccgaggauuucaacaaggucagugcugccgagccacccagaggcugccgggagaggaccacgagacggccucugacagcuggccagcgccuggggaaucccuaagcuggaaaaccagccuggccggcagcgcugugucacaaggucgaaguacuagagagccugagucucagcugucgugacucccuuuguaaccuugaacgggcaucuuucccaugaugcccaagaccugugucuaucugggaaagcuagcaccugccgcuguccuccacaggggucagggaaauagcggggcagaagggcugggccugucauggcuacagugugguagaugaguccugugaacagccagugucaacaaggcaggaagggcggcaugcugugcacaucccggugccucuugggccucggugcuacaagugcccaggaguggagcacugugcuaggcccucacaagcuggcagccaaggaacccaguguuuugagacugaccaucccauuggggaagcauuggaggugagcugacauaggcgcaugcacgugaggcuggcaggcaugaauucuaagucagccuggccugcaaagcaagacccugucucaaaaaaguaaagcaaaacaacaaaccuuaggaaauauaaagaagaggugccuguaagacucuuccugucucucugucgcucuuugccuguguaagugaaugugugugugugugugugugugugugagagagugaguuuuugaggaugugugcgcacauucugagaguguccuuuccucaguaggaucaugccccgcacaugcacacuggguaggcagacucucgucucacaguuguuuagggaaguugucacaucguagcacccugugugcuguguguugugccugcccuuacaugcugaaucuccuguucuucauggcauagaguacaggaagcugccucucucucuguagagaugagggugauggaggccugagcacagcucaucuugcugaaagagucagugaaggauuaaguguuuaagaguugagaucagaacccauucccugaugugugugaaaaggaaacuccugucacugucugucaugugaccugaguccccaccugagguguccacuaggaagucaggacucuguguugcccacucugcuugagacacugagugaggcagagucuucgucucuaguuggccugucuauugucagagcggucugugccuuccuuuuuugcccagguuaugcaaguuguccgagagcagaucacccgggcucugcccucuaaacccaacucuuuggaucaguucaagaguaaacuucguagccugagcuacucagaaauucugcgguugcgccagucugagaggaugagccaggaugauuuccaguccccaccaauuguguaagugucagcugagagggccagugaggggggcagccuaccaguuccaccucggagagcgccgcucucccgcagucuuacacugagugggugaaugugcccacagggagcuucgagagaagauacagccugagauccuggagcugaucaagcaacagcgccucaaccggcuaugcgagggcagcagcuuccggaaaaucgggaaccgucgucggcaagguaaggggguggcuggagcauggguagucugccaggggugcuugccuggguacccgacucuguacggcaccccuuugcccagcacugcccaugucucaccugcuuaucauccuuguuucuagagagguucuggcacugccgcuuggcacugaaccacaagguuuugcauuacggugacuuggaugacaacccucaaggggaggugacauucgaaucccugcaggagaaaaguaggugcaugucuccguuggugugucagcaagugucccaagugcugguccuggcucucaagccugugucugcucaucugcuaaagauccucucucugguccaccucgggguggugggagaguuacugaaucccaguuguggcagugugugggucauaaagggcaggacaagacugcacggaaaggcaguggguggaggcucuaaagcuacagagucuaaauggaagcccugguguagcccccgucacuugcuaaggcuagauguuguaaauuaauucucaucugcuuucauaucugggacaaugggauaacaccgcacuccauccacagaggacuaagaggugcagacguuuccacgaggcaccgucuagcagguggcccuuugguugauagcugugaugcuguuugcuuuggccacuuugucaccuucacuauggggaagaaguagacgggugcccaaggcucuauucccugaaaagaugaauccaaguagcacccaugagcuuugacgaagcugggguuuauagaggagcagggcaggcuaacacacgcacaccugagcugggagggcccuugggccugagagcugccacauccuggugcucgggccccgggcuucccuucaagcacugaacagugcugacaucuugcagcaccagcuuccaggcggugauucccauucucuaucaguuccuguugcagauauuaaggccauuguuacuggaaaagacuguccucacaugaaagagaagagugcccugaaacagaacaaggugagaggcgggcgggcgggcgggcgggcgggcgggcaggcagggcugaaccccagccccugcccaugacagcugcagacacagacucucaucccaccuuaaauuauacagcaguauuaagagcauugaacacuauaagaauaaacagauccgaggcaggcggauuucugaguucgaggccagccuggucuacaaagugaguuccaggacagccagaguuauacagagaaacccugucucgaaaaacaaguggcacagcaucucuuucaugagugucuccuacacaucucugaaggauacagccauggagucacauugacacaccuagcagaagauaaaaggccauuauucaauaugaaauccuccauuuccucuaauguccaccugcugccuuguaaauguuacaugcacacacacccacacgcuggacccagguuugaauccgucccagcggcuuugcuggcugcaguauguccuucaucuccgaguccuucauucaugcgcugcuucuccacccuuuucccgucuucacuuuauuaguguaauggaccauguugcuuaugugcucauuucccagagucucaguuuugcugacugggucuccaugcuuuucuucugucccagaucugcaaauuggcccagggaccuagagguuugauuugguucggguuugacuuugcccuggcuuggccacaucauacaugguacuggggccuauagagggaggcccuaauggcuggguggugcucugccaugucagcacacucuagcuguucagggcuaagccuuguacacuaggguacugcguuuacuaaugaacugagccacuucucugugaagaaacccgccuuuaucuacuguuggcuuccuguggcccaguugguggaacaagagaggccaaaggcuuugccucugcuugcagguaccucccccuaaagcagugagcagguuccaagugucacccaaucaugaccaagcuuuaugucucuguuguauguuuucuaugagcgcacgaguuuaagccggucauuugagucugugagugcauggguuuaaacauaagcaggucgugugugacucuggguacauggguguaagccggucacgugugacuaugugagaacauagguguaagccggucaugugugacucugugagcacaugaguguaaguuggucacgugugacucugagaacauggguguaagucacucacgugugacucugugagcacaugaguguaagccggucaccugugacucugugagcacaugaguguaagcuggucaugugugacuaugugagaacauagguguaagccggucaugugugacucugugagcacaugaguguaaguuggucacgugugacucugagaacauggguguaagucacucaccugugacucugugagcacaugaguguaagccggucaccugugacucugugagcacaugaguguaagccggucaugugugacuaugugagaacauagguguaagccggucaugugugacucugugagcacaugaguguaaguuggucacgugugacucugugagcacaugaguguaagccggucaccugugacucugcauugcaguuacuguuuugaugcucagacggucucagcucaucagugguuuguuuuugcuggagguuuuuuuuguaccgagcauagcaacauagaaggaggaaaccggucaccuugggcucuaagauaaaagcacaggguggcauauggcacugacguucgauguucucaguguugaaaauacuuugcugcaauaauuuuuguuuguugcuuccugggggagggugggucucccuagguagcccagacucaccucauaucugcaaccucucgauugcugggauccaggcaggcaucaccaucaaaguuccaaauugaaaacacuaccaccacaucuuagggugacuguggcagggagggggugguuaaggucaguuaacacuggccccaggucagccauaccugggaccuuggugacaucauaaccaggcacugcuccaagucacuccggcuuuuugucugcaggagguguuggaauuggccuucuccauccuguaugauccugaugagacacugaauuucauugcucccaacaaguaugagguaaguagugugccacacugccuugaacaccagugcccucacugugaggaggugucugugccacacugccuugaacaccagugcucucacugugaggagguguggccagcacagcgguauccccacaagccaggcagccaaaauggaucgcuaagucuuuggaccuucuaccacugggcuggacugcccacuucacacagaggucugucuuccucugccuucagagggcugggauuagaacuuugcgccaccacacccaaccuuucacuuugugccuuagagcagcuggccuggcacagggaggguuuuccucuuuguaaucucgcaguuacuuuucccaggagaguugaaucccaguuaccuggagccaaccuggucaggcuguggagccagauggaucugccccuccuaacaagggacucccaauucaccugaagaccaggaaggugcuagugcccaacucagucaacucguuguuaauugagggccuguuauugagcacuuggggucaagaggagaggaccuugggccagcagggcucuguugggaugauagagcgcagugagcuaggcacagaagagagcagcagcagaaggcugcagggcagagcuucugcuauacacauacacaauacaugugcauucugggagccucugccuuaaguuuuguuuuucugagacaaggucuaauccaaaacuuacuguagcuuagguuagccuaccuuugucuccuaaaugcauugauguuauaagcauguuucaucauguagguaugucaguuucuuuuguacugcccuuuaaaacauggguauuuguuuuuguuuuguuucgagacaggguuucucuguguagcccuggcuguccuggaacucacucuguagaccaggcugaacucagaaaucugccugccucugccucccaagugcugggacuaaaggcaugcgccaccaagcccagcugaguuuucuucuuuaacuaaauugcaacucugaguaccugcgugcuuccugcucguuucauugaguguguguguugagugugugcucauugaauguguguucauugaguauguucauugaguguauguguguuuuuauugaauauguguguguucauugaguguguguucauugaguguguguguucauuguguguucauugaguauguguguucauugaguguguguguucauugaguauguguguucauugaguguguauguguucauugaguguguguguguucauugaguguguguguguucauugaguguguguguuuucauugaguguguuuucugcuccaguccugguuucuguucucuuggucuccagaacugcauuguagaucacauuuccuauuauuuuuuaaauucccacaugaaucccccagacacuaucaguugauaugaugcucaucuuccugcuucccuugcucuugucucccaugaguuuugcauauuuugaaugguacccaacagcacugcugugagucccacugcagcccccagggccacugugucacuuuugcaacuugcccacaguacugcaucuggauugauggacucagcgcucuccuggggaaggauauguccagcgagcuaaccaagagcgacuuggacacgcugcugagcauggagaugaagcugcggcuucuggacuuggagaacauucagauccccgaggcgccaccuccgguccccaaggagcccagcagcuaugacuucgucuaucacuauggcugagcgggaagggacuggggcccaggagagacacuggcagcccacgccacuuguacaaacucuguagugauugugguaacuacuccucagagccagugggacccagagcuucucucugucccauccaccaggagucaugaagucagggcaugcugcccuccucagcaccacagagccugggucgggcuuggaggggugaacucaugaggcuccugccucccgcucugcgucacaucugcaucugguacuggaccuacugacagccauccccuuuccuuucaagucuccucucugguuuguuggagagcccaugugggccaaagcugguccaugaaaggcugaccaugggggcaagaggccuggggagcucggugagagccucggagugacugucuucagguggcucaggcaagaacaggccuugagcuccugcuuaauaggucucugagggcucaucccagccucguccugugccucaugcugcugccucugggguuuggcccuaccaugucuagucucuagagacacccgucucucuuguccuugcagguaucaggacagguaguaauuuugccccaagcccucagccucauccuggccaggcagaggccuccagccugaguccugcucucuuaggcuuuaggaaugaacacugcagggaaaggcaggcugaggccucuggcucccccuaccccuccaguccucucucuuccuugcugaggcacaauauucccaugcccccucaguuacaggccccuccguuugcuucccuccugccucagacagggguguugccuucccuuucuccccuuccuggcgcugugguuugugccauuagccaugauuucacagcggcuggggccacagcugugccacggccuucauuggugcugcagcacuggaagcccacgcgcacagccucuuuccuuggacgcauguuaccauggugguauucaguacugguagccuggcaugguggguacuacccagugaagaguguacuauauauuuucuuuacuauaggccauacuuauacagacauguauauauauuuauauaagaucuuccuaucuuaggauagaauguuuaagggaaaauaaaaucaagaacaaaacuguagugcucucagucaugagcugugaguguaaccagagagcagccaggagcuuccugucagugauguguuuucaauaaauacucuuucauguagacugcuuccuauccacaccucuuccucugcacuuauucccugucccaagggugaggagcggccugacagccuucauuucagugugccugggagcauguggagagcucccagccacucugagagcaucucccucuccccucaucucuccugcucuugucaugcgcaaacuacucacaccugcuggcuaaggaugcucacagcuugugcuacaggacagagcguuuucugcucagucgugcuggguacaacguggaaaggcauacuguacacccccaagaacccauccucccuuuuuccccugccagggacacagccagggaacagcucgaguacuugugccuuucaaagaagacauguuccgcaccccgcauguugccugcaguuagugcccagcuugccagcuggugcuuuaagcuggugcucccaucagcagccuugguagcugggagguuugaaugaaggcagugaugaaaauagauacuuccccuugccucagucagaagggggugaggacaggcgcuuucagaaggcauagaaagugcaugcaacgcaggcuuugagggcugaacgaagccaagaccuugggcugcgaugggcaccauuguaggucucaggaagcauugaaucaacgaaugcuuucgugaugccagcuggcaacagccuacagcagcagugugcacaaagcacagcuuacacgcuggccuugagccuucugcuaggagccaggagcccagccaagucaugugcaaggauuccuguuugcagccaguccuaguagagcccggaugagcagacgccgagaacugggccagcucgggucugcagcccuagcuugcauggcuuagagguuaucuugcccacauacucuguaccugaaaugagucaaauccaggugugcuaaauugguguucugcggccacuguaaccugcuucccugggcucccgguaagacuagauccuucuuacccccuuccuuuuggguuccauuuccucugcgaugaacuucacguacucagccuauugaauaauucucacaaauuuauaggcauacgcaaugucacaaaguguccauuaucacuuugccaggacguuuuacuaauaaaauuuaaugguugucaugucau

SEQ ID NO: 1272 - RNA, 3250 nt, Mus musculus
guuccaggucuccgaaaacuguucuuuuucaaaagauuuauuuaugcagaugagugcucuaucugcauguaacccugcaagccggaagagagcaucggaucccauuacagauaguugugagccacugugugguugcugggaauugaacucaggaccucuggaaggguagucagugcccuuaaccuccccgcccccuuguuuuugcuguugaaaaacugugagccugcuuuccuauaaaagaaaaaauggaaguacuuuuuuuuucaucuuuuaacaacucucaagaauauuuuaacaauguguucuugcuacuuuuguuauccguguguucaggaggggggggggagugggggaggacaugagcacauaggugcaggcuccugagcaggcggaggcagcacugggucccucagcugggugcuggaaaccacacuggaguccuuuggaagagcaaguacuccuagauccaggccaccucuccagccccucaaaaacauccuuuauaucaaacuccagacacccacguaggaauccacacuuggaacaagcuccacggagcaguccacugcaucccagucggagccuguucugcuuucucaaaguggaguuuacauccacugaacuagccucgagcacagucuucauacauauaacaaauacccgaccagaguaaaaggcagacaaaaaacugcaucccaaacugagucccugccuuguccuuccagggugucucagcucaaggcugccugcucugcaugagcuccacagccacugucugggaaagcuuggugaucuggaacagccaggucuagggcugggaugcagcucaguugguagagugcuugacuagcaagcccaaggcaccaaagaaaccagaugugacagcacacaucgauacuccaacggauacaggaacaccagaaguucaauguuauccucaacuacauaguuugaagccagcccaggcuacccacccagcucugccuagaauaaaccucauguacaugaagccccugagaacagugagccauggauggugguggcccagcacgaucacagaccacuuaacaacccaugcuuugcugagggguccagccucgucuacaucauccuucaccgugagccaguucaccacagcuccacuacccgaccauggaccgcuuucgcccucucaggcgcaccucaucuaacuucuucagcacuggacuggacuucugggucgaggccccguaacucuucagaaaggcuucaaacacggucucggugugggggugcgugcugaggaaggccuucuccaggacauagaggucgacgccuuuaucuuccggcaguccugagacaaagcucagcccaaagucgaugagcacgaugugcagcugcgccaggggccgccucaggagcauguuggagguggugagguccccgugaaugaggucuuggucgugcauuccggccagaaccugccccauccuccuggccagguccaagaggcacuggggguccuuuucagucuccauaguggauuggauauaaucccgaacagucaccgagucuucgauuucuuccauauauaagcaguuagacgcauaguccacaaagaagacgacuggggcagcuaucccugcaauggacacacgugguuagggaacgcaucuucaugaaggccagcuucaugcacaggcagacagcuuuggaacaggguuuagacuacuguggaaaaugauacaauuuauccagagcuugcccuguuaaagcccugcaggacuacggccugagaccaggccaggguaagucuggaaguaucaaggcuugcuccuccuuucucaagccaccugaggacuggaauucauugcugcucccuaaaaacaaacaaaacaagaagccagaaggaaagcauccugcagucugggcaguuucuaccugacagucaccaggcaaguggcuaagcagggugucaccuuacaggcucaucugugcucuggaacaggcagguucagaucccuuauuaggcgugaaaccucaagguucccuuagcuacucuaugccucagucuccacaacuguaaagugguaacaaaaccuccaguuaacaccaggagucucuccugaaugucaaccaaguucagaacaguuuccuagaaacugggguaccaagguagcccccacccaugucugauaaaacuuacaaaagguaaaggagaauauaugaacacuucuuuauaacuccauugccccucuagggcagaaaagcacaggccuguucacuucugcauuuccccuggcuccuggcaccuaucaauguccuggcagugggcaccuaaaaaccauuaaagagaaaaauagcaaaggcucggugguucugggccacagacaggcugccugguagcuguggaaccucaggcacuuccccucuuugagucucauuuucucuggaguaauguuguuguuguuguuguuguuuuguggggguguggauguuuuuuaaagaaaagaauaacaauuuaaugaaaucaaacauuuacugaacuaugucagcauaagaacaugugaugcauaugccuucuuuaaugaccacaauaucccugagauuccggugacauacaagguaacugggcuagacgacucgcugaauggcuacgagggagacaaugcagggagaaugugaauccacagagcccggcuccugccacccgccugucaggacaccuacugcuuaagaccaccaaauggagagggaaggacgguaagcagaaacagagaaaugagaaacggagggacccgagcgcuaaacaagccccgcgaaccaaacagaauggcguccugacugucgccuugaguccuuaagcauugccaucugauccuguccccuagaaaucggagccccgucucucacgucccacuggucucccgcagcccugucugucccgucucccggagccccguccggccccccucacccgcacggcggcagcggagcagcgcgcgcgccuccugcacuguccgccgccggccgagccgcgccuccagcuccgggugccgguagcucuucgggaagcggugcuucaccacggccgcgcggcccuggaagcggccacggaagacgcgcgccucggcgcccugcugcaccagcucuaggccgcucaggaagaggcggcuccgcucgcgcgcagcggccagcgccucggccuccgccuccgaggacgugccagccaugccuccgacuccuuccgacccugaccgcgccgcuuccg

SEQ ID NO: 1273 - RNA, 2285 nt, Mus musculus
uggcagggagacuuagugaagucacagguuccuaaggaaaagccuucccuuucaggcguccagccuuccucgggagacugugcuggggcccccuuacccugcacugaggugaguggaagguuaggaauuacgcgguccccuggcauaaugugaagacagacaggugucucugcaaggcugaucuguccuagagagcaggcugcagcgggaggaagcucgugugcccuucugaguccagagcagcacagcuccacaucacuucuccaggugaauaagaaaucucccagaacagcaggcaucuaagacgccaaagcuacagggcugcaccucugucugaggccaggguaaaaauguagaaagucugugagccuaaaaucugccaccaccaaauaacagcagccacuccugaagccggggaucagcaaggacagacagcccucaaaucuacagaggacugacccaaguccacggaagacucucacaaaagagguuucuguccaccucccccacacacacacacacagagucggggggcagggguaacaaugcaucuuguaaaagcccccuucacaggccgaacuauuaauaauagccucaugguggccaauguuauugacugcuaaggucugagaguuucagaaucccucuagcacuaggagcaaggagcuucaaggugacaccuuuucagcaccuaggagaaagaagggcgccaugcccaaggcugagccgggcgaggccuggccgcuggcugggagccggccugcagguaggugauccggguaggaaggccggccuggcagccugcgagcugcagcguuggcagggccucccuguuugucuggaagggagagcugaagccgaggagggggaagggcagcccgacugagcccagcaaccugaggccaaggguaacuccugaguugcuuuugcauuugaagaacaaccaugaaggcuucuaaacccaccacugccuuucgcaucugagccauggagagggggccccuugaaugugucuuucuucucagggucaaccagaggcaaagagauccagggacuggcaaccgggugccucggucagaggagccaggaggggaaagaaagcaaacagaaacaaaagagaucacacauuugaguagguuggacuucccaaacauagccugccuccaggguuaccaccagcacccagccuucuaaaauauggcaccacacacacacacacacacacacacacacacacacacacacaccuuuuacuuaggaccggaugcugcacaggcucuggaagaaagaggaaggccauucuuuuuaucucuaauuuauaauccaagggaacucagugcuuucuuucugacucaaaucuuugucgucgauuauuaaaguagcuagacuuggcugcaacauuucugcaauguucuugcucuacaauuaggggaagggagaaaaaaaaaaaacccugaagaaaguuuagugagugauuauauguaauuaauuccuaguuaagacggagcacugaccauuuucuggagcuaauaaaagcaguugcuccccuccccccacaugaaugccacuucaucucccaaagcagaauggcguacccaucucagaaggucuuaaacgggggaaagaggguggggagaaggcugagaggugagagggagggagucacugaagggaaaggggggggggagagaagagagggagaggaaggggguagagggagagaaggagauggggguggggguggggagagaguugaguaggggagcuggagggagagugggauggagggggagggggagagggggggagagagagagagagagagagcgagcgugcaucagugucuguaucugucccuuugcagcugugcauccucuuuggggaccaagaaggcaggaggaaaaaggaaaacagcccauccguuugguuuucgccucggcaaucugcacaaguguugaacccuccaccuggaugagggaaagcgaagugggggaugggggaguccuaaggauggaaugcaagagacuccucagcuuggccaccugcuuuuccuaaaaggaacaacaacaacaaaugguagaaauuuccagaaguccuuacucaggccacugcaaaugccaaucuuuaaccuuuccccuaaaucugcuggcuuaagagaacaggaagaaaggggaaccccguugggcuaaucugugggccugcacuaagaucccacccgguccaacugcaaugcagacuuuuuuuuuuaguucccccuuuaguaacuggaaaagaaugcuacuucg

SEQ ID NO: 1274 - RNA, 2285 nt, Mus musculus
cgaaguagcauucuuuuccaguuacuaaagggggaacuaaaaaaaaaagucugcauugcaguuggaccgggugggaucuuagugcaggcccacagauuagcccaacgggguuccccuuucuuccuguucucuuaagccagcagauuuaggggaaagguuaaagauuggcauuugcaguggccugaguaaggacuucuggaaauuucuaccauuuguuguuguuguuccuuuuaggaaaagcagguggccaagcugaggagucucuugcauuccauccuuaggacucccccaucccccacuucgcuuucccucauccagguggaggguucaacacuugugcagauugccgaggcgaaaaccaaacggaugggcuguuuuccuuuuuccuccugccuucuugguccccaaagaggaugcacagcugcaaagggacagauacagacacugaugcacgcucgcucucucucucucucucucucccccccucucccccucccccuccaucccacucucccuccagcuccccuacucaacucucuccccacccccacccccaucuccuucucucccucuacccccuuccucucccucucuucucuccccccccccuuucccuucagugacucccucccucucaccucucagccuucuccccacccucuuucccccguuuaagaccuucugagauggguacgccauucugcuuugggagaugaaguggcauucauguggggggaggggagcaacugcuuuuauuagcuccagaaaauggucagugcuccgucuuaacuaggaauuaauuacauauaaucacucacuaaacuuucuucaggguuuuuuuuuuuucucccuuccccuaauuguagagcaagaacauugcagaaauguugcagccaagucuagcuacuuuaauaaucgacgacaaagauuugagucagaaagaaagcacugaguucccuuggauuauaaauuagagauaaaaagaauggccuuccucuuucuuccagagccugugcagcauccgguccuaaguaaaagguguguguguguguguguguguguguguguguguguguguguggugccauauuuuagaaggcugggugcuggugguaacccuggaggcaggcuauguuugggaaguccaaccuacucaaaugugugaucucuuuuguuucuguuugcuuucuuuccccuccuggcuccucugaccgaggcacccgguugccagucccuggaucucuuugccucugguugacccugagaagaaagacacauucaaggggcccccucuccauggcucagaugcgaaaggcagugguggguuuagaagccuucaugguuguucuucaaaugcaaaagcaacucaggaguuacccuuggccucagguugcugggcucagucgggcugcccuucccccuccucggcuucagcucucccuuccagacaaacagggaggcccugccaacgcugcagcucgcaggcugccaggccggccuuccuacccggaucaccuaccugcaggccggcucccagccagcggccaggccucgcccggcucagccuugggcauggcgcccuucuuucuccuaggugcugaaaaggugucaccuugaagcuccuugcuccuagugcuagagggauucugaaacucucagaccuuagcagucaauaacauuggccaccaugaggcuauuauuaauaguucggccugugaagggggcuuuuacaagaugcauuguuaccccugccccccgacucugugugugugugugugggggagguggacagaaaccucuuuugugagagucuuccguggacuugggucaguccucuguagauuugagggcugucuguccuugcugauccccggcuucaggaguggcugcuguuauuuggugguggcagauuuuaggcucacagacuuucuacauuuuuacccuggccucagacagaggugcagcccuguagcuuuggcgucuuagaugccugcuguucugggagauuucuuauucaccuggagaagugauguggagcugugcugcucuggacucagaagggcacacgagcuuccucccgcugcagccugcucucuaggacagaucagccuugcagagacaccugucugucuucacauuaugccaggggaccgcguaauuccuaaccuuccacucaccucagugcaggguaagggggccccagcacagucucccgaggaaggcuggacgccugaaagggaaggcuuuuccuuaggaaccugugacuucacuaagucucccugcca

SEQ ID NO: 1275 - RNA, 1082 nt, Mus musculus
ucccucucccuuuucccucccucccucccucucucccaggcucugaucacuugaacuguuuucuagggcaaagagcaggaagcugccggcauaugcuggugaccuauuggggcagcuuuguuugaggaaugcugcugccauucaggcuugucugagguuaucugggaaauguaacugggcuggagacaagagacaaagguaaggcugcagacgggauucugggaagaacaccgauggaggaggaagccgggagguccgccuaccaaccaaggcugauccagugccuaauggaauguggcugacaggcgagaagcaaggcuacuucuccaagccugggcucaggggccgcaucuggguugcucagaggcuaaguucaucggggcagggauugcuuacaccuugaacagggcccagagaagugacacugugcaccacucaaggucacacagcuagcagaugccugugaucugacauguacacuaguaguaacccuggaucgcugagccucuggagaaagccacgggagugaggccaggcugaggcccauuuuucccaggagcaauguugagccuuaucuuccucuuagcaauccacccuuaggugggcuuugcuuugaggcacagagcugagagacaucggauucaacugaugcaaccucccaucacagacgagaagccggggaagcccccuguccuguccaagccuccuguuagauugccaccucaaaugaugcuuuuuauaauucuuaaaaucuguccccgucguccccccaauggaagugacaaauggagacuucugggcugucacagacagagaagaacuggcugcugacacccagagaauagaaaccaaagauacaauaaaaacacugcaggaguacccacccccacguaccccacccccgccagcacugccaggaauuuugagacccagaauguacacuguacugagguugggaguccgaggcaaugggaacgacagaaaaaaagaaaccuaaccagaaugcuuugcacagaaaagcgacacaggccuaaacaagcaggcuccucagugauauuaauaaauaaugagcuaaugaaauu

SEQ ID NO: 1276 - RNA, 6202 nt, Mus musculus
cagagagccuugggucuaggccggguucugagugcuaaaagccagaaaaauauuuguugaauaugaauagggacaaggagcaaagaaauaauaaacucgacccccaagggaauucauuacuaauucuucuucuucuucuucuucuuuuuuuuuuuaaaaagacaaggucucggggcuggcgagauggcucugugguuaagagugccgacugcucuuccgaaggucccgaguucaaaucccagcaaccacaugguggcucacaaccaucccuaaugaaaucugaugcccucuucuggagugucugaagacagcuacaguguacuaacauauaauaaauaaauaaaucuuuaaaaaaaaaaaaaaaaagacaaggucuccuauagcccagauuagccucaacucacagcaauccuccucucucagcaucucaaauucagggacuacaggcauaagccacuauagcacauuaguucuuuccuuuccuuucccuuccuuuguuuuguguaaauauguuugaaggcagccuggguaacaggagccugcaccaccaaccccccccccccaggggaaaaaaagcccaaggaaacccauccuuuccuaagaggagccaccauuuccugugugguauggcuccugcaggaccugucuccugcguguagaggucagaggucgguggguacucucccuccacuauguaggcucugggaugggacucaggcccucucucuuggaaggaagccucacaagugucucaccgucuucuucguucucuuuguugcuuaaagcuuuauuuuauuguuuguuuauguacacuugugugcacaugugagugugugugccugcucucucacaggccagaaccccuggagguggaguuauauauagauuaguguggggugcugggaaccuaaccuguuacauugcaagaacaaccagggcgaugagccaccucuccagcuccccuucauucuuuuuuuuuuuuuuuuuuaauauuuauuuauuuuauuuuaguacacuguaguugucuucagacaccccagaagagggcaucagauuucauuacagaugguugugagccaccauguggucgcugggauuugaacucagaaccucuagaagagcagucagugcucuuacugcugagccaucucuccagcccccuucauccuuuuuuaauaacugaaaaauacauugugugaaccagucaugggugagcacugcggacaucugguagaccuguguauauaccuggagguccaagucccuggguuauguggcucuuccuucugucguuguuguugaaccuuuugggagcugcuaggugguuuucugaacagccuauacuuuccacagcaucuuacaauguccugugucgucuguugauucuaggcauuugugcuaacaagagaugguggcucagugaccuagauaggaaagaaggaaaggaagcauuaucuuaggauuucuuuauaauguguuuccuuccuuccuuccuuccucccuuccuuccuuucuuucuuuuuaaaaauguguuucaagauaggauuuuucuauggagcccugggaucgaagcagugagcaccacugucucaguuuuugugggggagagggaugggagagguaggguuucauguugcccagaucucuuccagcuagcuuuguccaaggugaccuugaacuccuaauccuccuuccuccaccuccggaaugcugaaaugcucugugugagccaccacgaccuguuuuuguggggcugaaggauggcuggaauucagggcugcaugcaaacuagacucuagcaacugagggauguccucagacuuuuuuuuuccucuuucauuuucuuuuugagacaguguugucucucacucuguaggucucacuggcccaccucugccucccgagagcaggggaaaggguguucacaacugccauuuuuuuuuuuuuuaucuuacauaugcuaggcugcccagcauauguaaguacucacuagaauaccucauuagccuugaauucuaggcugccuuccugccucugccuggugagagcugggauugcuaauuaaugucaccacacccugcuuugucugggguucugagacgaggcauacugaacugaaccuuuugaagguuuaguccagguuccuuuagaaagccacuccagcaggguggagguggcacacaccuuuaucccagcacucaggaggcagacgcagguggauuucugaguuagaggccagccuggucuacaaagugaguuccaggacagccagggcuauauagagaaacccugucucgaaaaaccaacaacaacaacaacaacaaacaaacaaacaaacaaaaauaacaaaacaaacaaacaaaaaaaaagaaagccacucuccgggcucuuguucacauguucacuuuggaaagucuacuucgacuucugauaagauuuugggagaccgaucugucuugguugucucucuguaccagcugcucaaacuguggguugagauccuuucuuugggagcugaaugacccuuuaguaggaaacacagauauuuacacaaaaguagcaaaacugcaguuauaaaguagcagugacaauaauuuaaugguugggggucacuauagcaugcagaacugucuuaaaaggucacagcauuaggaaggcugagagcacugcucuaaauucuugaauugaaggacuuccucccaacuggcaguggaacccagggccuugggcaagcuaggcagggaauguccaccagugaccugcacagaacaccucagcucuucauagauggcuuuuaggcaaacacccuagcaacugaaagcuagcucucacccuaccuuuucucagccugcucaagcaggguuguaacuuccuacagugugagcccuaggccuuccauccugccuugagauuuacauaaccacccaagccccgccccccaaaggccgggcuccucccuuucuggagccugguuguuaacuucacacaaacaggcuugguucuccguuccauuuuuuguuuuuuuguuuuuggcuucuggggauuucccguacuuucucgugaacucaguuauucauuugaaagaucaguuguccuuuacuuagaauuuccacuugucugcgugggggcggaguguucaguacugccuacucuggaguguugcuggaaauggccaccuuggcuuucaggacaccgcuucuuuuggggcucuucguuccaccuggcaucucuggguguuccuucacauguaaccccagccucuccugucuccucaggccugcaacuccucagcuucgaguccuuuaaugaaccagcugacucaucucaaauuggaaaucagacaggucaaccugguuccuguuuggucagauauuuuugggcccagcucucuuauaaaucacuggccagccggugccuuggcugucccuggggugacacccaugccugacccaaucaucuguagucugagcagaaguaggcagucacaugauuccggagacagugacuucugcccuuccuguggaaggcaguguggguggggcaggcucuccgagccugaugggugcagacauggacacacgaaaagguuccacaguacucgauugacaacagccggagggguuuaguguuuuggguuuuuuuuuuuuuuuuccagcugaauucuuaacuuggcuucuaaguucaccccuggcauugacauugucugccugccucaacacauccccuucucccguguuucugcucuguaauuagccaauaaugggaacaagauuuauccuccgaaauaguuucacugcccccacuuugaaaacucaccuucucaacaccaguuuuguuccucuuuaaaaugcaacggagugauucuggggcuggggucagaaaaccuugugaaguggggcaucugcugacuagaagccagccucuucucccagagcugcucagccucugaaagccugagagaaacuccuccucacugaaaaauagcaagagcggagccgagcagcgagcagcgagcagcguguggguguggagggugacccuugggguacaaaaaucugcauaugugguggggguuuuggggguaggguggaagugcaccuauaaucuuagcacuugguaggugaaagcaggacgaucagcaguucaaggccagccugagucaucaggccaguccugggacacaugaggaucuaucuaaucuaucucaucaaacaaagcaaauuuauauguguguguguguguguguguauguauauauauauauauauauauauauauauauauauaugaucauuauauaaucauuugcuaauccauauggguucuuagaauggugugguaguggcacacauucagcucuuuuuuuuucgccaaugauaaauucaaauucuauguauuuauuuauuuauuucuaugucuuugaauguuuaugcccauagugucuugaaugaaaugacccccauagccucauagauuucgaggacuuggucccaguuggcagaacuguuugggagggcuuaggagcccuggcuuuguugaaguuugucuauguuacugguguccuaccuuggguuucuugaucuucccagagcucccccucuggcucuuaacuguggaucaagaugugagcucucagcuguuccuuugccccacagucauggacucuaaacuguugaagccauaagccagauuuaucacuguuuuaucagucauguugaccauggggucuguguaucguguaugugugccugaugccugaagaggcccagaggccauggggauccccugggagugacagguaguugugaggugcuguguggaugaugggucucaaacccuggugcucuacaagaucagcaaguagucauuuuuccacccucaacaacucuauguauuuugguggugguggugguggugguggugguggugguggugguggugguguguguauguuugagacaaggucucacaggaagacacagcugguuuggaauuagauaauguguaacccaggcugggcucaacccucaguguaucugagaccaaaggcccgugccaccaugcugacuugaaguuuuuauuuuggaugacuguacauguaugugaugacuguacauguguguguuuaugcuccucugcuugcagauaccgaggaggcugaugauggaggucuuccucgguuauucuccaccuucuggcugcuguuguuugucuugagacaagggccucaccugguagcucugacuggccagucuaacuauguagaccaggcuggccugaaagucaagagagccaccgccucuacuucuuuaguguugggauuaaagaugugaccccgugccaagcucuccaccuuaguuuuuugaaauaguugcucacugaacaaggagagcgcugugguucagcuagacuggccagccagucauccucaggaccuccuguccccgccucucuggaggugggauuauaggggcgcuacacucucaugggggugcuggggugugaauugaggucugaaugccuguguggaaagcacuuuaccaaaggagccacuuccccuccccuucccuugugagcuaggaucuugcauagcucagucuggucuccaacuucauaugugacugagggugaacacuuugugcuuucauuuccugugugcuaggauuauggcgugugcauccacgucuggcccagguaugguaucagaucccuugaguauauacccaccacuggaaaugcugggucagauggcaacucuguuuaucaucuaagguauaucucagacauucauuuucuaaaauggcugcaugcaguauuuuacucuuccaucaguaaugcauggaaguuccuguccgccccugcuuucuuaccggagacguccuuccuucagcgggugccguucugguuucucuuccuguugcugugauaaaauacuuccgacaaaagcaaucuaaggaugaaggguuuaucuuggcucacagcuccaaggaagcucacuguccugaguugggaagugaggaggcagaucccggucucaucccauccacacuaggaagcaaaaagcaccgaaggaguugcuacuauucgucuccauguauccagcccagcaucccaucugcggaagggcaccauccaggaugggugggucaucccacccucgaugaacacaaucaaguuaauaccucacaggcaggcccagagg

SEQ ID NO: 1277 - RNA, 1400 nt, Mus musculus
aggacgugcaaggccaagaugaggacaaagaauggugaugugaagagcuuguuuguguuuuagggugugugcguacauauguguguguuugugugugucuguguguguguuuguaugugugccugaguguguguauacauguguguguauguaagugugugugugcauguguguauggugagugcgugugcauaugaguguauguauguuuguaugugugagugugugugaguguguaugugaguguguauguuugcauugugugaauauguaugugugugcaugugugugugugaugaguacaugugugaguaugugcaugagugugugugugagugugcauauuugcaugugugugaugaguguguguauguuuguguauauuuucuugcgugugugaguacguaugugaguauguaugugugugugauaaguauguguguauugcaugacuguguguguuugcauguguguguaugugugugugcaugugugugugaugaguauguguguaugugcaugagugugugaguuugugugaguguguguguuugcauaugugugugcauguaugcaugaugaguaugugugugugaaugugugugaggauuugugcauguaugcauguguuauaugugugugaguauguauauuugcaugugugugugaugaguguguguauguuuguguauguuugcuugcgugugugcaaaucacgcacccaugcacagcaugcuaaucaauauuaucuuuugaagagagggaaggagguugguuccugacagagaugugagaaggauggagaggagaagacccuggcgcagaccccuaccuggccccaccuccugcgagaguaccacuguccguuugcucugacucugcacucaacugaugugcugaggagccuggacaggaucacacucacuaugcugagcuggcccuugcaccagcgaggaggcccaggaggcuccagugcuucugcuccugccucugcaugcucucccucuuccugccuugagacuuaauauagaguccaucacuugccagcugggaaccugaucauuacccaacauccgugaccugaggagggcacacaaguccagugcucuguggguguuccucuggaacauugugggauggcaaaggagcucugagaagcccccaaaggacuucaggggacucugaagcauagagaauaagggaagcccuucaaggcaggacacggaaaccugcagggacauggagcagacugaggcaaugcucaggcccugccaucaugacucggguucuuggcugagauuccaccuaccaaugucuccugccaaccgucaggucaccagcugccccucucuuguccugagucuccugcccauugugaccuugagggcucaugggcucug

SEQ ID NO: 1278 - RNA, 759 nt, Mus musculus
guaggggagugauggucaaugacuaugaaggggaagaaaaugcaggucaaagccuauagacaugggcagcccugaaggaaagaugcaagugaucggagguaggaagagacuaagagcaugcgcuagauaugcugagaaaagcgaaagagggaguaaaggggaaagaaaaaaaucguaaaaagaauuagugagggcuggugagauagcucaguguuuaagagcaccgacugcucuuccaaagguccugaguucaaaucccagcaaccacaugguggcucacaaccacccguaaugaaaucugaugccuucuucuggagugucugaagacagcuacaguguacacauaauaaauaaauaaauaaauaaauaaauaaauaaaucuuuaaaaaaaagaauuagugagaguaauaauagucgagagaagagagaugggcaaaaggaagugaauggaaugagagaggugacagagaguagggaaggucagaugccggauccaggaagggcagagaaaucagggauggaaaggaggcucagggaaguuaagaaccaggacugaggaugaagccagaagggaagagagaagagagaggaggggaggggaaagaaggguaggcuggaagguauauucacggugucuaucucuuccagauuuguaucucugacagcaaaccacaccagcccuggacacaguccugcugccacaggagagagagcuccuggcgggccaguuuguaagaaguaauccuucugucgcuagag

SEQ ID NO: 1279 - RNA, 8526 nt, Mus musculus
cuuaaaguagaaggcaagaaguauucauaaccgcaguuguggucaagguguggucccaccaaccgcugacccuccucucagguccaguccauugcaaggaagucuaacaagucuggggguggggcugggggggagggugucccugggagggcuccccucugguuuguccaggcuuuuucguuuccuaacuugagauucuuggagacaucuaacuugcugggguccguuguuuggguagucugggagucccagugugccuucaugcuucuaguacaguagcuguggguucaagacugcaggagccagccaugccaugcccggaagcggugggugucccucaacagcgccuucuccagcucucaguucccucuguguucucuuccacgguggucccucacuauugcaaggaaaugauaacauuuaggacccuucugagcaugauggugagagaugaauuucaaagcaaagguaagguggaugcucggccaguuauagccccaaucuuuuuuuuuuuuuuuuuuuuuuuuuuugagaugauuucauauagcccagguuagccuugaacuugcucuguagcagagaacaaccuugaacuuguaauucuccugccccaauaaaccuaguacugguauuaugaggagugcacugcacugguuuuuauguaguucugggguugaaauacaagauuucaugcaugcuagccacacacucuaccaaugagcuagaaguacugcaaagccuuucgugugugugugugugugugugugugugugugugugacccuuuucacauccacugcuaacugccugucuuccuccuauucacacucccuagaaguggaugagcaagaggucuccacaaacccaugugacuucagggaggccucaaagagaccacacccuucaugaacuaaccugcuuggccugugggcagauugccuguggggaaggagaaucuagaaaagggcuguaaugaagcugucuaagaagugaguuggccucaggcugcacucccuguggaaaugaggauuugggaauaauggaauugggugucaggagaagucugacggaccugggguagaugcagcucaacauguagagcacaugggacuggagaguuggcucagcggguaagagcugcucuuccagagguccugaguucaaaucccagcaaccacgugguggcucacaaccaucuuuagggggaucugaugcucuucuucaggcaggcagaugaauauguagcaaagcacucauacauuaaauaaaguuuaaaaacaaacaggagagcacaugcuuuuggacgcauugagguccuguauuauauauaucucccacacuauaaaacaaacaaacaacaaaccagaagccugguggugaacacccacaaccucagccacuccauuuauuugauuggcugcuugugacugggucuuagucuguaaccaggcuggccuugaacucugcaauuccuggagcucugucuuucaaaugcagaacuacaggagcaagccagcagaccuggugugauggagggcugagaaugaaagccagaggucaguuuaugcuagacaggcauucuaccaacugagauccauccauaagucgcuaaaaccauuuucagaauaacagguuuuugucguuuuuguuuuguuuuuugagaugggguuucucuguguagcucuggcuguccuggaacucacucuguagaccaggcugguccugaacucgagagaucuaccugugucugccugccaagugcugagacuaaaggcaugagugggaggcaccauaccuggcccucagaacauuuuuaauuacacuuacuugugcacaccgauaaguguacuauggcacacgugugaagugacaggacagcucucauguauugguuuucuucuccaaucauguggauccugggcauaaaacucuaguugucaggcuugguggcaagcgccaguaagcuauugagccaucuaaucagcuccaauuucucauuuuuuaaauaagggaagagaaaaauccagcauagggcuguagccuagcaccugguugauggugcaggaguucaaagccaggaugccuacacaucaacuuacuuccaggccagccaugagaaaugaccucaaggggcuggagagauggcucagugguugagagcacugacuacucuucagagguucugaguucaaaucccagcaaccacaugguggcucacaaccaucuguaaugagaucagaugcccucuucuggugugucugaagacagcuacaguguguuuauauaauaaauaaauuaacaauaauuaaaaaaaagagaaaugaccucaaaaacagacaagccagacacagugguccaggccuauaacaucagcacuuaggagccugagacagaacuacugcaaguuuaaggccagccuggguuacacuugaguucuagaucagccuggacuauagggugauaugcccagcucaaaacaaaacugaagccagacuaagaggaagcaggagaugagaugcaaacauaguuguuuccuguccagugcacauuuggugcugggcuguacucaguaagaacuaacacuuucucucucucucucucucucucucucucucucucucucucucucucucucucucgcugucuuucuuucucucucccucucucccccucccuccccucccucucccccucccccucucucuuuuuaaguuuuauucuuauuugacaugaauggguguuuugccugaauguauuugugagcuucacaugagugcagugccuguagaggccagagagggcaucggauacccuagaacuagaguuacagcaguucucggccaccaugcgggugcugugaucggaaccugggagucuccaagcgcagcaacaguuuuuaacuguugggcugucucucuagcccacugccucuauuuaaaaaccaaggacaaacacgccucagugugaugcuucuugauuuuagcuaugaccgcucuuuucuucuuacuugggccaaaggacacuuguucucugcaaguaugagcggaugugcccacauccgucugaauggaaauagaagaaauggucuuccauggagcccgcgauaggagaugcgucuuuucagaaugaucuuccaugcuguagagacauuguuuccuuagucaucgaaaacaagggaaugaauuaugagugaauacuuagaauucugcuuaguuaucaucuguguuuccaacaccaucauucacaguuguagccaacgcuaagaauagguagugguacucauucggcuucgccacacacccugcagaucggccuguccaaaguacccgcuagcauggcgcuucugcugcugcagagacauagugugugcuggggugcuuacucucagacagaccugaucaucuugccucagcguuuggguuuucaggcugguguuagcugcaggguaccagccuguauccaguguaugugguauguguguauguguguauguauaugugguugugcauuugugaaguguguauauguguguggauaguguuuguguguuugcaugcauaaauauauauauauguguguguggucuguuauaugugguguguguguguguaugguauauauauacauauauauauauguauauguguguguguguguggugugugugauauuuggacuggguaucaaauuguaagaaacaugaaguuuuuuuuaucauacaguguaaaauuugucuuuuuuuuuuuuuuuuuuuuuuuuucugagacaugguuucucuuuguagcccuggcuguccuggaauucacucuguagaccaggcuggccucgaacucagaaaucugccugccucugccucccaagugcugggauuaaaggcgugcaccaccaugcccagcucuggcuuuuuuuuuuuuuuuuuuuaaaaccaagaccuaguccaucaaauuccauagaucuuggaaauucucuaauuguacuaaucuugcuuuuuggcuucuguaguuucacuuaaaaaaaaaagauuuuauuuauuuuuauguauauggguacgcuguagcuguagaugguugugagccuucgugugguuguugggaauugauuuuaggaccucugcucccuccugucaacccugcccgcuccggcccaaagauuuauuauuauauaaguacuauuauauaaguacacuguagcugucuucagacacaccagaagagggcaucagaucucauuaaggguaguugugagcuaccaugugguuguugggauuugaacucaggaccuucagaagagcagucagugcucucagcugcugagccaucucuccagccccaaaauuucucuuuaugacaagaaauucauauauuuuauccucuccaaccuuguaagauuuuauauaaaugguuuagucuccuuacccuguaaaaccuuuguuuauguaaaggcccuguugcucucuuggaacuuaaaaauauuaagagcccaaccccuucuucucuccaucauauccuuuguuuucuuguucuguuuuguugagacaggguuucucugugcaguccugacuguccuggaacuuucucuguagaccaggcuggccuugauaaggauuaaaggcgaguaccaccacacccaguucuucacuuucuuuugaaacuagccaauggagaagugugaggucagacaccagccaauggaggaaagaccugaccgaucgucgccuacaucagaaaaugcucuuccauguuucugagcaaugcacucuagaaucuagaacaaauguucucaccauggggcucaccuaagaacauuggaagacaguuacuuacguuauauuauuauguuaauaauaggagcaaaauuacaauuaugaaguagcaacaaaaauaauuuuaugguuggggggguccccacaacaugaggaacaguaugaaaggaucccaguguuaggaaggcugaggaccacugcucuaguccagggucuaggucaaaguaaagucuugcccuguugagacauuucaacuggaauaguggucucauucuuuagaacuuugaacuuauuucuaacaaaauccagggccuuaccagccgguggugguacacgccuuuaaucccagcacucaggaggcagagguaggcggauuucugaguuugaggccagccuggucuacaaagugaguuccaggacagucagggcuauacagagaaacccugucuugaaaaaccaaacaaacaaaaaaaauccagugccuugcuuguacuuauacacgacauuucaccuauacggaugugcauacccaacacacagggaggggcaggagaggugcuccuccaugggugaaagcacuggcugcucuuccaggggacccagguacuguuuccagcucccaugugucaccuccagcucugugggaaacagcgcucuccucuggccucuuugggcacugcaugcauguggcacacagaaaagaaaaaaaccuuaacauuaaauauacauauauuuggacuagagagguggcucagagguuaagagcacugucugcucuuccagagguccugaguucaauuucccagcaaccacaugguggcucauaaccauccacaaugagaucuggugcccucuucaggcaugcaggcauacaugcgggcagaauauuguauacguaauaaauaaauaaaucuaaaaaaaaauuaccuagcaacagagccugguggugguggcaguggcacaucuuuaaucccaacauuugggagauggagucaaccagaucucugugaguucgagaccagccuagucuacagcucugucuuccaggacagcgacagcuacacagaaaaacccugucucgagaagucauaagcaaaccaaaccaaucaaacaaaaaaccccagaacaucuuuacugagcagcuggggugugcugaguguuggaggcacggcuauaaagaagagcaguaagacuuaagcucuuguguagaagaaacacaagaaacucacacgccuugcagacagcaugaggaggagggcugaggguagaagcacuugcugccaagacugagggccaggguucaaucccugggacccacaagcuggugagaccugaccucacacagcuaccauggcacccacgcaccccuccuguuacauaaauuaacucaggaugauagaaugaagucaagccaaccagguaagauacagaaaacccaguuuagggcuggcgagauggcucagugguuaagagcaccggcugcucuucugaagguccugaguucaaaucccagcaaccacaugguggcucacaaccauccguaaugaaaucugaugcccucuucuggagugucugaagacagcuacaguguacuuacauauaacaaauaaauaaaucuuaaaaaaaaaaacaguuuaaugagaaccuuacauaaacaaugcaugcuuuugaggguaagcguucccaugaaguaucgauuaugaaaaugaguguuugugaccuggaauucauggcaagcuaggcagccuguccuuuacuggcuaaaacgcaaagugagccagcuacuccuggacccagagacaggaaggaacacauaucagugcaguaaagugggguaagcuuguagcagagaggaacagagaaggcaagcuaagcuggcuucuucagcccggucuuacuacagaacacuaggcuucagucuugaucaaaaaccugcuucuagaccuucaccuuucuuugcuugcgaggcguacagucacacaacugucuccuggcuuuugaaaagauaagauuucucuuguucaagggucaaaugaacaucccaguuaccuuuaaguugccaccaacuacaucgucgucugaaaaaaaaaauuuuuuuuugagaaaggaucucacuguguagcuaugccuggccucuguguagaccaugcugggcuuaaauaaauggcgauugucuugcuucugccucccaagugccaagugguaacaagcaugagccaucgccuucagcuucugaaaucaugugugugugagugaaugaaugugggugucuucauccauugcucucuuaguuuucaaggcuggaucucuuauggaaacagaagcucaccaauuagcuagacaggccggccaguaagccccagcgaucuuccugugucugccuccccagguacggaauuguagucaggcuggcuuuuaugugggugcuggggauucgaacucccgucuucuuccuugcgcagcuaucacuugcuuaaccaagcgugcuauccccuagcuugaaauucuuacucauucguuuauucuauuuguccuagaacagacgcucugcucugucccuucgcucaggcgugaacgagcacguuccauccaacaguuagaagccacuaggagccacucgcagaaccugcuagggucugaggaaagaaacccaaaacagaagccugcgucaaaaggcacggucucuugugacgucaccgcagacccgagcaaugguuccgauuggcccucgcagccgggguggggccaaagcauuccuggcuccaccccgcgucccggucucacucgcacaugcgcaguggccgccaccuuagccgccgcgccauuuugccaggguuugaaugugaggcggagcagcggcuggagugggguagugucggcugcagcucucgcuugggauucccuccucggucucggcguccccacgaggugaggcauggagcgagcaggguggccgcggggacgcggcugagggaggggccgaucgcugggagguggaucugggccucagcccgaggacgcgcgccuggucuuccccgcacgccgccucugggucgggccugaccgcuccgggaagcuggggcagcuuggggcucggccucacgcgagcuucucgagcucccgccccuucccuuccagcguugcugggauuggucgcgccgccgcguaggcguccgcggauuggucaagcccgcgcguccguucucggcgcgccggggcccgcagcgugagcgcuguuccgcgccgaggccugaccuggccgagccggucugggucccugguucuaaaagaggccggagaucgcccacucugacuucgcggggcuuuggccuccgccagaguggacuuggcccucggguuucagcuggcugugacguucgugucccuaggaccuaaggaaccuacaggcgaaugguguuccccugccuggggcucgccggcuuuccaguuagauaaucuguccccacgcacacuccgucuuucccuaggaguguaauucagagcuaguccuugccucucuacgaauuuccuaguuuuuaaauaauuaggugaugcugggcguggaaaccgugcucccucacguguugaacaaucucuuccacugaaauggcauuuuuacccucuccucaaacuuacgauucuucacuugcauauucgguuaaguggcuugaagguuccgcugacugcaggcuguguuucccagagggcucgccugaacugcugaccauggccauucgucucuccauaagcacugucgccuccaug

SEQ ID NO: 1280 - RNA, 8526 nt, Mus musculus
cauggaggcgacagugcuuauggagagacgaauggccauggucagcaguucaggcgagcccucugggaaacacagccugcagucagcggaaccuucaagccacuuaaccgaauaugcaagugaagaaucguaaguuugaggagaggguaaaaaugccauuucaguggaagagauuguucaacacgugagggagcacgguuuccacgcccagcaucaccuaauuauuuaaaaacuaggaaauucguagagaggcaaggacuagcucugaauuacacuccuagggaaagacggagugugcguggggacagauuaucuaacuggaaagccggcgagccccaggcaggggaacaccauucgccuguagguuccuuagguccuagggacacgaacgucacagccagcugaaacccgagggccaaguccacucuggcggaggccaaagccccgcgaagucagagugggcgaucuccggccucuuuuagaaccagggacccagaccggcucggccaggucaggccucggcgcggaacagcgcucacgcugcgggccccggcgcgccgagaacggacgcgcgggcuugaccaauccgcggacgccuacgcggcggcgcgaccaaucccagcaacgcuggaagggaaggggcgggagcucgagaagcucgcgugaggccgagccccaagcugccccagcuucccggagcggucaggcccgacccagaggcggcgugcggggaagaccaggcgcgcguccucgggcugaggcccagauccaccucccagcgaucggccccucccucagccgcguccccgcggccacccugcucgcuccaugccucaccucguggggacgccgagaccgaggagggaaucccaagcgagagcugcagccgacacuaccccacuccagccgcugcuccgccucacauucaaacccuggcaaaauggcgcggcggcuaagguggcggccacugcgcaugugcgagugagaccgggacgcgggguggagccaggaaugcuuuggccccaccccggcugcgagggccaaucggaaccauugcucgggucugcggugacgucacaagagaccgugccuuuugacgcaggcuucuguuuuggguuucuuuccucagacccuagcagguucugcgaguggcuccuaguggcuucuaacuguuggauggaacgugcucguucacgccugagcgaagggacagagcagagcgucuguucuaggacaaauagaauaaacgaaugaguaagaauuucaagcuaggggauagcacgcuugguuaagcaagugauagcugcgcaaggaagaagacgggaguucgaauccccagcacccacauaaaagccagccugacuacaauuccguaccuggggaggcagacacaggaagaucgcuggggcuuacuggccggccugucuagcuaauuggugagcuucuguuuccauaagagauccagccuugaaaacuaagagagcaauggaugaagacacccacauucauucacucacacacacaugauuucagaagcugaaggcgauggcucaugcuuguuaccacuuggcacuugggaggcagaagcaagacaaucgccauuuauuuaagcccagcauggucuacacagaggccaggcauagcuacacagugagauccuuucucaaaaaaaaauuuuuuuuuucagacgacgauguaguugguggcaacuuaaagguaacugggauguucauuugacccuugaacaagagaaaucuuaucuuuucaaaagccaggagacaguugugugacuguacgccucgcaagcaaagaaaggugaaggucuagaagcagguuuuugaucaagacugaagccuaguguucuguaguaagaccgggcugaagaagccagcuuagcuugccuucucuguuccucucugcuacaagcuuaccccacuuuacugcacugauauguguuccuuccugucucuggguccaggaguagcuggcucacuuugcguuuuagccaguaaaggacaggcugccuagcuugccaugaauuccaggucacaaacacucauuuucauaaucgauacuucaugggaacgcuuacccucaaaagcaugcauuguuuauguaagguucucauuaaacuguuuuuuuuuuuaagauuuauuuauuuguuauauguaaguacacuguagcugucuucagacacuccagaagagggcaucagauuucauuacggaugguugugagccaccaugugguugcugggauuugaacucaggaccuucagaagagcagccggugcucuuaaccacugagccaucucgccagcccuaaacuggguuuucuguaucuuaccugguuggcuugacuucauucuaucauccugaguuaauuuauguaacaggaggggugcgugggugccaugguagcugugugaggucaggucucaccagcuugugggucccagggauugaacccuggcccucagucuuggcagcaagugcuucuacccucagcccuccuccucaugcugucugcaaggcgugugaguuucuuguguuucuucuacacaagagcuuaagucuuacugcucuucuuuauagccgugccuccaacacucagcacaccccagcugcucaguaaagauguucugggguuuuuuguuugauugguuugguuugcuuaugacuucucgagacaggguuuuucuguguagcugucgcuguccuggaagacagagcuguagacuaggcuggucucgaacucacagagaucugguugacuccaucucccaaauguugggauuaaagaugugccacugccaccaccaccaggcucuguugcuagguaauuuuuuuuuagauuuauuuauuuauuacguauacaauauucugcccgcauguaugccugcaugccugaagagggcaccagaucucauuguggaugguuaugagccaccaugugguugcugggaaauugaacucaggaccucuggaagagcagacagugcucuuaaccucugagccaccucucuaguccaaauauauguauauuuaauguuaagguuuuuuucuuuucugugugccacaugcaugcagugcccaaagaggccagaggagagcgcuguuucccacagagcuggaggugacacaugggagcuggaaacaguaccuggguccccuggaagagcagccagugcuuucacccauggaggagcaccucuccugccccucccuguguguuggguaugcacauccguauaggugaaaugucguguauaaguacaagcaaggcacuggauuuuuuuuguuuguuugguuuuucaagacaggguuucucuguauagcccugacuguccuggaacucacuuuguagaccaggcuggccucaaacucagaaauccgccuaccucugccuccugagugcugggauuaaaggcguguaccaccaccggcugguaaggcccuggauuuuguuagaaauaaguucaaaguucuaaagaaugagaccacuauuccaguugaaaugucucaacagggcaagacuuuacuuugaccuagacccuggacuagagcagugguccucagccuuccuaacacugggauccuuucauacuguuccucauguuguggggacccccccaaccauaaaauuauuuuuguugcuacuucauaauuguaauuuugcuccuauuauuaacauaauaauauaacguaaguaacugucuuccaauguucuuaggugagccccauggugagaacauuuguucuagauucuagagugcauugcucagaaacauggaagagcauuuucugauguaggcgacgaucggucaggucuuuccuccauuggcuggugucugaccucacacuucuccauuggcuaguuucaaaagaaagugaagaacuggguguggugguacucgccuuuaauccuuaucaaggccagccuggucuacagagaaaguuccaggacagucaggacugcacagagaaacccugucucaacaaaacagaacaagaaaacaaaggauaugauggagagaagaagggguugggcucuuaauauuuuuaaguuccaagagagcaacagggccuuuacauaaacaaagguuuuacaggguaaggagacuaaaccauuuauauaaaaucuuacaagguuggagaggauaaaauauaugaauuucuugucauaaagagaaauuuuggggcuggagagauggcucagcagcugagagcacugacugcucuucugaagguccugaguucaaaucccaacaaccacaugguagcucacaacuacccuuaaugagaucugaugcccucuucuggugugucugaagacagcuacaguguacuuauauaauaguacuuauauaauaauaaaucuuugggccggagcgggcaggguugacaggagggagcagagguccuaaaaucaauucccaacaaccacacgaaggcucacaaccaucuacagcuacagcguacccauauacauaaaaauaaauaaaaucuuuuuuuuuuaagugaaacuacagaagccaaaaagcaagauuaguacaauuagagaauuuccaagaucuauggaauuugauggacuaggucuugguuuuaaaaaaaaaaaaaaaaaaagccagagcugggcaugguggugcacgccuuuaaucccagcacuugggaggcagaggcaggcagauuucugaguucgaggccagccuggucuacagagugaauuccaggacagccagggcuacaaagagaaaccaugucucagaaaaaaaaaaaaaaaaaaaaaaaaagacaaauuuuacacuguaugauaaaaaaaacuucauguuucuuacaauuugauacccaguccaaauaucacacacaccacacacacacacacauauacauauauauauauguauauauauaccauacacacacacacaccacauauaacagaccacacacacauauauauauauuuaugcaugcaaacacacaaacacuauccacacacauauacacacuucacaaaugcacaaccacauauacauacacacauacacacauaccacauacacuggauacaggcugguacccugcagcuaacaccagccugaaaacccaaacgcugaggcaagaugaucaggucugucugagaguaagcaccccagcacacacuaugucucugcagcagcagaagcgccaugcuagcggguacuuuggacaggccgaucugcaggguguguggcgaagccgaaugaguaccacuaccuauucuuagcguuggcuacaacugugaaugaugguguuggaaacacagaugauaacuaagcagaauucuaaguauucacucauaauucauucccuuguuuucgaugacuaaggaaacaaugucucuacagcauggaagaucauucugaaaagacgcaucuccuaucgcgggcuccauggaagaccauuucuucuauuuccauucagacggaugugggcacauccgcucauacuugcagagaacaaguguccuuuggcccaaguaagaagaaaagagcggucauagcuaaaaucaagaagcaucacacugaggcguguuuguccuugguuuuuaaauagaggcagugggcuagagagacagcccaacaguuaaaaacuguugcugcgcuuggagacucccagguuccgaucacagcacccgcaugguggccgagaacugcuguaacucuaguucuaggguauccgaugcccucucuggccucuacaggcacugcacucaugugaagcucacaaauacauucaggcaaaacacccauucaugucaaauaagaauaaaacuuaaaaagagagagggggagggggagagggaggggagggagggggagagagggagagagaaagaaagacagcgagagagagagagagagagagagagagagagagagagagagagagagagagagaaaguguuaguucuuacugaguacagcccagcaccaaaugugcacuggacaggaaacaacuauguuugcaucucaucuccugcuuccucuuagucuggcuucaguuuuguuuugagcugggcauaucacccuauaguccaggcugaucuagaacucaaguguaacccaggcuggccuuaaacuugcaguaguucugucucaggcuccuaagugcugauguuauaggccuggaccacugugucuggcuugucuguuuuugaggucauuucucuuuuuuuuaauuauuguuaauuuauuuauuauauaaacacacuguagcugucuucagacacaccagaagagggcaucugaucucauuacagaugguugugagccaccaugugguugcugggauuugaacucagaaccucugaagaguagucagugcucucaaccacugagccaucucuccagccccuugaggucauuucucauggcuggccuggaaguaaguugauguguaggcauccuggcuuugaacuccugcaccaucaaccaggugcuaggcuacagcccuaugcuggauuuuucucuucccuuauuuaaaaaaugagaaauuggagcugauuagauggcucaauagcuuacuggcgcuugccaccaagccugacaacuagaguuuuaugcccaggauccacaugauuggagaagaaaaccaauacaugagagcuguccugucacuucacacgugugccauaguacacuuaucggugugcacaaguaaguguaauuaaaaauguucugagggccagguauggugccucccacucaugccuuuagucucagcacuuggcaggcagacacagguagaucucucgaguucaggaccagccuggucuacagagugaguuccaggacagccagagcuacacagagaaaccccaucucaaaaaacaaaacaaaaacgacaaaaaccuguuauucugaaaaugguuuuagcgacuuauggauggaucucaguugguagaaugccugucuagcauaaacugaccucuggcuuucauucucagcccuccaucacaccaggucugcuggcuugcuccuguaguucugcauuugaaagacagagcuccaggaauugcagaguucaaggccagccugguuacagacuaagacccagucacaagcagccaaucaaauaaauggaguggcugagguuguggguguucaccaccaggcuucugguuuguuguuuguuuguuuuauagugugggagauauauauaauacaggaccucaaugcguccaaaagcaugugcucuccuguuuguuuuuaaacuuuauuuaauguaugagugcuuugcuacauauucaucugccugccugaagaagagcaucagaucccccuaaagaugguugugagccaccacgugguugcugggauuugaacucaggaccucuggaagagcagcucuuacccgcugagccaacucuccagucccaugugcucuacauguugagcugcaucuaccccagguccgucagacuucuccugacacccaauuccauuauucccaaauccucauuuccacagggagugcagccugaggccaacucacuucuuagacagcuucauuacagcccuuuucuagauucuccuuccccacaggcaaucugcccacaggccaagcagguuaguucaugaaggguguggucucuuugaggccucccugaagucacauggguuuguggagaccucuugcucauccacuucuagggagugugaauaggaggaagacaggcaguuagcaguggaugugaaaagggucacacacacacacacacacacacacacacacacacgaaaggcuuugcaguacuucuagcucauugguagaguguguggcuagcaugcaugaaaucuuguauuucaaccccagaacuacauaaaaaccagugcagugcacuccucauaauaccaguacuagguuuauuggggcaggagaauuacaaguucaagguuguucucugcuacagagcaaguucaaggcuaaccugggcuauaugaaaucaucucaaaaaaaaaaaaaaaaaaaaaaaaaaagauuggggcuauaacuggccgagcauccaccuuaccuuugcuuugaaauucaucucucaccaucaugcucagaaggguccuaaauguuaucauuuccuugcaauagugagggaccaccguggaagagaacacagagggaacugagagcuggagaaggcgcuguugagggacacccaccgcuuccgggcauggcauggcuggcuccugcagucuugaacccacagcuacuguacuagaagcaugaaggcacacugggacucccagacuacccaaacaacggaccccagcaaguuagaugucuccaagaaucucaaguuaggaaacgaaaaagccuggacaaaccagaggggagcccucccagggacacccucccccccagccccacccccagacuuguuagacuuccuugcaauggacuggaccugagaggagggucagcgguuggugggaccacaccuugaccacaacugcgguuaugaauacuucuugccuucuacuuuaag

SEQ ID NO: 1281 - RNA, 40371 nt, Mus musculus
caugcgcaguggccgccaccuuagccgccgcgccauuuugccaggguuugaaugugaggcggagcagcggcuggagugggguagugucggcugcagcucucgcuugggauucccuccucggucucggcguccccacgaggugaggcauggagcgagcaggguggccgcggggacgcggcugagggaggggccgaucgcugggagguggaucugggccucagcccgaggacgcgcgccuggucuuccccgcacgccgccucugggucgggccugaccgcuccgggaagcuggggcagcuuggggcucggccucacgcgagcuucucgagcucccgccccuucccuuccagcguugcugggauuggucgcgccgccgcguaggcguccgcggauuggucaagcccgcgcguccguucucggcgcgccggggcccgcagcgugagcgcuguuccgcgccgaggccugaccuggccgagccggucugggucccugguucuaaaagaggccggagaucgcccacucugacuucgcggggcuuuggccuccgccagaguggacuuggcccucggguuucagcuggcugugacguucgugucccuaggaccuaaggaaccuacaggcgaaugguguuccccugccuggggcucgccggcuuuccaguuagauaaucuguccccacgcacacuccgucuuucccuaggaguguaauucagagcuaguccuugccucucuacgaauuuccuaguuuuuaaauaauuaggugaugcugggcguggaaaccgugcucccucacguguugaacaaucucuuccacugaaauggcauuuuuacccucuccucaaacuuacgauucuucacuugcauauucgguuaaguggcuugaagguuccgcugacugcaggcuguguuucccagagggcucgccugaacugcugaccauggccauucgucucuccauaagcacugucgccuccaugaccggcucuuuuaaguauucauagucccguccuguaugcuaaguccccagcuuucgugauguuagaagcagcugaccucagaucuuggcggggcugccucccucccugccuuucaaguucccuucuuagggaggaguucucaguucucacugcgauggccacaucacccacguuuauguguccuguagcauugaccuuauauguaguaacuacugcuuguuucucacgguucucaucugcucugaguuaucuuuaaggauaacuuuuuauugcugggucccauguaugagagccacauggugaaugcucuguuauuuuaugaagacauggaagguaucugucugucugucuaucuauuuauuuuggauaaagggucuuucauagcccaggcuagacuuagagcguuaucuuucuacaaguguaggcuaccacacucaacucuucuucacuuuuccauuugugcaaaggaauuuucuccccucuggcuguuugguguucuaguugggcuuugggaagccagucucuagacaggaauugguugagagagcagugcuuuuaacuguggaauugauuuauugccuuauuuguuuaauaucucauucuaugaaacccugggaauauagugaagaaucacaaguggacaaggugucucucuuuagggagcucacguucuaauuggaggaguccgugagugaguucagguauuucaggucgugacagaggugacaggugaagagguggcguuugagcagagacuaaccagggaaaggugaggugaacaagaaacaaaaacucaaggacagaaacucacuuggaauucggggcgucuuaggaaaauccaagucaaguggugggaagaagagcuggugcaggacuuuguggccguguaaguuuggguuugauacagaguggaagcagagaaaugauguagggacucagguuacugcccagacuccuguugucuugaagugugcuuaguaacuguucuuuuuuuuuuuuuuuuuuuuuuuuuuuuuuuugugguguaugggggauauaacuccccccuuuuuuuuuuuuuuuuuuuuuuuuuuugauuuauuuuauuauuauauguaacuacacuguagcugucuucagacacaccagaagagggagucagaucuuguuacggaugguugugagccaccaugugguugcugggauuugaacucuggaccuucggaagaacagucgggugcucuuacccacugagccaucucaccagccccaguaacuguucuuuuaaaaaagccaaggguagggugagcaagauggauggauggaaaguaacccuaagugaccccucccuggccugacaacuggguucccugggaccccagugcuggaaggggcgagcugacuccugcacguugucuucugacuuucacacauaugcuguggcacaugugcauauaauaaaugccuauaguaaaaucucggggaacaggagagguggcucgguagucaagagcauguauuggucuugcagaggacccaagggugguuuccaguaccuacaggugggccagaauugccuauaccucuagcuccagagaaucugauggccccuagcuuccaucgacucuuagguauacauacaggcagaaacauauacagauacacauaaauuuguaaaaaacuuuuaaggugggaacagauguuaaguuaaucucuugauguauuguuaauuuucauuuauugaguuccuuucccucuucccagaugcaaggaaggccucagaaaugcuucucuuagugagguugacaaaaagacaagagucuuggacauuuuaucaugggcguuugugagauguuuggggaaaaguauuuguucccaaaaccuucauuuucaucugagggcccauaggaagaggcuaggcuuuccgcuacucaggacuuugaaaagguguuaauguucuaugugugaguguucaccuauauguccuuuuuuuuuuuuuuuaaagauuuguuuauuuuauguguauauacagcuauacagaugguugugagccuucaggugguugccgggaauugaacucaggaccucuggaaaagcaguuggugcucguaaccacugagccaucucuccagcccaagauuguccucuuacaacaguucuaagucaucugggaagagggagugucuagcagguugccuguaugcagucucugggauuaauucuuuucagggcaggugguccugggugguacaaggaagcaggcugagcaggccaguaaacagcacuccucccuggccucugcuucacuucuuuuuuguuuuuuuauuuuuaaauauuuuuuuuccuuuuugauuuauuuauuuauuuauuauauguaaguacacuguagcuguccucagauauuccagaagagagcaucagauuucauuacagaugguugugaaccaccaugugguugcugggauuugaacucgggaccuucagaaaagcaguuggcacucuuaaccacugagccaucucgccagcccucugcuucacuucuugccucuagguuccugccuugaguuccugcccugccuccucuucguaaugaacuacaguggugaugaaauaaacccuuaccuccccaaguugguguuugagcaugcaauaucugccacagcaauagaaagcacacuagagcgagcagcaaaugcucuuaacuauggacccuucucuccauccccaagcuugguuuuugaggggcuggugaaugguucaguaguuacaggacuggauucaauccucagcgcuuauguaaaagucaggcagggacguaaaugccuguaagcccagcacugugagugggagacaggugaucccaagguugugagucauaaugugugucucacaugaggucuggccacccauccuuaagcucagacuugccuugugauaaguccucucaauagcuaaguggaaaggacuauggugaggagaacacagauagcaaaguucuuuugaaggucauggcuuucggcuauugggaagcauccugcacaaggccagccuuaaucuuuuucacugaguguuuuucucaguauguaucaagaugaaaauuuaguuuaugucuauaauccaucacuuagacaggaggguuguuauaaguucaaggcuagcuugugacaccuugucuucaguaaaacaaaacacugguggaacaucuuuuucauuuauuuuuuuuucuuuuuuuuuuuuuuuuuuuuuuuugagacaggguuucucuguguagcccuggcuguccuagaacuaacccuguagaccaggcuggcuucgaacucagaaaucugccugccucugccucccaagugcugggauuaaaggcugggccaccacuccuggcgaucuuuuucauucuuuagaauccugucuuacucucuuugacugcugcugcuuuuccuggcuucuaggaugcccucuuuuuuuuuuuggggggggggguuguuuguuuuguuuuguuuuuuugagacaggguuucucuguauagcucuggcuguccuggaacucacuuuguagaacaggcuggccucgaacucagaaauccaccugccucugccucccaagugcugggauuaaaggcgugcgccaccacucccggcucggguugcccuguuuuaacagcagccuuucuguuguguucuuaguucagcuguaucauuuugaaacauuuagaggcugcccuggggagcagaaaagguguuaugaaucaggcagaucugaaucagaccugucuaucaguuuaggcaugugagucagccacucuggaguucccuuccuaaucgcuguuugaaaugaacgguagagcauauaaaucaccuagcacugucugguugcuucauacagauuuccccuucccaguguccgaacugucuagucucucuaucucuguuaugcaaaccauuaccagcucaaaguuccaaaaucucuuuaaauaaauuucacccacuuuaaaaucuccagugagcucuguguggugacacacaccuuuagucccagcacucaagaagcacaggcagguggaucucugugaguuggaggccagccuggucuacauaguaaguuccaguacacccagggcuacacugugagacccugucuucacaaaaaaaucuuuagcggcucccuauuuacacauuuaauuucugaaacagcugggucugaggcaucagcagaccuagagucaucuccuagucuugccucuuucugucucugguacuuuacucacaggauuucccacugggagauccagucaggacucgguccuaagaaagcuugggugagugacuucauauuccaguagacuuuaucauaccauuccagcuguuagaugcugucugcggauuccuuuggcaauuuacuccagaagauaaauguuuuucaggauuuaguuuucugcggugugugagagcauacuuuguauaccacauacgugguggggucugggguagcacuugccagguuucccaccauuucuuuauugggugguuuacuacaauucacaggagaggcugccgagcggagucugcucucccauacgugccacucaccaucucaccagccacaagcacauuauuucuuuagugaaacaaauuggugcacuuaacuagauuuuuuaaaaauuagacuugaagccucagccuaggccaagcuuuuuuuaaaaucauguuuauuguuuaugugggcggggugggguggguaguuacuugcugugugcgcauguggaagucagcacaacuuuagugaauuagguuuuuccuuccaccaugugggugcuuagcauggaacucagaucaucuugcuagccuagaaggucaggugguguuaccaaauguuuaccacauaacuguaaggaaacaaaguccuggccauuaauugauuugggggggggggauuuugagacuggagagaaauuacaugucuauaagaaaauaaaauccuuuuguuuuauugauuuggggaguuuugagacugcagaaagggauuauagguuugguauguggcaauuuaaacgagucuucccaguuaaucuggaagcugaggcaggaggcaguucaaggucauccauaacuauugagaccuuguagaaaauaugggggcuguggaugugccuugguugguagagagcuugccuaggauguaccaacccugaguuccaucccagaacugcauaaaccaagcaugguggcacauaccuguaauuccagcucuugggaaggagccgaaugagaaguucaaggucaucuuagacuauacugugaguuugaggccugggcuaaaugagacccuuccucaauaaauaaacaaguagauaauuaaaaacauaauaauuuaaaacuuggugguuguguaugaaauauauaaaauaauuguaggacaucaggaagauggaggcgauugaaagacaauggaaguccccuguguguaccacaugcauagauccauagaucuaagcauccuuggagugcauuuuccuguuguuuuuuuagauuaauuuuuagguguguggguguuuugccuguaugcgucuguucacuguaugugcagguccaaggauguguccuuuccgcuagcccuggaguacugaguugugagcugucuugugggucuugguauuggcaguugaaaccagguccucuagaagaacagugcugagcgcuuuccagccccuucugcucuuagauacauguaaaaucccuaauggaguuugaaucauguuguccuugaaauuuuccuacuuaguuuuguugcauuuacaggguuuuuguuuuguuuuguuuuguuuguuuguuuguuuguuuuuugguuuuucgagacaggguuucucuguguaacacuggcuguccuggaacucacucuguagaccaggcuggccucgaacucagaaauccaccugccucugccucccaagugcugggaauaaaagcaugcgccaccaccgcccggcuauuuacagaguuuuuaucccccucuguaucacacaggagccuaaggauaacuuggcaauaugaguuucuagaaaaggcuacauugucccaguuucuuggcugguauauguggcugugccuaaagcugccuaagacaucaaaaucuaagcagaaguguuuuacauuuauuuacuuugugugcaugauaggugggguagagcauguaucauaugccauggucugugugugugacugucgggacaguuuaguguguauguuuguuucagauuuauuuuaugacuaugaaugcucuauuuuuuuuaaagauuuauuuauuuuacauaucugaguacacuguagcuguucagaugguucugagccuucaugugguuguuggggauugaacuuuuagggccucugcuugcucuggucaacccccacucacucagucccugcuugcuccagcccaaagauuuauuuauuauuagauauaaauacacuguagcugucuucagacacaccagaagagggcucagaucucauuaugggugguugugagucaccaugugguugcugggauuugaacucaggaccuucggaagagcagucagugcucuuuagccgcuaagccaucucuccagcccgaaugcucuauuuucauggauaccugcaugccagaagaagacaucagaucccauuacagaugguugugagccaucaugugguugcugggauuugaacucaggaucucuggaagagcagucagugcucuuaacugcugagccaucucuccagucuuuuguuuuuguuuuuugagaugggguuucuuuguguuuuccuggcuguuugggaacucuauagaucuuuuuggccugcaaccuagaaaucugcccauauuaagcuuuuuaaaaauaacauuuaauuuuuuaaaaaagauauuguauauauaugaugggagacaaggccucccucgccuuuguaaguacagguucuccaccuuuacuugcugagcuuccucaacagccugacacuuuuguugguuuuuauguuuuacuuuugcgugugcacaguggcaaggguagaaagcaugcaugccaugucauguggaggucagaagacaauuugcaggaguccuuuccucccaucauguauggccugcacacacauacauagucaaaacaugcauacacaaagaauaauaaaagacaauuuaaaaaguauggguucaccaacagcuauacacauaguuaagaauuagacuaccaaagugugggugcuuuaguccuucuuagaagggggaacaaaauacucaugugaggagauacagagacugaaggaaaggccauccagugacugucccaccuggggacccaucccauauacagucaccaaacccagacacuacuguggaugcuaagaagugcuugcugacaggagucugauauaacugucuccugagaggcucugccagagccugacaaauacagagguagaugcuugcagccagccauuggacugagcaugggguucucaauggaggaguuaggggaaggacugaaggagcugaagggguuugcaaccucauaggaagaacaaccauaucaaccaaccagaccccccaaagcuccaggaacuaaaccaccaaccaaagaguacacauggagggucccauggcuccagcugaauauguagcagaggauggcuuugucgaacauuagugggaagagaggcccuuguuccugggaaggcucagugcccaauguaggggaaugccagagcagggaggcaggacugggugggugggugagcacccucauagaagcagggggaagggggaugggauagggggcuugcagaggggaaaccaggaaaggagauaacauuuaacguguaaauaaaguaauccaauuuaaaaaagaauaugcuauaugaacccugucuaaaagauccugucccccaccaccucaaaaaaguauucauagcugggcaugcugaugagugcuuguaaucucugcuuuagagaugacaggcaagaauauggcacaaguucuaggccauccugucuaaugaguuuugggcuagccaggacuagcucuaaagcaggacacuucuaaagcaaacuagaaaacaucaguaacaaaaagauucauuuauguuacuuacucacuuucuccucagagauugcuuauuuagacuccgguuuuuaauuucagauucagagucauggagcucagcgaugcgaauuuacagacacuaacagaguauuuaaagaaaacccuggauccugauccugccauuagacggccagguaaagauggcuuuguuccuugacugauugagucucucucuuccuuccgucuuuucuuuuuuuuuuuccuuuucuuucucuuucuccuucucuuucucuuucucuuucucucucucucucucucucucucucucucucucucuuucucucucucucucuuucuuucuuuuuugagacaggguuucucuguguagcccuggcuguccuggaacucacucuguagaccaggcuggccuugaacuccgaaauccaccugccucuaccucccaagugcugggauuaaaggugugcgccaccucugcccagcugauugauucuugagacacauagcagaaaccuuuuguguagucuaccugguuguaaguucaaaagaaaaaauauguuuguuuauguucucaggccugguuauguggcaugguuggcugcuuacaauagcuauaauacauggaauaauauuucuuauugaguaaaguagcguuuauuugacaucuuuuaggguaaaaaguacuaguguguuuugaaagcuuugucucaggaacuuucugaaaaucucauuaaaucugccuucuuuaggagcauauguuaagucaucgagauugggauaguucucaaaaggugauuaaaugauugaaaucaaggaauauggcucucuucuucccuugguaguuugauuuacuuaacauugucuaaguccuagaguuacuuguauggacuuagaauuuuaaccucagauacaaaaguaaaagaagggagccucgccagguggacugcuggcuugugcggagcaagugacggcauggaagaggucaccuuuaagcuaacuggcuaauuuuguauggucagauuuucaacuuugcuugaaaauuaaggcuaucaauaugaaguacccucauuuuuaagugaugguaaccaacuuuaaaaaccuugggaaaugugggggucagaaagguuuugagcagucugguaauucuugauaucagaaucccccugaaccagaaugcgucaaaccugcagaacacagugauguuaguucauggagaugauuugucuugagaagaucugagucauauguggagggaaauauuguaugaaauaaauagaaaugugacugugugggugguuugugucugggucuccaccccacuuguuacuucuuuguuuacuccaaaagaaagccagugccaagaacuacuucugaguuauaacccuagccucauccuauagaaaagucuguggguuuuucucuaauuauuagacaguguuguugaaguuauuucaugccaguaugcaaugcacuuugaauucauacccaccucacauugacuaccauccucuaucauccccuauaauuugugugugcucaagugugcacgcaaauaggcacacgcggcagccagagguuaauaguggguauauuccucuuauuuuaaaaagauuguuuuauguguguguuuugccuuuguguauguauguguagcauguguguguauaugcaccacaugugcacuguacccaagagcuggaguuauaaaagguaguaagcggcugcgugggugcuaggaacagaacuugggcugucgggaagagcaucaagggcucugucugacugcucuuagugauaguuugugagacagggucucugaaccaggacgugguuagacuggaugccagcaagccacagguaaagaccugugcuuacuugaauagcccuggaauaagcaacaugcucccuugugcccuguuuuuauguggguacuggggaugcaacucagguuuacaugcuuggccaacaaacauuuacccaacugagccaccucccucgccccagucuuuuucugagagucauacuaugucccuagauauggaaaaauuaauugcucuaaucuucuuagaauuucccagaaagucuaugcuaacacuauuaaaacguauuuuuuaauuugucuuuaaaauaugaggaugcuaaaaagucuuaugaccccaggacagaguguagaaauaaaccgccgauucugggaagcacauuucucaaagagugauaugagaccugcacagugcguuuguguaucugacuguacugaccaggacccugcacuuguuagacuggcuacaucuuuaugacaugauggagacaaauugguuacuggaucucacuuugauuagacauuuaacaauuguauggauauacauagaaaauuggaacuguguguguguguguguguaugugugugccucugucauguuucugccucugucauuccacugauuuuugagacaggaucucuuaccaaaccuggcucacccauuggauagcuugcuccucagugagcgcagauccacagauccuuaugucuuuuagacauuaggauucaggaggaacucuggucaucacccugcuuccugcuguacugcgugaacccucuccccagccuggaacuggaaggcuuugagguuccuugcuaaugcagaaacaggucaaagauuuuugugugagagaagggagggaggagagacagacagaugaaggauguggcagaggacggcgauguaaaguugcucuuuucuccuguaccugauucccaggcauagggccuggguccuuaguuuuugagcagaugugggacagacagaagugcauuuacaagcuaaacugucugacccucaguuaggaacauugcauagauaaaacugcaaacucaaaagcauugacuuaaacuuuugggaaaagugcuuuagggcaagguagagugcuugucuaucaugcuugaaccuggagaguccccuccccaguacugaguuagugggacaugguagcccaugccuauaaucccaguuucugggacaggggacacaggaugaucagauaugcaagaucauccuuggcuacauacugaacuagaggccacugaggcucugagugaaugagguaguugagauggcuuaguggguaaaggugcuugcugccaagcuggcugacuugaguuugaucucuggaaccaacaugguaggguagaagaggguaccaucacacauaaauaagcugggcagaaagacagacugacaguuuaaaaauaauaaauaaaaacagauuuuuaaaaaugacacacaucaaacaaaaaaacaacauagcaugucuuuuccugagaacauuuuucaauucuacagucugaauucuuuauaaaggauagauagaaaacagcagguuucagaagccagugugguuaauacagccacucgcacacauaugcaugucaaaucaaagucugucuuuucuccuagucuuuuuuucccucuguuuuguuuguuucuguuuguugagucaggaucucaguauagaccaggcuggcuuaucucaguguagaccagguugacuuaccucaguguagaccagguuggcuuaccucaguguagaccagguuggcuuaccucaguguagaccaggcuggcuuaucucaguguagaccagguugacuuaccucaguguagaccagguuggcuuaccucaguguagaccaggcuggcuuacccuuucuaugaagaccaccuuggaccuuuaaacuugcagagcuccuccucccucugccucccaagcaacaaaaaucuuuugucuuaguuuugugggcucagugagccugacaguaguguagacuuuagggacaguuuagcuccugggauagccugcucacagaaaugaacucaucagcacuacagacaacccuuguggaaggaggcaccuaugcaccuuaucaguaccauuuagacauuuccugggaagcugcagcuuugggggaguaaccaucugaguagaugugggagaacugagugaggucauuucauuuaacauuaugggugaaccuuuuuuaauauuauuuauuuauuacuauuuauacaaguacacuguagcugucuucagacacaccagaagagggcauuggaucccauuacagaugguugugagccaccaugugguugcugggaguugaacucaggaccuuuuggaagaguagucacugcucuuaaccgcugagccaucucucuucccaugugugaaccauuuaauggauaaaaugaguguuacccuguaggaaagauguucuaaucuuugcguugguugguugguuucuauuuauguaucugauuuguuuguaagagagaaugucacugugugcuucagaguguagccugggcugucccggacccucccaugugugcagaugacucuuacuugucauggaaucuuucccccuuuuuuggcauuucuauguuuuaaauauagacauaguucauuauagguauagaaugaaaacauuuuuauuauaauaagucuaacaugaaaauucuuucacagcugagaaguuucucgaauccguagaaggaaaucagaauuacccacuguugcuuuuaacauuauuggaaaagucacaggauaaugucauuaaaguaugugcuucaguaaccuucaagaacuauauuaaaaggaauuggagaauuguaaguauuuugggaaugcauaaucaaauacuguguauguuucuaugguuuauauaaaugcuuuuaauagauucagccauuaaugaugaacagguucuucuuccaaaaugucucuuaccucauuuacaucccacauaacauccucaaacuucauaauucagauuguuaacagaguugagagaccugggaugugaagacagucuaaauaaagaauuaaaguagguuaagguggguauguguuguguuuauguccucccaguuacaacaagaaccaaggucaaugacagccuggggaagcacagugaaauccuauuccaaaaaguaaacuuuuuuuuuuuuuaaugucuucauaugaucuggcuguaaagcauauucuuuuuuuuuuuuuuaagauuuauuuauuauuauaucuaaguacacuguagcugucuucagaugcaccagaagagggcgucagaucucauuacggaugguugugagccaccaugugguugcugggauuugaacucaugaccuucggaagagcagccgguguucuuaaccacugagccaucucuccagcccccaaaaguaaacuuuaaaguaauuaagauauucauucguccauuuauuucacagcagggucuuuguaucccuggcuagucuauaaaguucuaucuauagaccaggccggccuugaacucauagaaaucccccugccucugccuccugagugcuguguuuaaaggugugugugugugugugugugugugugugugugagagagagagagacagacagacagacagacagacagagacagagagcgugagcaugcauaugugcguguguguuuuaaauacuuuguaccaccacagccuuguuguuguuuuuuuguuuguuuguuuguuuguuuuguuuuuaagacaagggucucauguagcccagaguggccucaaaauaagcugucuuagagaacggccuuaaacuccuaguccaucagccucuacuuccuaaaugauaggauuauaggcaugcaccaccaugccuaauuuguccaguccuugagauugaaucuaggacuugggguaugcuaugcaagcguucuacucauuauccaugccuuggcucuguguguuuggguguuguguguucauguauguaugugugccacgguacauauuugcaggucauaagacauaugaucuugguugguucuuaccuuuccuauuguuugagacauguucuauuuguuuuucuucuguguguugugcuggccuuggcuucuagggcuucuguuucugccccaucucacuggagugcuaggguugcagguauuucugcuacaagucuggcuucuauauggacuuuggagauuuauuuuaauucaaguccucacacuugccuggcaagcauuuacauccacugagccaucuucauccauccauuuauuuauuuagagacugucguaguuaugguuuacugcugugaacagacgccaugaccaaggcaagucuucuaaggacguauaauuggggcuggcuuccaggucagaggugagggcauggcagcauccaggcaggccuggugcaggaggagcugagaguucugcaucuccaucugaaggcugcuaggaaaauacugacaggcuaggaugagaguuuuaagcccagguucacaguggcacaccuacuccaacaaggucacaccuucuaauagugccacuuccugggccaagcauauauaaagagucaaagagacaauauggcccguaaacucacuuuguagccgaagcugucacuuaacugcaugugugcugagauuacaggugcccaucucccugcuucucuuugaaaagaauguauggacuaggcgguaggcacaggaggcagaggcaggcuggucucuggaucccaggccagcaugcucuacagagggagcuacaggccagccagggcuacacagagaagcccugucuuguaaaacuuuaaaaaugagagagagagacacagagagagauagagauagagagaggggggcugucuuguaaaacuuaaaaaaugagagagagagagaaucuguaacuaaucuugaaagaggaaacugaagagcagacacguuucuccauuuuccuuggaaaccugagauaauaacauuaguuguguucuaucgguaaggccaguggaugugaaaguggauccugugucacuugcuuguugauuuuuuugcucuuagguugaagaugaaccaaacaaaauuugcgaagcugaucgaguagcuauuaaagccaacauagugcaucugaugcugagcaguccagagcagauucagaagcagguacggcccugccucugggcugggccuggggagugggugcuccuccuuguggcugucugcucauuagcccauuccuucccuagcugagugaugcuauuagcaucauuggcagagaagauuucccucagaaauggccugacuuguugacagaaauggugaaucgcuuucagaguggagauuuucacgucauuaauggaguccuucguacagcgcacucacuauuuaagagguacuagucgauaaguucauucuacaauaguguacauuucugcuguguaacuuguuagucuugaguaugcacaucuugguaccauuguuugcuucucuugcaaggacacucaucucacacugcccugguuucugugugcugaugaaauuguccuucaugcuuugccuucagaagccucugguugaaggugucuagucaucuguucuuaaaauguuuuuuuuuuuuaagauuuauuuauuaguaguaguaguacacuguagcugucuucagaugcaccagaagagggcgucagaucucauuacggaugguugugagccaccaugugguugcugagauuuaaacucaggaccuucagaagagcagucggugcucuuaaccacugagccaccucaccagccccuagucuucuguucuugaacaacaaagcugaacuuauacuucuccauuuccuagauaccggcaugaguucaagucaaaugagcuguggacugaaauuaaacuugucuuggaugccuuugcuuugccuuugacuaaucuauucaagguaugguaugucuugaaaaucaccuuguauuuuacguuucuuaaauauguguguaaauuuugagauuaaaaaaaaagauuuguuuauuuaauuauauguagcugucuucagacacuccagaggagggcgucagauuucauuacagaugguugugagccaccacguguuugcugggauuugaacucagggccuucggaagagcagucagagucaucucugcagccucuugagaucuuuuuuuaaaacuuguuagauaguguagcauuucuuugagaagaauugcaacccugugcagacguggacacacugaggagugaguuuccugguuguacaagucuuuuuucuuuuuuuguuguuuguuuguuuguuuuucgagacagggucucuguguaacccuggcuguccuagaacucacucuguagaucaggcuggccuugaacucagaaauccgccugccucugccucccaagugcugggauuaaaggcaugagccaccacugccuggccgguuagucuuaaguuacuaaaauuuuguuagucugcuuccuuauuuuuauaagaauauuuuaaaacaaaacucaaguguccuaccauuucacccaaguaagugaacgggugucucuaaagagagagugacauuuuugucuacauguagauuuuaaucaauuacauacuuauaaaguacacaggcuacuuucuuuaggauguucuugguguuuauaaaaaucauauaaaguuaaagaaaauuuaaccuccccuccuuuucuuaaugaacaagaucauacaaaugcaguuaguaaaaugggaacagggcugacgucucacucccugcgauggcggaaggcuuuucauuucccacuugcaaagaggguaguuguguaauacuuaguauuuagauagagagcuuagacaaggguuuuuuaugggaagaauaacauuuuucaaaaauuaaaacaauguaauuaguuuucuaauuuucaauugggaaagauuuuuauuuucuaacaaugcuaauuaaaagucuucgaggcugauguaguucacaugucuguagucccaacuuaugggcagcagaggcaggaguauuaauauuaauugggggugucuacucugccuuugaucauucauuucccagauaaaagacacacaaaaccuuugcauuuauaauaaaccuuaacagcacuagaacucggcaaauaucaacccucuaagcuauuaguaucuacuucccuaucaguaaccccaauuacaauucacuaggcuguguuuggucuaggccccucauacucccaauuggccagcccuucccugugacaucuucucucuccaccuuuucuugguucucugccuccagccccaauucugggaaccgaggcccugccuaucucucuucuccccugcuguaguuuguaggcaucuuuauucacccaguaguucugaacuaaggagcaaggcugcacaacaaaagcuggugaaggagaauucacugguaggccuggaacuuagcauuguauuacauagcacagaccaaaccucaaggugagaaaaaccuuaguguguauuuuucauucuaaauuccagaauaaaucaaguagcaguugcuuccauaguaggagugugcaaagugcagaaagugugcucuguuuguggcuuuuuguuauuuuggguuugggggcagguuugguucuuuuuguuguugggguuuuuuuuuuuuuguuuuuuuuguuuguuuguuuuuuuaaagauuuauuuauuuuauguauaugaguauacuguaacugucuucagacacaucagaagagggcaucagaucucauuacagauagccuugagccaccaugugguuguugggaauugaacucaggaccuuuagaagaacagucaguguccuuaacugcuugagccaucucucuagcccuuuuguuuuuguuuuguuuuguuuuguuuuuuugagacaggguuucuguguggagccuuggcaguccugaaauucauuuuguaggccaggcuagccuugaacucagagaucugccugccucugccuccugagugcugcuauuaaagaugugcaagccaugauugcccaucagggauuaacauaaaaaaauucugucauuugcuacuuauauuugcacacugggccuggcagagaucagaauuauuuaguuauuuuauuucauguauaugaauauuuucccugccugcaugaaugaauaugcaccauguguguaagccuguuggauucccuguagauucuuauccacuguagugcucuuaaccacugaaucaucuccuagccuucuacucaguguagcucuggauagccuaaaacuuguuauacaggccaagcuggccucagacucaaauagauccaucagccuuugaguuuaggaauuaaaguuaggugccaccacauuuuuuuucucucucuuaggauuucccuauauagcucuguuaggccuagaacuuagcauguacaucaaauuagccucaaacucagugaccccuguacucugaguccugguauuaauugugugagguaugcuacaccuagcuuuuguugauuuauuuuaggauagucuuguagagcuaggcuagccuugaauuuauucuguaaccagugauggcccugaacuugugaugaucccgucuucaucuuccaaguagcugauuauaugcgugccuuacccacaacgcguuuauguguugcuggagaugaaaugcuugccaucaaguaugucauuccugcuccaaccccacccuccugcagauuuuugugugugauuugcucuuccuagguaguucaggcuucuuuugaacuuuggauccucuugcaugcacuuggagcauaugcuugccugaccacaagcagcuguaacucacuaggagaguaagaaauaguccuugugaguaagagucuagguuucuucagaucucuggcucccgaaccauuccuguacggccuuguacuacuuccuuagaaucucugacucaaaagucgaagcaugcagaacaauguguagauaaaacuguugggacugcuaggauagugacaaaugguagaggaauuguuuuucccucucuuuuccuuucuuuucauuuuuguuuugucuuuugaagcguuucuucauguagcccgcgcuguucuggacauuucucugcagaccagacucccuuuuucugccucacaaugcuaggauuaaaggcccagugcccaguggcaguagaggaauuucuuaaugagagcauguucaaacucguuuauuuauuauuuauaugugugcacacaggggguggaaagagucgguguuaaauauggguuacagacagacuaaaauacacagccuuaguuuucagaaucacuuacaugaacaaaugcuacuguuuaaaggccuccuuuggagaagaaauacaaguugucucagcauaguauaaagcuauuucacuggguuccagaugcuggcuuuauguuaaacuaaaaccacguuccuaaacuucuucccaaggccaccauugaacugugcaguacccaugcaaaugacgccucugcccugaggauucuuuuuucuuccuugauuuugaucucaaaauuguucuauaguuugaacuuucagguaaguuucccgucucuucuuuagaucuguguaaaucucuuuaaauccaccugacaaggcugcuuuccccagcauugguuuuggaaggaaauaaauccuuuuucaugguuuguuuuguagggauuuugcuccucucuauucuuuuuuuuuuuuuuuuuuuugguuuugguuuugguuuuucaagacaggguuucucuguguagcccuggcuguccuggaacucacuuuguagaccaggcuggccucgaacucagcuuccuuccaaguccugggauuaaaggugugugccaccaccaccuagcuagaucagcauuuguaagugcuccuuggaauuugaccccaggaugcacaccguggaaggagaaaguuaguucccagaugacacaagugugaacacaugcacacagagacaaaaauucauaguuaauguaauuuuuaauuuuuuuuuuuuuaauuuaaaaaauaaauuugugugaacgugugccauauaugugucuauggcgacccguggagaccagaagugggugaaguuacaaguaacacugagccaccauguaggcgcuagggaccagauuuagguacuuugaacagugacgggauuucagaggcaugugcguacaguacagacagcagacuuacuaggccgaugauucaacugcuacaguugcagcugaaguagaauuuucagacuaaaguuuggacuugagcaaacguuugccauaguugggaaauguguuaaucuauucauuuuaaucaaaagucucaacuccaugguuauucuucaggaucucccugaauucuuugaagauaauauggaaacuuggaugaacaauuuucauacccuccugacacuggauaauaagcucuugcagacugauguaaguauuuaaacuaucgccagucuuuuucuuuccucaagaauuauuuugugccagucuuggugguguaugccuguuuugaguuuugucuuuucucucauguaaggaugaagaggaagcaggcuuacuggagcuuuuaaagucucagaucugugauaaugccgcucucuaugcacagaaauaugacgaagaguuucagcgguaccucccucgcuuugucacagcuaucuggaacuuacucguuacaacagggcgagaaguuaaauaugacuugguaagaugagggggagagaugucauauucuuuacuuguuuauuucaaacaagaaauaaauuaguguugcuuuuaaauauauucuuuuuuuguuuuguuucaguugguuagcaaugcaauucaguuucuggcuucaguuugugaaaggccacauuauaagaaucuguuugaggaccagaacacgcugacaaguaucugugaaaaaguuauugugccuaacauggaauuuagagguaauuauggcaaaguggaagggguuggggggcuguucuuuaaaguggacaagcuguggagauguccuaaguccgcaacuuggcucuacacuccuucucuugcuuuaaaggugcuuaacaucaacuuaauaagauuuaauuuaauaagauuauuauuauaaucuuuugauuauaagauuuaauuuuuuuaaacuaccaaauaaaacuuguguccucucauuuauugcugguuucucaaagguagacaauguaacaucugugaaaugauugugugugcauguguguguuguggguuuucuuuuauaaaaauauugagaaauagagucucaaauucaugaaauuguuuuaguauuguaacuauuuuuaaugcuucacuaagguaaaguguuuuuaaaucuguuaacuugaagcuugacccugucacgucuguugagaguggagagcccauguuuuugcuucuuaauuaggcaguguugucuaucaccugccagggucagcugcagcagagcaaggaaaccaaggauaaugucauauggcauuuguuuuauuugugaguuuuuaagccacauuuuauacauauauauguauacacacacacaugcacacgcacauacauauauuauguaugugaguacacuguagcucuacaggugguuguaagccuucauguaguugucaggaauugaauuuuagggccucugcucacucuggucaaccggucggcuccagaccaagcauuuauuuauuauuauacauaaguacacuguagcugacuucagacacaccagaagagggcgucagaugugguugcugggguuugaacucaggaccuuuggaagaguagucaguguucuugcccccugagccaucucgccagcccccugccacauuuuauucugauaaugucuucccuacuuguuuuuauuaccaaagugauuuaucaaauuauagugaauauaguuagguuuuguuuuaauguuuacucugacuuuacugcugcagucacagugaaagacgacuuggcuuguaaaacaaagcaguugugcuugcuuggguguagaauuugcagcucguguucuccggaggcuguguuaaauucccaacuuucuccguagcugcugaugaagaagcuuuugaagauaauucugaggaguacauacggagggauuuggaaggcucugguauguauuuggguuuuaaguuaaagucgccuagcaagccaguuauaaagcuuuuucuuucuaguaaaugugagaagugcugaagaguguaguuucagcuuuuauuagcaauguuuuccuucucuaacccuaccccuuugucgguuagaccccucacaccccaaaucuccuuccucucucacacucacauauacacacuacacacaaagcuuuuuuaaagcguaaagggauuaaagaagaugcucacauugacuucuggccucagaauaccugugcaugcacagaacacccgugugagcacaccaugggcagcaaaguucagcaccauccccagcuaggcuggaugguugguauccugucucagaucacucaauccuuagagacucuggacacagcucaucuaucaguccuuacuauucccuguuaaaaaacaaaacaaagcgccagguagugguggcgcacaccuuuaaucccagcacuugggaggcggaggcaggcggauuucuugaguucgaggacagccaggggugcacauagaaacucugucucggaaaaaaaacaaaaacaaaaaacaaaaauaguguuaauccucugucuugucaaaauauucucuguaggauuuaugauauuaugaccacuuuagccucauucucauuuuguguuucuuagagaaaaaaauagguuuuuuuuuauuguguugcugauaguuucuggacugguuguuucuuuuuuccaagauacauuuucuuucgguuuuauagauauugauacuagacgcagggcugcuugugaucuuguacgaggauuaugcaaauuuuuugaagguccugugacaggaaucuucucugguuauguuaauuccaugcuccaggaguaugcaaaaaacccgucugucaacuggaaacacaaagaugcagcuauuuaccuugucacaucuuuggcaucaaaagcccagacacagaagguacaucuuuucuuggggguuuuguuucugaaacacauuggcagccacaggacucaaagaaaggauguguuucuucuaccgcagucuguugagcuaauacacucuucacagugcuucuguagacgggccgagugcuggcuuaccucuugauucaugcagagacuuguguagaacauuaacuuagcugcuuugcuuaggagguuguguguagccucugggcuggaggagaauuuugaacugaagacuagccagggcacauagggagagccugguuuaaaaaagcaaaaaaaggaggaaaaacuggacggagagaugagauggccuagugguuacgagcgcuggcuguuccucuagaagaccggguucagauccagcacccacaugcugggucacagccaucuguaacuugcauggagcuagacaaccucuucuggcuuucucagcaccugacacacaugaaggcaaacauucaaucucaugaaaugaaaacaggauuuaucugauaaaguguucuaaucgggcuuugaugugguuuucuaaaauugcuucuauuucugauacuauguuauuuuacuguuauauauuuccuuucagcauggaaucacgcaagccaaugaacuuguaaaccuaacugaauuuuucgugaaucacauacuuccugauuuaaaaucaaauaauggugaguguugugaauuuguuucuuuuuuguaacuuacaauguuauacuuucacuuuuugcaguaguaacauagaagucaaucucucuguauguuguucauguuauuggcaauuacuacguggucccucuagcuucugucugccuguaaaacuaacuugacaaagaguauguuuuuguuuguuucuuucuuuuuggcuuuuccaaaugguuuccuuccuguccuagaacuuguucuguaggccauacuagccuugaacucaaagagacccaccugccucugccucccaagugcuagaauuagaagugugcgccaccacugccuggccaagaauacauuuuuuauuacaagaaacuaaaaauaaggagacagaaccauggucagcuuuguuagcccugauguaccuuauuuucuuuccugugugaaaaacauuaaaauagaaguuucagguuagguaugguggugaacaccuuuaaucccagcacacauuuaaaugcagaacacucaaacauguuaaauuuuagccagucauagugacacauacuuuucaaucccaacacccauaaugcagauaucuguuguagacaucagucugaugucgacagcuacagcuacauaaugaggagaccuugucucaaaaaaagcaaggaauuaacuuauugguaaaaauaaaaguucucgggcuggugagauggcucaguggguaagagcacccgacugcucuucugaaggucaggaguucaaaucccagcaaccacaugguggcucacaaccauccauaacgagaucugacucccucuucuggagugucugaggacagcuacaguguacuuacauauaauaaauaaauaaauuaauuaaaaaauaaauaaauaaaaguucucaugcagaugagguaggguaugucuguaaucccagcauuuuaaagcugaggcgguaauaauaguucagagacugaaaccugacaaguuccaggccacauggacauagaugagauucuguuuccaaaaacaaggaaaucaaauguaguuugaaaggaugugagauugguaaggcacuuuucaauuuugugagcaggcugauauaaagugaaauaauuguuuuaacaauuuuuguagguucguauguagccagacaugauggagcgucccuuuaacugcacacaagggucagcaguauuguaaugagcuucugugucauucgcuggcuuuauaauuaguauuagcuggccaguauuuuaccaucacuaacuugcuuuccuuucacaagacgaauugaaagcaaauggcagcugagugaauugaguuuagacagcuuaauuguugggacauugacauucaugcacaucaguuaacucuggucaccugaccaggaguagcuuguuuaagcuccgaugucugauuugucaguaaucuucagaucuuaaguaauugugguuuuuguuuuuuguuuuuuuguuuuuuuucagugaaugaguuuccugugcuuaaagcugaugguaucaaauauauuaugauuuuuaggaaucaaguaaguagugcuuucccccuguccccaccuugaguuuguuuuguguagcagcuucuuaagucuacugugcaaucaauauuguauaucuacaucuagccaaaaaccuuccuuaguaaccugggauuccaggugacgcuucauuucccuuaguuaucuuuuuuucccuuguccugggaacugaacccauggacucaaacaugcuagggaaucauccugauguguugauccauguaguccucuuuguaucuuguguucuucccuaguuauauuaaagacugauccgaacucuccacagguugcuuuaguucaccugucugguguguucuucuucauacuggagugagcucugcucgccuuacaguuaggacaguucauuaaaaaagugcggcauugcacacugcuucuggcucaguguauccucacgguagugucuugauccucuagucuagcuugaauuaauacauguauaugggauaaauggguaugccacagcauaaguacagaggucagaagacaaauggcuggagugguccucuccugacaugugggcggagcgaacaucaggcauggccgcaagcaucuguauuuccaucuuguuggagcugaccacuugauuucucccaagagaggaaaaaugcaucauggauauacuuugucauauuacuuauguuuucuauuauuauuuguguuauuauccaagcacucaaugacagcuguccacuuuuagaaauagcauggucgccgggcgugguggugcacgccuuuaaucccagcacuugggaggcagaggcagguggauuucugaguucaaggccagccuggucuacagagugaguucaggacagccagagcuacacagagaaacccugucucgaaaaaccaaaaaaaaaaaaagaaaaaaagaaaagcucaccaucaucucuucuuuuuauaacauuuuaauauuuugcauauucuuagguuuacuuacaaaauacacaccucaugauuuuuacuguauuuuaacauugcuacaauguugucaggagauaauauaguugucaguuucuauagaaaacauucuuguaguuaucuuacucauacaggcuuuaggaugguuuagcugccuauuuuuggcuaacaggccucuggcauauugcuucugugucuacuuuauauagagucuaaagucauugcuaguuuuucucaaaugauaagauguuccagauucaucuucuacauuuccugccuagaccuggcuagccccugugaaagguggaaauuuaaagaccacugucugcagccggcuauggcugccuauacauguacucccgggauucgggagucugagaggcaaaagcaggguggccuccguaagcaaggccacuugaggauguccugucucaaaggaaaaccgcaacuuagacuagaccaccaaauggccccaggguuaucaccaaugaaguguuacugguucuucugggggaaaauugaaaaggaaauaaaucacuguaggauaauucuuucuuuugauuugggcuuugcauugucuucacaacaguguccuacaguuugccuagacuggcuugggacucacuaugagaccaggucggccuaacauuucagauacuccuuccaggaauuaaaaauaugcaccgcuauacuccucuuaauguaacauuagugauguucuauuuauacuuacuuccuuaauuuauccuaacuuggaaguacaaggauguuuuaaguuuguuaugugugugagaguuuugcuuacaaugcacauguaguccacaugugugccuggugcccuugccugucaucagggggcaucagauucccugguacugguguuacagaugguugugagccaccauguguuugcuggagauuggaccuggguccuccgaaagaucagugucuuaaccuccgagccgucuuuccagucccucucuggguauucacacccuuggcgauaaccuaguuaaauacuuccaguguggcuccagcaggaugacucagcugguaaaggcaucuguggccaaggcugggaaccagaauucaguuuugaaaauccacauagaagagcggugccuccugcaaggugugagcucuccuccacgugcucaaacacaauuugaacuaccauauguaaaauaacuuugaauuauuuuaaaguaugguucuuaaaauuguagaaagcuguuuuucaauauuuuggugugcuuacuuguuuuaagauucugccuucaucaugccaggaguucagaaaagaauggggggcgacaguggaguuaauggcuagagaaggggcucauaccugucucuacuccagcuccagaggaucugaccgcaggcccugaaugcacagagcacacacucauacacaugaguaaauacuuccuaauaaaccgugcuugggaacacagccgugcagaccucacucuaucaacaauacagccugucacagcacagcaggggggagcugugggccugguuauuaaugucaacgcagugguuuuccauuucuuuuucuaaaaaguaacauuggauuuagaagauaugguaauguuuuucagguaccaaaagagcaccuccuagucucuauuccccucuugaucagucaccuggaggcugagaguauugucguccacacuuaugccgcacaugcucucgaaaggcuguucacuaugagagggucaaacaauaccacucuguaaguauuugauuucugaguguuuccuguacuuuuuagcuuaaggcagagggguauaccuuacuggugugagaugucucaggguguuuuccuaaugucauuaguauuuagaaaaacuuauauguguaauuuuuauucauuuaacuucucuuuccaaaaggauguaaggcaauucacuaaauagagucauucuauuaaugaauuagagcagaguaaaauaacaauugugagguuguugaaaacaaacaaauguaugucaggaggccucauauaaugacaagccugcuagcuuuauuugaagucuugucagcagucaggagagagggaaacauggagacuugaguauuuauugagaguaaagcaaagggcuucgucagacacuguguggccgcaugugucugcagugucucccaacugcugcugcgcauagcucucuuguucucagcucugagauacacuucaguugaauaacucauucuuugggugucaggaaaguagcucuugugucugaugccagaugaaaugcacaggaggguucugcaugacugucagaccguuuuucaguguuaagucuugacaccaagugcuagguaagacauggaacacagucuugggcucugaucuucacccagccuugagcacaaacgcucucaguggccacacaggaugaaaggacauccugagaggcgccuucaggcccaggugugaaugcagaggucauuugcuguaccuucaagaaaagaagguggcugaaacccuucugauugugggcgcuguucucugugguuguagacaggagcaagaggccacugagcucacugguguguuuguucaguuaugcuugaccccguugugucauuaggaacugaacaugagcgcauguaagcaguuacuuccuagaugugcccacaauugucaguggugagagauggcucauuuugugccaagaagugugauguaguguuugcccagggcacuccacagugaaaggcugagaguucguagugacugaaagcuguuuucucgucuauaguuuuacagcugcagaaaucgcaccguuuguugagauucugcuaacaaaccuuuucaaagcucucacacuuccuggcucuucagaaaaugaauauauuaugaaagguaggccguuucccugguguuuagaccauaacuaucuaaccucagauuacaagguaaacacucuguaguuauacaucagguuuccauacuucaaaaacuagguacugucuguucaaacaaaaauuuuucugcuuuuuuuuuuaaaaguaaaauaaauguuacuuuguuaacuaacauuuuacuuuagaccuguaguaaauuuuaauuuuucuuucauagaguuauuuucagaguuauuucaaauuagcucaugaaauagugucuguugacugugcucugcugaguaugguaaagcagggccaccugcacuuagcucccaggggugcuggcacaggaugcccugccaugugcuaggagagcucggugccagcuuuaacuuccggaacaaucucacugucacaucucagaggucucuauugcuuucaaaaucaugaugcaugcuuuccaaaggaacucccugaggggaguguauguauaugugacuuugaaucaagguggauauucauggguuucagcaccaugagggaccaaagugaucuguggucucuguuacugugugccugugugcauggcguugugaccuuuucaauaaauauugucacauccugagugccuuaccucaggcuggguugaugugagucuuuauucagguugaggacauuucacagccagagaagugaaauuucugcuucuuagaccaagcaugugguaguggggcuuuguggucaacccugauucuggaaaugaaccuccagggcuacuaaugagccuucaguaguuucccaauguacgccucucccgugcucugugcuuuuagguaccugccuguugcuaggcaaaguuuuuacaguccagacuauggcuucauauguuuagcauuuuaacauguuuaagaagauugguagcugauauuuucuuuuaguuaucugugagcugagacuguguuucuuuuagaccguggauaacaauucugucagugguuucuaauuagaagauaguagggcuguucccugaauggucugcuucucuguccuggccaccccacuugcuccuuacucugucugcuucuuuccuuauccaguaauguuucuguugucccuuuuuaaauucuuuaaccuuugggccuuauacaaguguuuuaguauuucccaccuaagccugauagaaagggaaaggagacauuuuuaaguguacgaagguauauaggggauauuuaagcaucuuagauuuuuauugaucaucaguggcccuucccuccagccgcuucuauuguaaugguugauugaccugucugugcuguucuucuauuuuacagcuaucaugagaaguuucucccuccugcaagaggccaucauccccuauauccccacucucaucacgcagcucacacagaagcugcuggcuguuaguaagguaacagccaguuaagaaacuagguugccuuuuacgaacauuuacucuguaugugugugugggcgugcuggggccguguaguguguggaggugagaggacaguuugcgagaguucuccuuacaucauguugauucuggggauuaaacucagagugugaggcucgccagcccaugggauuguuuuuaacuuccugugaacugucugcgcucagagcccuuuggcaccaggccaggugccguaugagaucugugccuucuucuaaccucacuuugguauacuuuugugaaagaaagucugggaugcacagugggcuggaaauuuaccaccugucaguguaauaaacaguuuauguucucauaacaaaauggacagaugacacugugaaauuaagaaagcauaugacccugcauuucuuuuaaauggagugagauaggaucugcacuaauggcugagaaaaugacagaccugugucugugcuuccuugcauuuauuuucauuaccuaaaguuccuuacuauacagagacgcccugucguuaaaaacuaauagcaaaguucaccgaccaauaauuuuaaagagaguuuaagggugacaauugugggguuuuuugcuuguaaguuuuugagaucuugauacacacacacacacacacacacacacacacacacacacacacacacacacacacacacacacaccaggcuagccucaaacucagagauuaccaaccuaccuucauggcacugugauuaaaggcauguguucccacaccuaauaagacuuucuuuauagaugcaugauuuuaauuaugcugugaaaauuaacuugaauucaugagacauaguaaacugagacaaggugugauggcacaugccuuuaaugccagcacucaggaggcagaggcaggccggucuuaaaguuucaggccagguaggacuguauaguaagauuuuuucucuuaaaaucuaagcaaguauuggaguuugacaauagaccaucuggguuuguaguauagaacugcuugggggcuugaggaauggaggggaaacaaagcaggguuuugguuuguuuguguuuguuuuuuuguuuuuguuuuuguuuuuuuucgagacaggguuucucuguguagcccuggcuguccuggaacucacucaguagaucaggcuggccucgaacucagaaauccgccugucccugccucccaagugcugggauuaaaggcgugcgccaccacugcccagcuacaaagcaggguuuuauuguacgagugugugugcacacacacacuccuacucaucagcucaugcuagcuuuccaagagcuuuugagaaaauaggacuuuguuguuuaaaaugaaacucgaaaauuguugaggauuggcagccuguguuaaaagguucaacccuggcaauaccagaacagcuuugcccacuaccuacaguguggcuuuccuaggacacauggguuugagacaacucacagaucugggacagagccuugugugauccaaaaggaacuguaaagaaucuagcuaaguaaccaagcauuuccccagauuucuuccuuucuuaaugccuauuuacuuuuuuuuuguaauguguauauuugccuguuugugugucuguguaccauaaugugcauaccugaugcccaccaaggucagaaggugucagaucccccagaacugaaguuguugggaugguugugggccaccccaugaaugcugggaaacuaagcaggcccuguacacgauccgccaauguuuuauuuacggagccauagcuucagccuuccugcuauuucaugucauuuaauuuugcuaagacagggucucaaaacugguguggugguacacaucuuuaauccuggcacucuggaggcagaggcaaguucaaggccaaccuggucuacagagcuaguuccagaacagccaccaagacaggaucucaauauguagcccuggcuuaccugagaccagccauguagaccagguuguccuggagcucagggacauaggccuuucauaguaccaagauuaaaggugucuuccaccaugccuagcuuuaaugcugacauuuuuauaggagcugacaugucuuuuaccuguuuuuaggagggucaggcauguucugcucugggugauacauaacauaauuggauuacugagagggcauuuuuuauuuuuauuauuucagaaucccaguaaaccucauuucaaucacuacauguuugaagcaauaugcuugucuauaagaauaaccugcaaagcuaacccugcugcuguugugaauuuugaggaggcucuguuucuaguguucacugagaucuuacaaaaugauguacaagguaagcuagcagaggccguaucuuucuauggugauucuauuggggugguuauaaaacacugacugcccuuuguuccagagccccaccgggcugccacuaacaacucuuuuaauuuuuucaacagaguuuaucccauaugucuuucaagugaugucuuuacuucuggaaacacauaaaaaugauaucccgucuuccuauauggccuuguuuccccaccuccuucagccaguacugugggaaaggacaggaaacaucccugcucuagugaggcugcuccaggcauucuuagaacgaggcucaaguacaauagcaacugcugcagcugacaaaauugugaguccgguuacuuauaaaaaacuuacauuuucuuuuucuuuuucuuuuuuuucaagacaggguuucucuguguagcccuggcuguccuggaacucacucuguagaccaggcuggccucgaacucagaaauccaccugccucugccucccaaguguugagauuaaaggcaugugccaccaucgcccggcuaaaaacuuaaauuuucaagaucuuuggaaaaacaaggaguuaguaguuuuuuuaaaaaaauuuccuuacaauaauucuaugaaaugagaugugguuaauaaaaaugguaauauauacuuuauugauaccagcuauuauuugguaauuauaagggccaauagguuaauuugaaagauuuaacuauaauaguuuauuaugguaagaggcuguugaaguacgucuccaaccucaauaagccugugcaaaaaaaaaaaaaaaaaagguauaacuuauuauaacauuauauuauaagcuguaugccuagauuugucaggacuacacuacacuaaucuauuccccagcuaugagagcccuugcuacuuguagcuccuccaagccaugugguucuguuccaucuccucccuucuuuucuccuuuccucccuccuccuucuccguucuuuuucuuuuccuccuucucugagaccuccaggcccaccuuucccuuccacugcccaaucccacccaggcucuagccuuuaucugaccaggaagaauggggagaaaguucacauggaaugacugaguacguggaugugacccaccccucuugaggaagcagaauuaacagaauacaaacaucaccagggcaacauacaacaagacugugccaucccugccccuuuuacaguccagaaauaacugcuagaaaaggauggggguggugcacacagauguaaucccaacauugggggaugaaggggggaguucaaagucaucuuugguucuuuguagccuaugugucugauacucaguccaccacacuaccaccuuggcugguuacacugucaaguaguagccacuuucuaagagagcagccuguugagccuccucucugaacacucaucauuugaucugcuuuguugcagccuggauuacugggugucuuccagaagcugauugcauccaaggcaaacgaucaccaagguuucuaucuucucaacaguauaaucgaacacaugccuccgugagucccauuaacccucugcacugaugcaaagauuguuacguguucauaaggggcugagcugauagcuuucuucucuucgauccuuuagugaaucaguugaccaguauaggaagcagaucuucauucuacuauuccagagacugcaaaacuccaagaccaccaaguuuaucaagaguaagcucaguauuuggaaaggguggggacauagauuuugggacuuuuaucggucaucaacauuacauauaaaauaaccugaaaaaaauuguguaucccaaacacuaacuuaguuugaaaugcauuauguugccgggcagugguggcgcacaccuuuaaucccagcacuugggaggcagaggcagguggauuucugaguuugaggccagccuggcuacaaagugaguuccaggacagccagggcuacacagagaaacccugggggaggggggggggcauucucuuccaaagucugguuuagggaaagaaacacuuuucaguagaaacagugauauauguggagagguauaaguuggggguuucaaguaaacucugugauacaaacauggggccucucucuguggggugucuuggaaggcaagugcugacccaaugcuuuccaugcugaaaccuucccuggcagacugcgagaguuuccauuucagugaagucacuacugauauucuuguuuucucuccacagguuucuuaguguuuauuaacuuauauugcauuaaguauggggcacuagcauuacaagaaauauuugauggcauacaaccaaaguaaguugugacuuuguuuauaaaaagaaaguuauuagacuucuucaauauaaaccaguguguguguguuagugguggcuuuuuuguucugguuuagggguaguuuaucgugguuuuagaaguguuucuagacauagaaaagcugauguccacauucccaaagucuuugucuucuggcauucuccacucagugucugagaaagaaugccuugugcaggguccacagccuggcacagagacagccuugcaguuaguugguggaauuugguugugacuuuaugcaaagaacauguuuaguugugugacccuuagggcaauggaaggcuaacggaugaguagaggauaggguuaggggaaauuuuuugugggcaacucucccagccauugcaaacugacuuuaaaaaaucagucaucuugugguaguagggguugugggcuaucugaggcucaugugcugccagacucagcacccccuucacagugagcagagugcuugccugugaucugcuuucugcacucgucagggauaaggagcucgucauuuagaaugugagagguuauugacucagcugaggacuaaucaaacgcacuucagcaaagacgaagcuccuggugcaggccugccacaaugguccuugccagugguggcugccucuuguauccuaacuaugguuuucauuuaaaauuuaacaauuuuugaguaacauuuuaagcaaauauuuuuucuccuaaccuccccccaaaagcugcaaagacugcuuaagagaagguguaaccccacagcacuauguaaucagcagaagccauagcagucagucugagacagacucauggggagugcccuuacuauucaguacugggcuccagucacaccacgucacuaaguaugaauuauaucuaucuuacugucugaguauaaugcaugcuuaguauugagugcauuuguucugcuuuuauuaauagaauguuuggaaugguuuuggaaaaaaucauuauuccagagauucaaaagguaucugggaacguggagaaaaaaaucugugcaguuggcauaaccaaauuacucacagaguguccaccaaugauggacacggaguacacuaagcuguggugaguauuccugcugagaguguggggaaaggcuuucuuguggcugcacaauugacuggcuaacucuuggagggccuggggaggcaagauaguugucuucugcucuuggcuucuccacuggaaacugauggucagcauuccuaacccuaacccugauggauuccagcaugacucgcaggcucuucuggguucauugguagauuuccaucugggucuuaauacuguuguccaagcuggcuucaacuucaacucaaagcagucaguccuccuacaaagaaagacucaagagggcuagugguagaucugguuuugagucuuaauuuuuguuuuguuuuuuucuuuucuuuuuaagauuuauuuuaugccaguaugcuauagaagagggcaucagaucccauuacagaugguugagccacuaugugguugcugggaauugaacaccagagcagucagugcucuucccauugagccaucuucccagcccugacuguccugaaguccaggcuagacuugaacucuaccugucccugccucccaaguacugguucuacagacaugcaccaccacugcacagccuuuacucuuauuuugaagaggauauaucucuccuagaaauuacaaauaaauuuccauacauucaccuccucugagagccucugagucuaauaagauuuuugcuucuuccaaguaacccugugacacagguguggccgcugugcaggauuugucucugugacacagguguggccgcugugcacgauuugucucuuagggcuuuuuguuuuggucuugucuuuauguauguauacauguuuauguucacauguguauuagcauguguguggggguaugcuugucaugaguggaccucuggggugucugucuuccagucacacuucacuuuucuugaggcuuggucucucgcugaaucuggagcuuggugauuccuuuauggauucuaggaaacugacucuagcuguuaaccuuguguggcaagcauuuuauucaguaacgcagaacccuaacauuguauuuuacugaguagcauuggggaacucacagcagucuacaugucucuacuuccugagagcugagauuucaggcauaagccuccaugccuggcucuuaaaaguaaauuugcuuugguuuugucugcacuguccaauccaggacuccuuuguuacaaucucucauuggccuguuugaauuaccugaagaugacagcauuccugaugaagagcauuucauugacauagaagauacaccaggauaccagacugccuucucacagcuggcauuugcugguaaaaaggaacaugauccuguaggucagaugguaaacaaccccaaaauccaucuggcacagucacuucacaaacugucaacugcuuguccuggaaggguaaguauccguggugcugugggacucugacugggaaguaagaagaugaggucuuacccugcucucuccaguugagcuuagggagugcuuuauuuuuuuaauaaguaugcuggauggugguuggcacaagccuuuaaugccaguacugagaaggguaacuuggucuacagaguuccaggauggcuagcacuauacaguacagagaaacccugucuaaagaaaauauccgagaaaaaaaauuuuggagaaaaaaaagaaagaaaacagaaugguaacauacucaaaaauuaaauaguaugucuuuaaucaaagacuggaccuuuaauugcauuuagcuagucuuucagauauacuaucugaaacuauggguuuuauuuuucacacauagggacaaccaacccugguacacuuaguuaaaauaauuaaccauguuuuauuauuuucuguagcaaggguuauuaggauaaguaugccuaaguacuuagucuuugaaaagcaaaaguuuuucuuuugccaaauguauaguggcugaauccuuacagucccagaucagaugcauagguagcugugaguuugaggcuaaccugggauaccuaacaagauuauguccauaaacuaaaaacacaaaguccuuuuaucaaccacaguacaaaagaaguuccuuauggaucuacugugagagagagagaguguguguaugugugugcacgcacgcaugugcaugcacgugugcgagaucuuugauccccccccccaggggggggcaucuaucuaccuuuauuuuuugagauguguaaaggucacagagcuacuugucacuuuucaucuuccaaggaguggguccugggaagcaaacuuaguuaggcuuggugcucaguacucaguacuccuaugaccacaccacaaguaucuuugcucggcugcuguggugaaugccuagcuguuuugaaugucugaaauaaguuagauuauuuggcucuccaguggacagugacuggcugccuuuuccccacaugguggcagcguuucauuuaggccccaguuugcauuuguacauaagagccuccuacaccaugugguuucacucuccuguagguucccucgauggugagcaccagccucaaugcagaagccuugcaguaucuccaagguuaccugcaggcagccagugugacccuguugugaacuccaucuuccugaccaugcagcggcugaggaugguuucuuagaaccauguggacuucugagcacggcccugcugaagcaacacagguuuccaaccucuugaacuugucacaaacucuuacagaggacagaaaauauugcuguaagccaaugagguuguuugucuugaucaucaauauaacugauaacuugucuacuuuguccuuaaugggacaaguauuuacaaucccauguauggccauggucucuguugaacauuugcacgguuuggguuauuucaaauuuuuggcaggccuugacuguggagacuuaauuucuauuguuuugaagcuuguauuucucuuguccuuuguggauuuugucuguuucuuuaaacuuuuauuggacauaugaaaaagucuuguugacuugcaaugcacauuucguaguuaaagucuguaaucagcaauaaaaacccaaaauguguaucuaaaagugucuucaggacaggauuuggugcuuucugaaacuuugaugaaaugaagaauuucuuuaaaucuacuuuccccaucuggacuccauaaaaauacuaauuuuuaaaucauuuaaacucagaauggugguuuuuauuguuuuc

SEQ ID NO: 1282 - RNA, 49309 nt, Mus musculus
gggcgggcgcggccccucccccgucacuuccugccaggcugcgggccccgagccgcucuucagcguuugcgcuggcugucgucgcgucugugugcgcucccccuucuucugagccccggccuggcggcgcccgccuucgccuccgccacuccgccucuucccuccucuggucggucccuuuuuccucgccgucuucacuugcuucuucaccuccucgccgccgcccaagaccgccggccccgggacgagcucuggggaagcagccagguaaggcggccgguccgggccgggucggagcgggucgcggaaggacccacgcaggcacggcgucagcgggaggugggcggcgggugggcuaggccuugcgggcgcgcgagccgcggcccaggcccgucuccgccugcggggccuucccggaggaggcgggcccuccgcgccgcucgugggcccugugccggaguuaacgcggggggcgcgggcgggcaggggcagcgucgguccggaggccccccggguuucggugcuaugcacagugucgcggccagugccgagccgcgggaugaggugccaauucccggcucggcccccuucgucagucacuucguauucuuugugucucuguuaugagggggagaaggagggggaauaguauuaauccugucccaacccggucccugccucuucaggcugugaaguugugcagugaaauggggcguguaaagugcuuaucagugugccagacccacgucgugucccaauaagccguuugcauaauuuauuaagaugauaugaagguauaauuuagggugcagacggaacauaaguugaccuuccuuuccacuaggguuuucuccgaggcagaagaaucccgcgugcccacuggcagugccugagcauugugcucgcuuggcaccagagaggggcgggcgcuuaauggggacacuguagcagacaggguauggauguaaagccaucaucaugucugugaaaccagcuguagggacuucaccggcuccccuaggcuccgcacccugucccaugucucccugccaccauccagaaccuuauugccauuccuuuuuaugagaaaguugcuggcauaagcuucucuuggguuuagcagaccuuuuuggagccuucuugugugucaggcucuggagguggaguaugcaaagauucgaaaaccgugguuuccugguucgcaucuguagcucuuaacuuucuuuagcugaggcccucccuaguuaucaguuucucuuaagcucuggccucaccucccuacuuaugggcgaagcuuuuauuuuguuccguuuugcguuuugcccauuguauuguaugccuuuuuuaaggucacuguuuucaauugcuuguagcuguaauaauucuguuugcuugcuugcuugcuugcuugcuugagacgugguuucucggcacaguccuggcucuccuggaagaagaagcuugugcuguagaccaggcugaguagcgguaauucuugagaauuggaaguguuggaagagauuuaaacugggauuuugaucuuucagggauuuguacuuaccaaauguaaauuacaucacuacuuguugaagcaaaaacuaaaaauacauuuggggaguguggaggaagaagucuuggccauucuagugaacuuuuaggagacugucuuuauucugacucagccuugauuuucuuuaguaagauuaaguaacuuuuuuuuaauuuauuuuuuauuuuuuuauuuuuuguuuuuuccagacaggguuucucuguauagcccuggcuguccuggaacucacucuguagaccaggcuggccucaaacucagaaauccgccugccucugccucccaagugcugggauuaaacgugcgugcuaccauuuuauuuuugagcauuauaucagcagcagcuguuguggaagucagagcacaacuugugagauucaguagguugccagguuccuugcugaaagacuugacauacagagccaucucaauaccucaaaaaaaaaauuuuuuuuuuuuuaaaucugugcuuagugucauaggcaucccccuccuuaaagaugugcagcucacacaggagcagauuuacaagagucacaccucagguguuuucugugcucagugcuuuucugaguggaggccggaggucagccccuugucuuccucgagggcucucuaccuuauuuccuggaacagucucuaagcauuucagcuuuuccugagcuacccaucucuaaagccugucggcagauuuugggcacucaguuucuuuaguaagugaaaaauguuuauauugcacccaucucgauauugcaauauuuuuguaacagucaggaaauaguuucuagcauaaaugguugaguguaauggcuuuuuuguuuguuuguuuguuuuggauuguuuuguuuuuagagacaggguuucucuguguaacauagcucucuggcuguccaggaacuugcuuuguagaccaggcugucuuugaacgcagauaagccugccucugccuccagagugcuaggaucaaaggcauucaacauuggcuguuuuucaguuacucguuaauaguucaggaacuguugauucaauccuuaaggaguaaggcugaaaucugggcugaaaagugggaguccccaaaagaggacuaacuccacuaacucucagcuguuuuucugcuguguguuaaucauauuucaaccaagaagccagaucccaaaagaaagaaaaaaugagaaugagcgagcaagugaucccuuccaguauaguaagaaauuucauuucauuaacaguuaaacagucauccugaggugagcugguuaacaucaaaaugacuaagauuaugauagauuuaggauuuguuucaaaacaagcuagcuuaaaggagguucaagaagaaacaaggccgaccuuagcugugaguuaauaauugucaaagcuaggugaccaaauacacagugcccucuauagcauucaacuuuaacacuuaaaaauaaccucagguucucuaucacagccuuaaaguaucacuucgcugggucuaucauaauuugugauauggcaaaggauauguuuggcacuauuuguagauuugcuuguuuagggacuguucaaagacagcagacauuauggcauuauacagagagagauucuaaguucgaggucuucaucugcuuucuucccucgggucugggaaccccauggaagagugggaggaaaauuuguaggaaucagagggacugcaggacuaagcaggaugugaguagacaggcuuucagagacagaagcugcaagcauggggccuguauggucugcacuagguucuuugcaaacguguuguagcugcuagcuuguuuucuugagacuaacugugggaacaguuuugucucugauucuuuugccagcucuugggacucuuguccucuugugggauugucuuguccagcuuugugagggcuuucgucuuauuuuauuauaucuuguuuuguuguguuugauuguugccucuuggaggccugcugucuucugaagggaggcucuggaggagacaggagguguggagggaguuaaggcugcagggaaggaaaauugugguuagggugaauuaaaugaaagaagaguauuuucaauaaacaaauauaaacuaacaacaacaaaaacaaaaagaugacucugucuaaaaacaaaacaaaaagggaaaauaaacaaagcuugccuucuaaaaagcccccaggcuguaguccuagcuauuggagaggcagcccccuggccagcugggaugagagagacccugauugucucagagugaaaagaagagagccguagggcugaagcucaguggugggcacuugccuaacauguacaaggcugaagguuuaaucucucuacuguaaacccccaauuuacugccccccccccccaaaaaaaagggugguugaauugcugccugaagggugccugcaguguuuacaaacaacagacugacuggaugcuaagaaccuuaacuguggacaagaugcaacaccaccuuagagacugguauuucccuugucuaaaagcaaagucucuuacagagaggagauugaccagaauguuguaaaugauugcugcuguugcucaauuuucucuguaacuuuguuaugucuccccucagagcuuggucaguacagugccaguguucugugguuucaguuguuccagccuggguggugggaggggccucucucuucacaguaauuuaggagcuuguccuuaaucccagaauuuaugucuaagaaggaauaaaacauuuaagaacaguggucuuuccccauuaggcuuaaaguaaaacuuuggaguacuuagaauuuuuacuauacuuguagucucuucaaaauagauguucucuuaaggugcauccagcaagcucauuuauauacaaaugguuuuaaguuuagacauggaccugacucuuggaucccagagucccuaguuugaaaaccaaaccagagcauuguuccugcuguacucaugacagaucagacagcaggaacccaguguggguggguaccuuuccuggaggcucuuuacccagacucaggagagcagaguaucuucagagucaaccuguucaguuccccagucugugggguuuugaaaaacaaaacuuuccauuuuguuuuggacaaucuguguacaguuguacagucugacugcuccucucaccgucccucccagcuggguuguuaagaccuccagauaggccaucuuaagugacacucacuguuguccccuccgaugacagcuuuuggaacugcuugcaaaguguccuuuuaguuuggaguuuuagagaugucaaacuauugacaggauuuucgugacuuguuucacaugggaccuguaauggaugaaguguugguggaauuuuauguuuguguuuaaugaaagcaaaaaaaaaaacuuucugggauuccaguuguagcauuuaugcugcucuaagaugcagacgcugcaagcuaaagggugaacaugagaagaccugugaguugcuaugguuacuuucucccaacauuuuauuacaaaguuuuaaacacauaccaaaguuucuggaauguucguccuggccccuuuaaauacuaccucuuuaccauaucgccgagcccacuugcacuggcgugcuugucuguuaaaugcaucaaaaacugucaguccaguuuuugaugcauuuaacaguugccacagcgccacaugcuguucacuaaggauggguaacuuagcuguugugcuugcugaggugagccuagggccuugcuuaaaauagccaaaagcucuacuguuacgaccucaccagcucuuaagguugauuuuacuuuauuuuuuucuuuugagauagguucucacuugguagcuuuggcuguccuggaacccaacauguauaccacgcuagccuccaagucauagugauucacuugccucugccuccugagcugcuggcugggacuaacggugugcaccgcccugacuggccccagaucuuuuuuuaaaagucaaaagcuuucuggacuuuuacuuccaguuaugcuuugacugaaaaagcucuauuuuugaggcaaauugucuauugaacauuuguaccaggauaauguugaucaaauccuguguugguaucugggugaagaagagaugguagaaguagaagucucuccaugggagcuugucagaggguccagaugacagacagcuggauaucugucuucucuacagcucagugcucuaaacuaaaaaccacacugugaacuauuuucaagggaguaaaaggaaauuacuuccaguagccuaaguuauuuuugaauauuuucauucuuacacuagugauaagguugauugaaaagugaugucaccuuguaaguaggggcuccgugguaucuuugguaucauauguuccuuuguauauuaaaauuauacaugggggauuggggauuuagcucagugguagagcgcuugccuagcaagcacaaggcccuggguucgguccucggcuccggaaaaagaaaaaaaaaauuauacauggaaagcaaaaauagaaagcaugguguaacauuccccccccccuuuuuuuuuuuuuuuuuuugguuuuugguuuuaugagacaggguuucucuguauagcccuggcuguccuggaacucacuuuguagaccaggcuggccucaaacucagaaauccuccugccucugccucccgagugcugggauaaaaggcaugagccaccacgcccaguuggaagauuccuuuuaucccaauacuuaggaggcagaggcgggcagaucucugaguucuaggcuagccuuguuauagguauagugagggcuacaaagacagacucugucuggaccaccuuucccucccccaaauaauuaucgguaggguuauuugauacagucaaaaggaauccaaaagguucuguuuauauaagaaaugaaagcugcuguuauugaauucuucuagaccaaggagggcgcucgccuuuaaucccagcacucaggagguagaggcagaaggauuucugaguuugaggccagccugauguacaguguauguacagaaucagcauuucuuuucuucauuuagugccucaguucucaacagacagaucucggucuaauaguaguggcaagccgagcauugcagacagcgaagguuuucucugcagcaaucuaaagcagccuuaucucccugacuacucgagugucauccagguaaaggguuauggcacuucacuggguagaguugguaaauuggacaauagagaauuguaggauccaagcuuaauuugccuucacuggguauguuauccucugacacagggggcugcccaggauuccauacauacagcauuagcaaauagcaucccauuucuaacagggaauucugcaaaaacauaaaaccuuuauacuugaguuaauuugacuuauggagagcauggauuuuaggccaagcauaguaacccaagccuguaaucccagugccuggaaaguggagacaggaggaucaggaguucaaggccaguuuuccuacauggcaaguagagauuguucuacaucccaugagaccugucuucuccccuccccaaccaaaaaaaaggacauggagaaauuaaacaggaucugaggagaucacgaggccagguccugagggaagcaauuaauaacuugagcaguauuauauucucaguaucccagaacagaccccuuucuaauucccuuguguuggaugagauguagcuggccauuccauuugauuucaugcuaaccuccugaaugucaucccaccucacaucaccucaguagcagcucacagccaaaggcagugggugucgccggucagucucuuagaaccagccacaugggacacauggcuagaaagagaacuagaggcuuguucaggccaugaaagauucaaaggaaguaagagaaauuauucaggaagccauuuaacccucaacuacuaaauuagccaggcacuuagggacagguuggaaagaaagagcagcagacacugacaccaggaagcuuacagggaucggagaucucccccggcccccucccccaaaaguuaauuggaaaaagaaagucuuuuucagguuuuuucuucuuuguuguuguuuuucuuuuucuuuuuucuuuuuccuuuuuccuuuuucuuuugguuuuuugagacaggguuucucuguguagccuuggcuguccuggaacucacucuguagaccaggcuggccucaaacucagaaauccgccugccucugccucccaagugcugggauuaaaggcgagcgcugccaugcccggcguuguuugcuuuucuagacaagauuuuucuguguagcccuggcuguccugcaacucacuuuguagaccaggcuggccucgaacucauucuccugcuucugucucucucccaagugcugggauuaaaggugugugcaucucccuucgccuuuuguuuuuuguuuuauuuuguuguuugagacuuggucucauuuuguagcccuggcugucuuggaacucacucuugaacucaaggaucugccugcuuugccuucuaaggauuaaaggugugugccacuaugccuggcugaaaguuaaguuuuugagcaacaauuuuaucuauagucaauauuuuuuaaacaaacuucacugugacagauuacaguugaggaguuagcugauguucuucaaggaagguuagaaaguagcccucuccuguuaagcauuaucacccauccucacagcccgggagcuuucugcugcuguauguaccuuucaguaaccagguaauguuuauuauaacaguuuaguauuaaguagauacugcuguggcuggaugugguggcguauggcuccaaccuuagcauuaaggcaggaguauugguuugaguuugaagcaagguuggguuacacaugaagacucuaucucuccaaaaagagguggucauggugguacaugcuugggaagcagaggcaggugaaucucugagucuguggccagccuagucuaccuuccuauugaaacugagacuacgucuucaaaaagaaauaaccaagcauauauuguauuugcugggcagcucaggcuggccuugagucagggauccuuccccugagucucuggagcacugaaauuacucauauccaccaccucugugugugcaugugugugccuaugcuuguggauaccagaagugaaccucugguaacuuuaggcucuaucuaccuugcucuuucuuucuuuuuuuuuuuuuuuuuuuuuuuuuuuuuuuuuuuuaaagauuuauuuauuuauuauauguaaguacacuguaguugucuucagauaccccagaagagggcaucagaucucauuacgggugguugugagccaccaugugguugcugggauuugaacuucagaccuucggaagagcagucgggugcucuuacccacugagccaucucaccagccccucuuucuuucuuucuuucuuucuuucuuucuuucuuucuuucuuucuuucuuuuucuuuuuaaaauauguauguauucauuacuuugaaaugcuuuauuagaauauuuuggauaaaauuaaguauuuuuaagacaaaauaaauguagauuggaauuaucuauugugaggauguaauaugugauucugaguucacagucaagugaucucuggcuuagugucuaggaguaucugagagcccagugcaggagucugccacgacacccagcugagcucugccugggacuuaagugugcauaguaaugauagauucuuacacagaauccauuaaagauaaaaguuuuuagacucugcccagcuucagacagagcuuauguucaugaaagcaagauauagagcaaccagaacaaagugcucuauuuauuauuauuauauauauguucuagauuuacuuauccuauguauauaaguguggcuauauguaugucuaugcaccaugagcaugccuaguaccaguggaggccaaaacaggacauuggagaccuucaauuaagaguuauggauggcuauaaguguguaugugaguucuggaaaugcauccaggucuucuggaagagcggccuguggucuuuaacuccggagccagcucucuagccucauccauauuauuucaaaauucgugugugugucccugaaugcaugugaacugugugcauguagaggucagaggauaacuugugggagucaauuuuuuucuuccauguaggucuuagggcuugcacucagguccucaggcuuggugguuaaugccucuuaggacaagcguagccauuucucuggccuccaagccccaccauauuuauuuauuuguuuguaaccaggucuuuuaaaaaaauuauagccgggcggugguggcacacgccuuuuaaucccagcacuugggaggcagaggcaggcagauuucugaguucgaggccagccuggucuaaaaagugaguuguaggacagccagggcuacacagagaaacccugucucaaaaacaaaacaaaacaacaaaaaacaaaacaaaacccaaaaaauuuauuuauuuacugcauauaaauacacuguaguuguccucagacgcuccaggagagggcaucagaucuuauuuggugguugugagccacuauguaguugcugggauuugaauucauaaccucuagaagagcugccacugcucuuaaccacugagccaucucuccagcccccuuguagacaggucuuuauguagcccuggcuguccuagaacuugcucugucgaccauaucugccugucccacuguauuuuugagacagaaucacuguucggaagcucauugcuaaggcuggcaggcuagcaagcccuaggaaccugccugucucuugucugcuuagugugcugaguuuucuuuaaaaagugugugugcauuuguacacauuguuguguguguaccugugugugcauaucugccacagcacacauguggaagucaaaauacaacuugugguagugauuuugaguccuggggauuaaacugaucgugucaggcuugguggcaagugcucuucccaaggcauuccccgcuccagccuuucccacagguucuaaggauuaauguagguccuucucacauuugcaugacagccacuuuacugacugagcaucuguuucuguggcccccagacugaaaaaccuguuaagaacauuuuugauuuucaaauuagauuguucauauuuuacuaucuggagauagagguugagguguaaagauagaaaagaaaaagaagcaggcuuguaacuuaacuuguggaauuuagucagugaacaguaguuuucuacugucugugaaagcugucauaaugacagacugaagagauccaaaccugcagaaaacacacacgugcgcggcaaggaacucuagcugauagucacugcaacuuuucccuuuuuucuuuuuuuaauuuaaucuuauauccuguagaccaauauguagaagugcccuuuuaguaauuuuuuuguguaauugccuuuguuuuuauuauauguagcaaagacaguuagaaucagaugguagauggcucacaaauuuaaaaaucaggccaugugauugggcagugcaugaggccagucccuucagugccacucucuugucaggaagccauugccaugugcgugucccugugcggucuaaggagcugcauccauggaagcuucuagggugcguugcaugaugccaugcuggugucacauuuacagacuuuugccugucgauucgagguuccccaagaacugagcaguucaggagagcagauguaagcuaguaaauucccgauuuucauugugcaggagucucccaucgcccacugccuuagauccagagaaaacacuauucccagagagcccuucuuaagguacauacagucuggcuuuacaaugcuaggucugcuuguaacugcugaugcuuucuguuccucauugacuggcggaaagugacuuuucuuuguaacaguagagaaauggaagauuauuuuaugcaucuugaauuuucuuuuuuuguuuauuuguuuuguuuuccaaggcaggguuucucuguguagcucuggcuguccuggaacucacucuguagaccaggcuggccucaaauucagaaauccgccugccucugccucccaagugaugggauuaaggcauccaccaccauuggccagcuuaaguuuguuuguuuguuuguuuguuucuuucuuucuuucuuuuugcuuuuucaagacaggcuuucucuguauagcccuggcuguccuggcacucacuuuguagaucaggcuggccucgaacucagaaaucugccugccucugccucccgagugcugggaucaaaggcgugcgccaccacgcccagcuuuguuucuuuuuuaaaaaacuuuuuuuuaggggguauguggauaucucauagcacuugugugggaggucaguuaguuuguaggagucaguucucuucuagcguucagguccuaggggcccagcuagggugaccaagcuugcugacaagaaccuuuacuuaugagccaucuuggcaaacuagccuugcucauaaaguaugcagacaugagugcugcaggugccacuaaccauaauuugaucagugagcacaagaacuuuuguaucuugcuuuguuuuuuuguuuuuuucuagacaggguuucuuuguguagccuuggaugugcuggaauucguucuguagaccaggcuggccucaaacuccgagauccaccugccucugcuacuacaucuggcuuuuucauuucuuuucuuuucuuuuucuuuuuuuuaaagauuuguuuauuuauuuuaugaauaugaguacaguguugcugucuucagacacaccagaagagggcaucagaucucauuacagaugguugugagccaccaugugguugcugggaauugaacucaggaccucuggaagagcagucagugcucuuaacugcugagccaucucuccagccccuggcuuuuucuauuuaaguuacaaaaaguuuauguguguggguguuugucugcaucaugugcaugcuguaccuggugaggacagaagagggcgucagauccucuggaacuguaauuauggccaguugugagcugccuugugguagaugggaguggaaccuggguccucugcaaaacagccagugcucugagucaucucuccacccccauguuugcuguuugauuuuuuuuuuuuuuuuaaagauuaccuuuguuaaccuucugccagacuuggaucauuuuacauugucuccugugcuagggcgaguagagcuggaguugaagcccaggccccacagcuugugaucagacaacuccggcaguguuuaggauuucaggcugggcugcaaaguccagggcacucugagguaugcgugcuaguuugccuggaggagcuaaaaaagcacugcuggccagagcuuugagggaagggguuuguuuguuuguuuguuuguuugaucauccauuccaggggauccagcaucuaccuucagguguacauaaaggaauauaaauuauaauaaagaucuaguuuuucauuuaacuuagugcuuuuauguuguuuguauaaauauauauguuguaguauguauguggaggucagaggacaacuugugggaaccgguucuucuaccuuauggaaccucaguauugaacucaggucacuagcucugugugccgaauagcuuaacccuccugagggcaucagauuucguuauggaugguugugagccaccaugugguugcuuggauuugaacucaggaccuuuggaagagcagucggcgcucuuaaccgcugagccaucucaccagccccugaauuuuauuuuuauuaagauauaauuacgucauuuccccacuugccuuuucuuccucuagucccucccaugucuacccaccacucacucaaauucauggacucuuuuucuuugauauugauacaugagacacacacacacauagagacacacuccccacacccugcugauauaccuguccggggcugaacucuuaguguuugauagccaaugagaggggcgcaucccugggaaagacuacuucugcucucagcauuguuccuugugguucuuuguuuaugggugcuguaugacaaucuuucuuccauguuaacuugucuauugggcagucuuccuuagggauccacguuguugaggcauugugaguguggcuucgcugucauuucuaggagaugcuuucacagcaggcuuccugauucuguggcucuuagaucuuuauacccucuuuucuacugugguguucccugagccuuagauccaaggcuggagcuguguugaggugaucaacuguguuggcuaccuaccccugacgguucuuuuaugcauuucaccaauuacgguuuucuguuaugggcucuguuacaagaagcuucuuuggugagaacugggaucuacacuuauuuuuggguaugaggauacguguuuggaauguagucagggauuaugcuggucuaguaaaguggcaguuguauguucucaucuaagauccauggacucaguagccucagguaguuugcuaaaaaguuuccaguacgaggcaugaucucgcuccuguuguuuuuuguuuguuuugagacaggguuuuucuguguagcccuggcuguccuggaacucacuuuguagaccaggcuggccucgaacucagaaaucugccugccucugccuccugagugcugggauuaaaagcaugugccaccacucccggcuuuuucuauuguuuuuguuuuaagucucauaagagagcuauugguuaccuuuaagguaugagugccaccauuacacuuugagggauagcuugccauguuggucauugcuguaguucuuagacuuuacagcuggguggaacuauugguugcuuccuucccuugacagcugcacagccccuucuaggacuguugaauuuauuuuuuuaaaaaagauuuauuuauuauuauucauuaguacacuguagcuaucuucagaugcaccagaagagggugucagaucucauuuugggugguugugagccaccaugugguugcugggauuugaacucaggaccuuuggaagagcagucaaugcucuuaaccacgagcuaucucgccagcccaaauuuauuuuuaaaacuguuguaggggaggggaaauaagagcaugguaagguuuuagggauagaaaagaaaaugagacuuauggguagguaggcuauugguauuaaacuuuuuuucuuuuuuuuuuuuaaagacaagagucucucuguauagucuugguaguccuagaauucacagagauucuccugccucugcuuccugagugcugggauuaaggguguguacuaccuuuuuuggugugaugauuuuucugagggggaacaauuaaugaugaguucucauuuaggaaguguauuuuuauuuagaugcauuuuuuuauuuuuuuauuuauuuauuuuuuuuaagauuuauuugggcuggugagauggcucaguggguaagagcacccgacugcucuuccaaaggucuggaguucaaaucccagcaaccacaugguggcucacaaccaucuguaaugagaucugacgcccucuucuggugugucugaagacagcuacaguguacuuacauauaauaaauaaauaaauauuuaaaaaaaaaaaaaaaaaagauuuauuuauuauauguaaguacacuguagcugucuucagacacaccagaagagggagucaguucuuguuacagauggcugugagccaccaugugguugcugggauuugaacucaggaccuuuggaagagcagucgggugcucuuacccacugagccaccucgccagcccgaugcauuuuuuuaaaagauuuauuuauuuauuauauguaaguacacuguagcugucuucagacacuccagaagagggagucagaucuuguuacagaugguugugagccaccaugugguugcugggauuugaacuucagaccuucggaagagcagucaggugcucuuacccacugagccaucucaccagcccaaaauagaugcauuuauuuuauauguaugaguguuuugccuuuguguauguguguguaccacaucuuaccugauccccguggaggccagaagagaguauuagaucuccugaagccggaguuauggaugguuguaagauaccaugugggugcuaaaaaucuaaccuggguccucuguaagagcuccaaacuacugagucaucucuagacguugauuuucagccaguggguuuugaccacuuuggggucaaaugacccuuucacagagucaccuaagaccauuggagaacacagaucuuuauuuacauuauaauucauaacaguaguaagauuaguuauaaaguagcgaugaaauaauuuugugguugggagucaccacaauaugaggaacuauaguaaaggggaggggaguugagagcuacugcucuugccccaaggaagguuuuuuuuguuugguuugguuuuguuuuauagcaggccacucagcaguuauacauauuugugugcugaagaauccuuuaugucuacuugauucuggguaaaugugguaggguacagaguggaauguuuuacaguuguuugguuauauuucuuucuuguacaguuauguauauauucagaacggcucuggaacacuggcuugacauugaucuuaaaggugucauuuuggaaauuauuguauaaggugcauugacacaugugugcgcauggcuuuccuuacuacaggugugugaauuauguugaaguccaaggauuguuuccugggaggggagggggaagcaagcaacagugagaggugaguuuuacucucagaaaacugaauugcaacuagaaaaaagagucucagaaaauggucuugggcuagaaauauggcauagugguuaagagcuuuuccugugcuuccagaggaccuaaauuuaguucucagcaaggcugguagcucaccaucacccacaguuccagcucuaggggaucugaugcccuuuuuggcuuuugugaucaccagcacucaggugcacauauucacauguagacauauacacacauauaauuaaaaauaaaauaaaacauuucuguagaauugagaucacuucuacaaagggcagugauauguugauuauacagaaacagauacuauauuaucuuauguuaauuagugaaaaauuaauuagaagucuucucaugggugagcaagauggcucagugguuaaaagugcuugcuggaggcuggagagauggcucagugguuaagagcaccaacugcucuucugaagguccugaguucaaaucccagcaaccacaugguggcucacaaccacccaaaaugagaucuggugcccucucccagugcaucugaagacagcuacaguguucuuagauauaauaauaaauaaaucuuaaaaaaaaaagugcuuacugggcaagccuggugaccugauuucaguuccugaaucccaugauagaaagagagaacccauucuugcaaguuaauccccugaccccaacauacaugcuguuguauauguaugccuggagcccaugugcacacaugcacgcguguacacacacacacacucugcuauuuauuuauaagugcuuaucugaucaugaaggcaggaucauuacaagacaagccuugacuauauagugagucuuuguuuuaacaaacaaaacaagagccuggugugguggugaaaaccuuuaucccaacacucaggaagcagaggcaggcugacuucugugaauuguaggccagccuggucuacagaacaagcuccaggacagccagagcuacacagauaaacccugucucaaaaaacaaaaaacaaaaaaauaaacgcaaacaaccaaccugccaaaccaagacaaaguccuuaaguuguauacugguaagacuuugaaauugaauuugucaguaagaaagccagauaauucuggcugccugaggacucugucuccuuguguauugaauuguucaggaguccucagugucaccaggauuuuuggguuuacugcugagugaggaacacauuuacacuuagccacuuaguagcaaaucauguguaauuaaaauuuuuuuuucuuuuuuuuucuuuucuuuuuuuuuuuuucuucuucgagacaggguuucucuguguagucauggcuguccuggaacucagaaauccgccugccucugccucccaagugcugggauuaaaggcgugcaccaccacacccugaaaguaugggcaugugucauuuuuuuuuuuuuuugcucaguaaggcugcuugagacuuuauuuauuuauuuuuguuuuuugagacagagucucuauguugcccuggcugacccagaaccuuaucaugucuagaccagaauggccugaagagagauccuccugccucugccagcccagugcucaggguaaaggaguguccacuacaccuggcaguuuuuauaaagagacuugugucagcaagcugaugccuagguguuuuuagucgucccuugcuccccaucucauuucucucuguuguugugcuucuaugucaguaaauggcagccugagaggaaggccagcauauuuauucccuugaacuggacucuaaaguagcgugugcuagaggacagaggagaugucgacccuaacaugcagagggguccagugaggccugaggauuccuguguucaagcuuucagccaucgcacucuauuuuuugagugacacacaguuugauuucucaugaggccuucacaucugugguaagaagcaauccugaaaggaggcguuuugucuggaagauucuuagcuguagucauacucagaaguagcaguuggaauuucauggucccuagggcugcuuugaaccugacaugccaauaguggagagcuuuccucucugagcgacugaguacauggugcuuuuccacauuuacaacugugauguuuguuccgguggcccugguuccucuguuuucuagauauauaaggcccccugcauugcccacauguggcaacuggaaauaaccccacacuggcagaugguccuggaggaaggaaacuguucucacugccucccauucucuccuaacaugacaucuaggguuauguuagcaagugauaaagaaaaacuggcgaaucaguacugcuuggugucuuuuauuauuuaaaaauuuauuuuauuuuuugcugggccuaggacuacaucuagagugcucuguuaugcucagcaagugcaucuuuauuucaucccuggccucuugccugguaaauuuuaguguugcucaugugagaauuuaaagcuucucaaauagucuuguuaugucccccacacacauccugugucacugaggggcagugguggacaggcagaguuugauaauuggugucuuccucuuacaguguaccuuauuuuuugagacaggcucucuuuuugaaccuggagguugcugguuuggcuagacagucuggucagcaaaccccaggguuccuccugccugggauuauaaaccgccacugcccuugauuuucuuauuuuucuucucuuuucuuuuuuucuuuuuuugugggugcuggggaucagauucggguguugauguuugcaagcacugcucacuacgccaccuucccagccccuacacuuuuuggucaguuuuuguuuuuuccauuaauuuacuuuuucauuuuacaucccaauugcugcccccugcuccuggucuccuccaagucucucucccuacuuucacauuuuagcugcuuauuucaaccagucuuugagcuauuugagacuagaauuuuguggguaggcucaaugaaagccuguuuuacugugagccucuaaaguccucacauauuuaugaccggagcuagaaauguuagugggucugcuuuacagagcaggagccagaaaggauccuuuugggccccacccucucuaauuuuagguacucauucugccuuaggcucugccgcugugacccuguuagcauggacuuuguuuuagcuccuuuucugcuugugaccgauggcugcaguuggaaguuaggaggaauaaacugacuuguucuugucagugaguaaaccacuccagacaaacuuuaguaagaaugggaggagggagccagggagagagggacaucuuucucaauugguagcugaagaaaaaaaagggaacaaggcucagcugacuucggcacccuugcagacuuuuguguccacacuggcagcuugucugcugagagcucugcauugaggaugguagccucuguuuuugccccaaagcaaacaagauggcacaaccugccacaauggggacuggggcgagagugaggucauuugagccacucacuguggugcuucuuugggacuuuguaucucuuugagagaaaauaugucagacuuuucaaguaacuugcuugcucugguuuguccaugggagaggccugaugguaaaaggcaaugaggguuacccugccugggaacgguuaauuugccaguacaugcuggaggccugccugguugccuguuuccauaaacacugucauuucuagccuucauugauacuguuuuauucaaaguacuuuuaaccuccuuaaaacuuccucugcuuuuugauagauggccgugaauuuguauagaauuguucuacugugagucucgccuguauguauguuugugugccaugugugugcagugcccuuggaagucagaauuagacacuagaucccauggaacuggaguuacacauggcugugagcuccaugugggugcugggcaacaaacccauucguauggaagagaagcaagugcuguuagucacugagccaacucuccagacccccaccuuuugauuuuuguugccguugcugcuguuuuggguauaggguuucuguagcuuugguugucugguccuaggccaguuguguggaccagcuggccugaaucucacagagauuauccgccucugagccaccacaucugauuuuuauuuuuaaauuguuuuaugugaugaguguaucuugcuuauauacaccccaugcaugccuggugucuguggaggccagaagagggugcuggaucuccuggaccugugguugcagugguuuugagcugccaugugggcacugggaauagaauccagguccucagcacaaaccaggagucuggugacugcugagccccuccaguccacccugccccccacuuuugacuuaaaaaagaaauuuggcuuuguaguuucuucuaaguuaaaaaauaagaagcuggcaguggugacauauacuuuuaaucccagcacuugggaagcagaggcgggcggauuccugagucgagugaggccagccuggucuacagagugaguuccaggacagccagggcuacacagagaaacucuauccuaagaaagcacaaaaaccaaacaaagcuaagcaggaaucuugugugagagccguguugucguucccagcagcuugccucucugcagcgugcugggcuccugugcccaccacuggcacugacauggucccagggcaggacagggucuauucaagucacucgagaaugugguugaugcagugguuuucuggcuuagagucuguaauuagaugaagcuccuaauaaaccuuacucaaacagaucccugcuuuguucuaauuaggagaaagaaccagcaacagugagaaaucccuccugucagucaagugaggggaaaguuugucuccucagucugcugccuuuaacagcagcaguuccuggugucacucuccagguugcuuucagcuucucacagacucgaggccagaggccauuaccauguccuauaaauguuaauaagcaugacauauugccaguucucugugcaaaaugaacacauaucgcauggauauuguaagucauuaagucacugaaggaucugcaggccaggacauggcaaaccuacgaaggagcccuaagccuuguaacugacaguguaauacauguugcacauguggcuuuguuaccugagagagugccagaauugacugcacucagcagucacuuuacccccucuacaguuuagcuuuuuuccuuucucucacuacuuuuagguagaucuuuagauuuuguagcacugacuuagcuacacugaaagcuguuuaucuguaaguuguucauuuuuguugaguagccgugucccacauugaagugugaguuccgguugcgucugcugcucucucuggagccagauacugaacaagaacugguuucugcucucaguucuucuucucuccauaucugcagucagaccugcucaaggcccuacauuaccuccuccagugcagcugcagggaagggugagcucuagugcuccucguuaggcucugcuccucaacuggcugucccaccugacaagcauuccagaggugguggugggaccauuuaccuuuaggaagcaaauugccauauauaccuguauaucccagagagggaggucuguuuggaugugggguagacaggccucaguugcaagaccauuuagaagucaugagaaagagaagugguugcugcugugaucuaacccuuucuguuucagagagaaaugaacaggaaauaccauuugggguggucauuguaucaaaguucugccuuuuaacaauguuuuauaccaagcaagggguggguggccagauuuacuacaagaccagucauuaacaaauucauuaaucuuuauugaaguuuuaaaauuuuuguuuguuuguuucuugagacaggguuuuuuuguguagcucaggcuguccuggaacuugcucuguagaucagguuggacucaaacucagagaucugucuacucugucuccugaauggugggauuaaaguuguacaccaccacugcacagccuuuuuuuuuuuuuuuuugguuuuuuuuuugguuuuuugagacaggguuucgcuguauagcccugguuguccuggaacucacuuuguagaccaggcuggccucgaacucagaaauccgcuugccucugccucccuagugcugggauuaaaggcgugugccucuucuuuccuuuuccucccccuuccccuccccuccccuccccuccccuccccuccccuccccuccccucuccuuuccuuuccauauccucucuggugguguucuuaguuugcagcacuggggauggaaaccaggacuuaauguacccuagguaaggguugucucaguaaacaucauuccuaguccuuguucuugcucuuuguaagacauaauuaaucacuuccuggguuaccgaauuugguuuuuuuguuuuuuguuuucuuuuuucaguccuuuccacuucaguuuccuuuccaaggagaaaaauccaaacuuacuuugugaaugagucagcugucagcaggguuuaguuugaguuaaguuucugucugagcaaggccugucucucugggcugaaucuguccauccuccccuguccccugagggcuugugcagacacagguuuucugguguuuguacugcugaaaggggagcuguggcucaagauagagauuuucaaacugcuaagaauagagguucaauauacaaguucuagagaauugccuuuaugguguuuuguuuuguuuuuguuuuauuuguuuuuuguuuuguuuuguuuuuuuguuuuguuucgagacaggguuucucuguguagcucuggcuguccuggaacucacucuguagaccaggcuggccucgaaaucagaaauccgccugccucugccucccgagugcugggauuaaagguguacgccaccaacgcccggcuuuguuuuuguuuuaaagacaagguuuccuuguauaguccuggcuguccuguucuaguccaggcugaucuugaauugacagauccaccugucccugccucccaaguguugggauuagaggcaugcauagccacaccuggcucacugagaagugccacugcuuuuaagugcaggauggaucaugaaaacaugcuuuccuuggaaaaaaaugagauuggccgaucacaugagauuggguaggauuuguaguggauaauccccaaaugcugugauuucucaugaguaaacaggcuuuggagcuucuuguugucuguagccuuucucaggcuccuuuccugcuuguuugcauguggcccgggaaggugaggagaugggaagucagggagaccacuuguuagcagucuaggugaaaggacgaugacgcaagauggaucuuugucucaaaggaaaauuuggguugucucauuaucuuugucauuuuuuucagucuugcagacuaaaauacuguuaacaugaaacaacuguuaaagauuuauuuaucuuuacgugugcauguuugugccugcagggguuuauggguaccaucugcagguggcaguggcggccaaaagcauggaguucaggcagcugggagcugccugaugugagugcuaagaacugaaccuaggccuuuugcaugagcagcauaugcgcuuaauaugagccagcuccagcuccuugcuugaguugucacuaaauuuaguuuuuucaaucuauuugguaugugauaaguuaauuuauauuaauguauguauacauguguuuucauaccuguuuuuuaucuccaucucuagugguauaagaggauauaguaugagagagaaagaauuaauuauguauugguuucuuauuucuauuuguuguguguggugugcacauuugccauaucaugccuguggaaaucagaggagcauuuugggaguuguucucuccuaccaugugaguucugggaucaaccuaaggucaucaggcuuuuguagcccuguaaccugcugagccagcucaguugauuugcuugcuugcuugcuugccuuuuucuuuuuccaggguuucucuuuguagccuuggcugucuuggaauucauuauguagaucaggcuagccugaaacucagagaucuaccugccacugcuacaaguggggauaaaaauuuaaauccggaggggggugaggggaagagagggggagagagagagagauaaguggggcaguaguaauguccccuuuaaucccagcucuugggaaucagugaguuauuccaggauagccagccccccccccaauuuuauuuucugugcuugugugucuguaugaguuguuugcuacaugaauacaguaccaucaagggcauuggaucuucuggaacuucuguaauuuagagcuccaugggugcugggaacuaaaccuaugcccucuagaagagcaacacguucucuuaacugcuuagccauuuugccaugcuuacccccaacggcuuuuuuaagacaagggcucacguugcccaacuggccuuaaucuuaguuuagagccaaggcuugcuuugacccugccucuaucaccugggugaggggauuacaggcuugggcaaaccuucagcagaaaaucugauaggaauaauuaacccauuauaccacauauaucacauaugaauaauuaacccauuauaccacauauauaucacauaugaaucucaagccuugaaugaaauuucucuuuucauuaagguuugugccugugugugugaguacccacauggagccagaggauaugggugucuuccucaggucaccauuuggcuguaguaucuauguaugugucuagguuuguauaaaugagccggaggaagccagcuuuggggcccugaagcuagaguuacaggcauuguaagcuccaguguaagugcugaggacugacugguaucuucugcaagagacacauucuuuacuauuuuuuuuuaagauuuauuuauuuuauauauguuaguauacuguagcugucuucagauaccagaagaggguuuuggaucccauaagccaccaugugguugcugggauuggaacucagaaucucuagaagagcagucagugcucuuuuaacugcuaaacucucucuccagcccaagagacacauuuuauuuuuuagagagaauuauuuauguauaugaguacacuguagcugucuucagaugcaccagaagaggguaucagaucccauuacagaugguugugagccaccaugugguuccugggaauugaacucagaaccucuggaagagcagucagugcucguaacuucugagccaucucuccagcccaagagacacauucuuuuuuuuuuuuuuuccuuuuucuuuuuuugguuuuucgagaaaggguuucucuguguagcccuggcuguccuggaacucauuuuguagaccaggcuggccucaaacucagaaaucugccugccucugccucccaagugcugggauuaaaggcauacgccaccacgccccgccugguuuaagaggcacauucuuaaucaucucuucauguugguuuuuguuuuguuuugguuugguuuuuugagacaaggucucccagugaaccugcagcguaccauuuuggcaagucucaagguuguacccaccagcuucugacuaacauugacauaaaaacaccaucauccugguaaggaaggccucauaguccagcagguacgggagucacccuuggagucagcucagcuucccaagagcucagugacagugacagcaggugacucuuuguugagccugaguuccccucuaagaugggauggcagugccugguuuagaugagugugcacguguaguguguggugcuggugcauguuugagaugaguagggaaacagaaggccccagucacaggaagcucguugaaaggaauuacucuaaccuggcugugauagcuuuguacuuaggaucccagugaguucccgacagccugacugcagggugagaccaacaaaaaaauggauacucagaagccucauuaggagcuagagagauggcucaguaauuaaaagcagucacuguucuuccagaggucccagguucaguuccuagcaccauagggcagcacucuuucaacuguaacuccaguuuagaggauccuacacauuuucuagucuccuugggcaccuaggcacacgugauagguauacaugcaggcaaaacacccaaacacauaaacgaaagaucaaucauuacaaacaaucauaauuguauuuuuuuaaagauuuauuuguuuauuauauguguguacacuguagcugucuucagauacucuagaagauuuuuguuacagaugguugugagccaccaugugguugcugggauuugaacucaggaccuuuagaagagcagucggugcucuuaaccgcugagcuaucucaccagcccccucauaauuguauuugaaguaucucuuuguguuagugccuggacagcauagugagauuaucacaaaauaaagggaaaugugaaggaauguguuucuaaggugaugagcaacucuuuuaaaucauguccauuaaaagugcccaaggucaguagcaggccacucacugagcacuggaggcguguuucugcuuguuugcaguacagcuaacacuuggagaugaggucugggaagcuaguugauagaacuagguuuuuguuuguuuguuuauuuauuuguuuguuuguuuuuaaacuaccacauaacugcuccacagcugggaaagaaagaaauuuccuaaaagcacagggcaggaaaaauacaccagucugucugugccaagacagacuccuuucaaaaguguguuugccugccaccuaguauggugugauggcuuuccaagcacaaguccugcacugaguggcaaauaccuuugagccauccuaguaugcuauccgcauacaguuuuuaagauuaagaauaaaaacacagugaaaauaccuuuuuucugaguaauacuguguagcuuaucaagaaagccuagguuuuuaauacaguauacuauuuacaugcaagcuggcaggucauagugcuucagacaagggccuaaagcaaaugaggaaccaagagauguguuagggauggacuugcuggaggccuuugcaaggggucucuaguuacagccccugaucugcaugaagccaucccaguucuugguaaucaggacggaaucccaucagcucuaucauccuuugugccuuugacucuccuuagugggcuuuccccugcugcucucuacuuuagccggacucucuggucacagcucucaaggugacugagguuguccuuucccuuuugguuuccuacacaggguuccuugcucuguagaccaagccggccucaaaccuacagauccacagccucagccucuugaguggcuaaaaccugugagccaccacugccuggaaguugagguugcuuuuaaaaugcaauuuauauucucucucucucccucucccucucccucucccucucccucucccucucccucucccucucccucucccucucccucucccucucccccucccccucccccucucccccucucccucucccccucccccucccccucucccccucccccucucccccucccccucccccucccccucucccucucccccucccccucccccucucccccucccccuccccuccucccccucccucucuccuucucucccucucucccucucccucucccucucccucucccucucccccucucucccucucucccucccccucucccccucucccucucccucucccucucccucucccccucucucccucucucccucccccucucccccucucccucucccucucccucucccucucccucuccccucuaucgcgugcgcaugcacaaacagggaaggacaguaucucauuuugaccuucuaaguaugcaaacccauugauagucuuauuaauuugauucaugguuuaaauuuaguucaaccgauuauaaaauuaauuuuauauuauuuauuuauuuaaaauuuacucuguguaauauccuagaggcauuuaaagggggaaaauuauauuucuucccgacccaaauauuuuuuuguuguuguuguuuuucuuaagguuuauuuauuuauuauauguaaguacacacuguagcugucuucagacacugcagaagagggcgccagaucucauuacaggugguugugagccaccaugugguugcugggauuugaacucagaaccuucagaagagcagucagugcucuuaaccucugagccaucucuccagcccauuuauuuauuuuuaagauuuaagauuuauuuauuauauguaaguacucuguaguugucuucagacauuccagaagagggcaucagaucguuagcucuuguuaaggaugauugugagccaucauguggaugcugggauuugaacucaggaccuuuggaagagugcucuuaaccauugaaccaucucuccagugcccccaccccaaauauuauauuuaaauauuaaauuaaaaaaacacaucagcuaaucauuuggcauguguuuuucacauuaccuugagaaaugaaauaauucuaucauaguaaaaacaaacaaacaaaaacauuguauauaucugagaucacauagugucuuuaaguaggcgauuccauuacaguccaguacagggcugugaggaucuacaaaaacacagcacacacgccaaaaaacaagaacuaaaaaccacaagguuacugucccccccgaggguugacagcgacuagaagccacaaaaacugccagaaaguaaagugcuugucccuucugacacacagcaggccuuggaucugugguauucagacaggaacugugggagaggaagacuggcuggccaggauacugauugacugaguuaccugaggccaggaagaggcagcacucaaaccuggugucacuaugauccuccguguuggcuccauggacugucuuacacuacucacucugaagacagugucagaucugcugcccuucauagaacaaaccagaaugugucucuucugcugacucaccugauauguggaucagggaugcacccaguauauuucuuuuuguaaagauuuauuuuauuuuuguauauaugguuauuuugcuugaauguaugucugugcaccacuucugaauguaugugcaccugguacucuuggaggccagaagagggcgucacauauccuggaacuggaauuacaggcaguugugagucaccaggugguuacuggaaaucaaaucuggguccucuggaagaccaguuagugcucuuacccauugauccuuuucuccagccacuaacguggguuuuuguggacauuuaauccuggcuaguguuguucuguuuuuguuuugagauagucuguuuaggcuggucucaaaucuguaauccuucugccuuggccuuccuaauacugagaguauaggccuguaccucuagaccuagugaaaauauuuguuuuaaaguuucuuuuuuuuuuuuuuuuuuaaagauuuauuuauuuauuacauguaaguacacuguagcugucuucagaagagggcgucauaucucguuacagaugguugcgagccaccaugugguugcugggauuugaacucuggaccuucggaagagcagucgggugcucuuacccacugagccaucucaccagcccuguuuuuuuuuuuaauuguguuuuuguggugcuugugugcagugcuguguggagauagaggacagaucguaggcuuugcuuuuucauucaccaugggggucucugggauagaauuuagggcaggcuugacaggaaguaccucagucuacuaugccaucuugaaggucucaaagggauaugcuuucuuauuuuuaaugaauuaauuucuguguauggguguuuucccugcguaccacuguugccuggugcuuccagaggccggaaaaggguguuagauccuuuggaaugggaguuacagagagguuuuaguagccuuguggaugcuaagaauuaaaccuugguccucuggcggggcagucagugcuuuuaacagcugagccaucucucuaaccuagucccacucccaaagguuugcuuuaaaauguggguuauuggggcuggagagauggcccagcagguaagagcacugacugcucuucugaaaguccugaguucaaaucccagcaaccacaugguggcucacaaccacucguaaugagauuugaugcccucuucuguugugucugaagauggcuacgguguacuuacauaugauaauaaaauaaaucuuugggccggagcaagcaggcagggacugaccaaguggaguugaccgaagagagcagggcugacugaagcgagcagagguacuaaauugaauucccaacaaccacaugaaggcucacaaccauuuguacaacuacaguauacucauauucauaaaauaaaucuuuuuuuaaaauguggguuaugccaugacaauaaucuuucgagcuguuuugguuugugaagguuugugaauuagaugaccuaagagagcaaauuagaagaugaguaguguguguauuucugugaguguguauacacaugugugcagaugugugugcuguguauagaguucagaagacagcacugggauuucucaugaaauuuuccaccuauuccuuagagguaggaccucuuccuaaaaugugggcucauguuuucucagcuagguuggaagacagcaguccuguuagagccgggguagcagacaugugugggaccuugcugugucaauguagggaucugaauucuagucuuuaugauuagacagcaagugcucuuacugcugagcccuaucuccagucuuagucuguauuuucucaagucaucaauucugagguuaaaguucccuguugauguauaugaaaaugaaacuggguuuccugucaucugugaccaugguucagccccacuguaauguuagguuggagauaucuggauguuuucugguccucauuugccuccucuagacauccacuucccucaacuuacccagguuuuucccgugauucuguacacuguguggauucuuggauuuccugauggauguccagggguagagugcuuggcuguuagcaucaguguccagggccugaaccauccuuuguaugauuuuguguugcagaaaguauagcuucuaccauugagcucaaugcacugugugugaaacuggaaagaaaaccaauguauaagcccguggacccucacucucggaugcaguccaccuacagcuauggcaugcguggaggugccuauccccccagguaugugcuugggguggaauuaguuggguuuuucccuaaaguagucucuaugaauugugaaugauuuggucugccucagguucaccucuggacuuaaggugugccuuugguacugugcugggacuguugaagccuacugccuuugcagagggcccaagcagguugcucaggagcagcugcauucacacccauggucuggcuacguuguuuccucagcacaugcuccugaaagucuucucugacauugugcuuugugcaacgcugagacuaaguaauagugcucagaagggucagagccuaaaguggcugcagauggccuauaacccuagaguuccagagguggaagcagaaagaguaucugcuaaguagaagccaggccagccugggcuacauaaacucuuguuguauguucaaaccuuugcuucaggagugagacauuagugaacagaucagugauggaggcagcuguuucauuuuccacccauccucugaugaggugcaggagggcaaaaccucaaaaauacagguuuugaaguagaaggaaccagacucuuuuggacuuggugcugcugagauuuccaaaaugagggucauuuccaaaagacgucacccuuaaaauucccagacucuuugagagaugugcaagugcacacugaaggcuugagaaaggaaagcaagcuaaguuugucucggccagcaccugcguucauucaggcacugucaguauggccuauuguggagcaucagaugcguacauagcaugugucagcuacuagaguaagugugacucuagcgcucugcuuagucacaguguggcagcuguagaucauaugaguuuuagggcagcuuuuguagagcugaccaggaggucuuucuagcuaugagcacggugacaaggccagaguacacaaagagugggguuugcugaagaaaguauggcugacuuaggagauggagacugagacccuacccuuguguuuguagauacuuuuacccauuuccagucccaccuuuacucuaccaaguugagcucuccgugggcggacagcaguuuaaugggaaaggaaagaugagaccacccgugaaacacgaugccccugcccgugcgcugaggacucugcagagugaaccccugccagaaagguuggagguaagguggacgcgagcuugagacaccucacugacuuccaaggugcugcugcugucuguacuacuggguaauuaauccagauucugucacugggaaaguguccccuaaaugucucagcaggaaagcaaauggccuuuccuuuuccccuggcaauggaguguagagcacauggugggugugggaaggccggggcucuugaguugugagugucggauucucagugcugacaccuaugcucuuggagcugcugauugguguucuuuuuguuuuuuguuuuuccuguguagcucuggcuggccuaaacucacaauguaaaccaaacuggccuugaacucacagagcucugccugccuuugccucuugagugcugaaaucaaaccugugagccaccacgcccagcuagaagccaugauuuguggugcuaaauuaagaguauuugugaccuucagcccaccaccauuuucuguagaaaugcuuuuagucuuuuguuagcacguuauccuagaacauggugcauguauuuuacucaaagaucugcagcuugagcagggcuagauguggcggcuugcuggcagaggaagcucaccaggacgucaccagcuugggaggacuuaguagaaaaauggcuccuccugacagggcaccguaguuucuggguagugucccucuuacaggggcuguugguaccuccucacaguuuggugacugcaucucaagaaugagaauccuuauagacaggaaaaggaagccaguuauuaaagccaauucucugaacccacagccuggcuucugucaugguuucuagguuaggcagucccagagcuaaaggaaggagauaaggagacucaccuuuguguguucuuuuauuaaagaccacauuagaugaacucucaacucuaguacaagcauuauccaguggcuucuagggcacucacaguguggaaaagaagguguugaagaauuuggaacuuuuuguuuguuuuagcuacugcuaaagguuaaugcuaauauuauuagccauggguugugauuuaaaacuacaggguagaaaaggaaucuuacagguuuuuuuguguuuguuuguuuuuuuuuuuuuguuuuccugugccuggagaguaaguaauuuuuaaaaaaaaaauuuauuuauuuauuuuaugcauaugaguacacugaagcuguacagaugguugugagccuucaugugguuguugggaauugaauuuuaggacuucugcucacucuggcccaaagauugauuuauuauuauaaguaaguacacuguagcugucuucagacacaccagaagagggcgucagaucccauuacagauggcugugagccaccaugugguugcugggauuugaacucaggaccucuggaagagcagucagugcucuuaaucacugagccaucucuccagccugaguaaguaauuccuaggaugacuguugguaguugcuugaccagcuucaugccagugagagacuuaucuccaggguggaugcagccuauggauggcaccagcuggcauggcucccucauagacagucaaauuucaaaccaaacuuuguaggucuucagcuuucuaaggcacuuggagggaagauuagcuuuaagaacuagccaaggaaagcagccaugcagccauaagggacagggagagguggcuguuuaggaggcugagguagcacugucccuuggguccagcuugggcagggcggcaagcacaugaagaagagaaggccagagcucugcuguugagggguaaggaagcaucuaagccuggcugcaugaugcuggggaagccaguggguaagggagcucaggcugggaaggaagcaaacuguuguugaggacggggagaaagaauugcuuauggagcuagaguaaacagauguuuauucuggagccugccuggauuguuuccauggauuuguacccaggagcuugcuuucugguaucuuauuugauuuuuuuuuuuuuuuaaagauuuauuuauuuauuauauguaaguacacuguagcugucuucagacacuccagaagagggcaucagaucucauuacgggugguugugagccaccaugugguugcugggauuugaacuucggaccuuuggaagagcagucgggugcucuuacccacugagccaucucaccagcccccuuauuugaucuuuauggcuggcucgucuacuguccugugggcaaguagucagcuugaugaacugacccacacagaaaagccuggcuaguccugccauggccugcuagcacauucagccaggaguuccucucaggacuaauccuggaaauagaaguugacaaauuuggcagaagaaagcagcagugugaagccagaagcucuggugagguccugggcugcuggugcugccggucuacccucuccugagucugaugaacuuuguagaaucuauguuaucagcucagagagguggccuggguacucugaguccuccuggcaggaggacuggugaaccuugguaccgagguggacuguccuggucaaggggacuguauugguuugugccuuggcuguuugccugcugugcuguaugagccaaggcuguugggcauucuguuccauugcauucuuuacaaaugugguuuccagggccucuaguccacuugugcaccaaccacagagcacuuuccuccgaccaccuggcucacagacuuagccaugcuuacucuuuccacacucgugccuuccacacucagccaggcccacugcgccugaaggugugcugcugugguuuguuagugacuuuaccagcuggacucuggcaggguuugaucugaggcuuaagauuuaauaccauguggccuuggucucugguucauuguuaagucuguagagucaacguucagugcuuuccaacuaacuguuggugguuugacugaaaguuaacuuguuuuuuuuuuuuuuuuugguuuuucgagacaggguuucucuguauagcccuggcuguccuggaacucacucuguagaccaggcuggccucgaaucagaaguccuccuggcucugccuccugagugcugggauuaaaggcgugcgccaccacuaccuugcagcucuuuuuaaaaaagauuuauuuauuuuaugugugugaggacacuguugcuuuuuuuagacauccauucccaucacagacaguugugagccaccuugugauugcuggaaacugagcuuggaaccucuggaagagcagucagugcuccuaacugcugagccgucucuccagcuccuuaaaauugacucuugcuuaacaauuacucuucuguagguaaauggaagagaagcagaggaagaaaaccucaauaaaucggaaauaagccaaguguuugaaauugcgcugaagcggaauuugccugugaauuuugagguaagccuauuucacauguacaacauugccguaccaaauccugucaggauucauuaugggaucaacuuuccuaaauauuggaguaguccuccuaaagugacuucagugggcagcccagcccuccacugaggagagcaguacuuacugcgucuuccuucuuaacugcgccauucucgccuugacacuggcaccauagcacacaggcccuuucccucccauugcucuagaaagcagcuucaccucccagauaguaugucucuuaagguacaggcucugucagacuugcugugugagaaauaccccagaggagcaaccuggagggggaguuucuccauaacaauuucagagacucaggagagggagggagggcuggcagugccagagcagaaagugcaggaaaagcacuguagaagaaaaccacuuucaguacagcuuucaguauuagcagagaggaguaacaaggaagggccagggccaagauggacccuaagaggacuguccacagcaaccuaccuucuccaagugagccuccaccuuccacugccuaccacuucccagugcuguggagaggcagguguucaacuugaugaucaagauugaccaccacaguggccccaagauccacaaggguucuuugagagggacauaguguccucauuguuugucuauccuuagcuuacuguuuuaauagucauuucuuagagaucugcuguucuaaagauaguaauuacuggcuucucuguucaaaaugcaaaauuauauuucuguucuagacuagucccaauacacuagaaaagaggaggcaauuuuuuuaauaguuucccuugacagaugcuuguugguuugagauggggucucgcuguauagcccuagcuucccuaggacucaugagauccuccugccuuucccucuuggugcugagacuaaagacuugcugccacaccuauuccgaugcccugcuuuaauuuuggcuuugggucuuccucuggaagaacauucaguguucuuaaccauugagccaucucuccagcccuuguuuuuguuuuuugagacaauuucucuguguagccuuggcuguccuggaacuugcucuguauccugguuggccuugaacucacagggaccuaccugccucugccucccaggugcugagauuaaaacuaugaaccacugucaggugaaggguuuuuauuguagauaugaggaagaggaccaccagaggcgucuggaagaguccagagcagagaaguguaaacuguacauggccuggccuggaaaggagagaaagagagagggaggggcggagagggagagaggaggaggaggaagaggaggaggaggaggaggaggaagaagagaaggaggaggaagagagagggggguggccuaagagagggcacagcugaaauagcaggguucuaaggagaaguggacagcucaagggaaggaggccuugaguuagaaaagucuagggucggugggaagaguugagaagagccaggguagcugcauggacucugaaauguguaacaaauaccuuuguguuacugcagagccuagaggccagcgugugcugugcugugcuaauaggcaccacagguagccauuaguuucuuuugccagugauaaggguaauggcuccuuucgguucagggaaacgcacguuccucaggagugcugacuuuugacuaaccaccagacuuuggaggaaauggaguuuccuuuggaccugacagguagcaagugucuuuaaccccuggggugcucugccauccccccaaaacuaaaaaauuguuuuaaaaaagcaaauuauuauuauguguguaaaugagugugcugcagcagcacacuguggcggucagaggauggaguccuccuccuccuccucuccaugacccaggcucaggcagcucaucaagcuugagcagcagguguguuacccaccgaggcgugucauuggucugccuucuuuuucugaagugaggucucauacuggugucuugggguccccaauuuagcucugcugagcccugucuucaccuccccauuacucagaucacaagugugaaagaaaccacacuggauugucugcguggaucagacucaggguuggcagguucuucaccccacucugcgccugcuuagccucugacauuuguugcuguugccuauguuaagcuaugucuuaagaauauuuuaacucuucgggcgugguggcgcacgccuuuaaucccagcacuugggaggcagaggcaggcagauuucugaguucgaggccagccuggucuaaagagugaguucccggacagccagggcuacaaagagaaacccugucucgaaaaaccaaaaaaaacccaaaaacaaacaaacaaaaaagaauauuuuaacucuuucuuuauagugcucccuuuuacuucagaaaacucaugcuuuagcugccaaacucaccuauucacccuucauuccauagccaagcgagggugacuuuguccuaagauguggcagugcuugccuucccauuguggggcaaaugucggauggacagcugugcuugccucccagaccagucugugugagggauguccuuguccccugcuuugugaacuagagccuccugggccuauauccugucuccuguuguggagguucuauugggcaggcugggguggaaaggagacauuaccuagaaugacagggcauguugcuggguggauacuaggugagagcuguaucccaaacucucccugggcagugccugaaggagaaggaaaacauacucuuucuuggggguaggauaguaugaggauacagcuguagagacuagagggaggaugggcuagauuaggcgagugccuagcuccccaaaucucucugcucaggaccagcucugguuaaguuugucagcucuugauggugaucaucuacccugccugcgucucagagcuuuuuagagccguuuguucugguggcagcugggagcuagauugcugcccuuccuccuccaccuuggcacccgcuuucugaauagguagcauucagagacuucucaggcagccccugaagaaauccuuagggugcccccuagugauggcuuuguaagguguauuucuuuucucuugguugugauaaaacaguaacugggagcuuguuugggcuaaugcuuccagggaaguacaagcucgucauggcagcgaguggguagaguggguaggcgcagcuggaggagcagggugcugagagcuugucucuucaagacaaacacuagacaggugagguggaaggaggaugagucugcucugucgugucacaggaauacacuuccucaguacauucugaccuauccagaccuugccaccaacuggggaccauggggacauuuguauucaagugagcacacgagguaguaauguggaucaucugcagaugguguuccugugaguuccugcugaguaacuguccagucagaagggucauagccacagccauugguagauugaguggggccugucuuaucuguugcacguggcauauggccuggcccaugcuagauucucaggaaguauauauauauuuuuuuuucuuucuugagacaggguuuuucuguguagcccuggcuguccuggaacucacucuguagaccaggcuggccucaaacucagaaauccgccugccucugccucccgagugcugggauuaaaggcgugcgccaccacugccuggcaggaaguguugcagaauaauaaacauaguaguuaauuuccgccaggcuuugugugcagucuguccuuaggaaucugaguuaggugggcagaacuugcuggcuccacaauggucacaccggcagccuagguaguauuucauauguagcaugguggagccaaggugugaguagaugaucucaccaccgcugaggggccaggugggcuggaggacacagugagccaacaguguucguauuccaucugagguguagacaacgcuguccuggggaguuuucugauagucugcaggguagagcaaggcugagugaggugccucugggcuccucucaucucaacagcuguuucuuugacauacuuuguuuucuggacuuuucuuucaauuuuuuauuuuuaaaaaugucaaauuugauagaagagcuuuaaagcaggacagugaauguguccuucacuuacuggugagagagagcacaagacauuucaaugguagcuuccaccaugaccaagugguugcuugaccagauuccuuuaacuagagcuggucugugagugcaaagacuuucagccuugacuguuccuacaggaagcugagcauugcugugcuguggugucucacauacguacuccgccuguacuuucuccacuauugugaauuuuuugcuguucugccacacagcucagggccuuccuuucaaucuugccuuuuggucacuucaucugugaccauccucagccuuuguuuuuugugagcuucguguguuugaaggcuuguuaaguggcucucauucugagggagcagauucagguagugucccucugagcuuggugcagcacuacugugcuaugguggcuauuccgcuuuuugcauuggcuuaggguucuacaguggcuaugcuccuuggaggagucuccuucucuuggauugugagaccuuuuguggagaccccugaagguuguauucuuguucccagggucugacagucagugucaucuuuagggguagaagguacagcgacaauugccugaauguccaagcuguuguggugcuguaacuagaaccuguccuucuccucugauccuccgcaccugugcuuguagcggaccuuagauccugagugugccaagcagugugcucuaccgcuuccaacaaguguccgucacgcuuucacucagucuuuccuucugacacagguggcccgggagaguggcccaccacacaugaagaacuuugugaccaggguuucaguuggggaauuuguaggggaaggagaagggaaaagcaagaagaucuccaagaagaaugcggccagggcuguucuggagcagcuuaggaggcugccaccccucccugcuguggagcgagugaagcccagaaucaagaagaaaagucagcccaccugcaaggugagagccuuccccagaaaacccacaggcaaggagagagccggcugcugcugugggugggguagaagcugcuugcucagcaccacacgggacagaauggauguuuacagacagcacauaggagcuauagguugaggauaaaugagccacugaguggguugaggagaaacguguccaggugucagcuuccccugggguugggcaccacagccugucggucuuuguguggaagggguaggguuuucuugagccaacuuagcucagggaucaagguggaagcagcacugcagggcccacagagacuauuccaaagacuuggaugcuugcaugaaacuuaguggcuauaguuaauaauaauaauacaagcugggcaugguggcgcacgccuuuaaucccagcacuugggcggcagaggcagacaaauuucugaguucgaggccagccuggucuacagagugaguuccaggacagccagggcuacacagagaaacccugucucgggaaaaauaaaaaauacagcauucaccaugaguacuggagacuggagagguggcucagcaguuaaaagcacuggcugcucuagcagaggaccuggguucacaacuaucuguaacaccaguucaggacuccuccugaacucccugagcaccaagugcacaugugaacugcaugcagacaaaacacucacauacagaagauaggaaucuuuauucagacauuggccccuuuuccgcacuagaaagggacaggacuucagccaaucucuccuuuuucaucugguguguccugaaaauuacuuccaucaucccugacaggugccauggggaaggaaggagccccuaguguccucagaagcuugcaguccucucuccccgggccucaccuggaggguuuuuaauucauaacaguguuuuguuuuugcuacuggggauuggaugagagacucaggugugcugaccaagcaaggccucuuccauagggaugcaucuucacacugagggcuuuacaaaagcuuuaaguggugucuggguuuuaaugauugagaaagcuaggcauggguccccauguagauucaguagcgacaggucaaagcccugguuccauccucccuuuuugucauucuuuuuuuuuuuuuuuuuccuggaacucacucuguagaccaggcuggccucgaauucagaaauccgccugccuccaccucccaaguucugggauuaaaggcgugcaccaccacugcccggcuccuuuuugucauucucgcccagugugguccuacagcuuuuuacauggcaguuccacugugcuaauguccccaguuacauggagucagcuuccgcaugccgagagugacagaggucacaggcaaacaccaacccaaagagcaucucagcaugauccugaaacauguuuuagucuuagagaggguuugguucugagcguuuacaccagcacuagguagguuucugucucagucccgugcugacgcuggacuggcugguuccucucugugaguaacagcauauugucucugcacugcuuguuuuucagcuacagacagccccggauuauggccaagggaugaauccuauuaguagacuugcacagauccagcaggcaaaaaaggagaaggagccagaguacaugcuccuuacagaacgaggucuuccacgucgcagggaguuugugaugcaggugaguuggugggguuguaggcagcccuucccugaccauguccuaauccggcaguguugcaguuagcuggacuugguagugccugcucuuggcucucuggaggccaaggcaagcggcagguggaucucuaugaguucaagacuccacauuagugagaucccaucacagaaacaggauccacucuguaagagugaguuggaccagaguuugccugaaguggcugggggacagcuuugaugaagugugcuggaauuuguccagcagccagcccucaggagagugguauggagggagagccccacugcacucuagauauauaccugucuuaauaaauuugaugauguguuguggcacacauuuuccauacaauaguuuuuaaaguuuaaaagaacucuuuaaggacuggugagauggcucagugguuaagagcacugacugcucuuccgaaaguccugaguucaaaucccagcgaccacaugguggcucacaaccacccauaaugagaucugaugcccucuucuggugcaucugaagacagcuacaguguacuuaaauaaagucuuuaaaaaaaaauaaacucuuuaaaaauagaguuuucaauaucucuaacguguguguggccaucacagcaguaguaguucagaauacgaaacauaaagcuuuuuaccaucaaguucagcagucaucccuggggcuuuggguuaagucacaggucuuuguugguguuuuacacagguaaagguugggcaucacacugcagaaggaguggguaccaauaagaagguggccaagcguaaugcugcugagaacaugcuggagauccugggguucaaaguuccccaggcgcagccugccaagccagcacucaaaucagaagagaaggugacugcugggacucugugccagguggccuaacucccugcaugggcaagccuggggcaaggcuucaucuccccugcaguaagcggccugccccccggggcuccuccauugagauuagauuugcaggagggaguuuccuguccagcucgucacauccugggagccauccauucgguuaagucuccuguuuagugucacuaugggcuagaugugcaucuccggaggagguccugcucucuacuucugauggguaguugggguuggagggaacuaaaaugacugccaccugucugcaugacccaguuuugaauaugccucugguuuuccugggacaagcuagcauggucaaauaagccaaaucuauagauuugaguugaauaucacuaucagccaccauugcuggcuacagcaguugucauauuggggauugagcuuccugagcucugccaguuucauuacaagaaauagcucccucccacugcugggacguuaguacuugguacucgccuugauuuggcuuccagauuucccauuccaaaacaguguagagucuauuaguucaagacuccacauagugagaucccgucacagaaacaguauccgcucuguaagagugaguuggaccagaguuugccugaaguggcugggggacagcuuugaugaagugugcuggaaucugucucuucuugucugauagcauuagguaccucuguguucuuuguggauguacuguuuuuggauguucuaguuauguaaaguguuucugcuuagcaccagugcagacccuacuuucccaacaagcugaacacuuuuaagccagcauuuucuccuggcagugguuuucugguucuuggcacagugccagcuaugcauucaagaucugcucugugcaaaugcugccauggggaggcgcgagcguuugucuauccacacagaccccagugcuugucuaugcucacugccauuuuucuuucuuaagacuccaguaaagaaaccaggagacggaaggaaaguaacguuuuuugaaccuagcccuggggaugaaaauggaacuaguaaguguggcccucuugucaauugaaccaaugugcucugugcuuguguggcucucgugaguuuuuggaagcacaguauuccugccuuccuguguaugcugggaugguaaggguggcucuguagcuucuuggguggugauggugacuuuggugaccuguguccccugcagguaacaaggacgaggaguucaggaugccuuaucuuagccaucagcagcugccagcuggaauucuccccauggugccggaaguugcccaggcugucgggguuagucaaggacaccacaccaaagauuucaccagggcagcuccaaauccugccaaggcaacgguaacugccaugauagcccgagaguuguuguacgggggcaccucgcccacagccgagaccauuuuaaagaguaacaucucuucaggccacguaccccauggaccucgcacuagacccucugagcaacuguacuaccuuuccagagcccagggauuccagguaaccguguggucaucucugggccuuacguucuuccugcacagaauugcuuguguagugugugcaagacccuggguucuguccucagcacuacagaaaccagaaaaggcaagauuauaugcuuuauuuaagauuugaauguacagugaaguucugaaggaaggaagaugucugggaugagaauggcuuauauaaagguagcuauuucuaagcccaacaacuuugaguaugauuacugguggaaagaaccaacuccagcaaguuguccucagugugcacacccugccccaggagguuuacguguggccagggcugaagggagagaagacacuuuuacuuaggaagcagccacuacaugagcaugggagaagaggcuugaggguucugggcuggggcccacaugcaagagguugcuguuuuuccuuagguugaauacaaagauuuucccaagaacaacaagaacgaguguguaucucucaucaacugcuccucacagccgccucucgucagucauggcaucggcaaggauguggaguccugucaugauaugguaugugggcccaggagguguugagaagagcuggcacauucccuuguucagucaguguguuaguggccucagaaagagggacaugguucuccuguagccuuguggacaugucugauugauucauucauucuuccuuccuugcuuucuuucucuuuccucacuucuggcagcuguagaaagcccccuuuggggaguucuguucaaagaaggaaucagcacacuugagcuuugguguucacucgaugggaccauaaugcacccuuuaagcgggcacccucugauuugaagggaaacaugggaguuugauguugagcaggauucaaacauuucauugggaaguuuuaagaagcuggacuagucuguucccugugguuugauuauuccuuccuucaccuuucuaggcugcacugaacauuuuaaagcugcugucugaguuggaccaacagagcacagagaugccaagaacaggaaauggaccaguuucagcgugagugcacacaugcagaaggcaauggcagugugggugagcagguauccauggaaggcagugucagaagaaggcaccacaccuucacccacuguugguuaggcagaguccuucccccucgaaacuugacaauaagacacauucauguagcuguuuaaaauuuuacgugcauuggugcuuugccugcaaguaugucggugucagaguuaaagccaucacugacacuuuuuucucagacauaacacaugcacacaucccucuuugcuuucuccacuuaccagcauuuucuagguuccauacagggggcauuggguuuaccaagcugcauuuuggauguuagcuuucauuucaaugucugccauugucauuucuucuuccuuaaaggugcgggaggugcugaaccuuuucuggccacaaaccauuauaaaacccaacauauauacugaaaauacugagaacugcuuugaaaauuuggaauaucugauaacuccagugggccaagacaugguggauaaaaauguggcaaagacgacaagaaacuucaggugguagcccugguugugcugggcggcuagugaugaugcugugcucugccauccauccagacagaaaccagccccaacgccuccaguucuguuuuugcaucgugacaaagagagcacagccaauucucaugcuggcuucuucagauacuuugaaaaacccggacagccacaccagagaggccuuauagcggccccggagcuaaacgcaccagagaaaaaccagugcuuccuacugcacaugacugacucagcuccgccacacguagcaccacuguaaccacugcuuucucuucaaguuucauuuuuuuccuuugauugauacaacacuauaauuuucauuucaguuccuuagucgugucuacuuaccuagcaguuuagaaacugucagucauguaacuggcaaggaucacagcccgguuggguggcauucugugccucuggcuuggcugaacaguucuggaauuaccaccagaauccuugacucccugccccuuguauaaauuggacagcuuaggacuuuuaaacuuuagaucaaaagauaugguccuuuuuaacuuuauuuuuaaggagcagacuuuaaaaugagcccugaccuuuacccauuauaacagaauuugucaaaaggaguguuucuugaggagguagcuuuuuuuuaccacacuacaggacauuaccuguaggcccagaagacuacaggcuggugucccuagagggcccaauacagucaauuccaaccucuaagucggggaaaggugacagguuuccuggugcuggugugcacaggggcaggcaggucagcuggccuggggaagagcauuguggcuccuagugcagcccugcuuccacucuugguuuagcuggaaccuucccacucauggaauauaaguaaacucacuuucuuugucaccaauaaaugguaauacuaaauuuuuuuuguuaauuuauuuucaaaugccacuucuagaucaaucuucugguucaucccccucucuaccuuuuuuuaaaagaagagaauauuucuuagaacuuuauauuaaaaauaaacagcuacuaagaaagucuuuuuccaauugagcaguaacugaagaaagugugauaugagggacugggaguggccagcuugagccaggcugacugauggaugcuuggcuguggaauguguaaaauguaauggcuaagaauucaguaugcaccccucuucaaaaacugccaggagccaguaguuccuuugagggaaugugugucaacuggcccuugccuaccacugagccgcaccccagugucacaauaucuuaacaacaaaaaacagaucuaaaaacuacauuggagaaugguaucucccaauccugacaacauuuaaacaaaugggaacgaagcaguucucaaccuucccaaugccacacguggcccuuuaauaguuuuucauguuguggugacccccaaaggaauccuggccacaugagcuauugcugaggacaugcuauggugugcuacaauuaaagugcaauaaaauauaccaaguggacaugguucugagcgccacaagaguuccaugcacagcacacacauccaugaaaugaaaaucacuaaagcagcauuguagaaggcucuccagccaugcagaacauuaaaggaccuacaaauacaccaccauccuauuuuccuuuuuuuaacaauuauuuuuaaaagggguuggggugagcuugagagaugguucagcaauggcuguucuucccuggguccuggguucgguuuccagaaacuacaugguggcucacagccaucuauaaugagauuugguguccucuucugacgcacaggcaugauguauacauaguaaaguuuaugccuaaaauaggcagaccucuaaguuccagaacaguggggcuacacacacacaaaaacccaucucaaaagcuaacaagaagcaagcuaaauuaguaacauuuaauguuuccauugcugcuuaaagagcaacagcaauggaaccuaaaagacaugagaugcugaagugaaggcucaauggcucauguguugccuuuucagaggaccuaccacaaugcucccagagauaugaacaccuauucuguuuccuggccucacauaaaacggggguggagauggcucagcauuagagagcacugguuguacuuccagagguccuaacaugcagguguauauaaaauaaaucuuaaaaaaacaaaaac

SEQ ID NO: 1283 - RNA, 22564 nt, Mus musculus
uguucaagaaggucugcuguucuuaaagauuuuauuuauuuuauguaugugaguacacuguagcugucuucagacccauuagaagagggcaucggaucccauuauagaugguuauaagccaccauguggucgcugagaauugaacucaggaccucuggaagagcagucugagccaucucuccagccccagguuugggguuuuauauauggaaaaaaaccagaccaagacaagaugacuucccacagggaagggauauaaaauugucccaccaacuucuucacaccacugagacuacuucuuucucuuguaccuauuaaggaaaucaauauuauaaguacugccucccacccagccugccucuccgcccauggguacugccucugcccucuacagugcaacaucaccuggacuuagauuugaaguucccucuccucuggcggggcagaccugacuguuuccucucuucaaaggaagggcuguaagacagaugaagaaugagauggguaggcugugggacacgugagggaugucacccauauuggcuucacaggccagcccaggugggauggguacccugaggggagugcagugccugggauucagucuccugugggcuugugcagaacaaugugcaguucuggaagccagacaccaauuucacaucagugggcagaggcuuuuugaaguugucuggaugagggggcuuauggaagcacacuaaguucugcucugcucaucauuacagcauugggaagcgcuaggcaagaggcagagugagcgagcauggacaagggugcuuucgugugagcggcacuuuaaaccuacccagcccgauacuguuucagggccuucuugcuuguguuggugaguucuucaucaaacacagacuucugcugcugcuucugcuuuuuagcuauacacagagaaaaaugggucagaggcuacugaguucccugacacugagggagagaauuccagaauccauggagggccagguucaaggauacaucccaguuccuccaaagcuugaucacugccaucccugccagcucuugccauggugcgagccucagaauggacacccuaucacuuaccagggccuguaggcucguccucaggcauugcccgugcucgcuugguucugcgauuccucuuggccagccgcucugcaaacaucugugccuugaggauuucaaacugggaccucuccucugccugggggcagagugagggaugagcacagaacacaccagugcuucaugggacccuacuccacagggaggccacucaccgucaucucccccuuuuucuuggcauccuucauaaacuucuuccuuuucuucuuuccucuuaaggccaagucaaacuccuguagagccuuagcaacuagagugaggacagaguguggaauuuaggggcuauuugauuaugucauuaaagcuuaaaaugagaaggaacuagaggugacagcucacugaguaaaguacccuucagggaagacugagggccugggcaggacugcucccuuaaugguugcugggagaaggggaauugagguuuucaguggugcagccacuggcaaggugacccuguucaagagaaucaucccacucaugcucaugucagagacuucacuaaaugcagcagccuugaaaagagacuucaagucaggaaggagcuugcuggaaagacacucagcaccaaaggugagggugguggggaagggacagguggugugugugugugugugugugugugugugugugugugugaugagagagagagagagagagagagagagagagagagagagagagagagaaagagagagagagagggagagagagugccaaguauacuaacacaauaaaacuaugauaaaaagccgggcagugguggcgcacgccuuugaucccagcacucgggagacagaggcaggcggauuucugaguuccagcccagccuggucuauaaagugaguuccaggacagccagggcuacacagacaaacccugucugggaaaaaaaaaaaaccaaauaaacaaaaaacaaaaaacuaugauaaaauaaacauacaaaguuuuaaaagagcugaggacuugaauuugauaccuagaaccaacuuuuuaaaaaacuggcuccuugacacagggucuauguaccccuggcuuaccuggaacucacagagauccacccaccucugccaccauaguaugaagauaaaggugaacacaggcaccuagaaccaggggggggggggcaggaagaggaggaggaggagaaggaaaggaaggaaggaaggaaggaaggaaggaaggaaggaaggaaggaaggaagaaaggagaaaggaaaaggaaaaggaaaaggaaaaggaaaaggaaaaggaaaaggaaaaggaaaggaaagggaagggaagagaagaaagagggaguguggugguggucuuguuuauaacccaguacugggguggcagaaaaaggcugauccuuaggguugcccggccagccagacuaacccauuuccugaguucuagaccaaugagacccugucuuaacaaauaaaacaagggcuggagagauggcucagcaguuaagaaugcugaguauucuuccagaggcuggcaagauggcucagugguuaagagcacugacugcucuuccagagguccugaguucaauucccagcaaccacaugguggcucacagccaucuguaauacuauccaaugcccucuucugugucugaagaccucaacagugcucauauacauaaaauaaauaaauuuuaaaaaaauaaaacaagauggaacauaagaucccugaagaaagacagcggagguugucuguccccuccagcucuccgagucccagcugccucaguacacagaagguccucacugucucaacucucaccacaaaugacccaguacucaacagcucccaccaacaucacugccccgucaaacagaggcagcguuucucacauugcuggcacagccuacaugagagaucauuuugaaacuuccacuagagucagaaauuuacaucccuuuucaccuccagaacacccuacaaagcacacauacucauuuaacuaaggagcacauguucaaagauucucaggacaucuccaccccaucugccuaauggcaaaaguuggguaaacuuugguaucucucaccauggaaaaguuacauuauaaacuacucaugauaaagcagcauacugccaucuuagguuugccuggcaagcaguuuccucacaaugcucagccagugaggagccuuccagacuuacucuucuccuucuuccucucuucuuuggucuggaaccagcuccucucaggcuccuggucugcugucucuuucccuuuggcuaagagucgcugugcugugucaaucuguggggaugguacaaggacacccgugguggaacugcagcugucccugccaggugagcgcugcagugucacugagcagcugaguagggagauggccacacagccucaccugggcuuccgacugcugcaucucuuuuuccuccgccuccagcugcagcacugcauacacaucuuucuccaauuucucaaucuugucccggaacuugaggauaacaucuuacaggaaaggaauaaagaauaaaacugaaggugacuacuaagcaguuagugaaaauaacgcagaugccuaccugcuaacagaacagcaugcuccucccugaacaccucccacuaagaaugaggcccugugaggucagcagccuacagaugcugguuacccaggaggcugagaccugcuugauccagccugagcacaagagagucagaagccuucucaaaagugaccaaacaaggagaugccacacaagaauaaagacacauucaggucuccagaacccucacaaagccggcacagcagcacgcaucugugagccagcugcuccuacacccagaugggagguaaagacagaaaagccagcuucuguaacaggcuccucuccuccugucaccgggccacacuguuaacucacugucacagcacaaacaccagcuguucuguuucugcgcaaucccuggcuacugggacugcagcacugaaccugggcacacagaaggaccuacuacccaaaugacaccagaaauaaaaacgguguggggaaaaugcgggcugguaagaacaauggcuguucuuccaggaccuggguuguucccagcacccacacauagcucacucucauccggaacuccaguucuagaugaucugaugcccucuucuggccuccaagagcaucacacauauacuaaaugaacauucaugcaggcacauacauaaaauaaaaauaaauagaaucuccaaacaaaaagagaccagcaacaucuacaaacagaagagacacugaaggaagggcucucugauuacagaguucauguuuauuaucaccaauucccacgaguagauucaacucagcaguauuaaaacauggaagccggggcuggagagauggcucagcgguuaagaacacugaguguucuucugaagguccugaguucaaaucccagcaaccacaugauggcucacaaccauccauaaugaggucugaugcccucuucuggugugucugaagacagcuacaguguacuuagauauaauaauaaauaaaucuuuaaaaaaaaaaacaaaaaaacauggaagccaggcacggugggcaugccuuuaaucccagcaccagcaugcaggggaagguagaacgucgagauugaggccaaucagguuuacauaauagcauggcaagacccugucucagagagagagagagagagagagagagagagagagagagagagagaacacgaacuagcaaauaaaugagucaaucuugagccacagguccaaggcuacccuggacaacugaauccacaucuuaaaauuaaacaaggucugggaauaacgcucagggguagaggagucgcccagcaugcacaggaacaagguuucaucucuagucuuggauuacaaauaaaaggaggaaggaagaaagggagggcacccauaagaacagaccaaaacggaugaaagccaagaauaagugcuagccuuguccaccaaagggaugggagagcugaugagaauggagacucuauuaacuccuaagaaguucugacaagcuggacccuaccaucaccauucuuggugguacacagcuuccuagggaaggggaggaagccuguccaggggacucaggagguggcagagucgagcugcccgaccccaccauccugugcugcucacccuggggaaggauccgagccuucacuggcgccuuggcagccuucacgaucuccuucagcaucuuccgcuccuccucucccacuagggagacagagcguccagcccugccagcacgggccguccgccccacccggugcacauaguguuuaacaguguugggcauggugaaguugaucaccugaagaucagagcgaggaucagugaggugccccaggcagacacaggaggcacagggaccccaccaagagcaaucaacacaagauagggacccaaccaagagcaaaaucaauacaagucucacuguuuucacuccuucaaugucaagaccgcgggcugccacaucuguggccaccaggaugucaaucuguucguccuuaaagcgccuagaaagagccaaagagaugguuaguaagcucccucagcccaacacgaugaaaugguaaggguuagggcuagguaucugcuaccaagccugaggacccaaggccucaugauggaaggaucuuaaccccuggcacccacaugcuggaaggagaacuaauuccuauaagguguccucuggcuuccacacuggcaccaugccacacacccaagcacacaaaauaaauaaaacaaccugcacugacugagcacaucaagucuggugugugcuguuucaggcagcauuucccaucacacucgcguuugucugucccgacuacagcagagcagaggucagagccucagaggguggacucagguccuugcuuuacacacaucuuucaggcagugaagagcagggcagggguaagggggcguucugcaggccccuguccuguagcucuccucugcucuugagaacugaaugacaaaccacacaggaaccaugacgcacacgcagagcacaugcucgugaaauggcugcuggccaggggcgaggccuaaucacuugacacuggagcugcucugggaaagccacacacaggagcacagugagcaacccgcuccaaggucagaagaguucuaagugcaucaccucacagcgcucacauuaaacccaaugaggugucagugagucccaccucccucucccaccugcugggacuacaggggugguggcagacacugguguacaacugcuuaaaguggggcacuguauuguuuguguccccugccucugcucuaacacaacucuuuucucccagcaugguccccugggcugaccaggaaggagggcagcaccgagcguuaccggagggccuccaggcgcugggucugugacaaguugccguggagcucgcccaccugcagccccagcagccccaggaggaugugcaugcgaugggccugcuucuuggucugggugaagagcaucacguggucagugaagguucucaucagcagagcugcagggagaagagugagccagcaccgggcagaccgaccaugaacugucugcggggcucccgggccaaggcaaagccagagaagccaacucccaagcguagucaacagcacggacugaggaaacgggaggcagcgggcuagcagccuccugggagagguggcguggacuagguaacaggcagugccaccgugugagcuggggagaauggauggaggcagccugagugcagacacccacccugcccagaccagcccugagucuucaccugccacaauggccucccgguccccuucccuauuaggccggauccguaugaacucuugccgcaggaagggagcgacaucuguguugcuguucacaaauauccgcacaggauucuuuaaggagaccgaagccagaucuuucaccuaccaaguacaaggucauggcugaucagcucugagauggagaacaagaaaagagggcuugcccagcugggauccucugcacgcaacgaggcacacccaccucaucugucaugguggccgagaagagcauggucuggcgguggugggaacacauucggauaaucuccuucaucugcuccucgaaauacucauccagcauccuggaggaaggcgcagacagugagaacgcucuucugucaagagcgagggggcgggagcgagggagggggccacacaggccacggcuguacucaggacucaggcuuacucugggaccgcuguugucucacccuuacuacgucaugucugagccaccaggacucugcccuucuauucugcaaggcacugagaugaagacagcuuguccccagaugucccagcagcacagacaauaaccugcuccugcacaaucacagugucagacaccuggcaggcagacaccggagugcuuggaccaaaucuccacuguuccccgcgcuacucuuuagucugucuggaacagccccucagucuugcucgcucucugucuaguuguguccuggugacggggacacuaaaccauccuagggaagaggcugcuggguaaggcuugcagaaacuugaaagucaaggagaugcugcuguacugaggacaagcaccauguguguauaaacaggguuugcagacagguguaccacagaugugacacacagagcugagcuggacagacagggccgccauuagcugagcugaggggagaggaggggaggagaggggcacacgcgaggcaugcucaguucuuccaggcucccccaagagggugacccaucuuuucaauggaccuuugccauugguccaaguggagcaugcaugagcaagaggagggcaguguggacgggcaggaagcagaguaugaugguggugccgggaguccuggagcuggccuguggaagcuauacugcccugccugcauuacucucuagaguauccagcaggagauggcuaccuuucuuauuuauuuccauguacagacaagaaaaagaauuguucugaggagcucagugacauuuucaaaucucagaaaaugguagaauucucauuauuugagauuuugguuuucuggaggcacaggcucacucuguacccaggcuggucuagaacuugcuauguacuaugagcuagacucccucuuggcaaucuugaugccucagcaucccagccuuccaagugugggauuacaggcaugcagcacuauuccugaaggaccucucggaccucuuaagcagcucacuauaaagguggaggaagagggaaaggggcagggaaggagggagagagggaagagaagaaggaagaagggggaaaggagagacggagaaggggagaggaagggagagagcacgcgugcgcacgcacgcacacacgcacacacacacacacacauccagaaaacccugaccucaaucuggacaaaaacccaaugugaacagcaaugguguuacuacacacgugucaccaagagccuuagcgagcacgcaggggaacagcacagcauccccaggccccaucucaggcacaccugucagccucauccaagaugagcacuucaaugcugcucagguggaaggaggggcaguuauggagguggucgaugagccggccagguguggcaaugaggaugucuggugcugcccgaagagcggcuuccugagacuucacauccaggccaccugcagaaaacgccccacggauggccugaucacucauucaucaguggggcccccggccuggggcucaggccaaauguagagcacacagagaaacaagcaagccgaaggccuuggcaacgugauuucucaaugagcaucaguggggagccaaaccccaccccgaauucucauuaucaagguuaagucaucuuucuuuauugguuugagacagggucucacauauguagcccuggcugucaaugagcccuacuucauccuugcaagugcuaggaucacaaaagauuuuaugggaaauaauacuauggauuuuuuuuaauaaaugauauuuuauuuauaugagcacacuguagcugucuucagacacacgggaagagggcaucagaucccauuacaaaugguugugagccaccacgugguugcugggaauugaacucaggaccucuggaagagcagucagugcuguuuuguuuuuguuuuuuggagacaggguuucucuguauaucccuggcuguccuggaacucacucuguagaccaggcucaccucaaacucagaaauccaccugucucugccucccaagugcugggauacagucagucauucagugcucuuaaccacagagccaucucuccuguccaaaauaauacuguuuuuuguguguuacuagaaacugaacccagagacuggcagaagcuacauaauacagcuccucugccguggagccacauccccaucccugaauucucuuucucaagguuaggucuucuuuuuagcagagucugacugugcaucuuugcugaucuagaacucauuguguccaccaggcuggccuccaaccgacagaucugacauccucugccuuucagugauggaauuaagggccugcauccccaagcaagcucuucuguaaaggucagcugcauucuauuaugugcccacuguguuaggugcacaggugcacgccugcuacugaugccucacaggucagaagacaaugucagauccccuggaacuggaguuucagagaacugugggucacaugugggugcugggaauugaaacccaaguccuuuuuuuagaguaguauguguucugagccacuggacuaacucuccagccccaaggcuaaguuuugugaguaggaauggaguuuagugauacaguacugggcaaaggccucagauucaauccccaguaccacaaagcaaagaggucaagucgugcugaguucuagcguucacucaguagcaggaaggcaggaagacuguguuugaggucaaccugagcuacacaguuaaguuccaagcuaaccugggcuacauauugaaaccuaucucaaaaacauaaaacaaaacaaaacaaaacaaaaaagagaguuaagucuuagugaaaccuccuccccuaccucccaccauguaaaccaccaguacccaccuccaguacccacaugaaaacauguccacuaauuuuuaggugaacccaauuaacacaaaggcccuuccugccaucugggguucagugaagcacaccccguccucugucaucacauccuaucucacucacccacagccaggcagguagugaugcugcagaacugggccagcugcuuggugacagagugcacuuggaugcccagcucucucguggggaccagcaccagcacgcgagugacugcagccuggcggggcuuguagaucagacgcuccaagacgggcagugcaaaggcugcaguuuugccuagaggaggacaggagagcagaacgcagcuucagcacccuccaugccugcucccacccaaguccaggaaccuacuucucugcuuaugggaacacacaacuucugcauaagugcuugccuacugucaccccacguccauguaaacgugaaagaaaagcauggugacugggcuggcgagaaaggcagcaguuaccaggcaggccacucucccaggaccacuaucauucaguuccuguccuaacacuaguggaugccagacacaaagcucucauucucagagucuuagcuagcuaggauuuuuuuuuuuaaauuagauauuuucuuuauuuacauuucaaaugcuaucccaaaaguuccccauacccucccccugcccuacuccccacccacccacucccacuucuuggcccuggcguucaccuguacuggggcauauaaaguuugcuagaccaagaggccucucuucccagugauggccaacuaggccaucuucugcuacauaugcagcuaaagacacgagcucugggguacugguuaguucauguuguuguuucaccuagcuagcuaguauuuuaacgacucuuuuuuuuuuuuucuuuuaagauuuauuuuauuuauaugaguacacuguagcugucuucagauacacaagaagagggcaucaggucccauuauagaugguugugagccaccaugugguugcugggaauugaacucaggaccucuggaagagcagucaaugcucuuaaccacugagccaucucuccagucuuaaagacucauuuuuuauugacaucucuguguaugucugggcauggaugccacauauguguacccagagaccacauaacagcaauggauccucugcaauuggaguuagacacagcugugaacugccauugggggcuaggaauugaaccuggguucccuguuagagcagccagugcucuuaaucacuaagcuaucucucuagcccugauacuuaucuauuuuauacuuacauguauaugaguauuuacccuguauggauguauggcuggugcccauggagaucaguagagaucagauaucugauccucuggaacugcaguuauagauaccugcuaagcugccaagugggugugggugcugggaaccaaacuuugguccucugagaguguagccagugcucuuuacuucugagccaucucuccaguuugcaaguuuaauauucuauaacauguugcuuugaugccaaauugacauccccauagcuuuuaaagcuguuaaaaucaccaucugagaggugcuggagagauagcucagcggcuaaggacacugacugcucuuccagagguccugaguucaauucccagcaaccacauggugguucacaaccaucucauauauaaacuaaauaaaucuuaaaaaaacaaaacaaaaacuccaccaacugaagggcuggagagguggcaguggguaaaagugagcgcugcuccucuagaagaugaacgcagcucccagcaccccugccaggcaccagagggccugucauccucuucuggacucugagcacaccugcgcucacauguacacauaacccacauaagacauaugcauaaacacauaauuaauaaaauaaaaucuuuaaggacaacaaaaaucucaaaaucaccaauugacuaccgauuucuacagacuuuucuuuuaagauacuuucuauacccccagucugagcagaaacuuacaaucucugucucaguucugagauuagaggacaacaccacuacaucuagcuuuauaaacucuuucaauaguucaaaaagccaggaggggcugcacgaauagcucagugguuaagagaacgugcugcuccagcagaagaccugggugggguucccagcauauacacagcagacagcauauacacagcagauacaaucaacuccagauacaguuacuccauaccugcacacauaugauaucuguauauacaugcaagcaaaguacucaucaucuuuauuuuauuuuaggauuuuauaaacaggguuucucuguauagccuuggaugcccugaaaugcucagcguagacaaaccuggcuucaaacucagauccacgugccucugccucuggaaugcuaggauuaaaggcuugcaccaccaccacccggcucacugguaaauuuuuaaggagccagguguguuuagcccuagugugcuuuggccaccuccuccccccuacccucucaccugucccaguggcugcacaggcgcagauguccuuccccagcagacccacagggauacacgccuucuggauuggcgugggcugcuugaagcccauggcuguaauggccugaaaagaaaaguuacagucagacagggcaggugggcagggaaugauucacagcaagcaacaagguaaccaagguccagggcacacaauguccucugagugccuuugcuccagagcuuaaggcaccagcugcagcugcgcucuggacagcaggagacaaaaggaaagcugcacucuggaaacggcagaaagaaacagacaaaaagacgaacacccauucuacagagauaaaugcagccacgaaggagcugcagccaaccaggaggacaugugagucacaacagggaugucaggggugaaucacugaacccugugggaugagagagcuccccaggagaauucuagagaagaagucuuucaaucggaggaaacagcaagugcaaaaaagaaaagcgcuacaauauccuccaggaggaccagaagaaagagaauccgggagucagugcaaggacuuuggcuucaucguccugcuccagacgguucucuggaacugagcccacaacagugcugaggaggccaaagaggaaugaaugaagauggaggccacuucaagaaucaacccuugucagccaggcgugguggcgcacgccuuuaaucccaggcagaggcaggcggauuucugaguucgaggccagccuggucuacagaaugaguuccagggcagccagagcuauacagagaaacccugucucgaaaaaccaaaaaaggggcuggugagauggcucaguggguaagagcacccgacugcucuuccgaagguccggaguucaaaucccagcaaccacaugguggcucacaaccauccguaacgagaucugauguccucuucuggagugucugaagacagcuacagugaacuuacauauaauaaauaaauaaaucuuuaaaaaaaaaaaaaaaaagaaucaacccuugucaccuggcuauagugauguacaucuagaucccagcccuugugagaugaaggcaggaggaucaggaguucaaggccuaucuuagcuacacagcauguucauagcaagccuggacuacaugagacccugucuaaaaugaacaggcuggagugauggcucggcaaugaagagcacuugcugcucuugcagaagaccugagucugguucccagcacacagggcagcucaccaucacuuguuacuucagcugcaggggauccaugcccuccccuggcucccacaggcaccaguacacgcacagguaugcgcacacgcacacacacacacaugcauaugcaugcuucaugugagcccaugugcgcacacagaaagaagaaauucaaucaaagaagaaucaacccuuguugccaaagcuacuaccuucaggaggggccgggagagguucauguccuggaaggacaggcuuuugucauacucggaugcaucuucaaagaauccuccugcugccugcaacagaucagacgacaggaaagaacucagcaaagcaagcaagccugcauguccuuucagcaaccucagacccaggcucaccuggcccuucuucuucuucuucuucuccuucacuuugagugugucugugggaaaaaacacagcagugugcagagugcuucuuacccagcaccugccucuggaccccauguccuuggugcuguccagggagggugcugucccacuccuuucacagguaagggcaaacgcagacaggacacuagccuagugaguacaguguagauggcaggcucuuaacacaacacugugacaccugagugaauucuaccaaaaugcucacugaacccccaacuacagaggcaaacccaaugcaaccgagucgccccaaguaggcgagcuguagagaagccaacacuccguggagcugagaaugaggagagaagcagguccccagaaagaagaagcccugauaugguggccaguaaagagacaauuuauccuaacaaaucccagcaccguggggaccagcaggcuccagcacaaagacugcacaaccuccuacagagccaaggugcaucggccuaccugcuuuggugaggauuuccucauccucagaggaguagucagucucagagucuucauccuuggagccugccucauccucacccggauucuccugccccuucaggucagagucugccuggccuucuuucuccuccaccuucccagacuuggcuuccuuguccugaggaaaaaucaaaugaaguaggugugacuacaaacaccaggaaauucagaaccuaagagaagcgaugcugaacuccaaggccagacaguaaggaguaaugaccacccagaccggagcaccuguucccgccccucucaaagccacaggccagagugcaacuacaaccgccgcagccgggucucagccucaccucugccuuccuucucuuccggacuuucucaaucuucucaucuaguguaguggcugcccgcuggagagaaaaucauugcaggucaaagauacacauaacucagaaaggacgccaaacaggcgucacggggucaggacucaagugcuaguguagaagaggacugucugugcuaggcauggaggcucauagcuguaaucuagcaucugaaaggguugaggcaaaaagccaccaagucaaagccagccuugacuacagugaguuccaagccagccugggcuguuaacccuaucuaaggcuaucucaaaggcuauuagacaacacugccuaaauuuuugggaauuuuuaucaaucugcaaacuuuguuaaccaagguuaauaaccaaaagaggauaggauccaaacauaguacauguauaugugaacauuaaguuuuuuuuuaaaggucuuaguuugucaaaaaauaaaaauaaaagcuagauuacuaaaaagcaauacaaacuuuuuuuuuuuuuuggucuuuccagacaaggguuucucuguguaguccuggcuguccuggaacucacuuucuagaccagucuggccucgaacucagaaauccaccugccucugccucccgagugcugggauuaaaggcaugcgccaccacgccgggcacaaacacauuuuuuuuaaauauuuauuuauuauuauauguaaauacauuguagcugucuucagacacaccagaagagggagucagaucuugucauggaugguugugagccaccaugugguugcugggacuugaacucuggaccuucggaagagcagucgggugcucuuacccacuaagccaucucaccagcccacaaacacauuucuuaaaagacuauuuuagaagcuggagaaauggcacagccauuaagaucaucugcugcucaaaucaguuucauuuccaggaaccacacugggugggugguccacagacaucuuuaacuucagcuccaaaagauccaguucacuacucuggccucuguaggcaccuggacaugccuggcagacacacacacacacacacacacacacacacacaaauaaaauaaaucuugaugcuggaaagauggcucaucaguuaagaacacuggcugcucuacuggaggagccagguuccauuguagcucacagcuccacagguaguucccaaccuccuacaacuccaguccuaggggaccugacacccuauucuagacucuacacacacugugcacacggaaugcacuuacacacacacuucuccuucuguugcgcuaggauuauagacgugggccaacaugcccagaugugggcauuuaauaaagaagaaaauuucauuuauucaguuacugaagcaggucuaaggaacagagccauggagcauaugaaagucaaacagcaggacucaggucucuccaaccaggugggcucuggggacuaaauucaggucaucaggugacaaaugcccuuaccaucucaccaacuggaauaagacucuuugauacuuccaaauauagacaauaugguugugacuauagucuacaauaagcccauuuuauagugcuuucuacuguucuaagucacgaggacuauggggcacuuguaacuuccucucccuacuccaucaaaccuacacaacuuauuuucaaaguccucaacuuccaaaagcugcugagcguaagaugaagguaaaaggccaugagguaaguguuuguccuaauaccaacguacugcuuaacggcccaucccccaucaccugaaucccaucccugucagucuuaccuucuucuugagcuggcucaugacaucagccagggcccagcugccaucauacaugcccuccuucucagugaaaacaaagucaggguugaagucagcacugcgguucuucugcaaggcuuucugcuugcggcccagcacaaugggucccuacaaagaggagaagugggagugacagugacuggcugagauggagggagggggccugagaaacucacagcuggaagcacggguggaccagcuggaaaagccuaccuggggucaaaucaacacauagaauacaaaagaaacgaggcagugguggcuguagggcaugccucuaaucucacaacuagggaggcaaaggcaggugcaucucuaugaguaccaaacagccagggcuacuugggagaaccugucucaacauagaugaauaaaccuuaagcuggaugugguggugcacaccuuuaauuccagcacuugggagguagaggugucaggcagaugucagucagccaggguugacacagaaccaugucuccacaucuccaaaacuucugagaaggcagaaacugacaucucugcagaagcugacuggucagcugacccucccuguuaaguccuauguuccaguaagagaaugguuuccaaaaacaaaguggacagcucccaagaaaugacagacacuugauauacauuaaccucuggccugcuaacacaugcuuguaccuacacacauauacuacacuugcaagaguguagacacacacaugggggugagacaugggggauggggaguguaauaauggccaguauagucuagccagugaauuccauaccuauguaagaucccgucucuaagcaagguggacaacuggaguaacagcccacaaaguuguucucuggccccacacacgugcaugugaacaaguacgcgcacaagaacauguacacaggcacacauaugaaugugcauaaacaaugcaaacagcaacaggaccgucagaagcucaaauguauccaagauccaguuucaaaaggaaacacaaaacugauacagaauuggauaccaacaagcuucuuacggagugaggcacugcucuaguucugccuuacagagcagguaauacaugagcuaagucucucccggccaccacccaguacaugccaggagagacaaagucauccuccauccuggacaccaagguacuugcucccaaaccuggaucgauuuaaaaugccucaugccaauggcagacaucagaaaacuguuguccuguacagugguagcccggagggaagcggaggcagcaggaggguuccagaaugaaacccuccuguuguggagagaaaaaaagccagagcagacugagacaucuagacacaugguucacaaccuucccaacccagaugguggugaccccaaaccauaaaguuauuuccguugagacuucauaaccauaauucauuacuguuauaaaucauaauguaaauaucugaaaugagauccuaggguccccagggucuggagccacagguggagaacuacugagggaagccuuccaggcagagagcagaagugugaagagaagcugggcacaccuuuaaucccagcacucaggaggcagaggcaggcagaucugaguucgaagucuaccgagguagguccaggacagccagggcuauagagagaaagccugggggagugggcuggguagagaugugaaaggcucugagcagaaaaagaacacaaguuucuaagacaugaaauggaaugguaugucgguguugccaggacaaggaaggcugcugagggucaaauggcagaaaagacaacagagccuggccugacucugaaagccacaaaaacuuagcugcauggcuggaaccacucagaccacugagaccacucagcuacuugguaaggagaccaccaagcuggaaacugaaguaugugaggggcacagguuugcaggugugcgggugggacuugcaaagaccggaguguggauggacagagggauagaagccuuggacagacgccuaaacugaccagcagagcuccaaacgaccucccagcaacauccuuaaagacuggagccuuagacaucagcuuucucggaaucggacugcagagggccugggccauccuuagugucgugugaggcuggcugacgccggugugaggcacugagaguuuggguuugggucuuuuucucucgccacucacccuggagccacuuucucagggcuacauccccaccgccuagcaucacuagaacccccuugggaggcuugauggauaggugggagcauguguccccgacugggcaggaagcaagacugacuucgccugcgaaguucgacuccgcacagcuuggugacacggccugcauggggacaccugagcacgcugaggagggccuggggcccgcagcugguucccggccgcucccgcccacggccccuucucccgccggcuccuaccuccuccuccucgucuccggaguccgacucgggcucaaccggcaccucgucauucucgccgaugguccggaugaagccgagcuccgccagcaugcugaagaagcagccacuuccggacguagcgagugcggcgcgccgacacgacccgccuuuuccgcgacccgcucggcgucgcgcgcaugugcuucacgucacuuccgcucgggggcggcacuuugagacuucgcgggccugcgugguuuccaauaauaaaaucaaauggguggggcguuguuuagauuagaaaacuacuuuguuuugggaaagaaauagaagucugagaguguguaaaggugagggaaaaauuagaaguauguguacauuugggaacuuaacaacaaaaugguagucagggcugccaucuggcucagcauggcaaaggccacacuacuccugagugcgaucccgguaccuacaaggggaaagaagagcucggaauccagaguuguccucugaucuucacacccuuuucaagugaacacgccccucuguauacacaauuauaauaauuaacagggggcuggauuccuggagggcugguuuaguggcuaagagcacugguugcuccugcagaagacccagguuugauuccuagcacccacaagguggcucacagcugucuguaacuccguaucugaccucugcggccacugggaacaucuggugcacagacauguaugcaggcaugaugcaggcacauaaaaguuuaaauaauagauaauauuuuaaggauggucgaauuguaaguucuauuuucuuuucuuuuuuuuuuuuuaaagauuuauuuauuauuauauguaaguacacuguagcugucuucagacccaccagaagagggagucagaucuuguuacggaugguugugagccaccaugugguugaugggauuugaacucuggaccuuuuggucuguaucccuucuuuuccacugccucuggugaguaguagacuacaagagagguuaaagcauuuaugaaccauuauuaaaaguacggguaugggcuggugagauggcucaguggguaagagcacccgacuguucuuccgaagguccagaguucaaaucccagcaaccacaugguggcucacaaccauccguaacaaaaucugacucccucuucuggagugucugaagacagcgacaguguacuuauauauaauaaauaaauaaauaaauaaaaucuuaaaaaaaaaaaaaaaaaaacauuaaaaguacggguacuugggaggcagaggcaggcagauuucugaguuugagaccagucugguauacaaagugaguucugggacagccagggcuauauagagaaauccugucucagaaaaaaaaaaaaaaaaaaaaagccaggcauggugacacaugccuuuaaucccagcacuugggaggcagaggcaggcagauuucugaguucaagccagccuggucuacaaagugaguuccaggacagccagggcuauacagagaaacccugucucaaaaaaccaaaccagagaaaaaaaagagaaagaaagaaaacaaaacaaaacaaaaaauacggucgagaaaaaaaaauuaaagcuacaacugugucugcaugcacacagcucuccaccaugaagacaaugaacaaaagcgcugaaauuguaagaacagccuaauuaaacgcuuugucauggugucccuucacaguaauaaaacagugaccaaggacucagcgguuaagagcaccaacugcucuuucaaaaguccuaaguucaauuccgagcaaucauaugguggcucacaaccaugaguaaugagaucugacgcccucuucuggugugugugaagaaagcaaugguguacucguaacacaaaauaaauaaaucuuaaaaaaauaaaaagcugggcauugguugcacacgccuuuaaucccagcacuugggaggcagaggcagguggauuucugaguucuaggcaagccuggucuacagagugaguuccagcacagccagggcgauacagagaaaccugucucgaaaaaaacaaaaaccaaaaaaaaaaaaaaaaaaagcacaggcaaaaaaacagugaccaaaagaaacaaacccacacucauuugaacaagcauacacacauguaugugucccacaugugcauacaaauaaccaaauaaaggaaagaaaacacuaaauuguaaugccauggccccugcuuagacaccacccuacucuuagaacaacaggguuuaccuacucacgccaacauucuuucucucaugcuugccccugaacucacacagaugaaucucauucuacccaaaaccuauacauggucuguucccucuguuucaaaugcuguuuccugggcuggagagauggcucagcaguuacgagcacugacugcucaucugaauguccugaguucaaaucaggccauggcaaccacaugguggcucauaaccaccuguaaugagaucagaugcccucuuccugugugucugaaaacagcuacagugugugcuuacauaaauaaauaaauaaaucuuuuuaaaaaaauaauaaaaugcuguuuccucugcucaauacaugacuggcucuuuuucauggcaaacacucuguuccaacgacaccuccuagggguauugucuucuuguguacgcacauuauguguggguuaagagagaccaggcaugagcuagaguagccccauggcuguaaccccuggcugugaggagagcucugcucaccugccacccagucuagccaaucagcgagcauucaguuucgugagagacccugcuucgaaaccaaagugcauagcaaugggauaaaucacucuggccuucacacacccacgugugggugcacacacagauauacacauagaaacacacacaucucagaacaaaaauaaauaauauaccuaccuggcagugauggugcacgcuuuuaaucccagcuuucaggaggcagaggcagaucucugaauuagaggcuagccuggccuauggagcuaguuccuggacagccaagacuacaca

SEQ ID NO: 1284 - RNA, 2495 nt, Mus musculus
gcaccggugcccauccuggcagaggacuuucuggcauggcuucaugcacuggaacuccuugugggaggagucauauggauggcaggcacgugugcacacaugaccacaggccaaccggaacucacagggccggcugcagccuccuuccgguacuuucuggaagucagaagcuuuggauacaagggugugggucucagggugguucuggcaacagaggcggagggacgggccuaucugguuguucucucgaaggguauggaugauccugcuccacaagggcaccuuggcaagcaucugcauguucccaaugcaguacauccccuucuuggcccgggacaaggcuacgcagaugcgguuggggaucugcaggaagcccaccuugcccucuugguugcuccgcaccagugagaggagaaugaugucauucucuuccccuugguacuuguccaccacauggaccuugaugccagcaaacgucuugacaggcaugaguuugcgcaaacagaagagcugcccaguguagguggugaggauggugaucugggagggcagguacuccuggcacaggagguacuggcacagcuccaccacaaagugugccucaugcugguucuggugacuuuugccuucuuggaucuccugcucaggaaaguugugcuccacaaagaaaagguuggaggagacacccuggaaaauaaggaggcaggcagcacaucagcacuggggcuggaaccggagccucacccgugcugugcacgugcgggaccucugcgcuacaccccagcucucugcacgucaucucuggacacugaccacugagccacaggaagagucuuugugcuuucugugcccuccaucuccagaucuuuaccucugaagcagucaugugccguggcacugagcuggaaacuaauuaaccuauuuuuguuuuccaaguauucaaucaccugucaugggcaagggggccgcaguagcuggugaugagaagcagcugauguccgcagcacgcgcagugcugacugcugcacguagcccugugcacggcucagggacugggcaggggcugcuguuaucacccggcugcagaccacagcaccagcaucucuugcugacuuacucauucagggucacacagcugccaaguggcaagacagauugacgccaggucaagagccaccauuucuuucucauucuuccuccuaaggcuuagcaguccugaccuggcucuauuggcucuauucccuuuucucccuuuuagagacuauuuuugcugacaacaucagaggcagggcagacugaccuuaaucugcucauacuugagaacagaaggaugguucuccagauccugguaaauguggggggucaaaaggcgggcgauuucagggcgcaugcggugcugaaacaacagaugccauuaggaacaagugcaagacaaagggccauuuucuggaggcuaagguaccagcagggaaccuacagagguaacaccaaagagcaacugggacaaaccaugaugcaagaggcuucaucuggaagagcaggggacuucgaaaugguuucaaacaguauuucugacuggcuaucuauuucugucuggcuauuuaagcaauaaaucagcucuaauugcuagcacccaggagccuucuccuagaugucgguagcaacacaagccagucucucaccugguaauucagacggacaaaggggauguucacuuuuaccagccguucaaacagggacaccucaagguugaaguucuuggccagaucauacacauuagcacuggggcgcagcuggggagagaaacaagccugagaauucucagugggaacacacgacagcccagcagcgugggcuucaagugccugcuggaaggcggcacuagcccaggugcuggcagguucaggguuaauagugacaaggaucaggaagaacccaacccugaggaugaauggucuggcuaggccucucugcacagugaugccugaguugacaggagcacagacagaggaggcugccagucuugcauucauuugcaaagcaagccaugagaaggggcagggaggacagugaauguugguccugagaaaugaggugagccagagacaggacaaagcccacuucuguuuuugagaucaucuugcuauguaggagcuuuaggcuaggcauggcugugcaugucccuguaaucccacacuugggaagugggggcaagggccaguaguauaaagccacacccagcuacaaagcgaguucaaggguagccuaggcuacacugaucaucucaaaaucaaaggagcuugauuuuuaacaucaagaguagugagaagccacugagggcuuuaaggaugacaugcaugggcuggagagauugcucagugguuagagcacuggcuacuuguccagagguccugaguucaauucucagcaaccacauuguggcccucuucuggagugucuaaagauauacauaaaauaaauaaguaaaucuuccu

SEQ ID NO: 1285 - RNA, 2495 nt, Mus musculus
aggaagauuuacuuauuuauuuuauguauaucuuuagacacuccagaagagggccacaaugugguugcugagaauugaacucaggaccucuggacaaguagccagugcucuaaccacugagcaaucucuccagcccaugcaugucauccuuaaagcccucaguggcuucucacuacucuugauguuaaaaaucaagcuccuuugauuuugagaugaucaguguagccuaggcuacccuugaacucgcuuuguagcuggguguggcuuuauacuacuggcccuugcccccacuucccaagugugggauuacagggacaugcacagccaugccuagccuaaagcuccuacauagcaagaugaucucaaaaacagaagugggcuuuguccugucucuggcucaccucauuucucaggaccaacauucacuguccucccugccccuucucauggcuugcuuugcaaaugaaugcaagacuggcagccuccucugucugugcuccugucaacucaggcaucacugugcagagaggccuagccagaccauucauccucaggguuggguucuuccugauccuugucacuauuaacccugaaccugccagcaccugggcuagugccgccuuccagcaggcacuugaagcccacgcugcugggcugucguguguucccacugagaauucucaggcuuguuucucuccccagcugcgccccagugcuaauguguaugaucuggccaagaacuucaaccuugaggugucccuguuugaacggcugguaaaagugaacauccccuuuguccgucugaauuaccaggugagagacuggcuuguguugcuaccgacaucuaggagaaggcuccugggugcuagcaauuagagcugauuuauugcuuaaauagccagacagaaauagauagccagucagaaauacuguuugaaaccauuucgaaguccccugcucuuccagaugaagccucuugcaucaugguuugucccaguugcucuuugguguuaccucuguagguucccugcugguaccuuagccuccagaaaauggcccuuugucuugcacuuguuccuaauggcaucuguuguuucagcaccgcaugcgcccugaaaucgcccgccuuuugaccccccacauuuaccaggaucuggagaaccauccuucuguucucaaguaugagcagauuaaggucagucugcccugccucugauguugucagcaaaaauagucucuaaaagggagaaaagggaauagagccaauagagccaggucaggacugcuaagccuuaggaggaagaaugagaaagaaaugguggcucuugaccuggcgucaaucugucuugccacuuggcagcugugugacccugaaugaguaagucagcaagagaugcuggugcuguggucugcagccgggugauaacagcagccccugcccagucccugagccgugcacagggcuacgugcagcagucagcacugcgcgugcugcggacaucagcugcuucucaucaccagcuacugcggcccccuugcccaugacaggugauugaauacuuggaaaacaaaaauagguuaauuaguuuccagcucagugccacggcacaugacugcuucagagguaaagaucuggagauggagggcacagaaagcacaaagacucuuccuguggcucaguggucaguguccagagaugacgugcagagagcugggguguagcgcagaggucccgcacgugcacagcacgggugaggcuccgguuccagccccagugcugaugugcugccugccuccuuauuuuccagggugucuccuccaaccuuuucuuuguggagcacaacuuuccugagcaggagauccaagaaggcaaaagucaccagaaccagcaugaggcacacuuugugguggagcugugccaguaccuccugugccaggaguaccugcccucccagaucaccauccucaccaccuacacugggcagcucuucuguuugcgcaaacucaugccugucaagacguuugcuggcaucaagguccaugugguggacaaguaccaaggggaagagaaugacaucauucuccucucacuggugcggagcaaccaagagggcaaggugggcuuccugcagauccccaaccgcaucugcguagccuugucccgggccaagaaggggauguacugcauugggaacaugcagaugcuugccaaggugcccuuguggagcaggaucauccauacccuucgagagaacaaccagauaggcccgucccuccgccucuguugccagaaccacccugagacccacacccuuguauccaaagcuucugacuuccagaaaguaccggaaggaggcugcagccggcccugugaguuccgguuggccuguggucaugugugcacacgugccugccauccauaugacuccucccacaaggaguuccagugcaugaagccaugccagaaaguccucugccaggaugggcaccggugc

SEQ ID NO: 1286 - RNA, 5860 nt, Mus musculus
acuuggugcgacuuuucuuguaaccaaaggcccuuucugccuuguguaggaccuggcugucccucccucuuguguuuugucugacuuuaaaguagcauuauaccgagaaaaugaugaauccagaauaccuuuccuagcugcauaggcagagucugacagaacuccuauagagacaaccaucaaaacaguauagacgaagcaaaagaagaguuuuccauuuugguuuuuguuggcguuuuuuuuuuuuuuccuuucacuuauauuugugugaacugugggaauauagcuucccccacacaaguguaacucaaguuagaauauuauaaauuuuucuaccaacccuccaugggcuaaaaaggaacacagagucucaggccgcauguaccugacccggguacauguguuuacacgcacugggaaaucuuggguugccaagaugaagaugaaucugacagaugggucucagcagugaagacaagagccaggggauggggacagaggccacuugaacauggugguccaccuggccugacccaaccagagcaaaaggaagugagauacccaaauaacuccaggggcuggaggcggagaucucccgguccgguuaugaaaucaacaggacuaucaaaaagccagcugaaucggagucccagcauccaccacgucaucagaaaaggccaggcgucggacugcugugcgcaccugucgcaccgggaaagccuuacuguggacaaggugaggacaagccaguucuuuugccuuuucauuuuuggauguuuccaaagcagcagaucuggggcaacagaucucucucugguauucuaccuuaagcacauuuagaugagagagagaguaaaggaggagagaauauuugucaucgaggagagaggaaacgccaaaguaaugaggaagccacccuuaaccugcuccacucacccugacaguugcugggaauaggagcucuuuuuccucccaagucucaccuucucuucaucuccucuguguucuguagcugcagccuugucucugucccuucucccgagaagauccacaucucuaaggaggaaacaagacgcaacagcauccucuucuauacaacuguaauguauugucaauauuuauaauuauguauuugucugacucuggucauggcuggaaugucuaguccuugaacaaggacauauuuaaaguucaucacagaaaagggucccuaaagccagguaucucuauauagauagguagguauagauauauaaauagaucucuuuuccuuguuucucugccaacuuugucucgaguaaaauaaccacagccugcacugaaucaaagggggauggguacacagaaaagcuucuagaacauccucguuuggagacagacuuuguguauguguaucugacagguuggcaggaggaagaugggggcuccgaggcccccagcaggacaacagaacacucuagccuugggcguuuccuaaccuauuauuguuuauaugacaacccccaaauacuuucaugucucuaggccagggccgcccaaagcagcccaggccacaccuggaaagaagacuuaccucugcauuuccuguugccauuuuucuggcccuagaagcaucuauauccuaggacguccacacaucucagaguagucuauuuuuuuguucagauaaaauauauacauauauguauuuuuaguauauuuauaauagggcaauugagucuaauuucuuuuguaacagagugauaucuuggggauuuuauuguugcucauuugcauagcuggucuuuucugcugucauuccuucccacugucccuugggcugguuuuuugguuuuguuuuguuuuguuggauuccaguugucuggagaugggaaaagacugggguuuaauauccuggaagauggaguuccuagcaaugggugggugaugggggucugggagagcaacucugugucuuuccucaucaggucuauguccccuggcugucacucuuaagaauccagguaugcaggagcaagccaggugaagacgggugcaauugggaccugggcugccgggagcucagacagagcucggacgcuugcuucccuucccaaaucuuaaaggacugugcuuucugguuaccagaaauauuagaaucaagacccuccugcaagcaaacuugucucugagcucaggagcauuccugagucccuccuggcuagauuguccccaaguccagcuauccugcuucccagggccaccaacuggauccaaggaccagggugugugcaggcuccagcaaaucucagaagaaugugcugugugucuccauuccauuucucacagucuuaccaaaaaucaguggccagacagccuuguagccaaacgcugaggagugacagacagcccaaagcugugauccacccagccccucgaagcggcaccaaggugagacuugaggcaaggguggcaguauuuuuucagcuucugcuuuuccaagucuccagucuuuggucaguucugaacauccaagucuccaguucuuggucaguccugaacauccauuggaaacaauuuugagccuaggcucaggugguggacagacuccacauggagugaaggggucugccaaccaucaccuuccaugggacaagaaaagccaaucagaucaccucccaugcccaaccagucaccuaccugccucagcucuggacucugagcucugccagcaccagaaauuugagucaagccagaucagcccuaucagacagcgaugguguucccacugaaagaaccccaagaggaugcagcccaaaugcaaauuuaauauucuggugguuggauugucuuuccucccccuuggguuuguucuguugugugguguuggggaccuaacuagggccuuggcugugucagacaagugcuccacccugcgcuacaucugcagccccugaauguauuaauuuggaaugugguucugaucaguuucucccaucccuaaaauuccugguaaucugguuuguuccagagccaaauaaaacagacaagauuuugugugcgugugugugugugugugugugugugauuaugugugugugauuaugugugguaugcaugcacaugcaauaugugcauaugugugcauaugugugugugcaacuuuugcauaagaacaaaauuuaaaauugcugucauguuguuucugaaguuuccugcccagcuaaguaaacacaggcuaucuucccaaaaaagagaggguaccucugaccuucucuccuuguccuagaauuccucucaaaauuuccagauggugacuugaacugaauuuggaaggggcuguuagucguuugggccguccucuccgcgucuagcccuaccucuguccgucucagccaaggcccugaagaaaccuaaaagccagcagaagagcaugggcaggaaguuggcccaaagaaguagccucucaacaugaauuguccauuucagcucaaaguagcaaagcccuuucucagcaggguggguggguuauaugcucauagaacacggcgcaugauggguaagaggauccagacuacccagugugucccagguauucccagggaggcugaguagugcacaaauaggccuuggcauuaccacaaaacgggacuggaaacucaaagcaauucuuucuuggaguguguguguguguguguguguguguguguguguguguguguuuucacagcuuucaugcacaugugggugucugcacaggugucuugaacauucuggguccagguucaagccucauagagaaggauucagagcagagcuacugggaccucagguuauaggaucgggccaucccagaaggcaccagcgcaggagggcugcagcagagggcucagcauccuaagccggcucuugcuauuuuucugacccugccaaccauuuauccaacccauuuccaauggucuaacaaggaccacuuagggaagagaaguacgcugcccuuuccccggccaguaaagggccaaccccgcaggcucgccugugguuggccacugcauuggugcuucagccccuuccccuauacucugugcccucaaagagacucagcgaucaucccacaagccagccacccacugcccaaccaauuccaaauggcaccauuccaaaagggcuuuuuuuuccuuguuaaauaaaaguaaaaccuagucaagguguucaaaggucucugcccaagagauaaaucuagaaaacuaaaaacagcagagguaauuauaauccaacuuuacgagggaaacaaggcuccagcugccuccaagaggaaagcccgcucucccacauccauacccaaagggaaucugucugucuccaucucccucauuggauauagggcguggggaagagguagugugugaacuucagagugagcccaaaccuaggugguuuugaaaggcaagguagaccaguaagccagaguuacccgaaccacuaucuucuaaaacuaaauuaaauaggaacugguuuaccaaaucucagcccauggagguguuucccaugacacugcgguuacagagcagcugugggaaaugugggguugcccgauucuaucccacuuagaugugcgaaacucgguuuggauaggcagggauguaccacagaagacagcccccagggucuaacucaacagcccagcucccagucucgggguuuccccaagguuugaaccgcuugaggccaccgggcauccaagagccagauguggauacagggagugcagggcagcugaccucuuucucucuggggcccauuuggcuugagucgaagcuaaagggcaaggggucccccuuuucuacacuggcgggaacucauggccuucuguccgcgugcugauggcacagagcagucauccagccuguguucuggggugugugcaugugagggugguaaguuccggaggaugaguggaagaaggcaguacuggauucucaccuggcuggggguguugcucgcugggaaggaaaacguggaagucccuguuucucugaaguguccccacgaaugucaucucgccuaugaccauauuuagagucacagugaugcccacauuugauguuggcagccucaagcugagaggggucaugaucuacucaaagcccccacccccacccugaggcuggucagcaccggcugucauccuucuuguuccuacuuaaguucacagggagucacauggagaccacauuggcuauccaguaguccaagccaaggguccgaggugggggugggguauaugggacuugacuagagcagggacaugggagccagugucuaccacuggaucucauuaccugagcuguaagaaccaauggccccucuuuuuaucugagccuggaaggccccccuuacaauaaugacaagcaccccaaucccaucagcucagacucucuguccccuccccccaggaccccagaguguaaggcccggguucuucugccagcaaagccauucggauugcuccaucuuucaaggaggccaagccaaccauauuagccauacuccaccagggucuucaccacucuucuuuggguuguguucauggguccuguucaaccuucaucaguagaaggcucuagcccuuccuguccaugugacagugcacaucagcgugcaugucuuauacgugcacaugagugcacacacaaggaaaccaacaaaacuccagugucgucuucugcauguggugagagggacuugugaccccuaugugaccuccagcugcuguccugucuuguauaaaaaaaaaaaaaucacauguuuaagaauuuucaagcaaauggucccuuaaugaagucugcagcguucaaauaaaagauccggagaaaacaag

SEQ ID NO: 1287 - RNA, 4109 nt, Mus musculus
uaacaacagcaaaaagcuaugaauuguuuuucaaaaucacacaggaaaaaaaaaaacccaagaacauacuauccacucaguagauaacagcugcugccuaugagguagggaguaugcucuggggggauguggggggacgaggaauucagaauaagugggccuagggacagggcugucagcaaagcacuugccucacaaacgcaagcaccggaguucaacccccagaauacacguuaaaacaaaacaaaacaaaacaaaacaaaacaaccaaacaacaaaacaggcagggcagugaauguuuuuauucccagggcggggcggcagaggcagguggaucucuggggcucacuagccagccagccuagccugcuuggagaguucccagucaaucagagaggcuagcucaaaauaaaauaaaauaaaauaaaauaaaauaaaauaaaauaaaauaaaauaacuagauagauggaugccauccaaggaacaagcccauggcugaccucugaccuccacaggacacacacacacaggugugcacauguguccucuguaagcuggaauuuucuggaggaacagaauugaugggaucccacauuuucuauauuaaauaugaaacauuuuauauaccaaauauauuagagaaugcaugucaucagcucacucugaaauagucucaacaccgaggcugggaauccgggagcugacugguccuggaggugccucaguagucaucaauccugcaccaaaaaucugcaaguucuuggagacuugaagguccuugguccaggauggaaaccugaaauggcugcugcuucuguuuucaguggaggaaucgucuucgucgucaucgucaucaucaucguccaacgcuucaagcaagaggccaggccaggccaacaagggcaaguggucuuccuucuuccacacuauuuaaucuggucccccacuagcagaugcuacccacauucuggucaguccuccuacaucaauuaaagcaauuaagacaauucuuuaggugaggcuguuugcucgggugacuuuaauuuguggugaguugacaccaacccuaacccucucucucacacacgcacauagggacgcaagggaaggaaaacaaaucuuacauuguccuuuuuguuguuguuuuuugagacaggguuucucuguguagcccugguuguccuagaaugggcucuguggaccaggcuagccucaaacucacagagaccugccugccucugcuuccugagugcuaagucuuguauuuuucuaugcuguuacugugguggccagggaggcguauggcugucccucauuugcccuuggccucuagccuagacacaacuccauguggaacuccucuuaccuccccacaucuaucacucccuucuuaccauggugguagagucuguccucacuucugagaggcccugcugagcuccuggguuacgcucucagcauggccuccccugcucccaugacuccccaguaguacucaugauugaccgaagcuuucuccuuuaaaacgaacaaacaaaaaaaaugcuuguuuuucuucaguguugggcaaacugagaagaggagggaggggcugagccagaacuaucaggccagagcaagggaaaacccguggaggcuuuacuccacugacaaccgcauucaguuugggaaauggaacauucauucugacagccuuggcacuguagauagaggagggaugggggagcugggagcagaggucacagggagagaagcugggaagggaacugaccagagugaaugguucuuacaaacaguuuugcgugaugcagugcaaaggaacccagguggagaugggaaagccuuaccuuggggcaccaugucccacuaaguucccccccccuccaggacaagguucucugcugcaucucuaacuccuuaacaccgcacaacagauacgugugucagagaacaaaccagccgagcccaaguguggcugacagagggauaccugaccccuucugcaugcaacccugccuacagucacuccggaaccugccggccccaccgcacagggugaggcagggccaguggaucucucgguugagccucgacccucggcagucuagaagcagcuguccaaguuagcacccaugggugagugacuaacaaggcccggcaaacucugagucuucccuggcccuucaccuggccuuauguuucuccucaacagcuaccacccagcugcccaccucuuuugccuguugguuuguuaauugguguaauauccaccuuccuccagaaucuagaauuugauuuuguagaaucuggaauggaaucaaagcaagggcuauuuaaaauugccaccugccuucuccagcuuucccauccucccagcuucuagccugucugacauagucuuccaauucuguuuacagucgcucuccagggagcccggcgacccagaggcuaguuggcuucgcaacuguaucucccacgcccguccuacgugcagcgcaugcaugcaguaggcgcucagccucgugguggccaggacgcagucaagcagcccgggugggccccgcggccugagccagggccgggccgggcacggagggguuaagccgcgcgcguuuccgacccgcagguggcgccgucccgccucggugccacucgccgcgcuccgaagugcgggacagaaucgcggcgagcgcggagccgaagcucagcccgacuuguugaucucgcgcaggcagccgcggccgccgccgagccgagccggagcccgagguggaggcggaggcgccgccgaucgcccgggccgcgccgucccugcgccccgcagagcgccccgcccgcgccccgcagccccggcgccgcccucccgcccgcccggccggcccggguaggccuagcccggccccgggaccgccgcugccgcgggcgggggcgcgggcgggcggccggcgagaugcgcgcggcgcggccccgggaggcggccacccugggggugaguguggcgggguagggggguggcgcgggcccaccccggggcugggggcggggcgugugccccgcgggcuguagggcccgggaaccccccgaaaucaccggugcguggcgggaggagggcacgcuccgaaaggccagaagauuccgcugguuuccccgccucccaccucccccaccccuucucuuccgagcccgggcaaaggcgcagaacccggaguuauaaaaagccaucgccgggaggagcgaggaggaggagcgggaggagggggaggaggagaaagagaggaggaggggcaggaggggagcaccgagcaggcggaucccgaggacuccgcgccccuccugcgcuagaguggggagggggcgcacaaggaggugcagaccccgcuggcuuggcuccuucgacccucaccuggucuccggagcggucucggguccugguguugugaggaguggggucgccccaggacagggcagccugguggccuccgacaggugggcaucugguagccuccacaguccucacucggcccaaaaucuucuaagauuuagaaaaagcaagcccaaugccaucguuaugcucccacccaaaaucuugacuaucuuggggugggaggagaugagaacucacuaaagagagaaagaaaguucucccugccucucccuugccucccaauugcgggggccagguugggcucuccagcccgagagcagggaguuucagcacucgacgggacggacagcgccccgggcggccggauugcgccagggcggggguggggcuuccugggagccuccugggggccucucccgccuggagggccaccccucccuucguccugggguggggcugacuucagcaccggcgggaggaacagcagccauccguccucccuucccccccccccgccccccaacuccccugagccgcuuaagccuugggaaggucaaggccgguaggggacccugggggaggggccucacaguacgguucgcugacccguguccgcuuucgcuuucugccucgcagccgucgggauggaggugagacgguagccgcgacgcccgcccucgcgcaccccugcaccacagcggccugcagagcuccccgccccccg

SEQ ID NO: 1288 - RNA, 13985 nt, Mus musculus
ugcuugacugacugaucuuuuauuuuucugagauaaucucacuuuguguaguccagguuggccucaaacucccaacaguccacugaccucuccucuccaguguuggcucagccaugggugggcagaugccaccacaacgugccuuuugugacagcccuagaauaguggaucuuuuaucagguuuacauuucuuuaguguaugagguuuucuuugaguuuguccaccaaauguuagcuugcuguccgguggcucugcuagaggcugugacaggcaugcccaugaggccuaugaggcacaccccgcuugcuuucauuucuaugaguaagacauuagaauuguaaccugguguugucugagcuugcccugcucagcacggcccuuggcaggcucuuaucuuacuuaacccuucguuuaacccuugcugagcucugacucccuaggaaacaggagucaggauacuucuuaacccugucugccacagagguucuuucuguucagugagcuccacaccuccaaaccaaugugcccguugcuuuucuacauuuauuuuucuucccaggaguaaaugaaaaacuuuuauagcgggcaagagaguuccaugccuauaaggccauuauuggagaggccagggcaggcagucagucuuggcuacaaaguggaacucuuaucucaaaaacuuaagcaaguggccaguaaaaaggcacagcaggcaaaggcgcuugcugccaagccuuaugaccugaguucaauccccgggacccacauagaggaaggaaagacccagucuucagaccuccacucgccugucauggcgcauacuccccauccccaucuaacccuuaaacagagcaacuaaacaagccaaaaacaaaaaacccaugagaaugcaguuuuccuuaaguguguguaacuugugaauuuggcuugccguggggccuuggaccuugcuuucucacugugugugagggguuuaguaaagaaacugcugaaauggcugcuccauugggacauggucagggcuaucugccagagaggaaugggggcagagauugagugccuguagcgaggggagggccagagggccagccuggacuaugguauaaaaccauaggugugugucaguggaacgcccuaugucccuucugccagaggcaagggaaacaacuccuuuugggaacuaagaaccuauuucacaaguuccuaaggagagcuggcuuaaccaccagaagucuguccguugucaagcuugagcccauuucugaauguguacuaccugagaccugacauuacagccuuuguugaugauaagggggaagaaauagcugagugcuucaauucaggggccaggggucaucuuuaacucaggcuggaguggaggggacaggcaguggcaggagauggggaggucccaucagaagcaucugguuccuugauagagcuugaaggcaguaaucauauuggcuggcugauugacacuggagggucguuuacauccucuuugagaagguccacacucaguuucugaagcaggaccacucgggaccagcaguguggaggcagcuuugcagaaguuugcugcuucugcugagaggaaaucuguuggacagauacagacuggggagguauuagcaugaucaccguuugaaauccucacuguaggaaaagcaguuagcaagugucuguggacagcugcaguggauucacaccucugaguccacuccagcaaaacaaagccugagaaguuugcacacgauagaagcaugaguguucaugugauaagucacacuuccuaucuggaaagagcaugagguccccaaggugguucuggguucaugcacacucuugaugcccagaggacuggcuggacauagauuggacggagguguuuucaccacagugagaagcauuuuugagucuauguuuagaaaacaacaaaggaaaugaaaacuucugagccugugaccaugguaacuuauuuuccuaaaagccaagauguuuuuguaaccaagaugggauucacaguuccucagaaucacugagugaacucggaagcuuuaucagcacacgguccucucuaagucucguuuguuacauaccuuaaaucauuuucucugacuucacaacuugccuucagacaccuuaaguugcuuucuuagaccauaccacuuuacauaaacuugaaacuuuucuguggaaacauccaguaauuuccuaugagacacagcuguuagagaacagagugcagucacugaaaagcaauuucccucuucacacaugagacucauucaggcuggcagguaauugugucucagucucaaagccuuuuuauguuagagacacggguaauuuaauucauauuaucagcaggccacauguccaucuuuugcuuccaaaguuacuguaaagccugacuguuuuaaaggugaaagcagacuuaguuaucaauggacuggucaggcaguguagccuugaggaaggcacuaagggcugguugcugcugguauacugucugauaaagucgccaccaaugucaucagagaccugagaaggauauauuugaguagaaguacagaccaaauggucuguguaucaguuaaaaugacaaacaccugcuaccugggcagccugggaugcuccaggguggcuccauggccuuguuuggagcagaagucagucuuccgcugccacaaucuuuugcuaccagacccagaaaaucugauagauuuucuuguacaggaggaacuugggggauuggccuacuuugggguggcaggguauagucgucuccccagcaguggccauagguuggacagggccugacaguagguaaggcaugggcaguucuuugcccguugaucagugacaccauauucaaagcacauguagguggacgcuucuuuggcgaucaucucaggacugccagaagcuggcuuaucugucuuccaggggaagccuuuuucauuaaacacauuaaaugcuccaguuggcaguucucugaggggcuugaggccaucguggaaucucuuuaagauugucccuacgaacaagucuuuuuuuuuuuuuuuacacuuagcacgacuguaagcauaguucugaggacauuaaagaagcugaucauuuauaaauugaucauuaacgugcauuucuuaguuuucuuuaacaguuuaguuugcagcaaauuaguagcuuuuaugaguuuaagauuuaacaguuuuaacccuguuaaucuugaaccuuaaauuuuugaauugagaauucaaaugaagaucuuuuagcaucaaaauaaaacuuuaaacuauaaauacaguccacagagaaaccaggaaccuuauguuacugguccguucauagugagucuuuauagacuaucacaauuucuugugugacucaguuuauccaaauagcuaaauugaacaaagcaaagacaaucaauagagacauagaucuucaagucaguuucugcuugggugagccuuaggaauucacaaaccauauuuaacaaacauguuguucuuuuuuuuuuuuuuuuuaaauauauaugucuuaauauaugucuuucagacacaccagaagagggcaucagauccuauuacagaugguugugagccaccaugugguuacugggaauugaacucaggaccucuggaagggcagucagugcucuuaaccacugggccaucucuccagcacccacauauguucuucauuaaaaguuuuuuagaagccugguguagaaauaagugguuaugcauacaucucuaagucguuuucuguuaaccugaugucuuaggguuucuguggcuucaaagaagcaccaucaccaaaaaguaagcugggaaggaaaggguuaauucauuuggcuuacauuuccauacugcuaaucaucauagagggaaggcagggcaggaacucaggcaggagcugguacagaggccauggaggggugcugcuuaccagguugauucuccuggcuugcucagccugcuuuccuauagaaccaggaccacgagccugggaaugacacugcccacaaugggcugggcccucucccauuaaucaccagugaagaaaauaccuuaagccagguguuauggaggcaucuucucaauugagauucccuacuuucacauaacucuaguuuguaugucaagucaacauaagacuagccaguacucucgagugaccauuauaaugguaauugucccaaguguaaucgucgucacuucucggccuuuuggcuaagaucagguguaaaaacuaaucagcaaacgcagguuguucucuguccucuccacagaccguguucacggcucuguccucaucuguuuucacgcucauggcagaaaccaccauacgaacauccaucuaauccaaaauaucuguguuaauguagaaaaaauaaaacaaaacuaaccaucuuggaggccucgcauuccccuuagucugaaaaaggagauacagugguaaccagagggcucaguaggacugguuguuaaaucggucacaugucagacugaagauggcugccagccacaugggugcaguuuacuccauggcgaccccaucaggccauacccuuaucuuuauuuacuuuuaaaaacaucuacuuccuuuuuuuguuguuguuuuuaagauuuauuauauaugcaaguacacuguagcugucuucagacacaccagaagagggagucagaucucauugugggugguugugagccaccaugugauugcugggauuugaacucaggaccuaagccgggcgugguggcgcaugccuuuaaucccagcacucgggaggcagagguagguggauuucugaguucaaggccagccuggucuacagagugaguuccaggucagccaggacugcacagagaaacccugucucgaaaaaucaaaaaacaaacaaacaaacaaaugaauucaggaccuuugggagaucagucagugcucuuaacugcugagccaacucuccagccuaaacaucuacuuuccuaaacuagauuuuaagccagcuccauacaaacaugcuauagcaaauuaagauuacauauauauauagauguuuuuacuacugucaaccauuucucuuacaaguuuuaagcuauuuuuaaaagauuuuuuacagaaauuuuaaacacaacagcuuaaguccugaugagaugcagaaagguuauauauagcaaaauguuuuagagauauuugggcauauucagaggguuaaacauugugacuguacugugacauuuuugagacaggcagcaguacuccucagagggaauagcugauguucuagcuguuucuaagcccaguugucuuuccuccucccugucagagucaggugaccagccuggcccaggacagagacuuuguagggaacuuaaauaaguaugcuugggucuggagaggaagggacaaacccaagcuccagagucaagccuuucuaacaagguuagaggcaggagcagacagacagacagacagcaggagagaagauguucuucagaagccaacugaggaggugggagaggucgaggguaagggucacaaacaggaacucucagagccccaggcgggcagggagggccugauguaccugcaugacuuccauaggguaggcuccagaaagucagcgagagggacagagaccgagcaggcagugccuagugugaagcagggagggauaaauggcugacuguggaguaaucuaaagugccugguucaguccuagguuucagcaccaaaugugaccgauagagcagagaauuuaaugaacuagacugcuggugggaagaaagguuuauuaccacaacuucugggaguggggggagaacagagaagaucagaauggaggaaaaacaagcggauuuuguaugacaacagagcggggaucugcacugauagaggcuuucuggguugacugggagcuagguacccuugcuugagauaauugaccuucgagggaaggucucaagggagguuccuggggauuaagggcgguuccugacagacuggagccuagauuagggcuaucugcuuuucugguaaacagaaacccaacuaaagacuuguuuacuaauaacaaucccuguguuuaccccuccagacuccuuguauaaaccaaagggacugcuccauggaaugauugagagguuuuaguugucgagaugagagagagaacagccagugugaccguggucagggcugucugugagaggggagcagagcaggggcuagagagggagacugaaaacagcagggguagggaggguggacccauagcucagagcaggggacagugagcagagaguucugggaaaugggugacaggcgcccugaggccagcgugagcuuugcagugcuaacaggcaccacagguagccacaugucccuucuggaucucccagaggaaauggcuccuuucgguaggugggggccgcuuucacaagugccuuaggcuucugccuaaccaccggaagugcuccuuaguccagguugagcucacuggacugcuuuuuuggaguuuggggaauuggaguuucuuuuggacguaacauuaaccacacgggauggaaccaagucuugugcuugcugucugggcuggguucuccccacugagccuuacccccaggucuacgaacaguuuucuuuucuuucuucucuuccuucuuuguuugcugcacacguguguacaugauccugucuagggcugcaggugcaugccugcugcaccacaggucuggaggucaggaggcagccauaguugucagugccuuucagcuuguuuuguuggcgucucuguuguucacugcccugugucagccucacuggccugcugucauccaaguguucugcucuggcugcugucuuuccagggagguauuggaguuacagauguaugugcuaacacugcuguaucuuacaugggaucuggggguuugaauuuagguccuuaggcuugcauggcaagagccaucuccucagcucuccaguaaauuuuuccccaagacaggguuucucuguauaguccuggcuguccuggaacucacucuguagaccaggcuggccuugaacucagaaauccaccugccucugccucccaagugcugggauuaaaggcaugggccaccacugcgcggccccaguagauguuuuaacuuaaucuuuuuuuuuuuuuuuuuugguuuuucgagacaggguuucucuguauagcccuggcuguccuggaacucccucuguagaccaggcuggccucgaacucagaaauccgccugccucugccucccgagugcugggauuaaaggcgugugcuaccaugcccggcuuuaacuuaaucuuuuaagaaaaaauuuaaaaagauuuauuuuauuuauuuuauguauaugaguacacuguagcuguacugaugaugguugugggccauuauaugguugcuaggaauggagguugcucucuccugucagccacacacgcuccgaccuaaagauuuauuuauuauuauauauuauauauaguacacuguagcugucuucagaugcaccagaagagggcgucagaucucauuacgaaugguugugagccaccaugugguugcugggauuugaacucaggaccucuggaagagcagucaguacucuuaccugcugagucaucucuagccccuuaagaaauuauuuauguaauuuuugugugcagaggggugacugucacucuguguaagucagaggacaacguaggagucacuucuaccacauagguucuagggaucaaauguagauugccaggcagcauaaauaccuuuauccacagaaccaucuuaccagcccuuaaguuaauuuuuuuuucaagacagcaugucucuugccccauuugagcauuuuuccuuuuuuagaccugagcauggugguaccuucauauagucacaaugccugaggagcauugcuaugaguucaagacuacagaaggcugucaagugagaaccaggcuaaccuuugucauguacacaauaccuugcuggugcuguucagcuagucugugguuagugagcucuggugcggccuuggugcuggagagccacacacaccaguguguggacuaugacuuacauuuggaaugaugcaaauacagaagaguggggauuuuggcccagaaacuuuuacuauuuauauuacugugugucuguguuuucaugcuguguacauguggagguauguauguguguguguguucauguauuuaaaggcuauuuguauuuuucagacagggaagguagguugauaagcucuuaccuaacacaugaaguccugguuucaauccccagcauaaacugggcaucuauaaucucaacacuaagaagguagaggcaggaaaagugagagauucaaggcuccccucccauacucccauucauaacaaguauaacaacuugggcuacuuaaggccaacaacaacaaagagagagagagagagaaggaagggaggaaggaagggaggguggguauuucucauaaucagggaaaugugaaccauuuuuaauggcuaucaguguuguagcuuacuaggaaugugcuguuagagggccugugggacagcuuagcagacagaagcacuuggcauacaagcuugggaccugaguuugauccccagaacccacguaaagauggaggagagaaugaggccagaguugucccuucugugacaugccucaagaacaguuguaaguggugcccucuuuuagacuuggcccucaggagugagaggcagguggauuccugugaguuugcagccagccugguuauagugagaaccugucuaagaaaaaaaaaauuuuuuuaaacccauuuguggggcuggagagauugcucagugguuagagcacuuguugcucuuacuuguugcugaggacugaagccaaggccucccaggugcuaggcaggcgagugcaguucccacuaagcugcauucccacuggccucugggguccucaguuugaucaggccucucugugagacucgaggaggaauggguacucagaaaggacccagguucaaguuuccagaaccuaaagggcugcucacaguggccuacagcuucaguuuugagggaugcagcucucuuuggccugcauugggcacuacauucacagggugcacagacauacacuuacauacgaaauaaaaaucucuuuucauuacuuuuauuuguuuguggcaaaugcagacccagagguuggagacagcccucagaagcagugucucccuguacacgagaaucauuguagugagaaucagacucugggucccaggcuuagcagaaagcgccuucaccugcugagccaucucccaggcucuacaaauagacuuucuuuguugcuuuuuaaaaaaagaaggaaaaagacaauaaaaauauggccaguguuggcuguuugcuugccaacugucuguuagcccgacuuccuugagcucccacugcuccgagccacugucucuaaacugccugugcuuuucccagccaucugcaucauccuggugcaccugcugauucgguaccgccugcacuuucugccugagagcguggcugugguuucucuagguaagugagacuggggguccauuccacaacaccaaauccauauaggauggagcuuuuucucauuuaugucccccaucccaucuuccaggugaugcuguguuuuaaggaaugaugcugugguuugguugauugugaacgaggaaacucugagucuaucuaguuagcaggucccuuagaugcucauggccucagcuaacuagagaguucuuugagcucuaggugggaaagcauucugaaguguuccuuccugcuuccugguugcaccaaaaguaaccugcaagagaggcuagcaccuagugcuguggggcuucucaaagaguuacagagcugcuucagggaauugacagcucuguagacagucuuacuauuaaaaauaagcauuggccaggcagugguggugcucgccuuuaaucccagcacuugggaggcagaggcaggcggauuucugaguuuugaggccagccuggucuacagagugaguuccaggacagccagggcuacacagagaaaccauguaucaaaagcaaacaaacaaacaaaaccaaaaacccaaaacaaaacaaccccccccaaauaaauaaauauugggggacuggagagaugucucaauagcuaagaacacaggcuucuuuucguaggauccggguucaauucccaauacccacaugguggcucaacuagucuguuaguccuguucuaacaggucugauccucuucuggcuucuuugggaacuguaugcaugugguacacagacauacaugaggacaaaacacucauucacauaaaauaaaaaaguaaaguuaaaaaaaacaaaacaagaauaaauauugggccaggagaauucaaggccaucaugguuuauuguuaauccugagauucaccagagaaaaaccaguucagcaaauuugagccaaauuugaaacaaacuuuaaucaaauacugaccaggcuggacuuuggucaggaggaccauucccuggaauuccuagcugaguggcgaugagacacguuuuguaggggugauuucaggacaaguucauauggccauuacauuuucacuuguggugguguuauuuuccaagaacugcaauucccaacauuccagaaaguuacuugguccuugggcaggugggcagguuaacuucaagucuuauacuauguaaguuucagaacauaggguuacccagucaaaaaaagaaggaaagaagaaauaauaauauuaguaauaauaauaaaaauggcuggagagauggcucugugguuaagaguacugacugcucuuccagagguccugaguucaaaucccagcaaccacaugguggcucacaaccaucuguaaugggaucugaugcccuuuuuuggugugucugaagauagcaacaauguucuuacacauauaaaaaauaauuuuuaaaaagcagcaccucaggcagauaaaggaaucuguuuucugccaggcggugauggugcacgccuuuaaucccagcacuugggaggcgggaggcagaggcaggcggauuucugaguucgaggccagccuggucuacaaagggcuauacagagaaacacugucucaaaaaaaaaaacaaaacaaaaaaaaaacaacaaaaaacauaaaaacgagcuguuccagcagagggccuagacuccagcaaacacauagcacccccaaccaucugugcaucucucuguucuaggagaucugauguccucaggcagcagcaugcaugugcacgugauguacagacaugcagacaugcaggcccaacauccacacacucaaucuuaaaaauauaacaauuagggacaagaaauguggcucacuaguuuaguccucaaauuuauaucgaguuucagaacugccugugauuucagaggggacauguacaggcagucagucagucaguuaaaaugugggugaguguggcucccugagaccacuggcccucaggcucucagcagacgugagcugccuagauaaagcccuuucuuccuuuuuucuuggaaauagaauccuaacuuguacuugguuuuugaugcugaggacugaagccaaggccucccaggugcuaggcaggcgagugcaguucccacuaagcugcauucucacuggccucugggguccucaguuugaucaggccucucugugagacucgaggaggaauggguacucagaaagcauuuggucuugguuaucaugagagugaugcacuuugcugugauugauuggaaggggugagacagugggacugacaggaagucugccgggauugugggguuccaaaaacuuucuccuuccuaagagaaguuggccuucccuucuuuugaugcugucauuggagugugaugccuggagcauggcuauaggaauaauaaacaaauuuuccuagagaguuuuuaaauaccagguccuccagcuugcugcuaaaaguaugaagaccaauaucaaacuuuuuccauuaaauggcuacagucacuuuuaaacaggcuccagcuagagagagcguauugcaaaccucugggcucacguaaccagaaacccacaaguaauggaggcuucagggcucgaaucccuggucaccacaucaccucuggucccguugcuuucuuucuggcuucucucaggcaggcugcuuagucagcagcccugcagcugcaguugccaugagaaggguaccuguccccacuggaaccaggcuguaggcugcugccugcacugccacucagauuuaggaugggguagaaccauugggcuauuucuuuacccaugugauucaagucacugucuggugauaaagaagguaugucugcucacagguaggaagcacauccgagagaguacugaaguccagaguguuucuuaugugaggagugcucagaacagaaacagugauggagcagacaaaacuaucuguauuuccuuuccuuuuuuuuuuuuaaaagauuuauuuauuuauuuauuuauuuauuuauuuauugcauaugaguacaucaccauugcucccuucagacacaucagaagaaggcaucaggccucauuacagauggcugugagccaccgugugguugcugggauuugaacucaggaccucuggaagcagucaguguucuuaaccacugagccaucucuccagccccaaucuauauuuccuaaagcccagggcuggcaagaugguucaguggguaaaggugcuugcugccaagccuucagacugaguuugauccccugcugccacggaccaccccaggauuaccccagucggucuguggcagcaggggcaccuggaaugaggguccucaaagcuagguggguaaggaguugguggagacaaacggaaacgaacaacacagaggcagucugaaccugaguguauucugcagcucccaagcaggggauuuuauacauuaaaaaacaaaacauuacaccucuuagaaacuguauccagugaaacaaucacagauaccaacaaaaaucauuuggcacaguaaagcacaaaaaucauccaagcauuacaacuuugaaacucuguguucugugaaucacaaacagaacagguaacaucauuagaauuauuaaucaucaaaauauaacaauucuaaaaggauguauucagugggggcagucauucaaggcuagugucauauuuccaagagcagguuaaucuuaacggucagugcuuuuaaccgcugaacuaacucuccagccccauauggucaguuauuguuuaacauuuucuaaugccugauuuuuuauaaaucuucaaugcguaaauuuaaacuauuuuaauucuuucuaguuaaggcuuucuuuacuauauaccaaagcccacuuucgaugacacacgugcagccauaugaaguuuuauuguugggaaaguuuuuaucaucauaguuuuguaaaugauuuaaaaaguaaagcauugauuuccucagggauaaggucauguuagugaccccaucucuagggaugguuucuuacccauuauucuugcuuaaguucuuggccuaggcuaccaggaacauauaaauaagaaaaggaauaagagaaaacaaagcagauagauugcuaugagaacuacggcucaauauuuuuucuccgucgaagaguuccacaacuguguccucugagcuccauacacuaacuuggaugccuccugucuuaggguguuacugcugugaacagauacuaugaccaaggcaacuccuauaaagacaacauuuaauuggggcuggcuuacagguucagagguucaguccauuaucaucagagugggagcauggcagugcgcaggcaggcauggcacaggaguugcugagaguucuacaucuuguucugaaggcagacagaagaaaacuggcauccucaggcagcuaggaggaaguucucaaagca

SEQ ID NO: 1289 - RNA, 11757 nt, Mus musculus
cuuccggaacaaauacuuccgggcugcuuuugcccccgguacuguucucgguucccggagccggcgggagcggccgggccgugugggccugugcuuuggaggcgcucgcuuuccuggcaggcagcggugggugagugcggguggggcaggaggguggaccccugcgcgcgcugucaccggccaggcccucggcucugucccgcggccgcggcggcuccgggcggcuggucgcagcacuggcuccccggugauggcacacgcgcccccggcgcccccggcgcccccgggggcaggcaccgcgcuauggcucucaguagggaggggaggcugaucuagcuuuggauuuaccgagugaccuuggcugagucgcucugcuucgggauccuuggucucccggucuauggaggagggacgcggcggccuuccgggcccgcggugggcguggaaagaggacccggguguugcacggugucggggugcagcagcgauguuaugacaggucccgguauuucagugacagacggaggggcguuugcgagagcuugcccaguuugugcgaugcccuggguucugacccuaguccccagcaccaccgacaaaagacaccaccagugggaacuccuuccuuugagcuugggcguuuuccccgcugccaugucggucagaggaagacggcucgcagagcuuggaguagccgccacagguuuacauucccuguagagaggggacuuggcucccuucagaaccgagagaggcucuccggggagggaagccaggcuccagcacagccaagguuguuuucagagcuuuggaaggccccgguggcaguguuucuguaggcuaguagggguguagggcccuuguauuguuuuacagccaguaggagaugccagggguggaucugggagccucuugcuuagaaugaaugcauagagguugggaggagggaacggugguagagccacaucccugauccuguguggagacugaagcuggaucagggauguguaaacauguaguuggagaacugggacccaaauagcaugugccaguauagagagggaaugcauuucagcguugccacggggcuuauuuuucuugagugggccagcaaagauaaaggugaaccauugcucuccuucccggauuauuuugguucuguuuagcugaauuuuaaaugcguucagcuuuccacacuggguccuggcgacugugcgccagccucgucuucacugaauugcuuuacaaaggggcccagauaagugcaggaggugccacccagagccgauggcacuaagcauccuucugcuuauguguuccggauauucacagagcuuuauuuuuuucccccugccagccugguauggcuuggcauuccagucauuggguugcuuggagaaauuaacagcuucugucucugggcugucuugcucuccaguaaccaggcuguguuuagcaaagaacguguuuuuuguuguguuuucuagaguguugggaauaaauugcuggcucugugcucagaaaagacagcaguuagggccagccacaaggcagccuguauucuuauucagcagggaugauguaacugccucacugcuggcuggucucuggccagccuuucuccugggcuuuugagcuuacaucacaaagagauuggugugggaagauggcaguuuugcuacuaccagacuuugcuucccagccauagggcguuuugacugaccaagccucucaaggagcccaguccagaagaugcagcaagaagauggcuuuugccuaggguuagauucaaauccaggucucagauccgcuccuucuuggcccugugacuucaguuucuucugaaauauuagagucauccuauggaucuuacugauuuuugagcagcuggcacggggccugcuuguggugaccccuuuguaauugguaccaauuguagccagaaacaagugagcugaaugagaggaagucaguucuuggggccuguuggcccuuuuggcucugccagagacauugauugcagcugagccucuguuuccccaauugcuucaaggaugcaguggcagaugugauuaaacuggggagccugucgugccacuuggaacguaguaggcccuuguucacuguuucauucucuuaccccgcuuugugugguuguuuucugguguucacaccugugcaucuagccaaagaggaagccagagauugcaugacuuucucuuaaucuuuccacuuuaaauuuucuuucauuauuuuuauuuuaugugauuggguauuuuguuuucaugcauguuuggacugugagucucuaaaagagugucagauucccuggggcuagaguuacaggcuguuguaagcccccauguggguucugggaauuaaauccagguucucuguaaaagcagacagugcuuuuaaccauugagcaaucucuccacaccucucccaccacgcacacacauuuuuuuuaggaagacauuauuuuuauuagauauuuucuucauuuacauuucaaaugcuauccccaaagcccccuauacccucucuccgccccauuuuuuuuuuuaauguguauaugccugugcacucugggcauccgggugugcacagaagucagaagagggaguuggauccucuggcacuggaguuaugggcagcugugagccauuauaugggugcuggaaaucaagcgcaaguucccuguaaggacagguguuuuuaaccaccgagccaucucuccagccaccacugccuccuuuucuucccucucuccuuccuucuuuuucuuuucuuuuucuuucuuucuuucuuucuuucuuucuuucuuucuuucuuucuuuuuuuuuuuuuuuugguuuuuguuuuuuuguguuuuuucaagacaggguuucucuguauaucccuggcuauccuggaacucacuuaguagaccaggcuggccucaaacucagaaauccaccugccucugucucccaagugcugggauuaaaggcaugcgccaccaccgccuggccacguucuuuuucuuuuuucuucauucuuucuuuucucucucuuuuccuccagugcuggcuacagugugcacagugcccugcucucuguagcccaggcuggccuugaacucuuagagaucuucccauucuaacccgagugcugggauugcaggcauucauuugcuauugcccuucuccucuuucagccuguucuucuugagagucguccagacagggcuuaagugaguggcaguccuccugccucagccucuugagggcugguauauuguuaggauucucuagagucacagaacuuauggauagucucucuauaguaagggaauuuguugugaugacuuacagucuguagcccagcuccccaacuauggucagcugugaaugggaagucugaggauccaguaguugcucagucccacggggcuaguggguuccaacagaugugcuggcaaguaagugcaagcaggcaaagaagagccaagcuuccuucuucccauguccuuaugcaggucuucagcagaagguguggcccagauuaaaggugggacaccacgccuggaucugggacuuguuuuugucccaggcuggccuugaacucagaucucuuugcuucagucuccugggauucauagccacugugccucaagaucuccaugccaagauccaggucagaaacuuguaucucccagcuucaagaccuggaucgcaggugagccuuccgauucuggacuguagcucauuccagauagagucagguugaagccaggaagagccacugccgccggguugguuucugggcaugggcuccugcuacucucagcuucaggauucuucccacgugacuucccauuucaggaccaugagcacacacuaaagcagugggucuccuuuccuuuuuuuuguuugccagcagcaaacaggguguaaagugugggccacugccaaacagcaccucugagcugaauggggcuuggaggguagcucacuuugaaaauguccccugcuuccagcucacagcugacuucuguggggagaaaaaaauagcaauguuuaggaaaaggcaugguagccucccgcugaugcucucugagacaguuuauauauccuuggcuguccuggaauucacuauuagcuggcuuugaacucauagagacuugccugcccugcuuccugagugcuacucuucaaggcaugaguggcaaugccuuucuuacguugauggcuaauugggcggcauauaggucuguguaccaugugcauacccuuggaggucaggaagaggguaucagaucuccugggacuagagugacaggcaguucugugcugucgugugggugcugggaaucaaacuuggauucucuggaagaguucccagaacacuuaacugcugaaccacgucuccagacccugucccuccuccuccuccuguuuuguuuuguuuuaguuuuuuuuuuuuuuuuaacuuuugggguguuuuguuuuguuuuugagacaggguuucucuggguaguccuggcugucccggaauucacuuuguagaccaggcuggccucgaacucagagaacugccagugucugcauccugagcccugggauuaaaggugugcgucuccauugcccagccccuguaggagggucagaagcucaaggucauccgcagcuguguagcaaguuugaggucagcuugagucccuggguagcacuuggauggaguccaggggcuccuccacugaggcaggaggggagcuucucuuggaucaacagcggcugugugucgucuuuggcuggcagugaguuugcacugugcuucuuuuuuuuuuuuuuuaagauuuauuuauuuauuuauuauauguaaguacacuguagcugucuucagggccaucagaucucauuagggguggcugugagccaccaugugguugcugggauuugaacuuaggaccuucggaagagcagucagucacugagccaucucaccagcccggcugcugugcuucuagaccgucuccuucacugauggccucuacuauccuggcccccaccauaaccuaacaggccgggcagaagaugcuuuguagaacaccuguggaacaugggccccaggguugucaagggcacaggcugcauggcaugcauauuugcaacccauccuccagcugcuuuuguggcccugcugagagacccagggucacugugugugcaugcauucuucaucacccaguggcuccaguugcaguaggugcccaguuccaacgcuucagugcucgguacuguggugaucuuugccuuugugggaguuucaggucauggggagagacugagagugagcuaguaaagaacaugcaaagccaguaauugcaaauugugguuaucccagggaaacugcagcaagggacugggaaggugggguuuacgcagcaugacgcggcaggagaucuuuguguuggagcugaagccugcgugaugcagugagagauccacccaagaggcaaagaaagaacagaaaacucaaugcaugugcaaagguucugauguagaaucagcccgacaugacaggagagcaggggacuguauggcuguuacuuagagggaaggcuagacugcugugaaguaugaccuccgccucugguuuuggucaggacuuagcacucaucuuuggggcccuuuugugcuccccaggucaguuuguuucuguguacccucacaggcagugggugaaaggaaggggacuuucugguucuguuuguuuguucugcaguggacuacaggccauuuugccuuaccuccugaguacuggaacacacagaguacugccaugcccagcaugggcccccaguuuugcucacuuucacccacuguuaaugcugccacucauguccccaaacuggagaugcugagcuguggcuuccugaggccagggugguucugugggcugugggauuguugccagagcccagauaauacuagaggaccccacaggccauaccaagcccccaaggagagcccaggccccuaaccucuucagucuuaguggugcugaugacgggaagccccgccugagugagguguggaggcuggcuuagaguaggaugcucaccacccacacacuggggcucuggccaggaaagcagcaggugcaggucacgcccacucuaccugaagguggacggagccuucuugagaaagccuggugucuugaggguggauaccuugccaaggcagaagaggcugucagugcuuuccuuacuuagccacagugugcagagcugugugugcugaucuggauucaugagaaaagagccaaaggguugagggugcugcugugcccucuugagccugguuugucugcaguguguggcacugacaguugcugucuuuccccgagguccccugugagcugcugggcugugugcuucuucucgcagcuggcugcggcccccucuaagguaaaggggacaguaguggccuggucucucuagucccuaucuagauccuugaauuaaacucuccagugguuuauguggacuuccccagaagcccuggcucuguguugugcugggagcuggacccaggguccuucucaccaagcagugcagucccaucguccccaaggaguaguggguguguccucugaguagcugugggucaggccccugcaccagcaaucccucugugugcccugaucauuagcagcaaaccuccuuucuguuggugccaagcuccuuccuucuccaggaaaacaggguguggugggcuuggccuggacucuggagccuuucugggcucugaccuuaucuccaccuugagagaucugggacccugggugcuucucuugaugacuggcugauuucaggggccaugguaacugcugugcccacuugcucaggagcaagggguuaguacuggcacaugcucuguagugccagcucagcaccucucugccgccaccucuggcaucacacccugggccuggcagugcuucagguuuaagugugccuugggguuuucccagacuccuccuccugucacaccaaggccaagugugcaccggcucgcuccccgaaccuugccuuugggggcauuagucacuccugugagcuggugagcagcagcgccuggcccaucuguguucugugucagugagguggaagagcacaugggggccaucugggcucaagagccagcuuacucuaggccagcucuuggcuuugcuguccuuggcauucugaagcugggauaggcaccagucagaaggguaaugguuucuuguuccccccuuuucagagcaugcgcugguccaugggcaccaggccaguucuucaugugaugugccagccuccaguuccagagccaugggggagaugagguagcccuuggguuugauuuggggaagcccaguucaauggauacgaaguacaaggaugacuuauuccggaaguacgugcaguuccaugagggcaaaguggacaccacccccggcaaccagcagccuggcagcgaugaguaccugcgcguggcagcugccacccugcucagccugcacaagguggacccuuuauaucgauuucggcugauccaguuuuaugaggugguggagagcucccuccgcucgcugagcagcuccagccugagugcucugcacugcgccuucagcaugcuggagacaauggccaucaaccucuuccuguuccccuggaagaaggaguuccgcagcaucaaggugaggugggguggccgccucugccugcugcucccucccgcgugcacgugccccuguucucagcccaugggcuccaggcagcugggagcugguguggaccagagucccaguugagggguggguagguguguguuggcuggggcuugagagaagauucucugcacuuucccuagcagggccaggggcuggaauccuggcaugugcauuuguuuguuuauugucgugcuagggauuaaaccuguagugcacgcucugucccugagcuacaucccagccuuggguguuccugaaacugugacagaaggcucaaaauggacauccuggggcuuaguaucucucucuguaauuccaccccugugcuucuccugugguacagagccuucacauagucagaaaccauggucuccuggccucccgggccacguguacuccuugcucgguggugugcauuuagugugcucuugccuguggucuccaggcaggagcucgccaucccucccugcggucgcgcucugcaucugguuugaacaggcuucucuauagcaugccuuuuuuuucucugcccacuuucucccuagaccuacacuggcccuuuuguuuacuaugucaaguccacguugcuggagaaggacauccgagccauucuaagguucaugggcuacgagccugaguuggggacuguguacaaacucaaagagcuuguggagucccuccaggugaagauggucuccuuugagcucuuccuggccaaggucgagugugagcagaugcugggcauccacucgcaggugaaggacaagggcuacucagagcuggacgugguggcugagcgcaagggcagcacggaggaugcgcgcgggugcucagaugcucugcggaggcgggcugagagucgggagcaccugaccacuuccauggcucguguggcacuccagaaaucagccagugagcgagcagccaaggacuacuacaagccccgggugaccaaacccuccaggucuguggaugccuacgacagcuacugggagagcaggaagcccccuucaaaggccucacugagucugcgcaaggagccccuggccauggauguaggggaagacuugaaggacgagaucauccgcccaucccccucauugcuggccauguccagcuccccccaugguagcccugaugaccuuuccuccaucuccuccaucaauggccuuggccuucuucguaguacauacuuuuccacucaggaugacguggaccuguauacggauucagaacccagggccaccuaccggaggcaggaugcucugcggcccgauguguggcuggucaaaaaugauacccaccccaucuaccacaagcguucaccccccaccaaagagucugcccucuccaagugccaaaacugcggccuguccugcagcuccucccucugccagcgcugugacagugugcuggucuguccuucggccuccaagcccagcgcuuuccccagcaaggcuucuguacacgacagcuuggcccacggggcaccuaugcgggagaaguaugugggccaccagacucagggccuugaccggcuggcaccuguccacucaaagcccaagcccucuaccacagccaccucccgcuguggcuucuguaaccgugcaggugccaccaacacgugcacccaguguucaaaaguuuccugugacgccugccucggcgccuaccacuacgacccgugcugcagaaagagugagcugcacaaguuccugcccaacagucagcugaacuacaaguccgccccguucucccagcucguguacagauaggccucaccccccgucuuccgcuacaagggcuacacaccacugaccuggcuuggucccaucaagagggaacagagcugcaccggaaggaagcagagacuugagcuugaccguggaagcaccaggguuacugcuuugucacauggcucccguagcaggucacauuccagccaguggcugcugugugguccgaaggacaggauggcacuuccauucagucacuucgcugcccucuccacuuccugcucagcugguauggguuuggguucugguucugguucccuugaaauaagucucugucucugggacucuugccacaccugccccacccacugcaaagccagcuuggacugggaaggagccuuuggggucaccuucaaauccccaccaggaguggugagcuagaggccugcuggcuugugaaaugagcccuccugccacaccgggccucucugguggcucgccucuuuuccugcucccuugauacaaggaucccuaggcagauguccccaccccuugucugcccccugacugguauuaauggguagccaaguccaguauuagucgaaugccaucuugccagcuccacucaaccagcccacaauguuggcaagcucugcuuggcaguuggaaaguggacuccauagcaggacugacguccccuccuguuugcauaacccccuuacuguauuguacauacagaauuugagguuuauuuuuuaaugaguguucaacuugcuguguguuucaacauggugaaagaaauuaaugauacgguauuuauaaaggugcccuggguucuuuagucuuccaaggggggccgcaugcccuuuccccguguuucuuccacagcuaggguggagcugggagccuggcguaagggacugauaaagcccauguuccuucccauggugguagagagcuacugucuucccuacgguaaauauuauacaccuaccuccagugugcacacagggguuagcauggugccggggcaaugaccucagugacaagauggggaccucagcccccacgucuauagcucugucuggucuuggugccugcugagcaugaaucuuguacccugaaccuugaaucucagaaggaaguucaggcggugggugccuccacccccaucuagccuuccucacugguucccggggcugucagcgcggcucucagucuuuuugcacuagggcgggcagaggugggaugcgcuccuuagaugccucuccaguauucaguguccacacuuccugggauaaaucccaccucuggguuuuccuuuuuggggagaggggcagggcaggaauuugaagcugucacuuccuugugaagugugaacacaguuuagccauaggcaguugugauguccaguguuugggaucuaugggcaaguaguuuucccaaagcaggcauucaguucuggagcaggcuugacucuggccaaacccugagccacugugaauuugcugguggucuuccgacuuacuggagugauuuuuuagguuuuccaaaucuuauaugacucuuuuuuuaucucuagcugauagaccgcauguaauuagguguacauacagcagacucugggcaguuuuauuccugagacuggccuuccugggcagcucuuugaugucagcaccucagaccuggcaaggccuggcccuuuccugagagcuccagcucugcauuccagucacuccagcauugcagggacucucuuaagauggaggacaggccaccugaggaaguccaguguguuccaccaggaaauacaguguacagacuggcaaggccucuccccuccuaggugugucucacuauaggagaucgcugugauccggguaguugaguauauguuaauuuaaaaugcacauauuuugcauuugauuucuacggaguugaaauguugagagauuuaaaaaaaaaaaauaaagugucuuccauuguuaaaugaaguguucaugguguuacagccccuucuguggcuucccucauuuauuugcagcaugugcuggccuagacaccacaguuagcucaagugacaggacucagacggauccuacugcuuuggucaucuggggaagcuggaaaccaggcccgaggucaagcugucuguuuucccaaaguauuucugggaaaaaauaauuguuacuaguaaaggcacaacuuuuuuccccugccuucugauuuuucucauuaaaggaauauucuaccacag

SEQ ID NO: 1290 - RNA, 3190 nt, Mus musculus
cgucgcugacuuccuguccggccugguacauuggggugcugauacaugggguucuguggaccugcccauugucgggaaggugcguaugccgggcugugugacugucccggggucaguccccuaagacuggacugaggauccccgagguugguaacagcacaggagggugggucggagagccuccuggagucuucccucaagucagggccaaucccgugcucgcauguaagcugucggugaggcuuucgggcuuaggcagaagauugaauucaaaccaguuccaucaggcaaggauuccgagucagucagugcuaaguuaaagccagggcagccaccuuuucagaaugggcauuccaucucuagucucugccuucccugcugaguucaggccuccacuccugucugccuagagaauucuuuccccuaguggcugccaaacuccuagcaccucaucccauuaguccaguugguauggcaccgcccaucugcagccaagcccugccagggagauggaugggcucugguuagccgguccuaggucugugcucacucaggccaggcuccacuuagcagcaugaauugagagccuggagauuguucccagaaucaggagcuuaagggccagguagacaggguccccuuugauuuuguggagauugucuccaagucccucccaguaugguuggggaaacugaggcucaaaaggauugaggaagauccacaucaguguauugaagccauuguggacugcagccuaccagaccgccccaggcagggucugugucuguggcaagguagaggguggggagcuacaggagagagucuggauucagcugaccaggaggcuaccucuguacccugcccaccuaggccuucauccggccauuccgggagcaccacauugaccccacagccaucacaaggcaugacuucaucgagaccaauggggacaacugccuggucacgcugcugccacugcuaaacauggccuacaaguuccggacccagagcccaggugagaccugcaguuggggcuccucagagucagaguccccggagaggcucccagggugugugggcgucuugugacauuuaaagaaaguauucuccauucguagggcgcauguaaaaguugggcauguagccuaagacggcauucucugguaacgugacccccaggguccuccuucacagagcugcucauuugacucgcuccuugugagucacaggcagcccaggccucguucuguuguauuauuuaaagaaaaggcacacuaugagcauguggaugggaccuauuagccaagagcuggcccgcugugucuguacccuggguucaaucccagcacugggaaaaaaggcaaaauauagacugugagcugaggccagcaaugcccgguuuugagucccaaagcuaucuggcccacuguugggcaucaggggaggcaaagccagaacuucugcuaguuggcaacacuucccuuugggagaaacagagggucuguccauggccggggaugggguacugcugggcccaccccccuuacugacagucucccagcagccccuucuccauauacccacuuccuuccucucccuaucccaugagcaggaagccagcaaguacaggccucccggaggcccauggcuuugcuuucuuccaaggugaacucuguggagcugcuauacccuagaaacccacagagccccacagagccugaaucccugucccagaugcugccugccucccuugcucuguagauguguuccagcaagagauacucccuugagcacaugaguguccugcuucagagaaccagacccagagucccugcuccgagcccaugcaacccacaagugucagcaagaaucagaagccagccuggcuggcugagagcccacacucuuagccaaucccuggcugcuucuagaucugaagaucugaugguagaggcugagguggugcuccaccucaggggucugggugcuccuggcacaggagcuggccggccaguggggcagcugccaaggucccaugcccuugcccuugcccuugcccuugcuuugcagagacccuggagcagcuguacccuugggaaugcuucgucuucugucugaccaucuuuggcaccuucaccaaccagauccacaaguggucacacacauacuuagggcugccauacugggucaccguccugcaggacuggcacgugauccuaccacggaaacaccaucgcauccaccacguggcgccccacgaaacauacuucuguaucaccacagguggguggugcuaccccccagggucaggaggguggauggccauaaggccuuggccuaccaaguauucucagagagcacauuuacugaaugaaccucucuuaugugcaagcguucuucuaggucagggcccugaacaccaaagccccuuccuuacuucaagcucuugugacuccagacauucacucagcccacagacaauuuacucggugcuuauucacugcccugggcuuaggcucuaccaguaaauaaaacagaauuccuugugauugcccgauggaagggcacacaccuuuagucccagcacagaggcaggcagaucucugugaguucgaggccagccuggucuacagagugaguuccaggacagccaagucuacacagagaaacccugucucgaaaaaccaaaaaaaagggggggggggaauccuagugauuuggggagaccugagggagggccccaagccgcacuugaaagaggucucucucuuucugugugcuccaccuucuucugccugucuccugagggcucuccaccccagggcuggcucuccucacuacccccauaacugugucugcugcaggcuggcucaacuacccccuagagguuauaggcuucuggcggcgccuggaggaucucauccaaggccugacgggugagaagccgagagcggacgacaugaaaugggcacagaagaucaaguagcaugucuggacucuuggucgccaaccuucccaaaccugaacugaagccaucugccaaaucccggcgucucugagcuacccuccagugaagagaaguccccugggcugggcccgggcaccccuagcccacccccagugacacagaauacuugagccacccacuuuucauuuccucuucuccuuuucuuuccuugggccuuccugg

SEQ ID NO: 1291 - RNA, 48342 nt, Mus musculus
aaacauguuuuuagauuuauuuguaugaugguuuuguaugcauguauguacaguaguaugguaucacauguauacccugugcccuugaaggucagaagacggccugaaacuagaguuaggaugguuaugagucaccaacaaaccccaaggaagauuuuuucccuuuugguuguuuuuuuguuuugagaaggggucucacuguauaacuggcugucccggaacgauguagaccaggcuggccuggaacucagagaccccuugcuucuaccuggagaguuuaaaggcaagugccaccacaucuggucaggauuuucuugauacuggagaaagacagaaaacuagcaccacaugucccauccguucauucugccaggguaaaaacucuuauggacuuucccaaguuucaugagagcagaguggccagcuggguguuagcaccuguccaaaacuccggagacugaggcaggcagauccagagcuggaggcuggccuggguuacguagugaacuccaggccagcucgggcuauagagugauucguugucuaaaacgaacacucugcucgcugggauguggccggaguagguccuagcaugcacggagcucugguuuaucccccgcaaugcaugucugugauuccaagacgugggagauggaggcgagaggaucauccuucgccugacagcaaauaagagguuauccuuggccugacagcaagugagaggccagccuggaauaucgugacccugaguuaaaaauaaagaacggagcccgaagugauggcacacaccuuuaaucccagaacucgggaaaaaggcagccggauuuaugaguucgaggccagucuuggucuacagagugaaugugaggacguccagggcuacgcacagaaacccugucuggaaaaaccaagacaaaaaggaaaaaaagaaaaaagaaaaacagaccgggacaggaaacgccgcucccacucaaccgcccagcucgaggccacgcccucgccgccugacucaaccggcgggcuugaggcucgaacucaggauacuccccgagucccgccucggcccacgcgccgugggcgcgccgccgggggucgcuugggcaacgggcgcgcgcccuccggagcgcggaacccgggaagccgcacgcggcgcgcgcagcaagucugcuccucggguucgggccucguccgcgaugccccgccuaccgcuccgcccccgcggaagugccggccgccuuuucgcuagcugacugguccucccguacagagggcggagcucgcggugaggcgggggugcguacuuccggcugccggcuugacaugcagaagccgcugcuggggagcuuggggcugcggugguggcgggugacgggcuucgggacgcggagcgacgcggccuagcgcggcggacggccgugggaacucgggcagccgacccgucccgccauggagauggagaaggaguucgaggagaucgacaaggcugggaacugggcggcuauuuaccaggugcggagccgggggccccuaggccgcgccgucuccccgacccucccggcucgggggacuccugucgcgcauccucgucgcccuagaccccucuugggguucgcggccccugcgacacccccacucgccucuaucucuccgcggucccugucaucuucgagcuccccccgcaaacccgaccccaacauggcccagccacccuuuguccccacugguccacaccccugccgcuuccuugucuggacuggaccaccucaggcccucuuccuuugucuccuggggaggagggugggcucgccgacacccccgcccccucacauuucacuuccucgggccucggugugcggugguggaggcccggggaugacagcccccuuacuccuuccuguccauucauuuguuagacgugagcuggagggucucuucggugcuaggcuuuggagcugguguguauugaacgccaccguagaccuaaccuauccccccccccccgagaggcuauagucacacagacauucaaauacugaucauugcaucuggugacaaguguugagaagagaaagaccuguucugguggagggugacuguacgcaaaggggcugccuugucuagggcaucaccggcagggcugcuagcggcucgacagggaaggagacuugcucuuugaauagaccaaggagugacaagccaugagguuaggcgacuaacuagggggacacagaacccauuccuauagcugccugacccucuccaaauggccucuuucuuuugucuuuuauccuuugaccgugagcugagaugguuucuguuuucugugauccgguccacuugagggguucuggugguucauuaaaaaaaaaaaaaguauuaugaaaguaggguucucccccccaccccccgccauguaugaaacagugaauugaaaaugcaaagaugucuuugcaagcagcuaaguccucuaaagaaaacaaaucuuccgauuaaaugucagugcggggguugugaggauuaaccauacucgccaggcaucuuaaauaagcaugugcaaaauagauccuguuccucggguaaagagagcaggcgguuuauucugcuuucagcuucuagguucaaaagacagcgggugagacccaucagcuggaaauugaaaucuauuuugagcuucacuuaggaaaguaggcacccucaggcuguuguuugguguucuugacugacaaaaccuuuuuugggggguugccuugguuuccagauucuuugacaggguucuuuuuacuugggccucggugugcucgucagcuuuuuuggggggcagauauuuguagcuaguguaaucugugucagucgagcgaucaauuguaacauuuguauugcacgucuagucuaugaauuggcuggacagauuccacuaaggagucaggucugugggcagauuuucuguaucagauuaaaugcaaggggaucccaguguaacaacagcacgugaagauuguucuguaagccacucugauguguggagguuguuggcuaaacagaccgucccaaguggagaccguugaaucuuuaguacugagacagacuuauuugguaacaaauuggcaucauuaauaaguuaugguagaaugugguuuuuuacgcuuuuagguuagaguggccugccccgacaucuaagccuuguuaaagcuggcgcagagugggcuggcuuugaaaucuguuuucuucauucuucuccaauuucuccuccacacuuaagccccacacguuaguaaauugcuaguaauaguaauaguaagccccacaaguuaaguacgaugccaggguccgcacagccuguucacaagugcuugugcccuugguuccccagugugaagguuuuauguucucucucucucucucuucuuuuuguuuuuuagagauaagguuucucuguguagcccuggcaguccuggaacuugcucuguagaccaucuggcuggcuuugaacucagagaucaggcuguuuuuguuucuggagugcagggauuaaaggagugugccacccugcauauuuguaguuuugaagaugguuauggaagugcuccuguuuuacauuuuaaaaguagccuuuugacuuacaguugugagcauuuuguuguuguuuuauuuugucuuuuugcuuuuugcucaagacaagguuucuauauguaacaguccuuggcugucuuggggcuccauuugcagaccaggcuaaccuccaacucagaaaucuuccugccucugcuuccagagugcugggaucaaagaugugugcuucaauugugccacuuuuuaaaaccaguauuugaaugaccuugagugaaugaccuaaagcuguuuuucuaauauaaaggauaauuucucuaaaccuuuuguuucagcuuaaagaaaauauguuuacgauugguggaaaauaaaaggguugaguuguuuuuuuuuuuuuuugguuugguuugguuugguuuuugguuuuccgagacaggguuucucuguguagcccuggcuguccuggaacucacucuguagaccaggcuggccuccaacucagaaauccuccugccucugccuccugagcgcugggauuaaagguguuugccaccacugccuggcaguuuuuuuguuuuuuauuuuuguuuuguuuugucuuguaguaagugugugacagcgugucauagugggcagccuuaucagaaguccuguuugagcuuguccuaguugagagcaugcagcuuugcuauggcuguacaagcaaggcagcagaaucauuuccuuauucuaacucauuuucuacucagaccaagaaggucuacaaacucuaaaacaaaugggcgaagaccaaaaggugaagcagacguuugagaucuggggaagauggcaguggaagaaaaacaccccugagcagcacaccuucugggaggaagccugggugcuuuuuaaucuuuacuguuaacaggugacggaugauauaggucuguagaguugcauuuguuugcauauggaaauggcuguaagaauagcuuucucucuuugagcauuugcaaaggaaugguaagacuaaaggagcaguguguagaggacuggucagagaagagacuggcuuagccagcccagggagagaagaugcuugaccagacggaagggcuaccuagggacucuggccucccucaguguggcagaggugcuuacuggucagguuuggcuuuuucuuacuguucaguccuuugauucugccacuuucagugagugauuuguuuuggauaaugagcaucucccaccccaguagcuccugacuugaaggcaagacagcucugcuguagauggcuuuucuagcugauauguguuauagcugccuucauucugaaauagaacccagugccugauugguuuaaaguccuguagugucaguaaugcccuaaaauuccuuacugguauagaguugauacugucacgcuccaagagaugcucuuacaguauuggacaccacugcuucaaagcuggggaaacuauacuuugugcagaagagaucaagacaccaugacucauuuugauggguggggguugggguauagaacauagagauaggaauuucucaucuugagugacccuugagauuuaaauguucuugcuugcccuaguuugcaugaacuaaauuuaggcuucugaugggcacuuugaggaggugugaaggccuuugaaauugucugggcugguaggaaaugaacagggaguuccagcagagccaagagagcugcaccccuuguccgcuguccccagcguauuuacaguagcugggcuuucugggaguaagcaggacccauucaaccuccacagcagcuuggaguaguagggaaccggggaaaggcaaaugcuuuuucucguuuucagcucccagaucccucugcuggggggcuucuguccugucugcuaccuuugcauuuuaauaggaacccaggaccugguauuuauugaguaauggaauuaauugcugguauauugaaauugaagugaaugaaaaguucccuguagaggccuuuggaugauaauuacugagaugauugcuuuuucucuuugucuuucucauuugaugauacugggaugguacccagggccuaggcaagcaauguaccacuggaccaccucccugguccuuggggguuuuuguguuuuuuguuugccugcuugcuguuuuuuguuuguuuuguuuugugaugcaucuugcuguguggcccagucuggacuccguuuuuuuuuuucagcuguuccuucaucccuuacuaaccugagccccgccccaugccccgccccacuccccauuaaccugagcccugccucgcuccccauugucccuuuuccagucucuucuuucaaaaauucuuuuggcagugucuuccacuuugggcuuguauucguaagugccuugagcccuaccugggcgucuauguauuuguaucucuucccuucuucccuucaggguuggugcuaacucauucccagcagcagcuaauccugccaugaaggcugggcaugcucuagaaaccuagaauccuaccugagucauugcuucuaggaugacaucugcaccugcagugcccugagugggauuugaguagauaggagugcuuggcuuugccuaguucugagagucccaccccuccuuucauugcuugguuacccuaucacccaccucagugguccaagugcccacugagccugcaccuacuucuuguugauacugcagagaugccaagcugcuugccuuuauuuuauuguauguccagucuguguguguacaugugcaccuguauauguguccagucugugugugugugcaugggcagcuauagguguguccagucugugugugugcaugaguaccugugcacuggguguuggucuuccaucuuucucaucuuguucauaacaggaugucugugucacggcugcuuaggccagaaugccugacucacgaguguccagggauuaucugccucucaucucauacagccgcacugggguuauagcuaggccuccggguccagcuuuacguugguucugggggcccucacacuuccauaacaagcacuuuacccauugagccgucuucccagcucuugcugguuacuuccuaaucugguuggucaggcuuuccacccccaccccuaaccacucuuagacuuuuuaguuuauuacuaauauguuuuuuuuucuuuaagacaaaguuucucuguguaucccuggaugcuucuacuucccaaauguugggauuaaaaguggcugugguccccuguaccaccacuacccagcuuguuuuaacaguagcucugaggcuuuccguuuugucugacuuucccccaacuccuaagcccggacaggguuucuuuguguagcacuggcuaucuuggaacuaguucuguagaccaggcuaggcacuaaaauacagagauccaccuaccucugccucuugaguacugggauuaaggguguucuuugacaccacccaucgcugcugagucugggucuuaugggauguuaggaaaacauuaaaauacucauacaugguggucguccauaccuuuagucucagcauuagguaggcagagacagcucuagccauccuuguucaaggccauccuggucuacaaagggaguuucaggacaagccaggcuacacaaagaaauccugucucaaaaaauaaauaaacagccgggcgugguggcgcacgccuuuaaucccagcacucaggaggcagaggcaggcggauuucugaguucgaggccagccuggucuacaaaugugaguuccaggacagccagggcuauacagagaaacccugucucaaaaaauaaauaaauaaauaaauaaauaaauaaauaaacaaacaaauaaacaaaccccaagaucuaacccgggugggguggcauccagguggccuugguccccugcagugcccaguagguuuaguccugcacugugaucacacuuaccuagcgugccauccagcuugcaccuugcagcucaaaugugugccuccuuucauggaauuccguccugggucuuguacacugccugauguugcccugugcuuguuagaacugccacucuguaucuugguccaucccagagcccacaugcccuguggucacugacuguggcacccaccuggcauaaaguaaguauucucucaagugugguguggacauggcugcccagagauuuaguggcugugguccccuguaccaagcuagugauggggucaggaagauuugcacagagagcccaacaguaggguuccugccaugggaagcccuguauuugagccgugggccaaagaaguaacuugccuucauguggcuucccagagaaacugcugaguaugcugagacucguugcaucugcccaccucacagaagucugaggugugacaguguucccucugugugacaggcucaguagacagcggaguggcaccacagcuuucucuccaggccuagugagcuccucuacucaagucacucuugacaugauuaauuuuuggaaauaagauauguuucucugucagucaacaaccuuaccaauccuuguauuucuugaacuccaguuaguaaaggcaagcauuguucaccuuuagcuagacuguuugagcgucaugagaggaguguaaccuucugcucucacugccuuuagugucuggcaguggauuacaggcucagcuagagcuccauggcgcucaucuuccugccucauuucuucacuccccugucucuccguuccucuuguaaaaugauccugagcugacuuaaguucaccuccaguaauaaaaguucuuaauguucuugaaguagcccuuguaaacugcaggggucugcacaggucauaugguuaggcucaaaauuugguaggucugccaguguggcuagcagcuuaaagaguuggguagguuuguuuguuuguuuguuuuuccccucaagggacauucaagguucuuauaagagggcuuccuggagugagugacgugggaaagcuugccacaguuaggcaccccuccuugagacaguggugcuugggugguuuuccuguaaaaacagaggaaccgacucuggagaguucacaaaagcggggaauugaugggggggggggggagcugcccuuauguuguaauuuuagaaggaacccacaucugcucucagcuucauuugaaugagaagagagcuuauacaucugccagccucagagaaaagucccuaaguccccaccacuggacagagccguucacuguggggacacucccacucugcagccuuccucucucgacagcauuuaacagaagccucaguagcuuuucuucucagacaggguccuaggcaucccaggcuggcuacgugucaaggaugaccuugaaccuuuauccucgaguccacagcacuguauuauaagugugagccgaugugcuggguuuaugucguggggguggggugggggguaugaauggcuggcccucuaggcuagcacucugccaacugagcugcuccacacccccaggcccuuuaacuuuuugacacagguuugcacuguuuugcucaggcugcuccaagcucacaauccuguuucagucuccgaauuccugagacuugagucauauuccaccauacuugacacaucucaagccucuucugacaaucuguagauucugaaugacuggcaacagggccauaucucacaggaugccuuucccauucuaagccugagucuaacgcuccuacggcuuuggcauaggucacacugcagacacuguagacaggccacucuugugagugagggcugcucagcuuugugugugaugguucacuuccaagugcucaggaugcuguuuagucugugacuggagcuuucuggaccccaacacucaacuagcuagcaacugcuuuaagaccugagcccugcaguguguaccaggagucagcauuagcuugcuggcuaagugauggcucuagguuuucucugggaaaaauacgcauguucguguucuuuucauccaccugcaaguccaugccaggaacgccugaugagccaccagagaaggggcuuuggggaccaaauggucucauguccuuaacaacuccucucucugcccagagcugcuuuucuauauauggagacgccugggcuauggcuguggcuuuuguggcugaguggcacugcuuacagaaaggaugaacuggguucccagagucauucugaagaugcguuggucggucagagagaagcuccuugccacaucucugucuccaaguaguuguacugugcucuuucgucuuuuucauuggaucguacggucacaccguuuccuuugagaaagcauuacauuugguuguuguguuguguguucaccacguaugaagucagaggacacugaaucagucgguucucgccuucuaccucguaagucuuggggauggaaccugggucaccagcuggcaggggugcuuuugcucaccaagccaucucaccgccuagcacaccucuucccaaggaggaggcuuacuuaaaaaugacaggguuucagccaguagcuuguuuuuguucauuuugagcagacuggccucuugaaagacaugugcugcugcagagguaccuacaagaaggcacaugccagugacuaccccaagugacagcucucuucagaggugugcuaccuaagggcaucucacauagagucacuucugagcacagcuucauccaguugaaaaguaaacagacugcacugagugcauggcagugacccaccccaaaggagcuguuggggucuuuuccuccaguguggguugugucugcuuugcagucccaguagggugucuuuuacucccaauaggaugaaagcaaaauagacccucccugagcuaaaugugugugacuggcuuugcacuuaagggggaccugggagagaacggccaauggugauggaugcuuuuuucaucacacacacacacaaguugugugugucugugucugugugugucucuguguccguucugucugggugucuggauacagguauacauaugugugugccggcucacauauaggccagaagagggcauaggauucccugcugccugcguuacagauaggagugagcuggcuuugggucugggcacuacugcagucuugcaggagagcagcaggugcucagugcuccuggggucucugccaggagggcauuuucuuguagugauuacuuugguuguugcucugccuuuuguguuuccucugugauugagugagaccccugcugggauugcucuccagugccugacuccgacuccugccaccuugcaggugggguggggcuguaugccgcugaggaggaagcuauccucguggcagcccuaguuucagcaggugguuuagccugaucugaguaccagcaggcgcacaguucuccagaacuagagaaucugcugucucuugaagcuggguuccaaaggguucuaugucccaaucaugugccuuccuagauugccaucugugccagggugucccugacaagacaacagugcccgugggucuguaaagggcgcagagauaagccagucuggagacaguuucagggcacagcaucgacuuuauugcaugugagcaacuacuuacauaguggaagccuaauugacugugauuugaguaaguuaccucagauuagauagugaguguucauaccaccagggucucugugcauguuagagcagcucuggagagugcagucugggccacagccagcugcugcugcucaugcuacuucagaauugaguguucugaccucaugagaaaugcagugugggaggcaggcuggcugccagcucaugccugcuccgucuccuguguuucuuucucuuggguaaauccuagcugugucugugccauggacgguuugcugcuuucuguucccagcauagggagcuguccaccucugcuccucucucuuguucuucuccccgccacugagacugcucagccgguuugagugacagcauugaagcuggccaggagcagauggcagauucuguuuucuuguuuccuccuuuguaaacuugaaccaucucuccucaccccaaauaaacccaucacaaaauuaaucaaaagcaguuacacugcagagggaaucgcugugagacgccaaagguuagcaagcaaaggcuuuuugugaagggcuguucuucagccuugcuccacccuuguuggcauuaccguggucuugccagugacacuguuggaaguuguugccuuugaaagguagaggugccuggcuuugguagagaggccucaggagguaagggagcggggcauuucccagccucuguugccaugcagcuggagaugggugugggccauccuccacaacuuccugucuucagugugaggggguggcgguucucuaaccacugaagaacuguguggaacaggcuguuuauuuacugggcaaauggggcccuaauggcugccuuuggcuaaucgcuacccuuuggcaguguccauucaguguccggggcccuucugggcagagcuaagcuucccuuccaacguuugcagacgcucuucacacugguguuaguguagacugaucauaaaggaaacgaugaguguguucguggucugugcuaauuuuagucuucuguucacagcccauuuuguguccuucaccauuaaggcuccguuucuagaaagacgcguuuugaauguagggcacugccuguguucuacccuuggcuccauuucagggguggccuucucagugcucugagguagugaccagagccucccagguaggagccugggagauuguuuccacacccacuccuuugcuuagugacacucugcugucccugcaagucacucugcuuugucugaagugugggcucucggcaaggcugucaaggucauugugcagugugccacacacaggcucugcuggcugccugagacgccugccuuagcauaugggcacuguucaucuuggcuucugguuacucuuagcaggacucugcaugucaaagcuuuagucucagucugcauggcugcccuucauuguccacucugagcagcuacuucccaaggauggaagauaccggggucagagucuucauuaccuggcugcucgugggucuuuaaggaguugcauaggguccagucugugacauguggagugaaaagaacuggcuugacggcacaaccugcaucugaugcccucaacuccuuaaucccuggaagagcuagaagggggcuggcauuccugggagaauggaaggaagcuuugugucuguguugggcuucacuguggcuuuguugugauccugcucagcuacaaggggacacaaacuuuaaauuuuuguaauaccccaguuaaaacuuuaagaaccucuguucaucuuuagaaauagaaaaugcccuuugagguuguaaaugagauguauaauuuaccaagugugaaguugcuuuugagagucuugucuaaaguggguacuguugguuggguuuugccaucaggccccagcuuuggucugccacacucugcuuguucaacauaguacccccugucuugaguuagguuugugcucaaguucugugcaguaccuucauaccccugggguccucugagugguagcccaaugguaggucuaugauagggaguguuugcagaagacaguugggucauagagccucaguguuuuucaccagcuccccagugacuucaguccaccuucccagcuacugcugguguggccacugccugagcucacauguacacagcuucccugggucaucagggugauuggauuguagacuugaccuuugccuggcuuuguaaccuccuaccuagaugucacaaauggaccccccaccgucauuugcuuugucugugugcacuguguaagacuguugaugaacugggaggaagcaccacacagcuuagaaccuggguccugcugugagaccucucuuggccuugguccuggagccgaucgagggucacuucuucuuuggaugaacaucaugucugcauucguuacuugccucagucccauggccuuaugcuguucuggaugcuguguggugcugaucccuggggcccugaaccaugcauggcaggcugcguuuuuucaagguugguguuaguggugcgguugaagugguguuugauuuggaacauggcugguguggugucacaaacaaaaucagagcauagaggugaaggccgguggccuaagagggaucuccugccugaaaaguacagaguagaaccacccgaggcaaggcaggccugcuuuccugcugccucauucuuaguccuuugugcuuuaaaggaaguuggaagucgccaucaccauuuuuccaccgcagacaacugaaugugauuauauuuuuguccuauguucagcuauuuccaagaacccuuuuugugugcaugugguauguuuuauagucuccuuguguaacccagacuggccucgcaucuccuuaucccucggucuccccaguucugggacugcaguccuguguacaugcuugacuuccaggaaccuuaguugaugaccaggcuggcaguugaauccaaugggccccaugggaaugaugaaaagaaaaaucugcccaaguuugcuuauaccgagaaacggucgacgcuuguuuuaaugccugccucacucuguggcuugguuaggaagggugcuacguggccggugucugagugugugcucaaugauucuccagucuguccccucugucaagggaugaagucagagagcccgggaagacuuacaaagagaguguuaaaggcaacagcagucccuuuagggacuuaugggacgagcuuucucuggaacaccuguaacucauacagaugugugugcacuacaagaaaaaaacggagccauaguuuuuggcuguucuuuacccugaacaguugggcucuuuguccugcgcuuuguaacuucccccacaaagccgagucccugaaggccacaaccaguuagcacuggaacacucccuacgcugggcagauggcauggucacagcucagggccagggccaaaccucucucacugcucucuccuagaccuaagcccuugcuggccagcaucugucaggugcccagcagccacugggccccagccucugugucaggcagaggcgauccaggagcucccugcccuuagaagcuuguaguucaggugacagacaucccaggucacagugauaggagcuuuccucccacagggagccaguaacccaggugcaagauaacaccugucugucugucugucugucugucugucugucuuuguguguccaugcacauuucccuugucuucuuuuuaucuguucccucugucagggugacauggagguuguaguaguuaaagaggguaggcagcgcacacuauagacaggagcucugguguucauugugagaaaguagcuucuccugcagagaaugacguaaagaugccauuaaaaaacagccuagggcuggggagagggcucagcagguaagagcacugacugcucuuccagagguucugaguuuaauucccagcaaccacaugguggcucauaaccaucuguagugggauccaaugcccucuucugcugugucuaaagauagcuauaguguacucauauaaauaaaauaaauaaaucuuuuuuaaaaagaaaaaaaggaauagggcuuaaggauguagcuggcccagcaugcuugaaguccuggguuugauccccaucacuguguaaaccaagcaugguggcgcaugccuaggaucccagcucugggagguagagguaggaggagccuugacuacacagugaauuugaggccacccugggauauguaaguuccuauucuaaagaaauaaguaagcagacucuucagacacuagcugucauacuaagaauaaguugaagauguuuggccagcccugaucugcagcaggcaccuagaauaaaggcauuauuuauuuguggauuauaagggauauuuuuagugauguuggcuaguuuaucguauggccuguuuauuaguaguucuuguuauccagaucuuugagugauguucaagucuaguaccuuguaagaggauuuaagaucagugauaaccaggcagcggagguggcacaugacuuugaucccagcacuugggaggcagagacaggcagauauuugaguucaagaccagccuggucuacagagugaguuucaggacaacugaggcugcacagagaaguccugucucgaaaaaauaaaacaaaagaucagugauaaucaucuuacuaauucauuauuauuuuuauaauguucuacaugcuaggcaagcccucuagcccugagcuggaucccuagcccucuuuccacuugugucugugugucugugucuguaggucagagaacagcuugcaggaguugggguuuucuuucuacuguguggagccugggaaucagaugcagguugucaggcuugguggcaggguccugauugcuaagcauucucaccaaugcccaaguucuguauuuuagacacagagucacauuauguuguccaagguggacagcucaugaucuuccugccucagccuuuucauguuucagugcuaggauucaagcacaagcugucuccauggaugccaguucucucacuuuaaguggcugaguuacagacuuuaggauuacaacuugugagacuucugugguuaaguacauuuaaaaacaaaaauuaccucacguagcuguggauagagcacugcuuacugccuguuuuuccaguuauauucaucaaacuccuaaucacauaggaacaguccaaacuaauuaucugcagacaccauccuugugaaaacacuggcuguuuacuuuugggguggugauaguaugcauuaggcagugcucuacuacugacuggugcccucggcccuucuucccuucuuucaauucugguuaggaacaucaugcagcagagcccaggcaugagcccagcacaucacacugugugugcugagaauggaaccuggcgucuccaugucaggccagugcuccaccacugagccacauccuuggccaacacaaguaguuuuuuaaaaauaauucuugagcuggacaugauaacacacagcuguaguuacagcauuugggaggcugagacaggaggauugugaguuugaggccagucuagguuacacaccaagaugcauucucagaauggcuugaagaccuccaagagaaggcuuuucccuauggguggaugacagcguaagaacaggcagugccugguuugucuucauggcugaugagugacuuggaugggacugucccauuugguuuucugugcuguccuuuguauguccaaguauguaccuuaggguacacaugggaagcacaguggucaagcccugucuugucucaagccuguggaccugguuguugagacacaggugucuguggucaaacgcuagcaccaggcaagcacuugucagagagcaguggagaugaagugcacaguacaagcugccucacaacuaguuccuuaguucugcucugcuaggagagggaagcccuugaggucggggaggugcagguuugugcacuugccccuccuaugugcuuugggcucucuuaaguugcugugccgggcacuuuagcuccaggccuugugauacuuuaagcauaucauucucugcuccuucacuuuaccuggcucauggccaguccaccugccuccccaagacugcugcaccacccuggacuaucucagacugacccaguccccugguaacguggugucccauggguccugcuacaccugccccagccuuugaaauccucgaagcccagacggcucacagcucccucuuccaugguccuuaaucgacugcuccccucuuuccggcaugcuuucuccugacuccagguuuccagcugcuccuuucuugucaagaccauggccagccauuauuuuauuguauuugaaauugucuuucuguguaagguagcucagacugucuucagucucacguguacugcaggccuuccugccucggcuucccagguccuguagcugcagggauauuuucgcagucgauuagcgcugugcgcauuguucaccuuccaguuacuccuuggcacugggacugugggcuucauguucccaagccgcugacaugaugucuggcgcguugcuccccuuugcuagcuggcuuccucuuugauccgucgguggacacuuuaccuuacacccugagccgggcagcguuuagugugcuugaccuguccuuugcuugcuugcuugcuugcuugcuugcuugcuugcuugcuugcuuguuugcuugcuuguuuugguuugucugcuuguuugggacaaggucuuuuuauguagcccuggcuguucuggaacuggcuacaaagacaaggcugcucugaaacucagaauucuuccucccucugccuccaagugcuaggauuaaaguugugcaccaccaugcccuguucuguucuguccuugaccauuguuuggugcuggggagugcacucuuccugugucucauaggcauauuagcuaagccccuaccaagccuggaaacccuuucugaggaagaacuguguaacaccugcugguggugacucuagcagaaucuugcaugagccuacacuucaucucagagggccuguccaggccauguugaugcaugauaggacugaguuccuccucgcugcucccccugacaugugcaugacuugccgaucuagcuuuguguuauagggcacugccagagagagagagggcaucggugggagccaggcugagcugagaggaaguggaggggcugagucaggccaucaggcugcaggaagcagcuuccuuagcauaugccucuguggcuggggagaagggagucguguguucucagcguuaggucauucugaccacguugcuucuguguuuucauuugugugguauuuccugagauucugaucuugccagaaagugcccagcaaaaauucuggacaagugagguguuucucugcauugguaccuaacccccucuugaaguguuauccugguccagcccugaagaccauucagggcuugguuuuuuggacacuccuuccccuuggagcuugugaaaugaguggugugguuugaauggagaaggaaggcccuagucuguccagggagucuggcuugucuauccuggcccugccagucugcugcuccugugcagagaguugucuggggugcuuaagccucagugcauuucacacaagggggcucacuccugugugaaggugauugaguuuacagcagaggcauuuguggucuucugugggaugagcagaacuccucuggugagugacagcaggagacagagaagaucgacuaugaucagagugcacagagcaggcuuguggccuaggaggaggcgucugcccugcccagcauccucucugugcagcucugcuacuguggagccucaagucuccauucuccccaguuugaaggggacagacacugugcccaggcugcugaugugcccagccagcaagaccaagccuguagcuccccagaucuguguaaaaacagagcuuugaaacaugggcccaccuuucuuagaguacaggcugaagguuagaaguggaagagaugagaauggaguggucacaggacugguauggaggcuggugggguuuccaauguauaggucugggcugggccuaugcugcuauagccacugcaguggccacuagcaguugcagacaugggggaaucuuagggcuguuucccuauaagaaaacaagcaugugacauggcccugggcuugguaacccagcucuguggcuucucccugagcauaccuugugaugccgcacaggcugcaggcauucuggucugucauggcuacuacuugccuccguguuuagggacuuucuguaccugccagugcccacugaagaagauggcaaaagcaagcaugagcuuguaaccacagagcugaauaaacacuggaaaauggacgauaguaaccuucagaaacacuuguuuuuaaaugucccugaguaaucaguucuaaacugagagaggcuuucauaaaaacuguccaggucucagugucccaggacaccuggcuugugagguacacagcaccuucaauuguaccugggucacuucacagaagaguguugagauggacuuuccuuagcuggcacaggcucagaaugguaaccaugcgugacaguacagacaguucuccguggaugugccacaccucaggagcucggaguuugcuuggcacucagguuguguuuuccuguagacacugccggaaguuaguuacaugcacacccugcacgcagcauaaaguuacauaaacccccuuaguuuaccugaagcucuauuacuaucacaugacuucauguggcaaugguuuuuaugaaugaguagcauugggguucgccuggaggcuuaugucugccugccccuuuccaggcuccuacgccacuggaggcaaucuuucuaccugccugccugccugccucccucccucccuuccuuccuuuuaagucagucugaugcugagggauucaguaggacagagugauuugggcucagaguaagugugagccccagaacuaucaucaggcuagagucauggggucuggagagcagcgacaggcagcuagggcgucuucauggcuucugugcuuuauggauucccagguaagagcccauuggguguuugccucuggucuacagagucagucgccuauuucuggaccgcauggucuucuguagcagccugguacagugucaagugcuuugcaggguucucaugaguaaugcugccugccgugagggccgugggacccaggugacucaucgcagacaugcaugaacucggugucacucgcaucccuggggagcauguugcacaagaagcagcuuuuagcugcagcuucacugcccuccgagguuucuaacuucaguucaguuuucagacaaagcucauugugagaggccaugaaccuacacaggcacuucuacccaucaguguuggagagcaccugugucagagugcagcaaggacugacugcauaggucucugggcaguagcuguccagugucagauggcuccaugucagccucauuggcuuugggacaaggacuagcaagcaaccuguggcaauuugauuugucacuucaguguucauugcccccuuccugcacuuacaaauggccuuuaucccaauuggccaaaggugucugugggagccacccuaauaggucaugaaaugcuaguucguacaggcauuugguccguagauugacaucugcugcuucacugucaauaggugaggacacuugugucuacccagaagggaaaguuugauggcugcuucugaagaggccugccugggagugcugcaccaagacagggcgcuggacuggcuuccuggaaacauacguuguugcuaaguaugucuggcacagugcgauggaagauucuggggcuuuuucuucacuuaauaguuaugaucucagaaaggguugguuuaguguggaagcugugcuauuaaacagcuuugagcugauguuucccugugagccugggucuuuuccaguucauacaaguuucucuggaaaaagucugugguccuaaaaaucacucaaguaccaagccuuuaaccugugaaaacaucacauuucauaaaaauauacuagaagucucauguccauaagauauuuucaagauaaaguuucucuguguagaccaggcuggccucaauucagggaccugcuugccucugccucccaagugcugggauuaaaggugugcgcuaccaccauccagcuauuauauucuuuuuaaaguaugacuucaacucuuuuauuuggagagugcuuuguccccuugaucuuuguccugcauugaggagagcccaggacacugugguguuucugccuagccuuggccacacuaacuuaaagucaucaucucuucauguauccucagugccgguuaguaccucucuuccagcuuucuuucugacacugaugucccagagcugugcugguggcuaaugcuuguggucuuacacugaggaggcugaggcaggaggguugucacagguuugaaugaugccagcucaggguaucagacccuguuucuaugcccauaucaaaacagaaugaauauccacaacuuccagccuucacuccugggaagcccuucucaucucugggcuuuaguccgucucagcuggugcaagccuuugcuccuguucaucacuaaugugcugugucgcuguccagacauuccaguauccugucucugucucugucucucucucucucucucucugucucucucugucucucugucucucucugucucucugucucucugucucucacacacacacacgcacacacacacacacacacacacacacacacagucuccucgguagaggccuuagcuucacauguccucugggccagcaccacagacucugccucugcggcagucccugcccccaugcacugaaugggaguuuuccccauaguugcauuuuaacuugaggaagcaucuucuuuuugggaguuauaguuuuaguugcaaaaagagcagcugcacccugauugggcguggggguggcuguuguccaugcugaacucaccagaacacuuuacagcaccuggagugucauugcuccuccugccuagcuagcaccaagcuguauagaaauuugggguuggcuuuggcuuuggcuuuauacccuuugcaccuggugccccugcugccuggccuggaauccccuguggacuugucaccacagguagccuucagguguuaacugcacacugucccucucccugucaaaagaaaaaaaaacucuuuaauuacauaauugccaaugccacagacagaauauuucuaccacagaaaggagugaggcaguuuuuuuccaagacacuaaguggucugaggccucuggcuggcagcuaguuuaaggagggucuuuuagguuaauuucauacagucuccaccuugugacucacuuuaagagugcugcaugugagacaggauaccucuguuucuggagucagucagcguuucaggacgcaaagcuucuaagaaccuuucugacaguuacucugugaucagaguuggccuuuccccucagcauucuccaugucaucugcaaguucaaguacauguagugggcucccaagucacucacacugcuccugacugccuuggcugacagugugcugaccagggccugugccugagcucccgggaguagcucacggagagacggagguggacaggccgcagagguggagcggcugcuggagaggaacacgugaaucacagcuuaggcucggugcuguucuggggaccuccgagcacuugaguggggccugggguguagaguggggcuuuucuuuagaaguggcuucagguggaauccagggaaggagggcaagcaugugaccugagacucugucucugagcguuugccuccugacacaccccucggggaagugacuuuaguccucuccuuauccagauguuuuaaauguuaaggguuuucuuagacuaagcuaauaguuugggcuacaguguuuauauaccucgaguucugucaaaagccuuuaccccuguuaaauauuucuuuuuuuucuagucaguuggugguggcacgugccuuuaaucucaguacuuggggggcagaggcaggcaaauuucucucuugaguuugaggccaaccuggucuacaaagcgaguugcagaacagccaaggccacacagagaaagcccugucuugaaaacaaauaaaccaaccuuacuuucuucguagacuucaccgauccuguggaaagagaauaaacccucccugacccccgucacuccagcuacucacuggagacauuuuggguuggaaucugccacuaagauuuucuuucuugaaguuucagugaggucacugcagauuccuguacagcugugagaugacgcagacuucucauacccuuucuccucagccugcugcgugucugugaaacugcagcagggccagaguguguaaugcauuuguauuugagaugaucccuacuguagcucaggcuaucccggaacucauguucuucccuagccuuccaagggcugacauuucuguucccucgcagccgggccugguggcacaugucuauaaucccagcggcauucaggagagaggcagcaguuacagacucucagcucgucaccauucucucucugugcugucuaucauccugugcaucccaguccccugccguccccugggcucuuucugaugucauuagaccccacacacucccugaccgagcugugcccauaaauacuagcuccucuggguguguauccuguauaggcagcagagauaaaacgccuaauagccgugugugcugguccagccuggggugaagcucacugucauguggcaagagcccagagugauguggugcagucccugagcaugcucgggcaggggcagucccugggcccuugguccuguacuugaaguuuccguugaacagcuggaccauggcguuuaguuaguuuccucccacugaugccagccuuagucuguugggacagagucugucacuggcccucuguccuacagaggcuacccggcagccacuuucagagauaguacuuuuuuuuuuuaauuuaucuauuuuuauauguaaguacacuguagcugucuucagacacuccagaagaaggagucagaucucauuacagaugguuuugagccaccaugugguugcugggauuugaacuuggaaccuucggaagagcagugagugcucuuaacugcugagccaucucuccagccugagauaguacuuuugauuucacuagccaaucuugauaccuucccuuuccacauagugaacuuguggccacagguggucuaccuccucgcugaggacagggaccuuggccaauauuccacagccccacauccccacccccacacaccccgucccucaacacucggcccaaacugaaggcagggaaggaaauuggugucaagcuugugguccucauacaugguugcucuagugagcccgggggcugcaauucccugaucucagaagaagcugugaagagggcagugcagcacagcagggcucauagcccucgugggaccaugcuacagcacugguguuccggaauuccuguccacccuggguuuuaggaggccuugguucuugauaaccugucucucugaccucuugggcuuuggaggaaaaguagugugugcacgucuucauaggauguucaagccacaguagcugagaggguuggaagugaccugcaggaaaagugacaagcagugugcacguggguguacguuccucuggaauuuggguuguggcauuaaaauguagaccaauccuuaaagaagggucuagcucucaaaagcuucugcaggugauuauaugucacuaguagaggcuugcugccuguccccacuguaaaaaaaaaaaaaaaaaaaguguaugaguauguguguauguauguauauauuacacacacauuggcccugcugcaguuucacagacacgcuggcugaggagaaaggguaugaaaagucugcgucaucucacagcuguacaggaaucugcauauuauauacuauauaauuauguguacuuauauauguauguauguuuuuugagacaggguuucucuguguaggccuggcuguccuggaacucaaucuguagaccaggcuggagaaaaaauauuuuuugauguauucgccuuuaaaaaguccuaggguacauacuauagaaggaccagagggacagaucuuggaagaaucauucauuuuacugcacaguuaggauauuguaacacagcuaggaggcuugaggcuuggcugugugcugguguuguuugcaauaguacucuggauguagauuuaacuccuuuuguuaguuugaggcagggccuuacaaggcagcccagacugagcuuggugcugggaugugaauguggguuguuguuguuguuguugugcauuuguguguguaugcaugcaugugucacagcuggggaagucagaagguuacuugugggaguucauuccuaucuucacaauuuggguuccaagaggccaacuaagguugucagcaccuuugcuggcucucaccaggcuucugaguguagcuuuuuaauuaaaggcacuuaguaaaauuuguuucccuugaggcuagaggucacugucauggugcaggguggagggagugcgugugcaguucugugcccuaugcacacauggaggccaguugaggacauugggugacccgcuugaucacuacccaccuauucucuugaggcaggguccccggagucauccugucucuucccagaaaggguccugaugucauagcacauggccauaccgaccuuuuguacagugcugggaugcagcucagguccuguacucagccaacaauucaguuaccauucggcuugaccaggcuuugccacugcccggcccggcuucccucaauuguguauugaacuggaacuggagcacuucguuaggccugugggguguguguguguguguguguguguguguguguguguguguguguauccaucccuagcuggccuagaacucacagaaaucugccugucugggcuaugauuaaagaggaacaccaccacucuagccaauucaacauuuaauaucuucuuauauuuuucuauaaguuucuacacaaagaagcacaguugagaugaagauggggcagggccacugccuaguuucagaauuuggccuggaaucauuuucacuuccaggacaaccaugcuacucuguagaucaugaaauucuuuuuucuuauguagacguuaaacacaguguuuuggaggcagaggcaggcagauguuccagugaguuucaggccagccaggauuacacagugagacccugucucaaaacuuucaauuuuuuucuuuccauuaaaauuuuuuuauguauaugaguauuuuuucugcauaugugccagugauaugcacaugcccuugguagccagaagagggcaucagacccccuugggaccugugagccucugugugggugcuggagaccaaacuacaagagugguauuuuugaccacuuagcuaucaccccagccucagcucugccccacccagacacacaagacagggucucacuguguagaccaagcuugcugucaacuuacagagauucaccuggcucugcccgugacuacugggauuaaaggcaaccccauuuaaauuuucuugcauuuuaauaucccuauuuuuuuuaaaucuuugguuugcuaaaauuuugaaaagaaugaauuuauuccauaacauacuucguggcuugguuugguuuugacacaggguccuccuggguagcucaugaacuugacauacuucugucuccuuguaauguugggauucuuagaguguauacaugccugacauacaguccuguguucugccuagacgugaaaggucaccugcacuucuccauguaggcugacagcugagaucugaagagucucuuccuggugugggcacagugccaggcugcgucuggauggccugaaggaacgccugccuguguggagccucaugccugccugcuugcuuggaauagaauagccucucggucccagcuugggacuuuauuuuaaagacuuacuuguuuuauuuauaugaguacacuguagcugucuucagacacaccagaagaggauaacagaucccauuacagauggcugugagccaccaugugguugaugggaauugaacucaggaccucuggaguagcagucagugcucuuaaccccugagccaucucuccagccugugacuucauuuuugugguuucacaaauccauuccuuccagugcuaucaugccuucaucucugugccuccuucauccuuggucucucacaucagguaggaaagcauguggccucuagaagaagguggccagugaguaucucauaugccuuuuucuugguucugguuagcagagccucacacagcuuuccagggacuugggaaaaucuugaccaacauuguuguguuuuagugagcuguuuucugcucguucacacugcuaaguaugcagggagcauccauccauugcggaaggagagcacugucacuucagaucagggaugucacugguguuucauguggccucucccuugggaccuuggaaggaggaaacacagugggcagacugguuccugccaggaaaauuguagauauugcucuugcagaugccugccaauuccuuguuagucaacugucccacugucccccggcaggcagccaagagccgggugaaguucuuacuggccugauagaaagcagaagguaaacaaaacagaagugaaagucgauuuuuuuagccaguucucuuacgggaacaguuuugugguucucagcauuuuaguagacacugguuccaauauguuugauugacaucaauuacuguaagucugauucauuuucucccuauugauuucugcccaagguggaauucaugacauuuaacagaaaauguaagugaugucuuuaucaagggcuguaaaaauuagggucaaagccagggacacuugcaagucuaacugcgagugugucauccuaguuacccguguaaucuguguaaggugagcggcagcccgacgcucuggccugccacacugaacucagaaugcugcuucuaaaugcagugugggccagggucacuucaccagugugaagccauucauucauauccacgcucccacccccagccaguucagccucucaaagcuguuauucucagugcuaaaaccacaucaguccuuagggaccaaaagucauuguuaacauaauuauguaaguggcuuguucuuguaaauggcuugaggucaucagcagugacagaggucacuuugguauuuuuaaggguuagguguuuugagcagcuguacaagcaggaggacuguuagcagcacagugcugaagcccuggaguccacucugggagccucuccgaaacugcugcuucucugaagccauaucaccaccgcccacacccacaccucuguuccucucugugacugcagcugcagccuggguauuuugccccuguaguuauucaguaaaccaggugugcuugugcagacucccagcgcuugucugcugggauuauuaguucaaggucauccucagcuucauagggaguuggaggcuagccuaggcuauguaauauguaaguaccugucucaaacaaaacaaagcaagauacaaagaaugaaguauuguuuuccauucaaagacagccucuggugaucuaucuauucugauuguucuuugcuccacaaaauuuuucuuucuccuuuguaguuagacccgguuaauaaaaucugcugugcacucaccacucugaggugcuuacacacagcaucuuaggugagccagagacaagcgugugugcucucagccauggcugcgccuggguuccaggaagugcuugccucucagcccccacugcccggucuaucugcccuuccuuccuucagucucucagcugacuaucugagaaucaguauuuucccacacuaucaaguaacacgccagccccucaacucagaugccauuuagagaggagucgagacuggccagugagaggaacuugcuaguccccgaauucuacuuacaugugggguuuuuguuuuucauuuaucaacaacuucacacggauguauuacauauguuggucacuuugaccucucagugcugccuggaagccccuccuccucccaguaagacacccuccuguuuccauguuguggggauuguuuugcuuuuguuuuuuguggucccugaauucccaguguugcuugcaugagccugggugggggcuggauauuggaaauaacagucagugcgguagcuguucuccauucucugcuucaggaucuguuuuaguaaccaguuugguauuaucuugucaggagguugugugcgacaauugcagaagccaaaccaggccccaggagugugcguucugcagcaguuaggaugggcuugauggguguucucggaugcauguucccucuggggcacuuccacccugugccgggaagcaugcugggauagagucaaaagcuguauacuuacgguauuagcaucagccuuucggucagucgcagguuauguugagggccugcccuggccugggucugagauuagaaaugagggccucucucuuaauggacaccugacugcuuucaggaagccauccugcucugcccuguggcagacaguuuuaaacaaauaaugcauucuuccauggagcaagaagaagucauucacugcauggaacuaaagcagauguguuaaagccagugcugcuguuugacuuagcaaaguauucugugaaaaucuggaggcauuucuguguggcuggacuggauguuaucccuguuuacuuccaaaagaaauagagaucucagucaaggcaggucagcugcuuugucauccacguugguauuucugacuaauugcaugugagagacacuugaaucagcuucccuaaaugcaaaaauaucauucugcuuauuucuuguucauuuguucuguuuugagacaaggucucauuauguagaccaggcuguccucaaacucacagcaauucaccugccucugcuccugacugcugagaugaaagcuaugcagccuggugccagggaucauuuugauucuuugaggugggaucuagcuguauagcucaggcugaccucagccucugaguacuggcaucacagauguccauggccaccaugacuggcacucggaccguuuguguccucucaccauggcuuuaaugcuagcuuugugaucaguucacuuucucaguucagguuuuuguggagucaugcagcuggaggcucugaaggccugccaugcauaccucguucucaugcagauucugacgcccuccuucucccaucucaauuggaauccccuguuggcuagcuucaggucagauucucaugucuuggggaguaugcuggaaggcggcuugacgcugcugucuuucucaugucggcagaaggaagcguacagucaggcugugcugcccuuccaccgugaacugccucucaggcucuggggcuacacaguccagagaagggguuguuucucugcuucucaugggcacuuggugggacuuucuauugucucaguaccuguaguuuacuauauuuuacuuuagcugauuuuuuuuuuuuuuuuuuuuugagucagguuucucugugcagcccuggcuguccuggaacucacucuguagaccaggcuggccuggaacucagaaauccaccugccucugccucccaagugcugggauuaaaggugugcgccacuacugcccagcuuuuuguuuuguuuuguuuuuuguuuuuggcuuuccuuugggguggcugguguguguguguguguguguguguguguguguguguguguguguguguguauguaaggaguucuuuaucuuuucaccugagcuugucauuuuugcuauuuuguuuuacauuacaaaagacauuuuuguuuaguuugucauagcauccuguucuuacuugcuaauaaauaugagaucuugagaugugaguguauuaguaguauuuauucucaguuuuucugaacuccacaguuuguccaccgagggcuucuuuucccuguuagacacuuucuguguauaucugccaucaguggcaucugugucuggagaguagaggcccucaggcagauggagcacugagcaaaugggcacgcccugguccuggccuuuggugcuuccugcugucuggucagaucaucugaagacuuccgccuagaauggaaguggugcuacagcacacucugugugagcuucugagaugaaggaaggcagggccugagcuugggcucuacagcuuauuccggcauggaugggccguccaccuugcacgugcuauacucuagcuagucuagaggccuggccaacucuuguagaaaaucaaagucacccugugauuucagcacaaguaagagcaggcccagcagcccagagggacggcucuaggaggggauggcugcucugcucagaggaggcucagccccugccccacugucagucucacgcuuucuuccgaggugacagcugcccacacucugcaugucucuggggucugauuucuagauagacuguugucgccauggcccccuuuucuguccccuuuuuuacuccaaccccagagucaagaguuuaaaccacuuguagacauacaguuucaugguggcagucuauucacagugugcuugugcuugucguagcuaaugaaggagcagauugcugagggagguugugggaugggggcuugagggguaaccaggaagugggauaucauuugagauuuaaacaaguggaaugauuaauuuuuuaaaauuuaaaaagaauguaagaaaaaaagagcagauugcucccagacagcauccugagacuggugacagcccagcaagaacagggugagccuauguggugcuucuguucacgcagggauggguguuugccugcaggacggcacuugggugguggaguguuuauugacauguuccuuuccauggcuguuccaacucucaggucugacauuccagcacuucaagaucuggccugucuacccgcucccacagccaucugcuguucuucccugccacccacucacucauucacauaagccugacacaaaccccugcuuccacuagugggccuucccaaguaguccuuguauguaccugugcauaccaccuuguccuccccacacuucucugccuucgguacuugccaucaucucuggugcuccacugaagaucugaauacguuccugccauagauuccaaaagagaacucuuuauucuucuuuguaggacauucgacaugaagccagcgacuucccaugcaaagucgcgaagcuuccuaagaacaaaaaccggaacagguaccgagaugucagcccuuguaaguacccacuguuccaacugccccacuuacacuucccagcggcagccugucguuguccagggcuggguagaguccugaccucauggucuccaucauaagcacaggagacacugucauagcucacuuucacuguugcagaaggcacuaaagcuccaguuucuggaaacggugguggcucaggguccuuccuuuuagcucuguguuguggugagucacuuuccucccucgaaguggccugacaugggcuuaguggacagccucuucugcaugacucggcagcaaugguauucacagguacucacgccauuccgccagauguguagagccagccugcccuuggcuuucagugcuuaggacuggcagugcccacuggucuaauaagccuaugccuucuaacuggcuuauagucuagaaacacauucagagugaguaaguggacguguagaaagcguggaaagcaagaaaagccagaacugggccucaggaccugggucuaucguuaguucccagguguauugacuccccucaaggucuguggacguuacuccucaacaggguuguggcuacuuagaucugcauggcugccgaucugguuccuaggcucuaaaauggcgcuaggauuagaacacagccugugccaugcugguggcucuggcugacaggauaugggagucacacuccacuuauaggaguguguggagcugaagccaagugcucccucggguaugcguuugauaaaggaaggucgaggucugagaccguguuaggaggccauuugaaguguccuugagguccucaagugaaggguggcugaccucaccccagcaccugcuguuuucaucuuagcuggccuuggcugagggcaucgggccugauugugauagcaaaggagcauagggaacccccguguggauucugcuugggagcccuggcuggagcuuaaggacagcacugugaccgaccgcaugaaacucugccucuuccccacugccuggggccccaagacauccaccagcucuccuggaugggggcagacaguugcagugucccuaggcuggacucaaacuuacuaagacaccaaaguuggccccaggaggguguggccuggggcugaugcuggugcuauagaaugugguauuucuguguucagggcugaccccacaggugacugaugucauccuaacagugaggccccagcagugugcaugccccugggucccucucucugcuuuccuguagaauauaggucuuggcucucacgguuaaccuagcucugcuuuucuuucaguugaccacagucggauuaaauugcaccaggaagauaaugacuauaucaaugccagcuugauaaaaauggaagaagcccagaggagcuauauucucacccagguaacaggcugucugucuaaacgauuuuuucaugucaccugaagaacuugagagcuguuguguucacaucagauaggaucaucguguccgugagaaguuuaggcuucucaucagucagcacaggagcaagaaaggcaacacccuacuucagacucugagcacagcacugugagacgacacacugagcugccaguggucucuugaugggcaggagaagacccuagacauuggguccacagaggcaugagccucagcaucgaaugcuucuggcagcgacuaagagggcuagcuaguccuugguugucuaggcaccucugucccaagggcuauucaguguuccucugggccuuguuagaagaugacuuaaaaaucccacagcucugggcuuccuucugagaaagugugauagacguccuguaacacacuccacagugugugccagaaggcuguggaugucugggaagaggauaaaagcuuauuuucaguaauguucuagucuuagccuguggccugcaaugcggucuccguggcccuguguuguuuuccuguucucccuuugggaucccauaucacacggcgugggcuguagggaguuugaacgugacguuuuugccugcuuuuggaaaucaaguccuaaugaggccagagaucggaucuggcacuccuccgucacagacagcccuucucccuuuuguccuaagucaguuugcgugacaagaagcagcccagaagcccccagucaguguguacaguaucaguggcugcuugcgguccuguggaugcagggccaaccucccuaggucucagccaggguccucucagcaccuuuguguuuuccugggcagcugcagguuccuuaggcggguggggccuccuucugagaagcugagguacaguaaccuugagauucugugcagagaaguuagcauucuuggcuucaaccguucaucuguagcugugcucagagagacuugauauggcucuugucccauuguaggguaugugaugccaaaugagucagaugagcaguuagcauugccauugaggagaugggguuggauggagcuuagugacagagcacuugccagucacgcaagguucuggguccaguccccaguauuucaaacaaacaaacaaacaaaaacagugcuaacugagaaauagagaaacuaaagcauuacucuacccacuaccugacccugggcccuggccauuuugugagaccugugauacucugcuguguacggcuguaccaugagcauucauaaguggcuucuacauccguguuccagacaagaaugcaaacagucugaccccaaaggagcgucuccgacagggagacccggacuauuuccacgccacaaauaaagaacucuucauuucauucaguauuguucguuauagaaaccacaucguagccucaucuuguacaaauuggaggcugggaagaguggaggauguagggcuguacuucaccuccaucacaaagcauagccaggucacugugagcugggugguacuugggagcagggaugugacuaguaaguuacagaacacggagagcugcauccauggggggguugagaguuuggauccuuguguagcacagaggaugaaggacccggguggccaucagguaccugguguccugcugcacaaagcuagcucucuuaccugagggagagucaccugugugaugcuuuuguuagagcccuugccucacacuugcagaccacacucagggaagaaugagaagaugccaagugcuggcacaaggaagggagugugcugagaucuaagggcaauggcuuggagggaaauaggggagaauggagacuucccacccaaagauguaacuagcccugguauggauguucuccuguagcaugucaugaggcucacaauuaaagcacucccagcacuugacagucauccaucagcacccaccaucacuagguagguuuucugcucugcaggcaccggucauacccaggucuuaagagccccuucgcuaccucugagaccauuugugggccacgucucuugcacguuccuugguccagcucuaagggcuguccacacuuagacucgccaguacuaguaagaagagaggcucauucuguacugggugcuuguuccauucucggugcuaugcugaguccuucacauacagcaccacuguuauuuaugcagccuugagaacgggugcuguuuuuuaaucaagugggcuauguguaaagaaagcucagagagauggagugacuugccuaaaguuagacggugacagauuuuaaaagcagggucuagggccagagcacaguguugguccugcccgugcugccucucgcccacauaggagcuguguccuggacucaucugcuccuagacgagaagccuaguaaagccccucggccgucagcuuagauccagggacagccugcaccgaggugcggaaaugauccuucagcacaugaugggaugugggacugggugacugacgguggggcacgcagccuuggugggcuacucugccuacaccuaugaacauugucacugacugacuguguggugugcuuguguguccaguguuguacaguguguaucuuguguguuuacagggcccuuuaccaaacacaugugggcacuucugggagauggugugggagcagaagagcaggggcguggucaugcucaaccgcaucauggagaaaggcucgguaaguucucgccagagauccuugcugcugccaucuacauacacccaguucuuaaagcuccccugaguuuccguugugaguuuccauugucuaacuccuuuacacggcacaauguguguaaaagcauuacauaaauacacuuuuauuacagaccacacuagggagaaagagaugccccaggccaggcucuugcugccucuguuuucuugguacugccuguguuuguggaacuggguaaacaguuguuuuuuuuuuuuucuaaaagcagccuuugguguaucuuaaccaagcccaccuuugacuggucagacugugccucucgauggcagagguaauccuacagagcugggggagacauugguggugagaugacuuugggacuuguguucaggcucuguccuuucagccacccuugccucucagccugauguuucuguccaagguggucugugucacucaagucuuaccacagccucaccucuaaggguagucauugauagggccugagacucugaguggcuggaccuagaccugucucucacuccucaaacuguauccuggauaggccuccuuuugucuccuuccugucauuugggccagagaucugagucauggugacacucuuucagauuuaggcuucaucaaacagccagccuuccugucccuucccucuuauuccuguggugacacugaagauugguucucagugcugcccaugacuagcaugggcagagccagcagucucuucccucugcacuugguuggcacuuacagccuccccagcugcagaggcugaagccccuggaaaagcucagcugaggaucguugggaguaacagcagccauagccaggaguggagaacaggauguuccguucagccuggccagguguagauguugugcugucugcugcucagcugggacagcugccugcccugcuuuccuugugcucucaagaacaugagguuuccagagaaggcauccaucaauuccagagacaguggccagucacacacauccgagugaggaaagguaucccccgcaagcugcacccacccgcagagcgcaugggcccgggcacuccugcuaguuuccuugaggcugcuugaugucauauuguugccugauuuccacuuuccacuucuguagaacaugguaguagcagguacagagccugccgguguggucaguugacaaaaccagaaaguagaauuuuaaaucacccuacuacuaagaaaucaucuugagcuggagagauggcucagcggguaagagcacugacugcucuuccagagguccugaguucaaaucccagcaaccacaugauggcucauagccaucuauaaugggaucugaugcccucuucuggugugucugaagauagagcccucauguauauuaaauaaauaaacaagaaaucaucagauaugaggaaagagauaacucaguggcuaagaguguuuauugcucuugcaaagaaccuaaauuccauucccacacaaaggcucauagcccccuauaauucacguuccaagggaucgagcaaccucaguggacaccaggcaugcacaugguacacagauauaugugcagacagaacacccauacacauaaaaaaagucaccgggugugguaugguuuaguguguguguguguguguguauaaggauacacguacauguguauacuuaaauauguaagugguccugauggccaggguccugauggccccuuguaguuagcacaguuuggauuaguagguauugucacacuguaaggaauggugccuacucuguuguugcgugaguaccaccgggucuggcuuuugguacccugggcugaucauaaauagauccacuauggccaccuuggugaggaguccuguguuccauuggaagcagagccagugggcugguuacuuucucauggcagugguccucuggcacuauucuccacucagggcugucccaggaucuccugagacugccuggcucuuuguuuuggaaggacguguguacaucaugguugaaauggcuauuaaacucagaaggccagcacacuggcauugccaucuucugucugagacuggccaaagggccuuggugucagucccagccggcagggccugcucauauuccaguaagaguuagacuuccgcucagggccgugugggugccaucaacugacuggaagcaggcguuaugugcucucuuguuuguuuuguguuuaaagcagaaauuuuuacgggaacugacagagccaagcaugguccuauagacaucuaauuaaauguuguuugauggacauuuggcugugugccagaaugccucugaaauuguacauuuugccuagaugagagaucugucaggcuuguucuaggcuucugcuguggaagugaaggucagagccugucuacccugucccugaggcaagaacccccauucccucuucugaacugacagcccuguggcauucccccagcucauggugaaugcccacccuggcauguagccucgggucuuacugggaaugagugacccauucaagucucuccaugcaacguucacuggcauauugccucugcguucugauguagagaccugcucccaugcucacagaucggcccuacucggggagcuccucucuggcagcugguccuuaaagguaggaggaggcuuggguugagcaggccaagaccuugaaauggcucuugagaaagcccacguagcuucuguccugggauuagaagguuccugcuccuuggguagggaaagcucuugccuccuucgcugcuuucugucuuuugcauugguuuuguggagagcggcuuuggagcccagaagaguaacagcaacagccuuugcaauucugucuucggccucagucccuccuagccccucaugaggugacaucucagguccccgguugccacagccccaccaugcucuggccauccuugcccugucuccuacuuucccuugagacacuguccugucaaaauguucucuccagagagcuuccguugaccucuuugcuugguuagcuugagcuucucccuccacugaguccccagguuguaugucuucucagugucuccccucuguguucuccccauccacccacccuagagggcaggagcucccaguagucugggccagcccuggaacaggucaggcaggugaauucuguguguuguauaccagagaguagcuuacuucacuuccccgggaggaugaaggucucugagucucugccuuggagacccagaacagcucucugcagcaggaaggguaccugagcucacaggaccugugugacugaaucccagccugaucuuuuuuccuaaauccagcccagauauuuugguucaucaaaagcuauaaugaguauuugaauccagaucaucagugguguuugauauuagcaaaauagaacuccgggaacugaacugaaccaaaucagaaugcuccaaugagcugcaccugcgugcugucuuccacggcccucagccugacagggcucuagccucccgcccuguugcccguguguuccucagggggcucugggcauccugagauccuacugaaggcaucugugagggacacugcuucuguguagugugguuuuuaccucgcagcaaggaccagagcccacugugacacguugcugggugagaaguguaaacccugccccaaagcuacagggaucaggguuccagccagcucuaguuuuccuagggugaaagcuguaguguccgggagacccccaccugggaguugucagaaagcuagaagacagccuugccuugcaagccuccugucucauguagcaggugcucagaguaaccagagcucuucuucccccaguuaaaaugugcccaguauuggccacagcaagaagaaaaggagauggucuuugaugacacagguuugaaguugacacuaaucucugaagaugucaagucauauuacacaguacgacaguuggaguuggaaaaccugacuguaaguauggcaggggggaaguuccucuggagacugugacuugcuucugaucuuaguccuugggugccaauuucagcuguggcauucccgggaauuaugagucuugugcacaguauggcuucauuccauggugaacagaacuagcuguuguaggaggcagugcccaggcaccagugaaagacagguuacacgcaccucccauggcucucacccuugacaccacguaacacaguuccaagggaaaagucccuuucuuagcugagagugcuuugcucugccugugggacuuggugacugaaguggugccugcaagagaacugacagagcuugcagcuuccucacugucuggacugcugcaaggaggggggcuccccucccugcccagggguccugcagcugaggacuggaagccaggccuuggguaaacuuguuguggggacagccgucuugucugcugcucacugcacuaagaggaggaggagcagugggagcugcccacggcacagagcugugaccaaggccauaugagucccggcaugguggaagccacuguugacccacucugcccacugcugggauugggccaagggacagcucuccgugucuuuguuuguucuacuuugagacuaggguaguucugcgagguccuggugagagguaggaggugugugggguccugagcagggggagauagggaguccuccuggacugaggcuuucuaggccuaggaaaggguugggucugugcaggggacagucccauauccuugggccucccuagggcucccuccuuguagugaacuaauucuagaauuuucucagguugcuggaagcauggcagggccuccuagaggagccugggacgagcucccugaagcucuggguucaccgcggcuggcggcuggcuuggcaggggugugguaggcgcuuccuaugcuuuccaguauuugccagccuggcuuuaaaagugaugucagauaaucucuggaaaacgccugcuugggggggggggggcaauucagagcagcaccagagacuugucuguuugaggacaggggagcuuaggccuuguuugggguugggacuuuuggaggaaguuguuuguauuaagauaaggucucacugauagcccaggcugccuucauauuuacaguccucugccuccagaaugcugggauuguaggcacaaggccagcucaagguuuaacuugagcaccuuucugggcccuagaacagaguccuuguagagggaugggaggcaggaggaaugugguaagaggaccccaugcucuuuggggguuaaaauaaaacucuucuugccuacuuuacucuaaaccaguuuuaaaguguauuugagguaccuccugccuugcacccaguacaaguaguguuugguuuugcagugaggugggcagagcagcugcagggucucacauacaacauccuggaucuaguggccauacugaaggggguggccaugucuuugauguguguuugucucacagcagggaccgccuguacuucgcagaaagauagcagcuuguaucagcaagucaagccguaggugucugugucccagucuuugucuggcacaggcugcuggcccucucugcagcccugggggcccugaccucugaggucuggaccauggagcuggugagauagcuuauacauaaagguuuuuuaaaauaccagaccaucuaggaaagagcaguagagaaacagcaccagaggccauucuuuuugcucagucaggggcacugugggacagcuauggaaaugggugugguccaugaggugaauggugguguggaaaacucaccaucagccuggccucuggagucucagcugauguagcaccuggguggcagccaccuuauuggcaaucuugucuuuggagacuuuucuugaaaaguaacacuugucggauccgucccgguguucucccugauccacccagaccuggucucccaacacacacacacauaaacacaggaagccuuucugauaucuaaggggccagugacaucauggugacuuuccagcugaaaugauuguggccacaugugugaguacagaaggaacagaaaggaagaggauugugcacugcuuaaggcuguggccagauccagcuggaugcacugaggagggcugggcaggaagugacuuggugcacacauggggucuguguggauaaugugcccagccuaacagcaagugucucuuucagaccaaggagacucgagagauccugcauuuccacuacaccacauggccugacuuuggaguccccgagucaccggcuucuuuccucaauuuccuuuucaaaguccgagagucaggcucacucagccuggagcauggccccauugugguccacugcagcgccggcaucgggaggucagggaccuucugucuggcugacaccugccucuuacuggugaggagggcuucgcaagccuagggagaaaggaagcacgcuugaacccacccuguuggcuagcaucccugucauuguccaccagccuccuuccuuggaggacacccaaggauugaugaugguugagccccuucuagcuuuguucaugggguucuucuaguugucacaagagcaggugacucuagaacacccacgggguacccuggaacacccaugggguaugcuagaacacccaugagacacccuagaacacccaugggguacgcuaagacauccacgggguacccuagaacacccuuggggcacccuagaucacccaugagucuuuuuucuaagcucuuuccacucaggcccaaccggucccaaguuugcugcauuuuuguaccauuuccuugagacccucuacuacauaccccucuguggcuuuccucugguugacccagugucccuggcuugcagauggacaagaggaaagacccaucuuccguggacaucaagaaaguacugcuggagaugcgcagguuccgcauggggcucauccagacugccgaccagcugcgcuucuccuaccuggcugucaucgagggcgccaaguucaucaugggcgacucgucagugcagguuagugccacucugcuucaagaauacauguugguguucagcucuguuccuagcugaggauagaccacagagccuguguuugcucaccaagacucuacucugugaaagaaacucaaauuguuuaagguccaauacuguugaggucaaaggcaauggcuccgcuuaguauaugacauugcuacagucauuaaacaacugcucacucugcccgccgcaugcucuacagagcccugagaggaagcguaggccugaccucagaaguccagggucugccuggcgaccugagacccuaccuccaaauuuaccuuccaaauauuugccuggacccaggagcccagagcugcugcugagcagucagccgcucacuaggacagacccagaacaggcaccaauggagccucuguugcucuccucuaaggaucaguggaaggagcucucccgggaggaucuagaccuuccacccgagcacgugcccccaccuccccggccacccaaacgcacacuggagccucacaacgggaagugcaaggagcucuucuccagccaccagugggugagcgaggagaccuguggggaugaagacagccuggccagagaggaaggcagagcccagucaagugccaugcacagcgugagcaggugaugggggccuggcuugggguuggggguggggugagaggaaguggcuugcuguccagaaacacaugaaggcauugaaaacuuugaggugcuucugcgugcaugagcaaugguguugccgcuccccggccaagcccccacugcccuggauguuccugugaaaugacaguuccaguggguuuccagugcuccuuguggugugugaugugcucagcgccaacagggauggcagcuugcucacucacccugcuacaagcauuguugagccccuacugauaucuguggaauacuuagguaauacuagaaugugcccagaaucugugccgcagacccuccguguggggaaaggacaagcaccgagugguagaaccgggaugauaaagaaaggaugugccugcaggaaguggcacuguggugaccccaguaggagugagccauuuccugcgucggccgccuccuuccuggagggcaguuuugaggugugggcacacagucuaacucucagcaguacccaccagagcuuugcacacagcguguagagccguagccuggcugcccucauucuagcaugcguggacagaagguacagagccggcagugcacgggaagccaugugucuccugcagcugggaugugggucugagugcauguuugccucgagccgggacuucccauuccugguaaagcauguguacacuggugggcugcagacugacuugaauuaaacccagcccuggccauggcuacugcccaagguccuccagggcuggaagacaagcagggugcucugugcucgguggggaggguucauuucuccagguuuccuccauagagauggucuccuuuuccaucuacucaggguagguaaccaaccugucucuuccucucuccucagcaugaguccagacacugaaguuaggagacggaugguggguggaggucuucaaagugcucaggcgucuguccccaccgaggaagagcuguccuccacugaggaggaacacaaggcacauuggccaagucacuggaagcccuuccuggucaaugugugcauggccacgcuccuggccaccggcgcguacuugugcuaccggguguguuuucacugacagacugggaggcacugccacugcccagcuuaggaugcggucugcggcgucugaccugguguagagggaacaacaacucgcaagccugcucuggaacuggaagggccagccccaggaggguauuagugcacugggcuuugaaggagccccuggucccacgaacagagucuaaucucagggccuuaaccuguucaggagaaguagaggaaaugccaaauacucuucuugcucucaccucacuccuccccuuucucugauucauuuguuuuuggaaaaaaaaaaaaaaagaauuacaacacauuguuguuuuuaacauuuauaaaggcagguuuuuguuauuucuggagaaaaaaaaaagaugcuaggcacuggugagcuucucucgugcccuuuggcaugugaucagauucaugauuucuauugauuuccaguggaaggaucccgcugggcaggacuguaaaguuccugcuggcgugggcagcccccacugugcacccggagcuugcaggugcccuggagccccauccuguugugaggagggcagccacaugggcugccucugaacagcaagcccggcucugcuucgcucaggugucccccccgcgguuccauccuucucggucuccucccucuuugugagugccaucuugcaaauggcccagcccuugccacccuaucccuguaaaucccugagggccuugccucggggucagagguggcugccagccuaagugcugggguuuccauuucauuuggaaagucauuacuacucuguguggaagccacucuacugaggugcaagcaagacuggugaaggagaaaggagcccuggugucauggaagccccucggcaggaccuguaccccccucugaaacacuguuccagugaacgcucucgaaggcaucagauagaggauuuuugcagacugcaaagacuuccugaguggugauuuucagagucuggacucaaaaaacaccauggagcgcuuaccgcgcugccuuccaugcugguauggcugaggccguggggaggccggcgcuguggcuccauccagugcggaugccuuugugcaaucgcugcccagcagcagagccugcaugccagccucugcgcugcaggccacaauggccauggcggcccaaagagugagcugcgauggaggcuuaucacauggagcugccuuuucaggcuaugcaucucccuuccugcuuuacccucugcuuccuucccgaguagcaagcccaccaucaugaggagugcaagggaggggcaggcauuagagcggggugcggcuuucgaggugaggccaccuccgaggcugcccuccucuuauuuauucacuuugcccggagguggcccccgcgugagcaugcccugaaacugaccgugucugccugcacccaugaccgucaggucaguccugggguugaggcaugagugcaggacugacaggagccacaguauggccagugcuggggccaggagcaggagcaggagggugugaagagcagccuucaggagcauaggacagugguaaugcgcagagccccuguggcugcuccugcgacgugcaggguggaggcugggcuuucugcccacgaccuucuagaucccauucccggccucugcuuucccugugaguuagaagauacacaguucugugcugguggcaccuugugcuugacaugggaaacuuagaagccugcucacugacaggcaccucccgugcucugaccggaaguggccgucgcugaguaaccaccgccacucagugagagcagugcuguccagucaggugccaccugacuccuggcaggacacuucaggcuuccguccugccacuccacgccacgccacgccaugccccgcuggaucucagacauuccacacucacaccucauucccuggacacuuaggcaagcaggguucuuccaccucuuggaucagccccuccauuccaaguucaugcuguccuggagcaggccaggacuggaagcaaggcagcuugugagaagcaaccuccugggaacaguauggaugacagccuuagagucggccugcugucauugcuggccccagggccccuuacccagaagugugcagcucuccggccugggagagacggaugacggugcucaugacucuucugggaggggaagaaccgagccuucacauuggguggcuuuuuaaaauaagcgaaggcagcuggaacuccgcugccucgugccagcauuucacauuuugccuuuuacccagagaagccagcacagagccacuggggaacagugauagccuugccugcagagccugaggagguggcacagccaggguccaggcugggagcaguuagcagugggcugugucuggaguagugugguguguacaguagccuuagagguggcucucccggagaacaggcgcucucugcccugucgccccuguuggagguagcaagcugcuguaugccuuaagucaacauuuacucagcagggcucugucucucucucucuuugucuuucucucucucucucugucucucucucucucuaaauggccauagaauaaaccauuuuuacaaaaauaaaaaccaacaaaaaacugugcccuggaagaguaccuuugcaggaguguggggugucucagggucuucugugaccucacagagcugucugacugcaccauuuccaacuugcugucucacuaaugggucugcauuaguugcaacaauaaauguuuuuaaagaacacagg

SEQ ID NO: 1292 - RNA, 3172 nt, Mus musculus
gggaggcucggcgcuccgacgucccagugugguccccgggaaacuuccagauauggugaccguuucaagccaaucgugacggcuuccccggauaaaaacccauucguuucacuuucaagggccaggaagcgucuucguuuuccagucgcuaagagacaggcaaccggaaacggaagucccuucccggcucuuuccggaagaggcugucauggcugccccggaggacguagcugccuuacaggcugaaaucacccggcgggaggaagagcuagcuucgcucaagcggaggcuggccgcggcccugacagccgagccggagcccgagcguccgcuccgggucccgccgccgccgcuggcgccccgggccgcgcugucgcgggacgagauccuccgcuacagccgccagcuacugcugccggagcugggcgugcgcgggcagcugcgccuggcggcggcggcggugcucguggugggcugcggcgggcugggcugcccgcuggcgcaguaccuggcggcggccggcguaggcaggcuggggcugguggaccacgacgugguggagacgagcaaccuggcccgccagguccugcacggggaggcgcaggccggcgagagcaaggcucgcucggcggccgcggcgcugcgccgucucaacucggcgguggagugcguggcguacccgcgcgcgcucgccgaggacugggcgcucgaccugguccgcggcuacgacgugguggcagacugcugcgacaacgugcccacgcgcuaccuggugaacgacgcgugcgugcuggccggccggccgcuagugucggccagcgcgcugcgcuucgagggccagaugaccgucuaccaccacgacggcgggccgugcuaccgcugcguguucccgcggccgcccccgccggagacagugaccaacugugcagacggcggcgugcucggagcggugcccggcgugcuaggcugcgcgcaggcccucgaggugcucaagaucgccgccggccucggcuccuccuacagcggcagcaugcugcucuucgacggccucgggggccacuuccgccggauccggcugcggcgccgccggccugacugcgucgugugcgggcagcagcccaccgugacccgccugcaggacuacgaggccuucugcggcuccucggccaccgacaagugccgcgcccugaagcugcugugccccgaggagcggauuucugugaccgacuacaagcggcuucuggauuccggggcgccccauguguugcuggacguccggccucaaguagagguggacaucugucgccugccgcacucucuccacaucccuuugagucaguuggaacgcagggaugcggacagccugaaacucuuaggggcugcccuccggaaagggaagcaggagucgcaggaagggguugcucucccgguguaugugauuugcaaacugggaaacgacucccagaaagcugugaagguccugcaguccuuaacggcagugccggaguuagacucuuuaacuguucaggacaucguggggggacucauggccugggccgccaaaauugaugggacauuuccacaguacugagaggacagcaugugauucguguggaugacgguugugauaccugaagaaucuauucgagcuuuacaaaauaauguagggaagagccuggauucacggucuccgaauaaauaaacggagaccucccccccccccccccccaaggagcuuuuugagaaaagaggauagcauugccucugagagcuacuuuugggcacuugugcagcaccuucaacaugugacuugguacgacaggauuuuuuguuucccacccggucagauuaaacugagauuaaacaguuaagaugcagcuuuuacaacugaauuaaucacuuacauucauccuauuuuuaaauuaaggucuucuuugugagguugcagagauggcuuaacucgggcuaccccccaccccuaccccaugggggcgggacauccugguuugacucccagaauucaugaguuggcucugcaacuccauuuccauggacaucauaugcugucuccucgacuccuccagcuccgggcagggucuugguguacagauaugcaugcagucaaaacauaaaguuuuaaaauauaagaaaaaacguuuuuaaaaagauauugagucuuaauucuacuucaaaugauaggcuauauauaccccuuaaaaauacuuaacauggguagcauuuucauuaucuggaaguugauuguuguagaaccgauugagaguucagagugcagucuugacaguuuagcaacauguguccaucagcuucccucagaaguugcuagcauuuuucuuguacuuagcuccagucucugccuucggcuauaccagugguucucaaccucuuggucgagaccccaugggggucagauggccccuucacaagguugccuaagauaauuggagaacagauauuuaaauuaugauucauaacaauaguaaaaucacaguuaugaaauagcuauaaaaauaacuuuugugguuggguggggggucaccauaacuugaggaacuauuaaagggcugcagcuuuaggaagguugagagccacuggcuugugcucuggccgauaacacguggcauugguuuaacuacguugugggccugcuuuggaauuuuccaguccuaaguuucagccuuuugcuccaucccuuugucuuucucuuugacucaguguacucuauugcagcauuuuguuuuguuuuguuuuuguuuuucgagacaggguuucucuguauagcucuggcuguccuggaacucacucuguagaccaggcuggccuugaacucagaaauccgccugccucugcugggauuaaaggugcucucgaaauccgccugccucugcugggaucaaaggccaccacgcccagccagcauuuuuuauguaggcauuuuuauguuuauuugcauaguaaacaguuugaccaacccuacuggugaaggucggucuucccagcuauuuaacugaggcaggaggaucacaaguuuaggccugugugagcuacagaguuaaauccaaggucagccuggccaacuaaaggaaacccauauuaaaaucuaaaaaagggagcuggguguguuggucaguggcagagcaguugccuagcagca

SEQ ID NO: 1293 - RNA, 6105 nt, Mus musculus
gcuuggccucaucugcaggucaaguucucagauucuuuuucuguuaaaauggaggcuggucccaagauggaguaggucuggccacucaagguuagagaagcaguucugggugagguaggggguaagcauggccugggccuugagaucccagcuucuguuugauaaagaccaagaccccuggcugcggugaaucagcgagggccucuggcugaugaaggguguucuucagacaugcaggagccaugggaacaccucaggucagugugacugaaguuaaaugauuaagagcaaugucucagccugggccugggucaggucugucaucccagcuacuugggaaggugaggcagagggguggaaacaaugaaaaacacgaacagguauucacaggacaauggggcccggccacucccagguccaaaggaaacuccauuuccccaaacucuaaaggcaguuagauaagacagcauccucgggagccugugaaacuggcucccacaccuaaaggagccauuucccuuaccucuggcagaagggacauauggcuaccuguggugccuguagacacagcaaaguucaugcuggccuccagacucccucaagugucacaagaaccuauuacacauuccaggcuagccuccugauucuucucaccucuucucugccuuaauucucuccagcucuggcucccuucuaucucucuguucaucccuucuuagaacccugcucuuccuucuuccaccccccacauucccuucccuccaccccauccuccccaaccccgcccuacuccugcuucucccacugguuucucuauucucuguccccugcuguucccuccucucucacagacagcccuagccagcccuagucugcuggcaguggucaguuaucuucuuucccucucugcucuggacucuuccagaugaguucgagaacacgugugugugugugugugugugugugugugugugugugugacacacacacagaagcuuagcaauuaaguguuuguuaaugaaacagcgggggugguggggagagcauagaaggaaugggaccauauaucaccucauggcucugaaauuacgguauaaaaucaugauuaauuguaugcauuuauuaaaaagauguacuucugucaggucuagugguucacacuuuuaaucccagaacaagggaaggaaaggcagguggaucucugugaguucgaagccagccugguccacauuaugaguuccaagccauccagaguuacacagugggacccugccucauucauacauagauaugccuaaguccucaggaaagaucuggaaagaauggcugccuugaagccuugaggcccugguaccaagauuacuggaugucacaggcacaaaggaaacuuugguuccaggucugagauguggaagggacuugagagucugagaccaagacagcuuucaccaaggacugccaccaggggcagcucuucaggggccaugcuuuugagaagugacauaggaaagacgcagcuaugagauggaugauaauaaaggcggugggggugagacuggaagccugcugugaagaaagaagccagaacuaaugcggagagacagggcuagcaggugacagggacaacuagccaccuaacaaggaaucugaauuuucuuuucuaagaggcaugaagcaucaccugauguggccagagcuuucaaaagauccccuccagcuguugagagaacagaggcaagaaucacuaggcugccaauauggcucagcaggugaaagggcuugcugucaacccugacugacugaguuaaauccccaggacccacaugauggaaggaaagauccaacuucagcagguucgccucugacuucuaccugugcacugcggcacacacacucacacacuaaacaaaucaaaugugguuuucaaaaagaaaaaggccuuuguggcgcuccagucagaucccccugggcccacuucuucccuccaggaguggguggguuuucccacacucggaauccuaccucccugccugcuccacacaccaucgaugccucccucuccccugccccugagggaagagagguggugaagagucaucgccaugggagaccucuaauaugcuggaguccagguccuaccccagcaagaaccgacuccuguguacuacagaguuacaaaacugccauucaggcuacauccccaaaaucacaguaagugcucaaugaacgcuuaaaagguguguguguggaaagaccaacaaacucacaaaccacuaccagggcaggcagcuagcagcuuucuuuccuuccaaacagugugcuuuccccuccccagggaggaagagaaagccacaagcuugaccauugaggacaaagcuugucagucaggcugugagucaguaagccgcucgcauaggucuaacaggauaagcagcagaaguggcuacaaguguagccugacauaggcaaggccagggaggugagguuccagcguccuggauucagggugucuggcucccugucuuucccacaguaagacucuuccccacgaagucagcgggcuccccacucuguggaaaagaacuaaauuugucucugcagaaaugaaaggcgaagcugauaagauuccugccuucaugguuuuuuuuucuuacuucaaaaggaagugcuuggcaauaaaugggaggacccgggggcagcaaagcaugcaguuggaagcagcagaagggaugaaaagcaguguagaaauugcgagacccgaccugggggagggggaggucggagguccgguacacgggagccagaaggggccaggcaugaaagagccugcccgccacaaaccacucugcaaggcuuuuugcagccagcugcugcaggucuccaagggucacacacugggugacaaucacuuaacaccagagcugcucagagcauguaaugaaccaccacguagccucuugucaacaacaggaaauccauccaaguucaacccuccuggcugccaggggcagaagccacagcuugggguccaucgaggacugcucagccagugacccaguccagcccuguucuguaaagcccgagccacugugauccuuucgcaggggaaaucacugaggaagagagggaccagagcuguccucuaaaccacugugauggaccacugggacagcaggccaggcugucggcucuagaggugagaucuuaaggaagagacggugggaucaggauagcgggggaaucacucauucauagaugguggagucaggauagcaggcaaucgcucauucacucauucauagauggugggaucaggacagugagcaaucauucauucauucacucauucauucuacagcacuaucguuauuguuauuuuugcugguggagcccagggcaucuugcacccuaggcaaguacuugaccacugagauaugaccccuguuccagugguuuauauagaaaguguccccauaagcuuauguguuugaauauucaguccccagcuggugacacuguuuggggagguuauggagcccuuaggagguggagccuugcugaagaaagugcaucacgugggguggguuggagguuuuauagccccucccugacuuccccuucuuacugccaagcugccucacccucccgcugcccaccaugaugggcuguaucaauguggagcugugcacagaaacaaaccacuuucccccaaguuccuuuuggcuauaauauuuuauugcagcaacuggaaaguaucuaaagcuucggccuguuuuccucugguauuucuuucacuucagacggucucaagauguugcccagguugaccuuaaacuugcgaucccaccugccccagccucccaaguagcuuaggacuacagacgggccugugcuaccaggcucagugccauucugccaacacugacugggcauuuacuuucucagcgcugcaccagacagagaauccagguaaucauugcugggaucuacgaagaggcugagaucagccuaugugcaaacuggcaagcuggcuuccuccgaggcucgggagucuucaaggaagaagcaacgggaagacuguaagaguccaagguggaggauaacgcaacagagcagccacacaccagaacucccagagacugacagcacccacaggauccacccaagcucaagacagacagacaaaauccagucggggaguucggaggugggcacgacaucccacaccucccugaggagcuauuggcauuuaacagcugccgagaaaggagaguccauuuucuuuaaccauacaaccuagcaggucaaccacacaccaggccccaagcguaugcagcugccuguuuuaguuaggguuuacugcugugaacagauaccaugaccaaggcaacucuuauaaggacaacauuuaauuggggcugaguuacagguucagaggcucaguccauuaucaucaaggcaagagcauggcagcauccaggcaggcaugggauuggaggagcugagaguucuacaucuucaucugaaggccaucaaaagacucugaauccucaggcagcuaggacgagauucucaaagcucaugccuacagaaacauacuuucuucaacgaggccacaccuacuccaacaaggccacacccccuaauagugcuacuccuugggccaagcauauucaaaucaccacacugggcaacacaaacagaacuuaauuuggggggagagggaaaaaaauacagaaaacucaaaguuagauaauaaaggaggcugucuuagucaggguuucuacuccugcacaaacaucaggaccaagaagcaaguuggggaggaaaggguuuauucggcuuacacuuccaaacugcuguucaucaccaaggaagucgggacuggaacucaagcaggucaggaagcaggagaugaugcagaggccaugcagggauguucuuuacuggcuuguuuccccuggcuugcucagccugcucucuuauagaaccaagcccagagauggucccacccacaaggggaacuucuggaaugauguaaaacugugagccugaauaggaugcuaugagcuacgcaggcaugggugugaccaggcugacaaacaacaggaagaaugguccauuuguaggcucugcagucagaggaaacaugagccucuaggauuuucagccagguaagcuagaguggcaagucagaagaagcaaaagucagcccagcuugucaucucuguguaccaggcacagucagacagagcucagcaaaggcugucaaacacagugaacagugugucugggugggggggaugggcacagagagaucuggagugacaucuuucaaaaaaaaagauauaguuaucuuauuuauaugaguacacugucauugucuucaaugacacaccagaagagggcaucagaucccacuacagaugguugugagccaccaugugguugcugggaauugaacucaggaccucuggaagagcagccagugcucuuaaccacugaaccaucucuccagcccuggagugagaucacuaaaggggagcauuccaacugagaccccagaaagagaagaaagaggacccuggaguagcaguggcagaagauuccagaugucagaguagacagagcagguccuugauguuuggcuuucuaauaucugggagauaucaguccugccucugccagucaccugcugugcaaacccuacaagugucuagcucucucugcacuucaucucaucauuugaaaacugaggaauaaguuugaagccacaaucgagaggcugguccaaugauggcauccaggagcgggagacuuggccgugccacacacacacuuucaagguuuugaggcuuaaaggacaaauccgaaaggaggaguccacuaggcaguccugggaguggggguggggagaaccgagagggagaauuuaggcaacaaaaugcauauccagccaaggggaugagaacagaggcucugagcucugacggucuugcugcugccaaaugaagauguucugugucucccucaggucugcaggaacaaagcaagguggcaaucgcccagggugcucgcucacucugcugucagccgcccucagcc

SEQ ID NO: 1294 - RNA, 19778 nt, Mus musculus
cucauggagggaaaacauucacuuuauuuucagaccuuacaguaucagcagguaaaacuguggcguacacauucauucacggggcgugagaaaaccaaggcugguguguucuccguaagauacccacuucacaguguaaacaggugaaccggugaacacuugaucacgggguucacuuacaaucccagaaggaaaggcacgacuuggcgaaaaaaagaaagagaaaaagaaagaaguaacaacaaaacaaguuuuggauccuaaaaucaggugcaacaagucagaggaaacacugggcgagagucuccaucuucauuuggcaagggcauucaacacggcaggcagaauuuucuacccagagacuggagaaaucucuccuaccucacuaaaccauuggaacacuguuacaacagcuguucagaauuauuacacgaacaaaaauguaauuaaaaacaaaaacaaaacccacagaaccaaccacgaagacuucuugagcuucggggccuucuuaccaguauaagaacucuuagguuuaagaccuggcaauacuuggguggucgcaaaaauagcaaaauagagaagacuuuuggcuacaaaaauaaagauaauugagguagauaaauuaaagcccucacauccaagacuugcuggucucaacucuauaaccuucaugacggcaggcggcggagggugggugggugugaaggucuuugggucuuggaauaaccgaaauaaacagaaaggauagcaugcacguggagucgaggcaacccuccuggugccacuaggaaacaggcaguuuuccaauguagcgggcacugaagacaaccucagaaaaucuccugaggugcccacucuggugccuguccccacccuggggccugggaaggugguuugugggagaugggguagcagggguuggaggcauacucuaagggcucugaaauauuuaaggaagcagcaggagaaauugugggcuuuccgagggaccauggccgguguauggaggauguccuauccaagggcauaaggcugaaggaaguggauuaauugaaccaucuuaguuuucuggcauucucuucuccuuuucucuuaaaguacauuuaaaaaaaacaaaaucaaaaacaaaaaaaaaaaaacagaggaugaagacagggucgggaggcauaaaaccaggucccuacauuuacccgcauuagucaccacagaaggacaccacacccucaccccaggacuggguuaaggaguugucacuuccacugugguccaaugagucccaacuguuucacuucgaaacagguugaugacagucuuuggaaacagccaugaggucacacaaagcuucuagaauauaauuugucccaaauuaacagaacuauuuuucaaaacccgcuucuuuccaaaaugguuuaaaaacaaaaacaaaaagucuggcuuuuuaucauuuuuuuuuuugguuuguuuuuguuguuuuucacuuuuccuccauuuuucaucuuuuuuuuggaaagcagcauagcaacucucgugauuguaggauugcccaaggcuauggucacaagccacaucacuugcauaucaggaagaggaagaaaauaaaaaaaggagguggguuaagaaaaaaaaaaaaaaacaaaaaacuaaagaauaaagcagauucuagaaucucccugcagaagacuccucuccucuuccuccuuagcugacagcaaucuuauuuuccuccaggaagugagggaacugguguuuggccaugccgucgggaacagcgagcuuuucuccguucccgcucaugggcaugcucacaccggucugagagccgucaagcuuggaaaucgugccauugcucaccacagagcuggcccccagcgacacaggcagcguggggaugccuccgcucuggaucacggagaucucguuggucuucauggccagacccccauucaggacgcugguguacugguuccaggaggcgggguccacacucaccgcgggggacaggagcuccuuggaaaacaccucgggcgcucucuuucccucagcacucagcgcggccaugggguucucuauggccagcuuccuuccccggcgggcggaguuauuguuggccccaugagucauguaguguaccuguugggggacagcagagagaggguuucaucagauggucccccugcuuguaggcaagcccaagucagcuggcuucauguucacaccaguggucagagugugguggaaggggcagccugggcuacagucagaucuuguaucaguaagccagaaaauaauaaaugcagguaguaucuauacaguugagagcaugcuuguguguggguaccacugcccggcugacaccuuuaaucccagcacucgggaggcagagacaggugaucucugaguucgaggccagccugggcuacagaaggaguuccaggacagccagggccacacagagaaacugucucaauuaaaaauaaauuuucuuccuuuauucuuuuaaauuauguguguuugagugugcacacgcacguguuguaagcguacauguacacggaggccagagacaucagguucccccaccccaccccgagcccaaaguugagcuuacuggcaguugcuaaaccaccgggcaugggugcuaggaauggaccagccccucugcagcaguauguaugcacucuuaaccacugagcuaucucacccgccccuggcugacauucaaaagccucuacaggaucaggcucccgggcaacgcauuggcaacacauccucuccaggucgucucuagcauccuaagcugaggcuagcagcugcuggaaaggccuggcaauggauaccuguaagcaggaguucugaccccagcauccacugccugcagaaaccaaggcaccucaccugcucagaccccucaacaagaaaagcacucgacagucaggcagggccaguggacuaauuaaguuuuuuuaguccuaaauuaaggcaauuucaguuccuagccugauguucuggccaacuuuuuuuuuuuuuuuuuuuuuuuuaaagaggccagccuagucuaagagagccagagccaguuacaggaaagccagggcuacacagaaaaacccugugucagaaaccauacaaacaaaaaacaagacaaacgaagagacaagaaucuuuccuagcugagacugacauucaauacuggcucucccuugccccacugccuucaccucccaagaagugagacgagcaaggcuggauuagagggugacagagaugagcuuuagacaggcacugccagcccagcuucacccggcaccaacgugcagucuauggauuuucugguaaugcugagaugaaaccagcguauccccaacaccaaguggugugagccgucccacauaggagaugagaauugagcucaggucuucugcaagaagagcaacgcauucaacccugagaugucgaccuaggcccccgacugcaaccccccccgagacuacugggauuccgagugacucacaugugacuacaacaguuuuauaugucgccaaguucaagagcaucacaacuuggggauaaagacgggguagugguugggaucacucauugcucuuacagguccugagguuugacucgcagaaccuacacgguagcuagcgcauacacaauuuacuuuagugccugccugagaaucgucuucuaaccucccugaguacaaggcucugauguguguguguauauauguauauguauauauauauauauauauauauauacauauacacacauacauacauauauauguauauagagagaaagacagagacagacagacagacagagagacagcgcacagguaugauggcucacccagucagaaggauuaggaguuuucacacaaagcaagacuuuuaccgcuuacaggcagaggcaggaagaucugagaggccagccuggucuacagugcaagugccagaauaaccuagucuuacuauguacaccaagcuggccucgaacucagaggacccccgcuucugccucugguauugcuagguuuauaguaucugagacacaugaaccaauggauguucucugugcacacagacgucacacaccaacgcccgucggaacccaccuucagguugccuuucguggugaaggcccgcccgcauauguuacacacgaaaggcuucucucccguguguguucgcucguggaucugcagggcacuggcagacgagaaguucuuuccacaccgugugcagcagugcugcuuggccuggcggcguggcugcggcugcgaugcuagcaaaggcggcauacccgagggcaugcuggggggucccacaaaggugccaggcacuucaacuuugacaaaggugggcugugcucggauaaauguuggagggaggcugguacgaccuaauguggagaaagggagagauuuuuaacuuuuuguuguuguuuuuugguuuuuuguuuuuucugagacaggguuucucuguauagcccuagcuguccuggaacucacuuuguagaccaggcuggccucagaaauucaccugccucugccucccaagugcugggauuaaaggcgugugccaccaugcccagcuccgcguuucuuuuauuuuaaaagugaguuggguuagcuaaaugguaagaaucagcuggguggugguggugcacgccuuuaaucccaggacuugggaggcggaggcagaggcaggcagauuucugaguucaaggccagccuggucuacaaagugaguuccagaacagccagggcuacacagagaaacccugucucaaaaagccaaaaaaauaaguaaauaauaagacaaacgcucugcaguugccugcuagauuuuccuuacagaaauuauuuuucaauagcagcuuccucugaccuucuuguaugugcgcgcucgcgcgcguguguguguguguguguguguguguacaugaagggcagccuuuggguguuguuuuucugguaucacccaccucuuugagacaggcucucuccugagucuagaauaucgacaggggucuaagcuaucagcuugucucccaucagccaacaccagguacaagcacaccccagcacacauggccuuugcacauguguucuggagaacuuaacucagaucaccaugcaugggagacaagggcucaauugcuagccccgccccagaguucuucaugaaaagaaaacagaggcucaaacacuuuggaaaauggacguuuuuuaugguuuaaaguauagguaacauagaaauauguguacagauagcaccuaagacucaacguaagauaucaccuuuaaggucugggcuuaucauugcagcuacgugagagggcgaggcaggaggaucugaagaaagaaccccagcugguauccuccugccaacccuugaaaaagccugauccgggagugcaugacugcaaccccaacacuugagaggucgaggcaaacuacucaaguucaaagccauccuagucuacaacacagugaugagacccuaucuuaaaaacaaacaaaacaaaaaaaacaaacaaacaaaaaaaaaaaaacaggauggaaggucggggaugucaaccaggagagacacccuugguugaaauccuggcagcacaaugaagaaagucaccuuuaagucccaccuaggaacuuggguucuaguuaggaucaagggaccccucagcuaaggcaucuacaauaaggcaggcaguaccucucauaucugaacucguuucauagccagaccucuaaaucaggcaaauauggcuugauuucacaguccaaauggggccugcuucccugaacacagugauauggcuaccgucacccauguccccauggggucaaagaaaaaaaaaaucaaaacaaaaccaacauuucauauugggcacacucaaccucuaggaaccacgcuaccagccuacugggugucaggauaaaggcgguuauuagaucccgagacccagaacagaacagcuaauugcccuuaaagaagcugcuucaggucacacugucaaguucaaccuagguucuuuuucuggugaccuugagcccaaaagggaccuuaaaggaaauccaaagccucaucaccuucggugucaacgcggcagcucuccacgcccucggccuugugacccucgggagaccgggacuugacacuuccggcuuggcuauuggcaggugacacugccugguagcacauggucuccguggcaucugggcuucggcucugacacuccuggucacccacgagcaaggaagagucauuggcuggaccagugucaccgcccuccagggagcuguuuucucgacugcucugccucugcagggccagcgccggaagagccccuuuccccugcguauccagggaggccaacacagagaagcccagagagggcgaugccaggugggcacugggaaccggcagagagacaguugaggggccacugggaacauccugagaacagaccuccucggcuuccaucccuucugcugcgucguccuggcagaccccgcuggcacugccauucucacugacggccacgggcucgggagccgugaagucacagggacucucuggcagagggguguuggggaucuggccacccaugugcauccggauaugcugcuguaacaugacggcguuggugaauuucuucuggcagauggggcacgaauguugggucuuuacggucguguugguucggugaaccccaaggugugucuucagguugccuuugguggagaaggcccggccacagaucuugcacuggaauggucucuccccuguguggguacgguaaugcaucuucagggaacucugacagcugaggacccgaugacaaaugagacacucguuggggucaguaguggccuugucuauguucuccacuaguugcugcaauuucagggucucggacccugacucuggggccccagugcccuggaagcccccagccuuugggggauuauguaucauccccaccccaaggaguggaaggcccgccucacuuucuggagaaggcccuggcugcaugucauugggcaaggagccacccaugaggucccuggaauuaggcccugacgugagcuuuugagguagcccuagagaagggguucccgugaccgggacaggcucggcgucuacagagagacucgauucaucggcagggacggggacagggagugcauagugagaagcggcacucacugccccuuuguccuggaauucggccaacagcuggggguuugccuucaccucagggugucguuguaaguggaccuugagauugcccuugguggugaagcggugaccacagauagggcacacguaaggucucucuccggugugggagcgaaggugaaucugaagggagcuaucugucccgaaaaccuugggacaguaccuacacuugugcuuaccgaggacgacuucguccuuggccuugacaucuaacaccgaggcagaggcggagagguucugggguuuccccuuuccuuucuuggacuggucgagcgucacagcggagaagggacucugcaggagcacagagcccggagucugagguagcagggcacugggaaggcgagacacgaaguuggggagaacccgugucccgucaggcuucaaggugaaggacguuaaccccgaggacaacgggcuggcugcggaggggacgcuggcaugagguagcuuggcuuguuucaaggcaucgagcgacagagcuggguuugaggcuuucuggcugagcagggccacggcagccgacaccugcugggacacggacacuugcugagacacauggcugcuuaaggccuucagcgugucggcccccgccacuccagaguggagcgcgugcgcugcccacauguucaccuggacgcgaaucuguuccguaagcuggauuugcuggaguugcugcugcugcaggcacaggaucugcuccaggacccaagggaugccuugggcagcaggcaugggcgccaugggugccucugcaccccguugguucacggccaccuuggugccgcggagcgccugcagagucacauugguguuggcuacuuugccuuuggguaaauagcuuauguccugggguguggauggcuggguagccucugucuucaaguacaggauggaguccgugcccagcuucuucaagucccccgagcugcugccguucuccuggagacugucuuuauugcuugggcugcccagcugguggcucagggcagcucuggaaaaguccucugaaggcacuggccccucgcugucauucaugaugaggacaggagggguuuuagugcaacuuuucuuguguuccaugaauucagagagacuaaagaacucggcacagcauuuguugcagaugugaguguccucccgccggggccgcuucaccgguauggaguccucugaggcuucaucgcaguucccaggggaguucacuggagcaccugugaaaggagagaaaaaggugagcaggaugcccugagaagggaugucaagugaccagcaguaaucaauuccccaucagcacauguccugacucaggaggauuguauaagggacacuaagucuccuauauauagccuauaggaccgaacaggauaacacgagcaagccugcagccccaugccugucuggcauaacuaucuggaucguuuuuuaggaucucccuuagcccaggcagucucaaaccugcuuuguagcagaggcuggcuuugaacuccuaacccucccuaccucuauuuccagaguccugagauuacaagagccuguuuucccaugccuggauuggacagggguuuuggcgaauguuaaguguuuauucgcaucacuccaagaagaagaauugggaccugugagucacagucccagagaacagggccccaagagucaagacagagauggagucaagggcccccaccaagaacugcugaaaccacaggaaucuaucagcucccccgagcccugaggaagaacccagucagucacucaauccagacauuucacauccaugaaaaucaaucgaccaccguuuaagccaacuuguaguaguuuguuacagcaauacggagauacacagcuauuuuacauaggaacuuuguagcaauccuaccuccagccucccaggagcuaggauuauagauagccacguggcacuacgucccacuagauagcuguuaaauuaaccccaucaaucccuaugucuccuucggugcuggcuugcacagacuaauggacagggccaaaucacacugaucuccaccacgacacaggcgaaauggaaagaauaaaucagaaccucacccaaccccagagaugagcaaguuccagccauuagcagcuagaguugguggagggcuggcccagcuugcaggcgguucugaguuaaguccccagcaccaccuacacgaucacuuggaguacagaacacgggacacuggguguuaaaucuaaggacaaggaucguucuacagcuacgucuccaugagaaaagcuacugacaaaggcuggcaaagaugcagacagacuucacgcccucucaaggagagagccuggcaucgaacucuaaaaacaagcuuuuacauaaauauagagagagcaaaguagagauaagcaauuccgggaggccgacacccuacaacuacaacauucacugcugucccauguuaaacaaagaggauccaaguuagagcuguucuguuuggucgucucaacauugggacagugcaaacgcgaugucuucgacaaacugaagcucaggacucaagaguccuuccucccuuuauuauucaccaagucuguggccauauggaugugcuugcucaugcuauaccauauauggacgucaggacaaccugugggaguuucaguguuguguucugagucucacacggccaggcugaucgaaaaggacucacugcccugccucauccucccaagugcagaauccaugcgugacagggaagacuggauucaaccucgagccucaccgcaccaccgauguggccaccaaguucaaccuagcgcagccuuaauaaaacccucaacuguugcugauuuuggacuacgggauaggaagagcaucugcaggcaccuguuuaucagcagccgggcgugguggcacucaucuuuaaucccagcacuugggaggcagaggcaggcagauuucuaaguucgagaccagccuggucuacaaagugaguuccaagauagccggggcugcacagagaaaccgugccucgaaaagaaacaaaaaacaacaaaaaaaaauguucaucaucuggcgagauggcucuuccagagauccugaguuuaauuccuagccaccaugcaggggcucacaaccaucugucaugggauccgaugcccucuucuggugugucuauagacagcuacaguguacucaaauaaauaaauaaauuagucuuuuuaaaguuuaucagggggcuggagagauggcucaguaguuaggagcacugacugcucucccgaaggcccugaguucaaaucccagcaaccacaugguggcuuacaaccguccauaacaagaucugacacccucuucuggagugucuggaaacagcuacaguguucucacguauaauaaauaaaauaaaucuuuaagaaaacaaaaguuugccgggcgugguggcgcacgccuuuaaucccagcacuugggaggcagaggcagguggauuucugaguucaaggccagccuggucuacagagugaguucuaggacagccaggacuacacagagaaacccugucucgaaaaaccaaaaaaaaaaaaaaaaaaaaguuuaucgggggcucgagaugguucacugaaugggaguaguggcugcucuugcacaggacccagguucaacucccagcacccacacagaggcauguauaauuccaguuccagggaaucuaguguccuguugguaccuguguauguacaugauacacacauauccauauauauauauauacacacacacacacacacacccauauacacccucauucacaaaagcuaauaaaaaacugucgacgugcugugacaagucccucaccacagugaccaacuggagccuuguagaucacccagcagcuuucacugagggggggugaggggaugcugggacccgagcuaggucuuucccuaguacacacacauguccuaugaacacaaugcccuuuucuuucucaacaguaagucuaggggaugggggaggggaauccugcuggauaggaaaccaugaaacaagaaacacauuaaagccaguagaagacacugcuugcccgucuucucucucucacaacaacaacggagagcugggaguugggcagcgcgaagcauacaccuguauuccauccucgacacagagugaagucuugugauuguacacuccuggaauaauagcacccagccaggcagaggauaagaaguuccagaccauccuuggugacauaugagguguccucagauacaggagacccacgauaaaaaauuuaaaauuaggauguaagccgacuaccuguaaugacaguccuagagguucuuaacuucuaggccagccugggcuaccuugacauggagagucugauccuguccaaauacugcaacguucaggacccucccgaacacagcaggcaugggucagguaccacggcuccucacuugcuguccuuccagaggaccgggguucgauuccuagcaccuacauguuugcucuuaacugaaacucuaguucaaggagauuccacaucucaaacauuaaccaggcaugaacauaacaagaaaauauacaaauaagacgggcgagguggcacgcacuuccuuuaaucccagcauucaggaagcagaggcagguggaucucugaguucaaggccagccuggucuacagagaguuccaggacagcuggggcuauacuaagagaaacccuuuaucucucuuuuuuuuuuuaagauuuauuuacuuauuauauguaaguacacuguagcugucuucagacacaacagaagaaggcaucagaucucguuauggaugguugugagccaccaugugguugcugggauuugaaccccagaccuuuggaagagcagucggguacucuuacccacugagccaucucaccagccccuuucucuuuuaaaaauaaaacaaacagggcuggcucagggaucccagcaaccacaugguggcucacaaccauccguaacaagaucugacucccucuucuggagugucugaagacagcuacgguguacuuacauauaauaaauaaacgaaucuuuaaaaaaaauugggguggguggguaugggggacuuuugguauagcauuggaaauguaaaugagcuaaauaccuaauaaaaaauggaaaaaaaauuaggcugggcgugguggcacacgccuguaaucccagcacucgggaggcagaggcaggcggauuucugaguucgaggccagccuggucuacaaagugagcuccaggacggccagagcuacacagagaaacccugucucuaaaaaccaaaaaaaaaaaaccaacucgucuaccucagcaacuggcugcacacaauucccacauuaauuaacaaucaccaacagcucuugaucuaccaaguuuccacguaaauaaaacaaaacaguaaaccaccccaaaauaacuuuguuuucucuaaaagaaccacacaagagucuuuacugaugucugaaccagggucccgcaggccacgcuggcccggaucucacaaggcagccucaagcuuguugagcauaugccucaaccaggauuguaauaucccaacagcacuucaggcuuugccucaauucuucggaaagaaaggaauuuuugaaaggcaggaagcaggcugggcaggguaugggugugucagacaugaaugucuauagggaagugggauagaaagcgggguggguacuuugggaagguccuuuucuguuugauugagacaggauuucuguguagcccuggcuacccuguauguaaaucacccgguauaccaggcuggccucgaauccagagacuagcuugccucuguuuccgggacccucaagaucccucuaaaccgguaccaacuggaucagaagugcuuccagugacgucagccucuccaucccuccgcccuuccuucucgcccacucuggaaacuaccaaugcccaguuuuaccugaugccuaccuaguuaagucuguccaccuuccuaccagggcauccagauggccuuguaccgcucaucuccagcuuccagcucccuaaugcuccaaauaaaugcaagcaacaccagauccaguuuaaguuuccugcagggcugcaaauauugcuucauacacgcugggccagcacucuaccaacuggaccacaucccugucugucuuuaaaaggccagaacacagcaugccacagacagccauagcaugucacagacagccagaauaacauagagaaucccuaccucaaaaaagaaaaaaaaaaaaaacuaaauaaauaaaagucaaagaguucuccaaccacaccgugccacccuaaccugucauuuuauuaacagaauauuaacauuacuauaauauuccccugauauuuuaaaggagguggagagcagacaaaguuggagacucuaagggauccugucuggcacacccucugguuugccccccacccccacaugggguauagagcccaagcccucacaccagcuaaggguguagcucucccacugagcaguaucuccaacucccaaacuuuaaucuccgggauuuagcaugcccacaugcaaugcaaacacuauguaaauaguuuucaggcugcauuguuuaggggagaaacagccagaaacaauagccagcccagggcccucuuagucauuucccagagcuugcaaagggaaagacaagagggcugaauuuuuucguuucugaucauuguucauacaucacuguaccugcuuucccugguacccugcguccgcucagcacucagcugagaagggagcuauggcacaaaaaagguuaagcaucucugcucccgaaggauacaccagcucagagugauuuacuaccgggaugccaaccgccuucacuguauacacaagccccgaagccucucccccugcagccugaccgcugcaccaggcaucccacuuaaaacuguagccgauguuugcuuaggcaguaaaaaacuaccucguccauaccaccgucggcaaauaaugggacggaguauuugccaaggagaaagaggacccuguuaggaacaauugcuggcuaugcuuaaauuaaccugaagggaaggaaggcaaaguccacagggauaacuccagcaagcguggcuuccaucccccaccccgaauuuuaggaauguuaucucuucagcaucuaguuauccaguaaguaggaagaaugcaguaaagccagcaggggucuuucgauucaaucucacccagaugaauagaaaaugcgcuuacuauuguauaggaagaaagcuaaucagccaggaggcagaagacacucaaaacagcuaaaaacagaaacaaaaaaaaaaaauugaaaucuguguaucuugauaaaagccuggugccuugggcuuaucuguuacugguccuguauuaaagaaagacaaugaacaguuuaccuaaagcacacaguauccuagacccugcccuaccuccaggauaaauccuuaccaaaaaacaaaagggauuauauauuacagauccagcuguaggagcuuuauuuuuaaaaccaguuucaaacagcaagccuuaaaaucuacauagagaggucaaauuugacuugaaauuaaguuucuacuuaaucaagaauugcagaaaucaaaaaacaaucacggauuaaacuucaggggccuguggaaaagguuuugaaaggguaagacgcuggccacagcuaaugaaugaaugaccccagauagaucagcccucccguccucugaaugcucacucacaggguggcagcacacgcaaucaauaauucaaguuuuuaaggguaggagggucagaagacgcuuuauauaaaauaugccuuacauaagaguaagggauacuugccucaacugaacgagcuugccaaccccaagagagaucagaggucucucccugggaugaaacaaggcugucuagagccugcaccaaccaaggcuuuaaccuguguguguuagcuguguuuguuaaaaaaguagagauuagagugauuacgguaaccucccaaauucaucuccuauuugguuuggcuuuuuuuuuuuuuucuuuuucaaaaucacguaaccccaagaaagaaacccaaaugacguuagcucuugaguugcuugcugggaagucucaucacccacaguuucuaaaaggcaauuugaaaaaucaaaugggcacuggauuuagcggcacauuccuccaaucucagcuucagaggcaaagacaagagcgugacaaggcugggacagguuagaaagcugucaugguuacuacacagacagacugggggggggggugucaccaaaccaaagcagcuucaagcaccauggcuaggcugucccuuacuaaugaguacaucccccuugcucuagaaccaacaacaaacaccccauggauucaagaaggcuaaagucaagugggaggggaaccacugggcgacccuugccacccgggagccuuuauucaagggagcgaaauaccaaaacuacuucagguugugagaauuaacggugagguccuucgaggucccaggcuggagccugccacauagcagguuccagugaaaacugucauuccguggaugaaauuaccucaacaugcaaggagucuauagaaaacuuuuucacugccacuguacacaaggacccaaaaagcugggugaauaaguggggguacacuaguccaccuaggcaagguuacacccagaaugcaacgccgagcuuccucguacugaauccugccaaaauucuuuuccccaaauucucauuugacauuuuacauccaaaaggaggagauucaaaaauaaccaugccucagcucccccaaaacggcucccgguccccuacuuaaacugaaauccccuuaauccccaucaccaaugacaaaguaucguuuacuggcaguggagaaccuccgaggguuagggagcacauuuuacaugcaauuaaaugaauaaaaaagaagcccccucccccuuuugggggaagacugaauuagcuugaaaccuuaacuaagccaggcacaggcaggucgaugaaggauggcgaggagcgcuaaauuacuaaaaaccugggaaucguaauagcugaagguuguaauccaguuuagcacaaagggcauuuggaacccuuuugagaaaaugcuaauuuuccuuuaaguacuguaagccccuucuccuugaccaccugcggauuuuuugaucugcuaauuauugcccggauuucauuugccuugcucaaaaaaaaaaaaaaaaaaaccugcauucuccuacagaccgaccaagagggauccaaaagcuuccaaaagauuuaucuaaacuaagggugaucccaaaaugcaggcauuaaagaaauuuuaaaacaaaaacaaaaaaccucuucccaaaaccacaaucgaggucccccuacaaacacauuuuaagaacucuuggagaagauucccaaacacugauguugaugcagaagauggggaccccacagagaucacgcgugugcgggucuccggccuagcuaaccucacucaccaggugugugucgcaguccgcacauggccggucuccagagggcgcccgcacgccagaggccgggcuccgaccgcgagugauccgcagaaaacucgcuucccaaggcuggguggcagcgcgcgcccagcggccucagggugcagccagguuaacuacgacuccagccagcggagauuucggaagcccuucuauagcaagccaccucuccaugccgcccacccccagaguccccaccaccagcuaaauaggagaaaaaaacaaaacaaaaaacacuaguaugcgcucaccccaaauggagggggaagggaggucaucgcaggaccaggggaggggucagggccgagagcucgccccuccucuccagaggaagcaggcgggcugaggguuaacccuuuuguuccagguggaccaagcgacccagccucuccaugaucugcacccccaccccuagcuccccgggccaaggcacaaagaguccaucccagcugcccggcccuaugaugugggaugcuccaacgccccaaaacucacauccgcccccucgaacaagcaaugaccuuccaguugcccuggggggcaggggggggggauacaaugagguagaaggucacugaacuuugauaaacucguuaaguuugggaaaaguaggaucccacuccggggaaaacaggagcgcccaagcagagcgcgcagaguccgcacaccgcccaccauccgcggagagcuggaaucgagcgggaggcccagggggacucccuccucccaacguucccgguuucuucggcgacagcacggcgggcagggacgaggggcucgcccgcagcucccggccgcgcugagguccugaacuccguggaggcucaggccgggucagccgcaacccgaccucuccccuuucaccucccgggcgugugcugagcagugccgcccgggggauccgugcaaaaaaauaaauaaaggagcgggggugcgccccagagggggugaccaugcacccgcugcccgggccccggcccgcacccucccgcuggccgcgguuauuuuuagauagucggaaaucaaagauggcuggaggucaggccccgaaagguuagggcgaggaccggcagcaggcgccguagcccccgggaaaggcggaaagaaaaaaaaagguaaacaaaauaucuaaaauuacaaaaaaauaaaaguucccuuccuccgaaagggaacuaagcccaacagccucccccgcccucugcgcugugcggguggcccguaccccggccuggggguggggagaggucgcgcccccuccccccacucggccugggaggggcgcgugcaacagaucgcccuccucggggggucccccagaggugcgccccucccccaggggcccccaagaggguaguagagaggguggggagacuugggggucucuuucuuuuaaaagcggcgccacuagagagggggugaaggaagcccaaguuaccggcguaggugggugcuuauguauccaaaggagggaaaccaauuaugggacuguggacgaggagagagaaguuggagggagaggcagaauguggaaucaacuuuacaauaagagggagaaaacuagggggauuugcaaaggggugggcggguugaggcucccuccgaggugggggauugaggcucccucccuccgcaucucuccuuuccuggaacagaguccggaauccccauuccagaaucggcucccggaacccgcgcccucgagggacgcgcggcagugcuaggagcgcccucccgggacgcacggacagucgggcgcacggacguggccgcagccgcacucaccggguuccuccgccgccagcgccucggcgaggucggggcucgguagcugcugaggcugcucgcccuggcccuccucccaguugaugugcuggggcuucgccugcuugcgccucgacauggugcgcgcauuggggcgccgggaagagcccuggugacuugcccccucuccgccaccaauuccuggaguugggaaauuuuagcccccuucggccgaaacgcgcaugucccaguaauuauuauuaucaauaaugcauugcgauuuaucaugagcucugacagcugauuggccuggguccaagaccucagagaucauuuaaauaagcccucauugaucagggaggggagaggcaugcugggccuuguaguccggcccuacaugugacaaaggcguguucaucuaggaagcauagcuaauuagcauccgggcucagauuggccgaggcguggaucgacuuggagguggggggaaucauccuugcggccacuauccgaauucugagacggaaaaaggaaaauugguuuauugaaaaucagggcuggacaugaaaguucuagaaccgauguaucucgguuacgcgcuccacaaaauuauuguaguaauuggcguaguugauaacuaccagcugagaaaggucuuuccgcucacagaaaaauaagucgguucaacuuuucccucuaaaaucaaaccugaacaagagacucgagucccuuuucaauuuucuuuuuacggaaauguuaaaacugcguuuugaaguggccggugguaccuucuguccaucccaccuccccaucuuaccuaauuucaagcucuuccgaacccaccaggguuugcauccuuaaaaugcugaguaauacucgcgggauucauauucacgagccaggauuuguuguaaacuuccuggauuuucggaagcacuucuaaaccacugucugcuaacuguagaaagggcagaugaaaagcaaacuugcuagaaaacaauuccagaauagcaagugguugcagauucuaucccuaaagcuguucagggcucccaaaagguacgaggguguuuguacuuaacugcuuucuagaacacugcaauacagaacugacuuacagaaaagccacuuccuccugaaguugugugguccugauucgggaaugccuagaauuuccuaaaaggguguguauggauauaaaaauuuauuucucaaauc

SEQ ID NO: 1295 - RNA, 1968 nt, Mus musculus
uagucggaaaucaaagauggcuggaggucaggccccgaaagguuagggcgaggaccggcagcaggcgccguagcccccgggaaaggcggaaagaaaaaaaaagguaaacaaaauaucuaaaauuacaaaaaaauaaaaguucccuuccuccgaaagggaacuaagcccaacagccucccccgcccucugcgcugugcggguggcccguaccccggccuggggguggggagaggucgcgcccccuccccccacucggccugggaggggcgcgugcaacagaucgcccuccucggggggucccccagaggugcgccccucccccaggggcccccaagaggguaguagagaggguggggagacuugggggucucuuucuuuuaaaagcggcgccacuagagagggggugaaggaagcccaaguuaccggcguaggugggugcuuauguauccaaaggagggaaaccaauuaugggacuguggacgaggagagagaaguuggagggagaggcagaauguggaaucaacuuuacaauaagagggagaaaacuagggggauuugcaaaggggugggcggguugaggcucccuccgaggugggggauugaggcucccucccuccgcaucucuccuuuccuggaacagaguccggaauccccauuccagaaucggcucccggaacccgcgcccucgagggacgcgcggcagugcuaggagcgcccucccgggacgcacggacagucgggcgcacggacguggccgcagccgcacucaccggguuccuccgccgccagcgccucggcgaggucggggcucgguagcugcugaggcugcucgcccuggcccuccucccaguugaugugcuggggcuucgccugcuugcgccucgacauggugcgcgcauuggggcgccgggaagagcccuggugacuugcccccucuccgccaccaauuccuggaguugggaaauuuuagcccccuucggccgaaacgcgcaugucccaguaauuauuauuaucaauaaugcauugcgauuuaucaugagcucugacagcugauuggccuggguccaagaccucagagaucauuuaaauaagcccucauugaucagggaggggagaggcaugcugggccuuguaguccggcccuacaugugacaaaggcguguucaucuaggaagcauagcuaauuagcauccgggcucagauuggccgaggcguggaucgacuuggagguggggggaaucauccuugcggccacuauccgaauucugagacggaaaaaggaaaauugguuuauugaaaaucagggcuggacaugaaaguucuagaaccgauguaucucgguuacgcgcuccacaaaauuauuguaguaauuggcguaguugauaacuaccagcugagaaaggucuuuccgcucacagaaaaauaagucgguucaacuuuucccucuaaaaucaaaccugaacaagagacucgagucccuuuucaauuuucuuuuuacggaaauguuaaaacugcguuuugaaguggccggugguaccuucuguccaucccaccuccccaucuuaccuaauuucaagcucuuccgaacccaccaggguuugcauccuuaaaaugcugaguaauacucgcgggauucauauucacgagccaggauuuguuguaaacuuccuggauuuucggaagcacuucuaaaccacugucugcuaacuguagaaagggcagaugaaaagcaaacuugcuagaaaacaauuccagaauagcaagugguugcagauucuaucccuaaagcuguucagggcucccaaaagguacgaggguguuuguacuuaacugcuuucuagaacacugcaauacagaacugacuuacagaaaagccacuuccuccugaaguugugugguccugauucgggaaugccuagaauuuccuaaaaggguguguauggauauaaaaauuuauuucucaaaucu

SEQ ID NO: 1296 - RNA, 1968 nt, Mus musculus
agauuugagaaauaaauuuuuauauccauacacacccuuuuaggaaauucuaggcauucccgaaucaggaccacacaacuucaggaggaaguggcuuuucuguaagucaguucuguauugcaguguucuagaaagcaguuaaguacaaacacccucguaccuuuugggagcccugaacagcuuuagggauagaaucugcaaccacuugcuauucuggaauuguuuucuagcaaguuugcuuuucaucugcccuuucuacaguuagcagacagugguuuagaagugcuuccgaaaauccaggaaguuuacaacaaauccuggcucgugaauaugaaucccgcgaguauuacucagcauuuuaaggaugcaaacccugguggguucggaagagcuugaaauuagguaagauggggaggugggauggacagaagguaccaccggccacuucaaaacgcaguuuuaacauuuccguaaaaagaaaauugaaaagggacucgagucucuuguucagguuugauuuuagagggaaaaguugaaccgacuuauuuuucugugagcggaaagaccuuucucagcugguaguuaucaacuacgccaauuacuacaauaauuuuguggagcgcguaaccgagauacaucgguucuagaacuuucauguccagcccugauuuucaauaaaccaauuuuccuuuuuccgucucagaauucggauaguggccgcaaggaugauuccccccaccuccaagucgauccacgccucggccaaucugagcccggaugcuaauuagcuaugcuuccuagaugaacacgccuuugucacauguagggccggacuacaaggcccagcaugccucuccccucccugaucaaugagggcuuauuuaaaugaucucugaggucuuggacccaggccaaucagcugucagagcucaugauaaaucgcaaugcauuauugauaauaauaauuacugggacaugcgcguuucggccgaagggggcuaaaauuucccaacuccaggaauugguggcggagagggggcaagucaccagggcucuucccggcgccccaaugcgcgcaccaugucgaggcgcaagcaggcgaagccccagcacaucaacugggaggagggccagggcgagcagccucagcagcuaccgagccccgaccucgccgaggcgcuggcggcggaggaacccggugagugcggcugcggccacguccgugcgcccgacuguccgugcgucccgggagggcgcuccuagcacugccgcgcgucccucgagggcgcggguuccgggagccgauucuggaauggggauuccggacucuguuccaggaaaggagagaugcggagggagggagccucaaucccccaccucggagggagccucaacccgcccaccccuuugcaaaucccccuaguuuucucccucuuauuguaaaguugauuccacauucugccucucccuccaacuucucucuccucguccacagucccauaauugguuucccuccuuuggauacauaagcacccaccuacgccgguaacuugggcuuccuucacccccucucuaguggcgccgcuuuuaaaagaaagagacccccaagucuccccacccucucuacuacccucuugggggccccugggggaggggcgcaccucugggggaccccccgaggagggcgaucuguugcacgcgccccucccaggccgaguggggggagggggcgcgaccucuccccacccccaggccgggguacgggccacccgcacagcgcagagggcgggggaggcuguugggcuuaguucccuuucggaggaagggaacuuuuauuuuuuuguaauuuuagauauuuuguuuaccuuuuuuuuucuuuccgccuuucccgggggcuacggcgccugcugccgguccucgcccuaaccuuucggggccugaccuccagccaucuuugauuuccgacua

SEQ ID NO: 1297 - RNA, 2391 nt, Mus musculus
uaaaacaaguuuuauuuauucugugugaguacacuguuaucuucagacacaccagaaaagggccuuggaucccauuacagaugguugucagcccaccacaugguugcugggaauuggauuuuuuuuuuuuuaaaguaauuguuuucagauugggauuaggggcccuaagaacaaaauuuacauaucaacagaucuggccuccagguccucccaggauccuccaggcccuguuuagcauacccugcccaaacccuaaacuucccagcccaguggcugguugggcugcccuuccugcaggggcucucccuauagaauccagacauuuggucucuuugugcuuucucucuccucuccccccugcgcacacacucuuucuuucuuucccuuccuccucucuucucuuucccuuagcauggcaauuuccuuggcuuccuuccuugagaccacugaacuuccuugccugcuucccaauaaaccugcccuuaauauaguaaccaucucucuuugcaacaguguuacugaaugacuaagcagcucauuuuaagucuccugccauuuuggcagcaggaaaguuuacacaguggguaagcagcacaaggcugguggccaucuuggcuuugagaugaagaugguguggucagaguuucaccgccaucuugguuaagggcagucauacgcuggcagccaucucuuaugggaaauuaugguuugacugccaucuugccuaagggcagcaacacaugacaugagcauaucaggaaagcaggucuccaaacuauuucuguccugucuugauaauuuguugcacucucuauguuuuucuuuacucuuuaauaguacuaaagacaaaauggagagauuuuaaauucuuaaaguuuuagagguuuacaacauuaaaaacuuaaagaucacugccauguuuuugcuaauguuguaaagcuauaauuuagccuuagauuuaugcugcguaggggccaagggaugcugggagagucuggaagccaggucuguuuugauacguaaaauauguaccucagucccuuggucugaaaccaaauauccuagccuuuguugauaauaaaugaauaaggggcgauguaaucgucuauggcuacuuccugcugacauugggguacaguuuugaggugugggccaaaagcugggauguuggccaaguccgagaagagcugguuguuucucugcuguccaggcugugggaccgucugaggguaggcgagugcaggcacagcagaagcagugugaggcugggccagagcaccuguggguaacuguuuuggagcuguucuggaugcagguuaugagagaacagcuggaugucaggagcagaagagaaagcuaaggaguuuagggagacagccauuuucuugggugugcaucugaaacucuuuuuuuuuuuuuuuuuuuuuuuuuuuugguuauuugagacaggguuucucuguguagcccuggcuguccuagaacucacuuuguagaccagguuggccucgaacucagaaaucugccugcuucugccuuccaagugcugggauuuaaggcaugugccaccacugcccggcucaucugaaacucuuaggcccguggucuugguaguuggaggggugcuaguggggucucagaaccagagcaagcagaauagaucccacccucaggaauaugcagguggggaaggaaaacaggacucaucuggaguccauuugacugugggaggcagauuugaaugaagcuuacaagaauuuuuuuuuaacuuuaaaaaagauaaauccuuccuaacuugcauuuaucaaccucaaagcaucuuccuaaaccuucaaacacuuucuuaggcccucagagacuuuuguagaagcuuucauagccucagaccuuaauaagcuuuacaccuuuuccuauccaauuauuugcgagacacagguaaggcgaucauugggagcugucacugcaaagggagcuccuuuagauaaaggaauagcaaaaaaaaaaaauauauauauauauguacacacacacacauacauauauauauauacauacauauauauauacauauauauucaaucugaaaccuguuuauuuuuuaucacaaagccugugagcaaggcaaaccuguucacauuucuaauaagagagcugguagguuuaacuagcugauggaucaacuaaugaacuaacaugguguuaacuuaaccuugggguaaggagcuaguugccuauucucuagcuguuaugacagcuuagccgucaugugaucagagaccagagaaggauaaauaauaaccuaagugucauauauuaauuaaaaugacggagauuaauccacggucuacuacccaggaaguucucccagguuccuguggucuccauugcauugug

SEQ ID NO: 1298 - RNA, 2391 nt, Mus musculus
cacaaugcaauggagaccacaggaaccugggagaacuuccuggguaguagaccguggauuaaucuccgucauuuuaauuaauauaugacacuuagguuauuauuuauccuucucuggucucugaucacaugacggcuaagcugucauaacagcuagagaauaggcaacuagcuccuuaccccaagguuaaguuaacaccauguuaguucauuaguugauccaucagcuaguuaaaccuaccagcucucuuauuagaaaugugaacagguuugccuugcucacaggcuuugugauaaaaaauaaacagguuucagauugaauauauauguauauauauauguauguauauauauauauguauguguguguguguacauauauauauauauuuuuuuuuuuugcuauuccuuuaucuaaaggagcucccuuugcagugacagcucccaaugaucgccuuaccugugucucgcaaauaauuggauaggaaaagguguaaagcuuauuaaggucugaggcuaugaaagcuucuacaaaagucucugagggccuaagaaaguguuugaagguuuaggaagaugcuuugagguugauaaaugcaaguuaggaaggauuuaucuuuuuuaaaguuaaaaaaaaauucuuguaagcuucauucaaaucugccucccacagucaaauggacuccagaugaguccuguuuuccuuccccaccugcauauuccugagggugggaucuauucugcuugcucugguucugagaccccacuagcaccccuccaacuaccaagaccacgggccuaagaguuucagaugagccgggcagugguggcacaugccuuaaaucccagcacuuggaaggcagaagcaggcagauuucugaguucgaggccaaccuggucuacaaagugaguucuaggacagccagggcuacacagagaaacccugucucaaauaaccaaaaaaaaaaaaaaaaaaaaaaaaaaaagaguuucagaugcacacccaagaaaauggcugucucccuaaacuccuuagcuuucucuucugcuccugacauccagcuguucucucauaaccugcauccagaacagcuccaaaacaguuacccacaggugcucuggcccagccucacacugcuucugcugugccugcacucgccuacccucagacggucccacagccuggacagcagagaaacaaccagcucuucucggacuuggccaacaucccagcuuuuggcccacaccucaaaacuguaccccaaugucagcaggaaguagccauagacgauuacaucgccccuuauucauuuauuaucaacaaaggcuaggauauuugguuucagaccaagggacugagguacauauuuuacguaucaaaacagaccuggcuuccagacucucccagcaucccuuggccccuacgcagcauaaaucuaaggcuaaauuauagcuuuacaacauuagcaaaaacauggcagugaucuuuaaguuuuuaauguuguaaaccucuaaaacuuuaagaauuuaaaaucucuccauuuugucuuuaguacuauuaaagaguaaagaaaaacauagagagugcaacaaauuaucaagacaggacagaaauaguuuggagaccugcuuuccugauaugcucaugucauguguugcugcccuuaggcaagauggcagucaaaccauaauuucccauaagagauggcugccagcguaugacugcccuuaaccaagauggcggugaaacucugaccacaccaucuucaucucaaagccaagauggccaccagccuugugcugcuuacccacuguguaaacuuuccugcugccaaaauggcaggagacuuaaaaugagcugcuuagucauucaguaacacuguugcaaagagagaugguuacuauauuaagggcagguuuauugggaagcaggcaaggaaguucaguggucucaaggaaggaagccaaggaaauugccaugcuaagggaaagagaagagaggaggaagggaaagaaagaaagagugugugcgcaggggggagaggagagagaaagcacaaagagaccaaaugucuggauucuauagggagagccccugcaggaagggcagcccaaccagccacugggcugggaaguuuaggguuugggcaggguaugcuaaacagggccuggaggauccugggaggaccuggaggccagaucuguugauauguaaauuuuguucuuagggccccuaaucccaaucugaaaacaauuacuuuaaaaaaaaaaaaauccaauucccagcaaccauguggugggcugacaaccaucuguaaugggauccaaggcccuuuucuggugugucugaagauaacaguguacucacacagaauaaauaaaacuuguuuua

SEQ ID NO: 1299 - RNA, 6309 nt, Mus musculus
caaagcugcugccucauuuagcgaauggcauucaggugagacagcugugugaagacauuaggagaaugaggaccugggaaaaacaaaacugccucugugcacgugugugugugugugugugugugugugugugugugugugugugugugcauacacgagugcaugcauacacucacagucacacaucuauacauguaugcacacauacaugaacacauguacacacgugcauacacacaucuauacaugugugaacacaugcaugaacacacacacacacacacacacacacacacacacacacgcuggcaccaugaagccccugggauguuuucagucuucuugcugcugucuuuaagcaagucacagcugugccugcugugacauaaauguuuggggacuauagcuuucucuggcugucacuugaguaguuguauuucacauggucuuuggauuucugcaaugcauuucuuugccuauggagagucuaacuccacuacccagcaucucuaaccaucucugccuccuguucuguccccaaguuuucucagcauccuguucaccucuuccagggccaugaccacaauucacaauaucuccuugucuauucuugaucggguuuuguagacauccccaccaaggugcgaggcuccaggagagcagagaggcugugcucuugugcaguauuaucaaaugcaguaucuguauaaucgauguauaaggugacggcuuugaaaacgugaccuacgggguggagacacugagcucugguccugugccuuagaguugccuaaaucaacagcaaacaaguaucacauuaaacucaaagaucacgaagcugcagaacuaaugcagcggauaaaagggcuuccucacaagcaauagaacccauguucaauucccaaaagccauggagauaagcugggucuaacccaacacuguagaaucagagaccucugaucccugagacucacuggucagucagucuguccuacccagggagacccaggucccagugagaaacucugucucauaaaauagugguuagcaugaagaauaauacuggaggugacaucuggcuuuuuucacaccacacacacgcacacacacacacacagacaacauggcccaagugucagcucuauguugcucuccauacugucucuuuucagacuucuacaucuccugcauguaaggaccagguaauccagcgagcggcugggacagcaucaagauguccuucaaggacuagggacuguugagugcuuggagaaaacugacagcaggaagcuuuuaccagacugagagauggcaaagggaggagcucugugucuuuaauauucuaaaugcagaguagaaaaugucuaucaugcauaggggcggagcaaagauggcgcaggugagaggaggggaacacccagaggaacugcccagcaucaccccuuguguucccaggcuuuucaagaccucauggucuuauuugcuuuuuaucucccaguugucaaucaagcaggggugggggaagacaccuaccuaucucauacuggaauaucauggcaaagguauacugaacaugaaagaacaaggcuauacacguugugaacauauuuuaaaccacuuugaugggaauggcucucucuaagauaccuaagcaaugaucaggcaaaaugucuuugcaagaauauguauuauucucuuauauaugcaaaaagaguacugucuuagucaggguuucuauuccugcacaaacaucaugaccaagaagcaaguugggaaggaaaggguuuauucggcuuacacuuccauacugcuguucaucaccaaagaagucaggacuggaacucaagcaggucaggaagcaagagcugauucagaggccauggagggauguucuuuacuggcuugccucaccuggcuugcucagccugcucuuauagaacccaagacuaccagcccagagauggcaccacccacaaggggccuuucccccuugaucacuaauugagaaaaugccuuacagcuggaucucauggaggcauuuccucaacugaagcuccuuucucugugauaacuccagcugugccaaguugauacacuagccaguacaauuaccaaacagccagagaaauaggaacaaaacccuagaucuuaaaacuuuaaccagaaguuacacuaugaucugcuaauuaccugugccauuuucucccccacauucuugucucagacugaugggaacuucccccguguacauuugcuccaagaucucaauugucuucaugccuuggaggacaucuugagaggcucccauugccugcaguaucuggucacucucguguccuuuaacgugacaggagaacgaauccccgcccguuguuucugugucuuuuccuauugaugugauaaaguacuuuggcaaaagcaacuuuguagagaaaggauguauuuuagcucacaguucgggagucuuaucuguccuggugaugaugaacucaaggcaguaagagcuugaagcaucuggucacagaguguccgcaaccaggaagcaaagagcaaugaacgcuuacauagugguucuuaggucacucucucuacacuaugcaguugagaaauuccuucccagggaagaguccugaccacaguuaaaaagaguuuucccaaaucaacgaauacauagauaaucuggaguaggcaugcuuagagcacugucuccaaggugacuccagauucugucauguugauaauuaauucugaccaucacacuccucucugaaaagaucaccagugaagcucgucgacaccaggggaagaagauaccaugucuucagugucagagacauucuaaacagucagucagcaguucacgucucaagcaaucacagggccagggcgaaccugucaugcgaaccucauucagagucacauuucagagagcggaaugaagacccccuaccucaacucugcuaagaggugacaggaaagaaaaggaucaccaucuagggccaggaagguggcacagucacuaacgugcuucccguguaagcaugagggccugaauuuguuccccagaagccacguagaaaagccugaugggauuguauguauuacagccucaaggcagaugagaucagaucuaaagcuguggagguugcagcauugguccaaaccucccauucccaugcgagucaagcacaguagaggcggguuucaaaucucucuaauagcauccuuucuucacaaauuuccuucaacuaucccuggcuuagaacuaggacuaucuccucucagccaaacucuauggugugcugggacgugcuggguccuguaggauucucuggauacugauaggcccagucacugcaaugcucuuccuuguuagaaccuacugguuaguccacgauuuggaccucagugucugaugaggguaugguuuuguuuccuguuuugggaccuuacaauuccacuuaacuuaagaauuauuucuucuccccucagggcgcauucaaggcccuuacuguaugcccuucuccuuggguuucugcugcauggguagaaugggagcuugaagaacagugucccaagagaacucacugguaaagcuugccgccugaagaaucuuagugacagcaaccuuccuguaaacguagcucuuugcauggguuacaauuugccaccugccaagacugaccuggggagggcuguggcauucacucccacgggugugaggcauugggguucuggcugugcucacgugggucauagacgcuccuuguagggguucccucucucccucccucuccacaucccccuauuugguuucuuacuugccccagagcagcaugguuccuaggacagcagugacucugcauggucucugaaaacccaacugagaagagaaagaaaagcacuguagccccuagccaggcuucucugggucauccugcuucacacacacacacguauacagacacacguauacacguguacauacacguauauacacguauacacacacauacacacauauacacacauguauacacacauacgcauacacacauaugcacacaaacacacacauguauacacacauguacacacauacgcauacacucauacacacauauacacacaaacacacacacguauauacacauacacauauacacacauauacacacgcauauacacacauguauacacacauguacacacacauaugcaugcacacguacacacacguacacauaugcacacacacacacauauacaaacguauacauaugcacauauacacacgcauacacacaaacacacacauaaacacauguauacacacauguacacacacauacgcauacacacacacauguacacacauacgcacacauacacacacacacacacacacacacacacacacgcacacaacucugccagggcugcuugcaaaggacuuauugcuaacacaaguuuucuguauuugaaaggacugaucggaugauaacuucuggguuuauuuucaccaauggaaccccacagucaaggcuccagggucaguguccagaccaagauccccugaggccugcucaagcugacauguuuugugugagucucaccaaguguugcggaagggccugcaucccccugggaugcaauucuaucccggaauuucaucucucagauucuucagugcccagagcaccgagccuuaagaacagagucugaagcagaggacuuaugcuucuucuuaugaauaggaugguagucugggcaacguccuaggauggugaucugggcaaccucagaucacucaccacaagcccagaguaaaaauagaaguccuucuuggccuuuggcuuugugugugugugugugucugugugugugugugucugcgucugugugucuaugugugucucuauguguaauguuuguguaucuauaugugugucucccuguguacgagagaugugugugugugagugcacacacacuugcaagcacauccugccuucucacucuuucucaaacuuuaucccagguacauaguuuauaacuccucguugggaagccagggacagguccuuucuuguggacccaauuugccugauuuaccccugcccuauaugcguaaacuccccauaauucuuugugugcuucacacugggcaucccaugccugccugaugucagcuccccagagucagucccuauucuggccucccuugacugugaccugcauaacuuugggacccuccugauggauuaaugggaagugaagaaaugauagagagacagacgacacccuggaaccuaguggguuguaugcuccauagagacacagugagaagccagcuccuuuauuuauacgggcagcaucagcuaagagguucagcugaucucaguagccauucucugcaggagcagucucagcugcugucaccugggaucaggaagcugcauuagguaccuucuccacaagaugguuuuagccaagggucaacuucucauuaacuccuguacccagggcagaaaaggcuuugucauuuccugagccugccucagggaaggccuuacuguucccgugggucugagucacugguauccuuuauuuggcuguuuuccugucuuggaugcucauucauacagggguacacacccgcuccccagaaaccaagccaucauaaaucacaccgauuacgcaaaauaauccacaaauuguuuuuuuguauguuuguuuucuaauuuuccagacagcuuuuggcuauguagcccaaauucucaauccuccugucuccaucguuccucacuuauagacuucaagggauugcacuugauguaucaauuacgucucuguugcuacagcaaaacgccauggucagagcaaccuauggaaggagccuuaggaccuuaggauuccagaagaacaagagagcccacgauggcagaggagaggccaggcaacaagcagcaggugcagggccaaaacccaacuccagugacacacuuccgccagcaaagucacucugaacaucacagacaguaccugcuagccuucuguccaaacuccuccccacaguuaccuggcaacagccagguaggccuggcccacuauaaaaggggcugcucgccaucucugucucucugucucucucucucuugccuucuuuccuuccuuucuugccucuugcucucuuguucccucucucuccccauucccuucccccaccuccacguggucaugucuggccucuacuucuguggcccguaguccaucucugucaauaaagucuuauuaacccaccuccau

SEQ ID NO: 1300 - RNA, 1117 nt, Mus musculus
gcuggguugagcguaagcuggucguggucucguguugcccaugggcugcagagcuucaaaguuucuagugccccuacuggaaugagcgucuuugaucuuuuccgaggcuuuuucggcuuuccuggaccucggagccacagagauccuuuuuuuggagggaugacucgagaugaugacgacgaugaugaugaugaugaugacgaagcggaggaagacagaggcgcgugggguugagagagcuaugcguuugaugguucucagccuccagaggaauucgguuucagcuucagccccaggggagggaugcgauuccacggcaacuuuggcuuugaugaucuaguacgagauuuuaauagcaucuucagcgagaugggggccuggaccuugccuucccacucuccugaacuuccagguccugagucagaaacaccuggugagagacugcgggaggggcagacacuacgagacucaaugcuuaaguacccagauagucaccaacccaggaucuuugagggggucuuggagagucaugcaaaaccugaauccccaaaaccagcuccagauugggggucccagggaccuuuucauagguuggaugauacauggccugugaguccccauucuagagccaaagaggacaaagaucuugauucccagguuucccaggaaggucuggguccacuucuucaaccccagcccaaaucguauuucaaaaguaucucugugaccaagaucacuaagccagaugggacaguggaggaacgccgcacugugguagacagugagggccggagggagaccacagugacccaucaagaagcccaugacaguuccagaagugauccagacucucagagaucuucagcuuuggaugaucccuuuuccauucuggauuugcuacuaggacguugguuucggucccgauagcguucuuaaacagaggccuucagguccuucccacucccuuccuguugcccauugccaauaagcuuagcucugucugucaucccagggucuuaaaugugugaaacaauuaauugagcuuaugccagucugucauucauccaaauugaccaauaaagccuuuauuuaugcuaaaaaaaaaaaaaaaaaaaag

SEQ ID NO: 1301 - RNA, 598 nt, Mus musculus
uacucugcguauugaacggcaaugcaggguaccagauaauucuggcuaucugaagggcaagccgugggagcuuggcgagcaaaguccuacuucacaggaaauucacgccuggcauuccaggacagcacagggaccuggcccagggacucugcagacccuguucugugguacucuuauuaaggagggagugucaagucaagcuggagacaaccaggcagcacuuacggccucagagacagacacagaugcccuuucuugggaucagacugggucuggagggcaggccugucaacagcuggacaacuuauucacuucugccaggccacagcauggcgguggcuauacaagaggacaugccagggacuaaaggggcuacaauauucacgagcuccucucugaagaccugcacuagcccaucucccuuccccaguggcucugucucggucaucaucucccucaacaagacucucagcacaaggauaugaagacagacagguaccugggaaggugggagagggaagaagagaagaaggaagacuauguaggugacauacacauauucaggugacacggaacuaauuauguuguaacuaaaaag

SEQ ID NO: 1302 - RNA, 2390 nt, Mus musculus
agacuacacccaguguggcacauagucacuucugcugccugcugaucaagaugcagaauucugagcuccuucuccagcaccaugccuaccuggaugcugccauguucccaccuugaugauacuggacugaaccucuaaaccuguaagccaccccaacuaaaaaugugguccuuuauaagaguugccuuggucauggugucuguucacagcagugaaacccuaacuaagacaccgccugaucugucugcaaguucuuuaguguuuaagaagaccugggacaaagagacacggggucuaacgugaagcaaagacuccaggggcuuuguucgaaugcaaagggaggggaugcugggcuggucgccaagaacaggggcauuuccuuggguuucccagguggucucuccauuugcucuggugaccuacuugcugugucaucuguuucuacguaaagaaaaaugucagcuuuaagucauuuucacaaaaauuuuuuaaccuccuuauauuuuaauuuuguaacuguguacaugugcgugugcuaccuguguaugggcgugugcacaugagugcagcguccauggaggccgaaggugucagaacccagcagcugcaguuaaaggcagugucaggcagcccgguguguagucggggaacuuuaugggagggggcacaguauagaaacagauaacaugucugcaccauuauugguugggguauuguaaauaagagaaagagaacagucagaggugucugggggagucugccacuguugcuucgcagggacacagagagaaacaaagaaccaagaaccugcucucuuucccccuccccucccucuuugccucuaccucugucgcccuuacccucccucucccccuccuccuccucucuuccccacguguucccgaccagccucuucuccccgcccccccuuucuguccuucucuguuccccuccuuuuucugccucuacccccuucucuaggucccucuccugcugauaagcucucuuuuuacacuaagcuugucagaggcugguuccuccgcaugggcgugcugaggugcuuccucccgccacaucaucaccuccguuuuaugaggugagauggcaggccugcaccauggucacagcaccaggcccaguucacgucacugucacuguuagagccacccauguucuaccaacacuggcaccgucagccuucaacgaguaagggacaaagaaaggaaucuggcucuacuuuucuuacccugccaggccacuauucugagaaugacuaauuggugauaucagaaauuguguguguggcagagguugggagggauuaauggauacugaaggaguuauugucuucaguucuauggggacuagugagcccgccaggugccaggcuccacaugcaucguaaugcagaugacccggguuagacucagggggucacaaaacagaaagacauguauguagggaaaaguuucaagggagagauugacaggggugggaagcgggggauaaaagagggugggggugaaagggaucaggagguguuagcauuuugucuuggcucugccccauaguuaccuggcaacugccaggugugccugacucacuguaaaaggggcugcucaccccauccucucucuagccuucuugcucucacucugucuucuccucccacuuccccucucucccuauuccccuccccccucucuccaugugcucauggccagccucuauuccucuucucucucucugucucucugucucucucucucucucucucucccucucucucucucuuucucugucucuacuacccucuuaacuccccuccccauguaaugaguaaacuauacuauucuauaccuucguguggcuggucccucagggggaagggaugccuuagcaugggcccacugagacauccccucccccacauaacugacuacacaucuaucaagcauauuccuucucucuuuauuuuuguaaaacacaacaggagguauuguuuaugugcaguaucaucaaagaauacauuuaauugauaaaauaaaugugagucucuugcucauuugagcuuucuuucugcuuuuuaaacaacuucagguugaccuggagaacuggcuggucaaagguguuugguccuggcuccaccgcuggcaguugcuugcuuuguccucucggagucucaugccguguggugucucccagaacucuggguguaugaccauccugaaaccggaugagaucaugaagaacuggacacuaucauaugcauguccuuggggcauugccacaccauguggucaucuacaaaguucauaaagaacaacugcacaauugaguuucaaauuuuuuuaauuaauuauuaauaagucgcaagaaaucucaugcuu

SEQ ID NO: 1303 - RNA, 14733 nt, Mus musculus
caugcagccgagcgccgagcaucccugcucccucgcaagucugcccuucucgccaucuuacucacuggcacguucgagacgcucauucaccgucuccgaacuaaucaccuccgcgacugccuugaauccaaagggcugugugugacuggcgaacgccugauccuggggagcacggcgggcgauagaacggccgcagaucggacgggccguuggugcaccacuuccgggcuccgacagcucagugcgccugcgcccagcuacggcagggaacgagcuucccauagucgcguuuacggugagccaaucacagaacggcauugcuccggcucuagccaaucagcucuuggaguagaggguuugacuccuauuuuaaaaggagaaccuuugaauuguaacggcugagcuaccgggaucgcuuggaggcuucggucgggagcagguuccugccugugaguuggaaagggacauggcuguugagggcgagccuggaugcugcaaacggauagggaaggcuguguggcgucgggguaauggacugucucaguggguuugcauucuguuuaagaaagguccagacguuuaagauuucccggcuugguuuuagguucuugugggaauggggauccagaccaucagcuaaccgaguaauuugcaaaccgaugguggaugcgggaacugcggcuuauuggggacugcuucggguggagaaucagagucuaagucgacucgacgagucuguggaugaacgggaguucccucguagagugcccaggacuggugcugcucuucccgcagccuucugagcaguuuaugucgggacuacuugagggucuguuucaaagcgcagacccgcuaaagcucaguuuguagaauauuccagaaguuuuaggauugaacacugccuucgugguggccgccgcuguuuauuccaacaguaaggugguggaggcaggaucaagucaaaggucauccucagcuacacaguagguccgaaaaaccagccuaaauuacauccacauacgucccuaccucaacaccuccauccccaccacacacacacacacacacacacacacacacacacacacaccuaaaugugugguugcuuacaucagcagucugaggcaggagguuagccuucgauuuaaggccagccacagcuaauaagugagagccugucuggggauguaguucaguuaguagggugcuugccuagccagcccuggauuccauucccagcacuuggaaccccgaggauggugaugaccucugugguccuagcacugcggaacugcaggcgggaggaucaggaguucagaguaauccuccaccguauagcaugcucaaggccagccugggauccauggaacucuugucucuaccacaaacauaaagguuagguguggucuugcauucuuuuaaucccagccuuuuggaggcagagggaggaacucggugaguucaaggccagcuuggucuaccuacauaaugaguuccagaacagccaggacuacccagggagacccugucucaaaaaaaaaauccaaaccuaacaaacaaauccuggcuccacugcaaauacaggaaauagaaaccucuuagggauaagacccugguguagcuauuaugggaaagcuaaacugcagggcugguuauuaaccuuggucuggggcccaggagugugagguagcugcaacugcaguccuuugcucagggcuucugccuccugccuagcuucccugaucugaaaaggggaacccuguggcaugugcaacuuucuuguaguaaaucuuugagcugagugagaaccaucaaggucauuugguguagauccgaaggugaaggacuuggacuccuccuaaaagaaaggcucuuguuuccuuuuucaggugacauggacagauguaaagaaaacugugucuccaggccuguuaagguacagaauuaccuguauuuacaauuucggcuuuuaaaagauuuauuucugccgggcgugguggcgcaugccuuuaaucccaacacuggggaugcaaggaggcagaggcaggcggauuucugaguuugaggccagucuggucuacagagugaguuccaggacagccagggcuacacagagaaacucugucuugaaaaaaacuaaaaacaaaacaaaacaaaaagcaaacccaaaacgaaaacaaacaaaagauuucuuugcuuauuuuaugacuaugaaugugucuucaugcacacuagaagagggcauuacagaugguuauaagccaccaugugguugcugggaauugaacucaggaccucuggaagaguagccaguacucuucaucgcugagccaucucuccagcccccacaaucgguauuuuuuaaaugaugugcauuuuguuugugugcaccuaugcauaugccacuguguaggucagagagcaacuugucagaguggguccagagacccuaacccagguccuuaggcuuggcuguaaaagaccuuagucccugagcaaaucuguacagugcucguggaaucgaauccuuuccuccguggcuuuggguagaaacuuuagguugacccugccuggaggcuaccugagccucuguuucuucaggaaauggcucugcuguggaaaccucagacccucugagcucaugguggauccugagcgccucauuuaaggaggagggagugccagcgucucugagugugauuaguuuagucuuaagaucucguuaagacugacacaacacagaucaucccgugcaguagugauuguuuucaaggccuccguggucuucuuuguccuuuuuuuccuauugaaaaacauaauuucuaugcauuuuaguuuuggagauaacauucuuaaaaaauauuucuguuggguggggcuuggugggcacaccucuaaucccaguauuuaggagucaguagugggcagacugagauagaggccaggcuguucuauauugugagucugggacuggccaggauuacacagugagacguggucaaauaagugcugugauagaaagacccaggggauggaugaucugagagaacggcaauacgcccuggaagcccagcauaaccuuagauuuagacuguuuuuuuuuuuucaaaauugcuugaggaugauucuaucgucuuuucuccuaaacguaaaauugcugcaaggauuugauauaaacuuucaguaacaauaaaguuugccucaggcgcagaggcuggccuagaacucagucagugccccuccugccucagccucaguacuggaucacagguguggagugccagcguccgggccgcuggguuucacaggugcucaggguuuccaucccuggauggcggcuuauucgcgagugguuaaggaagcgggguuugagucggucgaguccucccuuagggcgcgugcacaauaaggcagcuucagccgccuccccuuuacuuuacuuauuaaagaguuguuuauauauuuauaucuuuuguggaugaauguuugccugcauguagccagaagagagggucagaucuggcucuggaguuauaggugguugugagucaccgcguggaugcugggaaugggagccagagccucugagagggcaggcagugcucuugacugcucaguccucucucugccccccauucccauuugucauacaagauauuagggguuuuguuagacugcaaaggacacuugguucuugggguagcagcagccuuuccugaagccauaacgccugucuucucuccaucucagaccacuguucccuucgguccgaaacgcgucuuggugacugagcagauuccgucucagaaccuaggaucugcuagcaguggccaggcccagcggguccuguguccuucuaacucccagcgugucccuucacaagcccagaaacuuggagcaggucagaagccggcaccaaagcaguugccagcugccaguguuccuaggccugugucccggcucaauaacccccagaagaaugagcagccugcagccuccgguaaguggucuugggugcucaaaugcauagcuuggcguuuauccuugauguccuagccucuguaccaugucuguugaggaggagagaaagaaugagaucuccaugcucagguguaugucacacaugucagugugucuggguuugggcuccaccagugcugggaugcagauaccauugcuggccaagcucgcagauguccucugcccggagcagaaggaaauguuggauguaauggagagacuucuggguucccagggccugggagggaggaguuccccagcauggagaggggaguuggaggguccuuccugacaggcuagcuggcagaggagaugaguuggcuagaggagggagggagccaggugaggugguaagggggauguuggacuuuucauuacauuacauguccaggcucacaaguucagucauaauuagaaaauacaaacagagcaccaccuccucccccauccccccuccuccuccuucuucccccuccuuuuccuccucuucuuccucuccucuuccuccucuccuccuccuccuccuccuucuccuucuucuucuuuuugguuuuucgagauaggauuucucugugcagcccuggcuguucuggaacucacucuguagaccaggcuggcuucgaacucagaaauccgccugccucugccucccaagugcugggauuaaaggugugcgccaccacugcccagcagauucuucuuauuaaccuauaacuucaauuuaaagacucuaaagaaugucaccuccaaaacaaacacauuuguuauaugacauccuacuuuuaagauggcaguguuugcuguuugaaagcacuccagacagacagagaauaucugaacccaucuuuucaugagcaaauacuaaugcccaacuucuuuuacuguuucaccaucuacacuauaaaguaggacaagccccuuucagucagucuauuuacugaguuuuauuccuuuaggaguguacccugcaugacucccuauuuuuaaacuucauuuuuagagaccucuaagccuauacuaaaaagagauguugaauccguagccuguucuccuacccagucagaguuugucaguugucucuguuugcccugcaucaauuauacuguuugaguuugcucaggggcagauagcccaggaagguuccuggagugauggccucaucuagcuauguacuuaucugugcuuaaugaucuccagggcauuaggaagacuuccaaauagugaccagauaaaguuaauuuuaggauuccucaaaagacucagacauaguuuuuuucaggaagacacaaaaggaauccuaaugcagaaagucccugcuaacauggcaaccauaaccccacacaaucacacagagaccaaaucucaaagguuagagagaggacagcgauugcagccauuggcucagcauuacugggccugggugggucaagcagcguugcaggcuccaggacuuucacuguguaguggguuuggcugugucagaaccgggcugauguugggauuguuuggcagcuggugggugcuuacagcgccucugggauugccuugaccugcauccucccagcccuggcaggcacucacguagacagcauguuacacagaagagacuaaaacgcagcaguuaacuuagcccaggacaacuccagaaaggagaggcacgggcaaaccugccacuucguuuaggaagcagaugcaagaccagugcgugauaagaccugaaagaugggaugggaggagauagcuguagcaguguaaggagggagagaacucaggcugggccucaugaagaaaaacagucuguacaaaugagucaaggcagacagcuaagucuggagaaaacccaugugaaucgagugcauauguacuagucacaaagcaggaaaccggaaggggcagauggcugaagcuuauguaguaucauucagcaagggagagaugcuccagcaagcucugagggcagaggagcagauggaggcaaaggaagccagugcugcccucagacccaccucucagcugggccacugucacuccaccauccgaaacacacucggcuggaguggauuuuggguggcuucuucugguuucaaguccuguuuggggucauugugaaaguaaguuuuauucaccugaaguaauugucgucugggaagcuuacuccgucugcuaaccugggccugggccuggaaacucccagccucuguguaaucuagucuaggccuaggacugucuggccucucagaucuccugcagaacacgcuuaccguucuagcucuuucugaacucuauugguugguguaacucagcuguccuggcucaaacuccuguccaagcugacggauucaaucuggcuucucuuaguuucuuacugaauugcuuaaaagaacuuuauuuaacuuauuuccuaggaaaugauucugaaaaggagcaggcauccuugcagaagaccgaagacacaaaaaaguaagcuugcugucucugcuacgagagcacccgucgggcugugcgacacuugucuucaugccauccccacuaaacucaaacuuagcaggggcucaaaaguaguucuuuuuauuuccuuaauuacuuuuucauagaagauuuuuguuaaaacuuuauuuuaaaaaguaguaaaaacaaaccaaaaaaaaaaacccaaacaaaaaaccaaaaaccugccaaagaugcuacaaucccaugaacuuguacacaauuuggauaguaauuuggaguggccuguuggcccuucccugcuccuaccagugacaguggcucuguguuucccaccagagugacucucgaacccacagccuguuagcuucucuggggaugcagggaggagguccucacaugguccugaaaggguguccuguccagugcuguugcuguccuaugguggugaggguugccagucagucuguccuggagcagagugcugcuguggacagggaacgcugggcucuaaagcuuguggcucguucuggugccuugggguugaugcucguugaggguguguacggaaugucucugagcacgaccaggcugacugcucaguggcauggcugugagcuguggcuagugauuucauauuuuaacuguucacauuacucuguagaaggcaguggacuuuggaagauuuugacauuggccgcccacuaggaaaagggaaguuuggaaaugucuacuuggcgcgggagagacaaagcaaguucauccuggcucugaaggugcuguuuaaaacacagcuggagaaggcgaacguggagcaccagcuucggagagagguggagauccagucgcaccugcggugagugguccuccugccggaggagcugggggacccggacagugccccuccuggcuugcuucagggaaugguuaaagcugacauuucccguagacugggugacguggcccucgggaaacauugcccaaggcuuaaagccagcaguguacuugggcuuuucucaucaggaggagauuggaggagacacugggugaguugguaguguugguuucccuuuuggcucucaguguuucugaguuugacacagaugccagugcugaggcucugguguccucugcugucuggcuugccguccgucaccuggcaggguggggacuggggcaccugcccacugccccccugccugccuugguugugacuccuguuugcacggccugcuccugcacagaagugcuucccuccucagagagagagagagauugcugucagcugacacuguuucccacuaaggauaaagaugucugaaaggagcagugagaacuaaacucgaucugcuucuauuuugaaaucugugcguggacauguuuaaggugucuuuuggcugggcucagaucugugcucagaucuggguucagaccucgugcgagcgcugugacacccacugucuuuauuuuuugaggggucagcaguccauguggagcuggcucugaagccacaugucacagucuuuguucuuuguugcaggcaccccaacauccucaggcuguauggcuauuuccaugacgccacccgaguuuaucugauucuagaauaugcgccccuuggaacagucuauagagagcuccaaaaacucuccaaguuugacgagcagagaacagcuacuguaagugcgcuccuuccuuuaugcuggcgucggcucuguccucauagaaagggcacguaguuaugaucaaauauuugaaacagaagaaaggcaaagcagcuuaguuaguugccucuauacugaguccguguguguguguguguguguguguguguguguguguguguguguguguguauguguaugugugcguguguguuuaccugaacauugcuucucuuauacuuuauaacuaagcaaugcuggugcaugacuggcgugcugaagcccacccuuuucuugcgagugcgucuguguucuuugugacuacaaagggcagagguacugagaagaucuugguuuaaagugagguuuugucaugucagcacugggcaucacugugugaccgcuugugaggugguaagcuaguguccuguuccuugggugaucuuuguccuauugaaagucagugucccccuucccaugcugaacucucagagccaguaagcacgcucucccugaggaggggauggaaugggacuuauuuggugccaugugcuaggagauggcucccucuuccuguugucuuuuagguuuauuuacccauguuauccauguggguauuuggcuugcauuuuucucugugcacaggguccagagcauuuuucucugugcacaggggccagggcuagaguuucagaugcuugugaacacccagguaggagcugggagcugaaccuggggccucuggaagaauaaccaguugcucuugucuuuuaacuuuguuguuguuguuguuguuguuguuuggccagcgcuaauguauuuuguuguuccaguguugucuccuggcgcucugccagguuucuccauaagccaccacugugggguuuuggcugugugagcuuucuuucugguacugaguacuuggccucaucuucacuuccaggcaggccugguccuagaagcagccauuucuucccuaaggaucuuggcuccuuuguuggagaauguuacugggaacugaggucuccugggaacucuugcugcugggcuguuguugcuuguagcucucagcuggggagauugcauggggcucgugcauguuuguuuagugaucaguauucaucucuccugagcucauccauuguaugugggacauuguggauacccccucuucuugggcuucacuguacccgugcaucacccauggccuccuuguuaguuaugcauuccugugugugugugugugugugugucucugugugugugcgcgcgcgccugcaucugccugccugggucucagugugccugcaucagcugguggaguuagucauuccacaccagcacaccuugggcauuugcuaccaugguuuugggcaucaguaguucuggcaggguagucaucuuucuguuggucaugguuuccaguggcaugugacauuggcuauuugcuauuuaugucugccauuagaugccuguguaguguaguucccucagcuccuguccugugucguuccugcagacgucuccucucagucucuccucccuucucaaagccguuuguggccucuuguccuuaaagcacagcaguucuuuuuucuuuuucuuuuucuuuuccuuuuuuucuuuuucuuuuuuugcuuuuucgagacaggguuucucuguauagcccuagcuguccuggagcucacuuuguagaccaggcuggccucgaacucagaaauccaccugccucugccucccaagugcugggauuaaaggugugugccaccacgcccggcgucuuuuuucuuuuucaaaccuugucugcuuccuacaugcugaaauucaagguugccaucaugcccaccuggcuuacagccaccuacacuaaucguuuucuauaauuggccauuaauaagaaaucauaucacuggacuguccugacuaggcagccgcccagguaaugccauggagacuuuuauuaaugugacagcuuggccuucgcuuaagcuuguuccuaacuagcuuguauaacuuccgugagcccauuuauacuaaucugccuucugccacauggcucccucccucuuuuuuuauacaaccagucuguuucuuccucugcuucuagcucucgaauccucacacuugguacuuuucuuguuccuaucucugcccggaagucccgccuauccuuucuagcuuggcccuaggcuguucaguucuuuauuaaaccaaucacaaggaugauggggggaaaaauguuuauaaaacauugagaugggugaugcuucauacaaauaacaguaccaaagccuggucgucuuuuccuuuugggaaagcaaaguuuguuugccuauugagcucuugacacacgagagcugagguggcucaugugugcugaguaagcggccaccacaacaagaagcaaauagaaagacagguuugcugggaaaugcccaccgccuuccgucuuugcuugcuuacuucucauguagauuaaaacuuaacagaguuauccugaguauccuguuaaugggaugcagagcagacugugggacuggcaauagauucuucagauguggaggccaugggugcucaaggucugccccuggucagggcauuaauuguuccuaucacuagcugugcaguucuguaaguccagcuuacagccagugccaucccugccucucaagauuaucuuacuccugugaguauccuguuagcagaguccugauugaguuugucaaucugcagcugguguucacagacucaccccuuuuuucuaugguguuugcuucaauacaugaaaagaaacacguuaguccuuguugggucaacuugcaguuuugccugauggccuuacauauaaaccuaagcccugggucuccuguguucuucucccaacaguacaucacugaguuggcaaacgcucugucuuacugucauucaaagagagugauccacagagacauuaagccagagaacuuacugcuuggcucaaacggagaguugaagauugcagacuucggguggucggugcaugcuccaucuuccagguaugggauuccagguuagcagaaaccuuaggaacacccgauaaaguucuuucugggaccugggcucugucacccuggcuuauggauacugagugucccuagagguuaauggagagugaugcacuuagagauauggcugaugguugguaaacaaagguguguccuggagagacuuguaccuuguuggguggggguagaguagggagugaagcuggacaccaguugauuggaacuucaaaaccacaguggugugggugcagcucugggggugccugucuccugcugcuggucaguagcuguaaagguucccuuacaacugcagcggagacaucaucuuaugcaacaguuuagaaguugguacuuucaaacuugaaaacugaguuggguuugaauaacuuugauuuucucauuugaauggggugucuuuaaagugugcaucuguugucaaaaguguugccaacuuugggggcuguguguguguguaugcaugcaugcauguauguauguauguguagcacuggcuguccugaacuugcucugaggccagaugagaaagcuaaacagguacagauaaaggugcuuguucaagaccugggacccauuugguggaggaaaagacugaccugccaagcuguccuucagccuugcucuauguagugagcgcucucucucgcucucucucucuccacacacauacacacacacacacacacacacacacucucaaacacacaaagaaaugcagauuuaaaaaguguacagccuguuuucuuaagcacuggugcaguuuaaggucaccuguuugucuccagcagcucuggggcaggcuguuguaacugaugucggugguagcuccuguuacccagugacacaaaccccagaguugcaggugucaugggacuguaugauuaagcaggacuguaaccugacuagugguggcaucaagagagagacccagcuugcagguuuuaggagagaucauaguugagaaucuugucaguuacuccaauaacuucaaauucaguccccauccuagcugccugguuacuggggaccauccuuugggaaucucacaaaagccucuguugucuguuccugguugauuccagcuuuuguuuucaaaacccaaacggauagaaaaugcugaguuggugaugguggcacagagguccacagcucuauucuagagcccuggguacagcuccauucuggaacccuggacacagcuccacccuggagcccuggacacagcuccacucuagagcccugaauauagcuccacucuagagcccuggguacagcuccauucuggaacccuggacacagcgccauccuagagcccuggacauuggugauaggggacauuuaaagucaguugugacaucacaaugugauguuucagugugcauccccuaagauaggggacugcuugcacugucaccaccauugugaccaccaaaguuagcauaauucuuaguaacuaauauuuaguuuacacucugauucaaagccgaccugggcuacagcgugcgacuaauuuugggggguaggaaaggaaagcccuagaaagggagagucuauaaaugaaggcggcagccguguaccucaggggacguccuggguucuguaguccuguuuggcuguuugguuuaggggucuaaagauuuuauuuuuauuuuacaacguauggguauuuugccugcaugccugucugugcacauggaugcuuaguguccaaggaggcuagaaaaagaauugucagcugugggcuugaguuacagaugguugugagccaccauggggugccgagaacugaauccaggcccucugcuaaagccucccaugcucuccacagcagagccaucccuccaguaucuugcuaugcagcccagacuccacuccaagcaggcauucucuggccccagcccucuggcugcugcugggaucacaggcgugagccaucacacccgacuaagaucuguuuuuaagacagucuuaccagacugaucuggaacucaauauccuucccucuccaccucucaggugcugggauuaaaagauaaaccagcacacagggcuugguuauguuucccucuuaccguccacacaggugugugugcuugcucauagcugcuuuuacuuaaaguaccgacuuuaaagcagcuauaagauuucaugaacagagccgggcaguagugguacaugccuuuauucccagcacucaggaggcagaggcaggccuggucuacaaagugaguuccaggacagccagggcuauacagagaaacccugucucaaaaaaaccuaaaaaaaaaaaaagauuucaugaacagccguagacgugaguuggaugggucugggggaaguuugguggcuccaugcuucccccugaccauuuaggugggcaccugucugagcgcgcuggccugccauagugagcgcucaucacaucaccacaugguaugucugugugucaaccccagucuccguuugguuuaggagaaccacaauguguggcacccuggacuaccugcccccagagaugauugaaggccggaugcaugacgagaagguggaccucuggagccucggcguucucugcuaugaguuccuaguggggaugccuccuuucgaggcacacacguaccaggagacuuacagaaggauaucucgggugagcugcugcugucaggcuucugccgagggcugguguuuuguuuauucauguucaccucugacccaugcuuguguugguuuaucauuuauucugcagguugaauucacuuucccugacuuugugacagagggagccagggaccucauuucaagacuguuaaaacacaacgcaagccaaaggcuaacacuagcggaaguccuugagcacccuuggaucaaagcuaauucuuccaaaccuccaacuggccacacuagcaaagagccaaccagcaaaucaucuuagggaauccugaaccacggccaccgugcaacugugagaaacacccuauugaagccacccuccuggacccucauggcugcccucagggugccuugcugagcaacuaguccuuggccaugcauccaggaaaccccaagaaccaugcugcuuuuccugauuuaguaaucuggagggaagguuccacugcagcuguccccuacccucacccugggccugugccccaagguguccuugugggggggggggucucacugugggaaacuuaccagagaucaccugugucguagccuucaagugccagaguguguguauaacuuauugggucaccaggccuagggaaacuguuggaauggguauguaaucuuuuaaaugucaaaauaaagauuugcauagacuuugacuuuuaagugacacccauucagggucuuguuuccagucgucugaagcccgugcgggauuuggauccucagccacugcuacggagccugugccuugucuugagaccugacucggggguuucuuuuucugcauguuaaaggcuauuuuuuauguuggaguucugucauguaugcaaacuuguuaaauauauauguauaccaucuaccuggag

SEQ ID NO: 1304 - RNA, 29355 nt, Mus musculus
cgucaucaaggagcgccggaaguagguaggguuucgccagagaccccggaagcgacggcuucucgucuuugcuaaggcuucugguuuuugcuacgguuucugauuucggcuuugggauggguugcgacggaggcaccauccccaagaggcacgagcuggugaaggggccgaagaaggucgagaaggucaguggggacugcgggcugcggggcucgggaugaacgguggucacagcgcuuguggaggguuuacuguuugcaggcacugaacaguacgguuagacugggauccuccccacagacgcuguguugauuugaaacauuaacguugaacgggacggagacuggagagcuaguuaguggcccagccaggacuggaacguaucuguagcuagcgacgaucacggugauagaugcuauuuauggacuuuguguguuuuugugaaaggcucucacaguguggcccuggcuggcugggacucccaccucugccugcugagcacugggauuaaagguguuggccaacaggccuugguauuugaauaauacuuuuuuuaaaaauguuuugugugugagugugguauccaaggaggccagaagaaagcaucggacgcccgggagcuagagcuacagguuuuugugagccauuaaucuuggcuguuagaaccaaacgcggauccuuuggaagagcaguacacaggcuuaaccacggagccaucucuccagccugagcuuuguguauuaaagucuccccaaaccauuccccuuugugaagucacacccuucuuaaacuaauuaucagcucuuagcacucugaauuggugguugagcccagcugauggucacgugacugcaagcuccuccuggugaacucugugcacuguuuuucuuccagaacuagcacaguuucugccacagugaauauuuuugaauaaaugcgugggcauucuguaaaucuuacaagacauugagcaaaguguguacuuaauggaugggaaauugaaugccgcaaaguuaguuaacaccacugacguggccuagagucaugaaccacuguccccauccauuuaugugcauuucaaagcuaguguugaugaugacuguuuaauaauagaaggcacagaaugcccccgauacaguucccagcacggggagagaaugcccccgauacaguucccagcacggggaggaucauguuuccugauccaacauucagagaacuuugggaugggaggugaaucccauccaguguuguacuuaagacacugcauaacuuccugacacaucccuaauaaacuccauuggguccugugugaacaaaccucugcuugucuuuuugcccucucuucugccccucuuuagcucuuucacucuguucuagauaccauagaccuugccccagcguccugaacauuccucacucauagugacaucaugacuugggggggaggggccacuugaagcaaggucuugcugugagguagcccaggcuugccccagcccccggagugcugguuacagugugugcugcuuggcucuuuccccucauuuguccacccagccuucaccacagucagcugcagucacucuuuaggcccgcccccucugcugcuuuccuuuuuuuuuuuuuuuuuuuuucuaugaucccugccucugugguuaucgacuauguaucucucucucccaugugcucugggauccuugcaugucuuagcucugcagucuauaagauguuucugcacauuauagacauccacugagcauauguugaaagucugaggacagagugcccucggaccaggccaacaugucacauucaagugugcauaaaguauucaucuuacuguuguugucuugugcccagggcugacauggaguaauggaagaguuggcaaaaaacagccaaccacacccaaacaauuaaaaacaaacaacaaacaaaaaacccugaucuuagaaggguaacgaaaagaaagaaugaucaggaagaguaguuuuuauuaacccauuuguccaaguacuuauaaaaugcuuguuauauauacaauucugggaccuaauggcaaauuaucccuucuagagcuuccauuugaaaugccuguuaugaaguaaucauauagauaugggguagggaucugccccugucuuggcaacacagccccuaagucccauggaaauaacacuugcccuaagugagauguguggugacuuuuuuuuuuuuuuuuugaaauacagugucacuauguaguccuggcuggucuggaacucucuguagaucaggcuaggcuccaaccaauggagauccaucuaccuuugccucacaugcugggauuagaggcgugcacgaccacauccagcucguggggacuagauaagcuccugguuggggaccagucaccagaaagacaaaaucgugaucagaaguugacacuuguuuuucuauuuuugcucuuucucucuuucuuucuuucuuucuuucuuucuuucuuucuuucuuucuucauuuauuuauauauacaugaguuuauuugcaccauguguaugcaggaaccugaauauauauauagagugcccugaaacuggaauugugagcuaccuaacacugugagcuuccuagcaugauuauugguagcccaaaacuggauccucugcuagagcagugagugcucucaaacacugagccguuucuccagcccugaagcuuggcacauuuauacccccuccauauugcaggaagauguuguaucagguguugccaggaagaaguuauguuguguaagauguuaauuuacuauauaaguauaggcauuaauguugguacuaggauugagauagaucaggaugaggaccucuuggugugugcagaguucacuccccgcccucccuccauucuguuuuuauaaagcuugcacacacgguuuaaagauggauaugaacuugccuuguguguguuggguguugguggaucuuaacauaauacuaauuuaaacccuuuuaaaauguguguuaugugcugcgaaugugggggucagagaccagcuuuuggaggcugguucuuuccaccgugguuuccaacggucagauugaacuuguuuuguuuuuucaccucugagccaucucaccugcucuaauuucuuaaaacuuuauaaagucccaaguucauaugccacuauucuauuuacuuauuaucaacuuacuuauuaggcuggagauugagccccauguaugcuaggcugauguccugcccuggagccacguucuccacaucccagccauugacaugguugcuuuuauaguuuuuaaaauacauuaauuuauuuaguugggaggauguauggcagacauguggaggucagaggauaguuugcaagagucaguucucuccuucaccuuuuaccuagggacaaacucagaucuuuugauguucuucuuauuauuauuguucggauuuuuucgagagacaagguuucucuguguagcccuggcuguccuggaacucacuuuguagaccaggcuggccucgaacucagaaaucugcuugcaucugucucccaagugcugggauuaaaggcgugagccaccaggucauucaacauagaagcaaacaccagugccugcugggugaucaccgguuccauuguuuuagaaguagcaucuuguuggguuaucuaggcuggccucagacuuuauccuccugccucagacucucaaauacugugauuauggucacuacugcuacuggaugugggucauuauucugauuuuaaaauuaaacaccacaguaugcguauuaguuggaauguuggaauggaggggauguccauggcuuaggccucuggagggaguguccauggcggcagguggcagagaggcagcugacugauccauuuucauccccaggcaggagaaguagggagagguuauaaaccuccaagccccccucaggcccgugcuuccucccacaaggcuccaccucugagguuucauaaacuccucaaacaccaccccuggggaccucguguucacuuggaugggcggaguuagguacaucuuacaggugaccggacuggaguguguguguucucuuucuuagguugacaaagacgcugaacugguagcccaauggaacuacuguacccuaagucaggaaauccugaggcgcccaauaguugccugugagcuuggcagguauggacccuucguguaaccgagauucauuuguucuguugguuuugaagaaaauacugaaguacuugauugauaggagcuguccuaagcacacuaguggggaaggugagcucgugucuggacauagccuggaccuucuaucucaguuuguuuuauacucaggagccaguaguaaaugcugagauauaagccccagagcauaaagcagccaugagugcugucaagagcaggaggcaguugggaguggagcgggcaugacaugugggggguuagagggggagcgggcugcuacucaguuccagcugguuuuuagagugaagaaugugggccuagugguucuaaaucuucugaucuuuacuuuuugaaggacagggagagauagauaagugcuugcauguugauucuccaagucuuaaaguccaccauccuggcuuuaagccgcugcuuuguguguucgggcagcaagugaagcagugcagaauguuuuuagcaaaggcaggcaccuuuggggacacagucaggucuuccccuguuuggucaucuagaaucaucacugcaguaguaaacucacgcuuccucuuguagacuguauaacaaagacgcggucaucgaguuucuguuggacaaaucugcugagaaggcccuggggaaggcggcaucgcacaucagaagcaucaagguaggacacugguguggcugcgcuccaggcaccucucagggagguugcuuuaauaggaucugugucuuaguuaggguaucauugcugugaacagacaccacaaccaaggcagcauuuaacuggggcuggcuuacagguucagagguucaguccauuaucaucaaggugggaacauggcagcauccaggcaggcauggugcaggaggagcugagagcucuacaucuucaucugaaggcugcuaggagaauccuggcuuccaggcagcuaguacagggguauuaaagccuauguaugcccacagugucauaccuacuccaacaaggccacaccuacugcaacaauggcacaccuccaaauagugccacucccaggcuaggcauauuuauacaaucuguauacauuagggacugaacucagcacuggcaagauggcucagugggugaagcaccuguaaccggaguucccuggggcucacguggugcaaggaaagaaacagcucagcagcuuguuuucugaccgccuuggagcacuccaauguauuuacuaaagccaacacagaaagcucuguuuuaaaaacagcguucaggggcuguggugauugauuauuggguaaaaggcuugacagacgagcacggggacuugaauucagaucuccagcaccgagguauaaagcugugugugugccugugccuauaaucucagcacuggggaccuggagacggcagagccucugcggcucacugggcaggcagccgugcugaaguguugagcugagguucacguagacuuucuuagugaggaagccgcagagagggagaggacaccugagcugacugcaguggcucugccaggagcacgugcuggagagguggaggcaggaggaucacaccggacauugaccuggccagagccucgggcacauacagaggagcacauagacauucaugcaccacccccccacacacacacacacauguacacaaauacaugugauaagauccuaugcugaaugcuggaauggucucuaucuucgauugggucagcuuacaguuccuucccuucuggugcugcugaaaugaugggcguuccauagaagugagccgcccucucaggccagcgugcugugcugcugaccuguagagcucuguggucaggucccugcgcuuauuucacgucagcauuauuaaugcuuccccacagaaugugacagagcucaggcuuucugacaaccccgccugggaaggagauaaagggaacaccaagggcgacaagcaugaugaccuccagagagcgcgguucaucugcccuguggugggccuggagaugaauggccggcacaggugagggugacauggcugauaugaccccagucucgccucauuucucuguguugucuuggagauguaguagggccuugugggaaaugggaccgggcauggugggcucuuuccccaguggccaucugugcacuuaacugccuacccugcuuagcucacucaggagaguggcccugcucugcccugugcccugcucugcacgaugguuggguacuguaugcacacuggucauaaugccggccggcucaagcuugcucucccuuggucccucuccagguuuugcuuccuccgaugcugcgguuguguguuuucugaacgcgccuugaaggagauaaaagcugaagugugucacacggugaguuuccaccacacuccauguguuccuucuuggcagcugagggagucacuuuaacaucuuuccuucuauuuaaauccuaaaguuguucugaaagcagucaguagguccucucuucuuccauagcgcuucaccgcuccagguacauacucaaacacauugaggucaucccuagucacacucuugaggaccgaguucuuucuacuccaaacuggcagccugaaggcccugcucuccucagcuucacgugcuccuuccuugucucuguuggggaccuuguuacccaucccaucucauugucacaaaauuguggcauuuagugagguguuuguacagaagccauggcuaaguaacuauucagugagugugagugugcuuagaccuguccugggugaugcccucugcugguggcuuuagugagcaguugucauggcagcuccuguccuagcccuuacugcugggauguccugaaggaaaagauccaccagagcucugcucuugucgaugccccuugcacuggagagaccgcacagaaguauugaucacgguggccugcuuagaagggagaucacaaggauguauaguugagggggaacgucgaccuuugcagugggcagcaaaggcaucuugaagcuucuugaagcuuugacuucagagcuggagggcacaaggcacuggcaaaggcugggcaagagcaggguacagcagcagaagggucaggggaccccaauuccaggagcagccggcauggccggggugaggaggcacaggcguaguuguagauagucaucucacaucgagggcugggcugaccacuugguguucauggauuuuagucuaagguggcuccagaugcucuucacauuaaagcacacccuccacuuguagcauucaugaagcuaauggauggauggugacgucaguaugggauacugacuagucuucacagcaugugcaaaugucaugucacuuucuuuuuugaaagugguacccuugggagguaaccuugaugcagugagguuugaaugaguggagaaggccccgcccugcgucgggugcuucccgcuuagacuucagcaguggggcaggcccuguuucaucugcaagacugcaagagucagagugucaccgaacacagaacagccacgacgcgcgggcagggaucuucuggccacucauuuaucccucccgucuuaggcugccugacagacacugucuacugugaccuggcaguuuuauagagaagagaaauucacuucacaguuggugaggcugggaaacccuagcaaggugccagugacugcaagggugcauuaguccaugucauaauguggaggacguuagcauggggugggguggugauugugagggcagggagugacgugucacaagcaaacacagauucaaauguuccugagcaucggguuugcgcaaugcucuuccugcugacagauucuccugucuguggagugccccuccccaccugucucucagccaggaccucucccccacugacccugccagauccucucucugaagugugguuaugcuccaugagcagaaagaacuuguccuuuauaaggaauacaccugugacauuaauuaaugucauuaacauuaauuacuucaugagacugugugaccuaaaugccugccugacaccaggcucugcacacugcuacacuggggacugacuuugcagcccaggaacuuugaggaacauauccccgugguauguccauauagcaccucucuggacccagaguccgguacgugaagugaaggaguuacuaugacucuucagagcccuucuuuuuacauccaaaaguucuaaacagggacauuuuuaaguugggaaauaaauaguccuauugcuaugaggaaccagacucugacuugcagugugaagugucugaaguuuguuaguaagagcauugauagaagguuggcuugcugcuggaaccauccucggguacugggugcccagcacaaagaagucuggcugggcaguuucuuccacccaucuuuccuugauuugaugaaaagcagagagagccucuuuggggagguuuuauaggucaggccugcaaacuauaccuggagcaucucacauuucguuggucacuucaaggagccuuugaaaaggagucaggcuggggguguagagcgaaguggcaagugcugguccuuucugcagcagcagccacugcagcguagagauggcacagcaugcgcccugcugugccuccugaggagggaaggaggugaagccacaggggcaagaccaaaagauugccagguucaggcucuuuuugaaauuuauaaaucaccaauaggacagugacggcuacgccuuuaaucccacuaaucaggaggcagaggcaggcugaucucaaagcugaguucaaagccagccugguguucuguggcgggaaggcagcuuguucucugcuugucagccugggugcacugagaucuguuccuugucuccacaagaggcucugacacacucacagacaguacacacagcaauaagauaauucaggcucucagaggcuuaagcuggcuuugcucacacuguacuacauggugugcacuuugccuccagagaacagcacccauagacguacaagugcugcaguuugguuuugcagaaaaugaauuguauuucugcucucugcucuguggcuuguaauaagaaacacaucgccaugcaagggggcagggaauaucuuaacauuuucaguguauaguaaggaaaguguugccuaggcagagauuacuucaaucuuauauauuuugcuuacaguugauuuguggugucugccuuuagcgucucuucucucugcucagcucuuccagaccccucaguaccucacugacgugaucagcucugugugggggaagccuccguuggcugaggugcuaagauguggccuuuacaguguguugguuucuucucuggguucacuuaaaaaacagcugcaggguuggagagguggcuugguggcuaacagcacgggcuguucuuggaaaggaccugaguucaaccccauggugucuggcaccacauggugucuggcaaccauuuguaacuccaguuccaggagugccaauacuuucugacuuacaugggcaugugauacacauaugugguacacauacauacaugcaggcaaaacacucauauacauaaaauacuugaacaugucagucuuuaugccaccaaggacauugcuagagaaagagcaucuauagaaguuucccagaacagcagcagcaacagucagggacauaggaaggaagggccugcaccugaggcccaagauggucauggccuuuuaugucuucagcccauacaccaggguguuggccacuugccacauaccuaacucgaaacacuccguaaaagucacgcucuugugugcagaagccccuguggaaguggcacgagcagugcaguuguggcccccaacauggcaggaagaacagcagauggcacgccaagacuacacagaguugaggcagcauucuuaagaagcuugcuuccucugugggauuauucauucuaccccuaaaugcuuuccuggaauuuucuagaacaaaguuguacugcucuuaguccauagggacagcuccagagaagcauggcuuccuguggguggggcuuugcuauauaugcgccucuuacucaggcucucuaggccuucagaaccagacccgcugcuggugugucccacgugagcuggauugagcagguggagagauucggcagcugauaaugcgcugggccuccagcuguuggcuugggcuccuagccacagccucggguguuuuccucauaguucucucccugccuguguaguggugaagucugguggcacaugucucugcaucauuuuuuaaaucauucacauccaagaauuuaaaaagcaaugcugacaagugccuuaauggugagguugacuguugaaguggcuuugcuggggaaacugccaguguggcucuggagggaccucggccugcuguagggcucugagucggugccgccucucuaggcauacucccaccagcgggucugaggagggcuccagcguggcaaagaaagcuggcagccggaugagcccaggcaggucucccaggccauacacacaagugucuugggcaucguggucugcagaaagaagcagaaauguaaccgccuguuuccccaggcguucaguuccaguacaaguaaggcaaguacacuuccucaggugucagcuggggggggggcacccucacugugcacaagagcucaaauugaguaucguucugaagcuguaauuggucuccaaggguggauuuugaauuuacacuggagggaauuucaccuuugggcugguauuuggggaacauucuaaacagcaugaaccacuaacgagugcugcugcaccaggcaagggggcccgugccuauaaaucaacacuuugggaagcugcuaaggcaggaggauugccaugauuaugaggacagaguuaguauccaggcagucugggucuaaugagccuuggauucuaauuccuauuuuaauuaacuuauacuuacaucgaguuuuacucagaagaacugauagaguugauaacuuucuagaccagaccuuucugauggacagcccacaggcaaggagaagccugaaaggccauggaguggccacucacaccucuaauugcagcacuugggugaaugaggcaggaggaucaugaguuuaaggccagccuggcuacacagcaagacccugucucaaaaguagaaggaacguggucuguccaugaagcucaguaggugguagggagaggguuuuguuagaugcuguuguagcucccuguugaauuacaaugucuaccuuaaaaaaaaaaguucuaaccagacauggagggauaugccuuuaaucccaggagguagagacaggaagaucucugagcuccaggcuagccuggucuacauagugggagccugucuccucccugucaaaaaaaaaaaaaaaaaaaucaacccagugaggugaacacuuguggcucucugaccuggcacugucaggacaguguguuuacucaccuuugagcuaccuuggccucacaguuggcacccuuccccgucauuaaccuguuuauuuuaggucagucuuuuaaauggcugggaaauggggaaccugguggcucucuguguacguccaguuuacugucuuaguuuagacuccauauccaggcacaccauugagcggaauacguguaguagcugaugcuuaggaagcugcuuguggacaaauggcagcacccaagagaggugcugugcucugccacaguccuucuguagccagccuguguggccugcgacugguaccccaacgugagugcaccccugcuucuguguauucugcagaguauugagcaccuauucacucauuagcguugugcaauaaaguaauggucccucuccaauccucaagcagccaucucuaaagugagcugggggguagaggacuggacuuuacccuccaaagaacucuguaguuugcuguaccccaaguguuugccccagacagguuggccaucagccaggucccucuagaccuuucauaacuggacucaaaccucuggaacaucagcgagaggugaauucgugguuccugggggaggauccaccagagaacagaaagacucgccugcagcaagggccgcccgagaguugcuuggccgccgggugcccugcaugagcagcacuugcuggugcacauccuuaguccuagcaccccacaggcagaggcagacugcuccucgagacuuuaccugugcaccccuugcgaccaucuccugccucuguucuccacuuuguggcccgaauguguccuucccauccagcaucugguguggcaccuggagcgucugaggggagagaaauccagggcacacuggagcauacaguaguguacaguucccagcuguuguagugcaagcugugcggccugccauugccucccggagaugcagucacugugagaaagaccugugcaguggccaucaguguaugggcugaccaggggccauccugcccuucacugcagucuucgcccuuuuccugccucucagaacucacuggaugugugugaugugcccucaggaccaugcugggggcucugcgcugcauuccugucugacagcccugguaggugaucugggaacagggcuugcagugggccugagagaucacagaauccuccaaagccauuccugcugggucccugucugcaaauguguuauuuaucaacagccguagguggccaugcuugaagcagcaugcugugagggaaccagucagccugucucaagaccgcaccaaccagagucccccacaagugcugggggguugccacagacaacaucacuuuuccuguuugggguuuuuuuuuuguuuuucuguuuucuagucaagaccucacucagcucaggcuguacuguacagcuguccuccugccucagcuucacaagaacugugauuuauaggaugagcccuuagcaaaaaugcagauuuuuccaaacauuuaugcccaggauuuccaaaagagucuguugaaagagacacagguuggauaggcacauggcaagacugucccccugaugccacauuccuaaaacaagaggcuaccccaaguggaaggccuugugagaugcaggcucuguacguagguagccacagcaagacaucuaaaagagucaaccccccgccagcuucuucacugcgugucacccacauggugaguuauccuaccuuucagucgguucagggucacccaguagugcuucuccgggcuuuggaugucuuuggaccacugcagcaugucuuuugcacggggaucaguuaggacgaacucuacaaacuuccucguaagugcauagugagcacuuccagaggaaauuguuagauuguggggugggcuuuguuugaaaauuguauuuggagcuguguagcuguuuucaucgggacugggcuuuggagggccuuggccugucuuggguuuggaguuugcggguggggucaccccaggcgugauguuuuuacccuuccaccugguucugaugucauagaugauuucuuuguugguuuugauagggaauuccuguccacagagauucaugacauagugccauugaaauggggaguggaccaggucccucaugcagucaaucucugccugcagccuccugagguugucaugagccaccuucugugucuuugaugaaagaaagauguuuccaaaacaguccacgaagguuugcauggcacucuuaaacuucuuuggggcauuuucaucacuguggauacaguagacauucugaggugcauaaaucgcucugagaagccgcacaaacaugaccagcucccucggagcauguauaacauaggccaaggagaaguuccccucuucugcagacaggggucugguuaugaagugcagcccccgagccagccuggagcaguuuccaggugugcgcaagcgagcaggaacuucagaguucugaggggguuugcagaauugagcgauuuggggggcugccuuuuucccgucaaauaaagccgagcacaguucaucuggauagaagccacauuccaccacagcuggguuggugggcucagccucagccucagccucagccuccucaggaccuggguuucucaaguaaagaaagaugaaggcgcaaaucaugccacaugccaccagcccagccuuugugguccggagcuggcucaugcuuugagcucucaguguguugucgccaccauagcuugaaagguuuuccuuuuaguucuccuaaaggaacaacagaacauuuagaguagggugaccuccuccagccccugcugaagcacauucacuguauguucuuuuuuuuuuuuaaagauuuauuuauuuauuauauguaaguacacuguagcugucuucagauacuccagaagagggcaucagauuuuguuacggaugguugugagccaccaugugguugcugggauuugaacucaggaccuucggaagagcagucggcgcucucaaccacugagccaucucgccagcccuuacuguauguucuuaagggagucacuugggcuggggaugcagagcagugggugcagugccugccuggcaugugugaaacccuggguccccaugucugucagcucugcacauuuggguagagacaggaagagcagaaguucaaggucauuguuggcuacacagugguuuccagggaucaguggauggauagauagguagauggucagauggaaaagugccauuugggcuucuuucuuucugcccuuuuuuuuuuuuuuuuuuuuuugaggggcuuuuauguugcccaagcugaccuugaacuuaaggguuuacacauccuccugucuccggcgccuaagucuguggacugcaggugcaguaggcacaucuggcuaauuugaccacuuuuaaauguguuuauacucugaaacuaccaccacaucagggcaacuuugcccuaccuuuccuuauaccccuggugacucgccugccuuucuacaccauuugugugauuucuguguccuggaugguuugcauguucuguaaugugacauagugacauaguagacucagacaguggauucuugguaggggugcuuuuuccuaguuaugacagucagccucaucagcccaguucuccauagcucucauugcugagugaugcucuaucucauggccaugcacaaucuauuuguucaacuguugauggacacgugagucauuuuuggugucucauuguuacagggaugcuguaaucauugugugcaagucuuuguguaagcauguuuuugucugucuccagugaaugugggguagugaagugguggucucccguguuggauagcuucacagugggcuucucugggucaguaguacagcagcagguaggagagagaguuccuuacacucugcacuccauucccaugguaaccauccuaauugggggugauucccuguggugucacugugugucccugaugacuccaucugcugaacacagcucaugagcuguguauucacgccuuucucuguuacacugaguuggagucuuuccguaaagaacuuaaaugacaaguugagagcagucuaugguuacacagcuaaccugcugaagugagcugauggagcugauagguugcuuuuaggcauuaaaaucgagguguguaaugaugucucuuuauaccaauguggucagcugccuagaagcggaguaggaacuugagcagguaccacugcggcagacaguugcugagagcacauuaaugaggcuacuguuguauagcuaccaucauuguccuucugcacugagagaggagagcuggccgagugagaggucaggaggucuugcucuuugugacuccugguucuguggugccacaagucacauugucauggccaauggacgugcaggagcucuuuccuuaagugacauggcgguugguagagcucugaaucacucuuaagacucacagccuugagaguucugccugucucagaugguuaaauaccacauugauuuucagugcaguuucugaucaccuaaugugaaauacaaagcagcugcugccccgggcgcugcucacagauucagucaacacaugccaauugcugagagcaucaaaccuuagggucuccuuuauuaaagaguuugugaguuuguagggcuugcaaggucuaccuucauaaacacucugauggcucaucauuucaagucugguccccaaaauaaacagccccucccccaguauagaaguccccuagggcggagaacccugguugacguagaugcagaucaagcaacacugaggauucuugggugcugucacuucaggcuuuacuuauuuuucagccugcuuggguuuuuugagacagagccucacagugucguccugacuagccuggaacucacuguguagaccaggcuggccuggaacucacagagcuguaugcugggguucagggcuugugccgccacacccggcugaaacuugggaauuuugagcaagguacacaguaagugcucguggcuuggcacacccuuccuggugguguagguuuugccaggaagaaggcucggggucugcuugguucucacacuagcagagugugccccuguaagccugcuguagccacgcaccagggacugccuuuucagacaucuauauaauuaaaugaagacaaucccagggguagcccaguguccuucagggcacucccuggccuaaaugguuuucugccuuuuuuagguggaugagagcaaggugugucuuucuuaucaccuucuccugguccucagcgcagcugauacugcggucugacugucacccacucagacaccacugcccagccagcugcuacuucagcacaagccaccacuguuucuauuuaguguguugucacaugaacuauagucuugcucccuuugagaauucucuucauucgaucagcaguuuccagaauuuccucaggcuuuaccacagcccagcucacuguguauuccucacccugagagccugcuguggaaccuggaggcugagcgcaaaccagggagccaggccagcggcugccacaggaccuccugagugucccuucccaugaucuucucacuggggucaucaccagccugccgcuugguugguugcagacccugugugucacagcuacuuucugagcauggugacacaagucacuguggucacagcagggcagguucucaucuguccucuuaguccucccugggcucaggacaguguccacagcaccaugaaugucagcuuuuauaaaccgcuagauagaucauguuaguugggcuaauuugaacccacaagcuguccauaagaugggcaucucguucgcagugugcuuaugccuaggucugugugcuggcccagcugugugucugcagaggugggcuccucuauggaguguccaccuggagcaagcacagcugccagaucaucuucagaagcaggcuucggcaguggccuuaaguaagucgggguugagacacgguggcuuuuuaacaccugugaaaugucaucugucacaugcuguggaaaugguccaccuugguuuucuuuggcuuaaagccaaaaaacaugggacuauuuuugaggggaaaguggugcccaccuaccauaaucgcuaaaacugggucugcugucacaggcagcugugccuguugcuguguuuacagucagagaaagcucuauuuccuucagaacgcacaccugcuugcccugaugcccaccguccccuccccauccuguuagcgacacacucaccaggugcaggucccguuccuggcaggaaccugggcaggugcuggccuagccaccucuccucugacggacgaaugcuucccucacugcggcuccugcuucuuagaguugccuggcaggcugggcugccucugugucccgggggaccuguauucuuguugauccugaugcguuguggaaaaaaacugcuguauuugauccugagaauccuucaagauuguaugccugcccccaaagagggauggggcauaaaacaaagcccugagagaugcugauaaggugugugcaugacacgccagguguggcgggccuggcggggcggggcucaaccugcagacucugaaaaccccugcuucugguggccuuguaguuucuaagaucuuggucagauuccuucaaagccaggcgugguagcacacgccuuuaaucccagcauucugcacuggagagagagaaacugcggcaggcguaucucugauucccaguuagccuagucuacaaaguguucucuaggccagccaagcuccaccguaaaacccugucucaaaaacaaacaaaaaacaacaaaauacuccuuuuagaacaggaggccaauuuuucugacacuucugucuuuagguucacucugcauagaucugcuuuugcacauucauucauucacuaauuacuuuaggggagggcucccgagccccugagcaugagagggcgucagaggacacuuugcaaaggccaauucuccuuccaucaugaggguucuagggauuauacucagagcucgggacucagcagcaagugcccuuacccgaugaaccaucucacuggccugacagauguguuccucgcacggugcugcucggugcagcucaguggcagugcucagcuagcaugccuggcuucuggguuccacagccgcagcacagaacauggagggagaagugcaucacugaagauuuauccccuuuuauguuucucaauuccugagcuagauggcgggaugaguggaugugucuucaccugccagcggagccugaguguguuuuguggagcagcugucacagcugcuaugaaggaggucuuggugggguagcugacagagucgccgugaccuucaggccugguccucaucagaccccagauggauagagcaagcacagcuggugucuggggguggucagccccauccuccgaggcuguuucucuacagcaguuuacaagagcagccaggcauggagcacacgacuucacauuggaggccagccugggcuaccagugaggccuugccucaagacucaagaucuugccugucacacuuggaaggcugaggcaagagaauugccaggaguuccaggccagcuuaaguuaaguacuucucagcuaaccugggaaggagggaaaauguguuccucacaaauguggcucaguccccaugaaccaucucugcaucagcccugcccuuccuccccaucacaguaccucuguccauugcugcuagcuaccggaugcgucucucaccuacauccaagguuggggguaaggaaguucucccaaggccagagcaugugacaugugaccuggaggaaacugucuuaagggacaguccuacuuaguuuaggucuaacuaaccaaugucauugaguguuaaugggacuuuugagguggggggggggggcgaaugcuucuguuuuuuuguuuguuuuugcuuuguggucaggguuuuguuauauaaucuauguuggcccaaaacucuauguguauguagccuaggcuggccaugaauucacaguaguccugccucagucuccuuaucgcugggauuauggcuuaagauagcucauuaaaggacuggagagauggcucaguggucaagagcacuggcugaucuuccagagguccugaguucaauucccagcaaccacauggugacucagaauguaauggggucuaauauccucuucuggugcaucugaugacagcuaaaguguacucauaaauuaaauaaguaaauaaaucuuuuuuuuuuaagauaguugaauuuaaaaagaaagacagguuuguugugugugugugugugugugugugugugugugugugugagcgugugugugugccuacauggcugugugugcaccacuugcauucaagugcccacaaggucagaagcgaggucagauccccuggaauuaguuacagguggugagccacuggaugggggcuggggacugaacgugggucucuagcaagagcaguaagcacccuuaaccacugagccaucucuccagcuccaaauuccuaacaguuuagcuaucaagauauuucagugcuggguauguguguguccugagucaggccacagccauggcuguuuccaaaggagguuguugccagcaccauaaaggaaagagcaggggcagagaggcagagaaggucacccugaggucccaggaggauagccacuagugugaggccaagucugcucuacacagauaguucaaggcuacagaguugcuuagugagacccagguucaagagagaaacacucagcaggcuuuaagguucagccucuuuccaggucugggcucuuucuccacaaccaccugaauguacagagaauggucggugggcagcauccugaccccuggagguggugguugcuccuugguggacucuuaggucaggggugcuaacccugccugugcugggcuggcuggguuuccucaccuugacacacccuagaguuaccugagaggaaggcaccucaggugagacggugccugugugagccuggcccguaggaagcuggugaggcauuuucuugucgggugauugauagggagguuccagcucccugcgggcuggccgugccacuccugggugguuuaagaaagcaggcugagcaagcagggagcaguguuucuccgugaucccugcuucaguuccugccuccaggccucaguggugagugcagccggaggguggugaguggaaagaagcccucuccucacaagccgcuguggccauguuguuuaucaccgcaguuaagauaugcugugcuaguccuggacuaggaauuccauccccacaaauuucucccucacagucuugucuuguaugacaugguuuugugucaagcuuuucaaugauaaaauccacugguggccucuccgcugguguuaaaacucagaagcagggaggucuggggccucuggagagaaacugcagcugaggucccagcagggagauggcucugcacuaagggucccgccuccugcacccuucaccguccucaggaggguuaguuacgccagcgagugccucugagccccuggggccuuccuucccaccucacucaguuccagaaaaaucccuuuucauccucucuccaaggaagaucccucccuucuucacugagggggucucuacccaagugugccuggucccagacuucccaggggccaccugcuuagagguuguuccuccccaucucccugccucaugguggcugagauagcccucucccucagugggaaccuccuuuccuucaggucauuucucuggaggccgccaagcucggggcuggcagauaccuucagucagcagcacuccucagggcagcccugagcaaggagcaaaccacucgucaggcucgcacgcugaccucugaccugugugcccagaggugccagagaccuugggcccucuuaaaagaggguccuguuuaucagcuuucuuacagaggauagcauggcaccucuucccaggugugacagccagaaucaucugcagacuguguggagucccuggggaacagagcagccaccuuugagggucucuucucuggaguuacaccacccuuacagcugaggaggcugcccuggaggcaggagcagaagccucaguucuguguaggagccuugcucuccgacauugucucucuuccugcagagacuagcauugagaacaacucggauaacgugaagaagaucccaggcuaucagugccuaggaccuaauucucaggggcgaagggacuuagugguuugguggcagguggccucuguaaggugggggcuugcuugcuuacaauucugugaauaugggcaugugugcagcuggcagagcugagcaugaacugacaagugucugucccugccucuaggacaccacugggacaccuuggacauggcucaguccuguucugcuaaggugugucuagggucaaccuuagaacuggaaguuagcagacacuuguucuuucagcuagggcugcugccagcaguagguaugcuguugguacccagcaguaugguaugggcauggggaggaugagcgggcucacagaguaaccauuagcccccagccacacugcacaagccuccucagauggucccacugcuuagaguccuugcucaggccugguuagucaaggauuacagacuuccaaaaggaaaacagguguccagcuuggaccaguguguacaaagucugauacaugagucacccuguuggaacccuccagagucgggcugccaggcuauguuucucuaggcacauggaccugagagcagcugauccaagauggaggcaaaacugacaggagccuagcaagggcuggaggccaaucgagagugaacggugggaccaugggugccucccuccucuggugacugacucuccucucuuuugaucuucaguguggggcugccuuccaggaggaggacaucauugugcucaauggcaccaaggaggauguggagaugcugaagaagaggauggaggagaggaggcugagggccaagcuggaaaagguagugccccagagccugcugcaaacuauccugcaaccucagcagaugcugcccagccuagggggccuggccucuagaaacagauuuggggcuuggcugcauuggucuucaucaccagauaaguagguggucgguggcucaaggcaugaugguguagggaagauuuuaaaaggaugggucaagcacuugcgcacagugucgcagaaugagcucucaggaaaagcagucauggaggugaaagagcacaggcgggcugggcuuggagcuuagcaguagagugugaggcccuagguucugucaccagugcagaaaaagaaaggagucauagugcauuuucauaacuuguagaggugaaagcagaagucagugucaccucagcaggucugaggucccccugcaguguaguccagcaggcauggagggcauacaaagcaauggaccucaucguggcuccaauuguuuuguuguugauuguuauagagaaagguuaggcuaaagguaaacucuagccuacuguuuguuuuacuaagguagaaauccagauguggcacaccuguaauccuauccuccuaaggaagaguuaggagaguuggaggaguuuggagagccaagggcuaaguguggcuuagugguagagcaccugcaucucaugugcagucaugaguuugaucccagcacugaaacaaagaaaacccucagggcaaugcuggaaggguuagaaaaguaguguggugaggacacacugaccagaaacagcuggcauuaaaucagccuacaucugccaguguggucugaagguauaaggcuguagugacaggaggggcuucagagcuuugcuugugccuuuuugucauagaugaaagaacagaaagaaucacaucacccgugggugacagugguuccaugguugugaggcuuaaaaagcugauggccacacaagggacccaucucucagaagcaaacccauccucaucuccucuaucagcuuggaaaauagugcauggagcccgugcaaauguucagcugugggaaucguggagcuucaaacaucugugugugcauguuaauuccaaauuaguuuucuaaaauucacuuaccaucauaaaagcauagaaaaguugcagugucuuuggcaagagacagcagccaaggggaucugauugguuuuugcuguucuuggucaguuuuuuaaaaauguaaggagaggcauagugugcuaaaaagcagcaggagcccugucagccuuggaguggcuucccacguggcuguccuaucacaggccuccugccaaguccugcagagcccagugggauugcauccccucugcagccucuucagcagggccucugugaacgcgcuuagauacugcuaccaagauacaaaauauuucccaaauauccucaccugcugucagggcuugugucucugcgcacaccuccagcuuugaacagcccaaccgucaaugaggggagagaacuaagcguucgucucaguuguuuugugugacuggggguguguggacacugaaugugugcacacaagaugucagguguccuccucugucccucucugcuguuaccuugagacagggucccucaguaagccugaagaacaccauuucggcaugacuagcuaaccagcaaauucucaggauccuagucucucuaccugugaguucugggguacaaacaugcacagucauguuucugcagugggugcuucugcaccaagacaucucuguagucugugagguuuuugcuuuguaguaacagccuucaaagauuugugugugugcauuucauguguaaaugaacuguuucuuaccauuuuuuucccaaaugcuuuaagucaaauugcaugaaugucacacaucaaaguccaccaccgagaaagaucuuuuguucagugcaagagaugagggccuuccaaaauucauuaucuuguuuuacuuuguuauuuuaaagacagggucucaugaaguccaggcuggccuugaacuuacuggucuuaaacuccugauucucuugucucugccuccccugcgcugagacagcaggugugcugugucucugguacaguuugggguucuuauggaaaugguguuuuaaaguaagcugugaccugccuuucugauggucugugggguuaacuguaauuucagaaugaucagccuucugggggaugaacacuguuacccaugcagcaucuaagaguccagugacgcugaccuagagccucaccagcugacgcuucucagugaaaaccuccucacagcugagcaggcgucggaggcugacagcucuggggcugagugaaugaggcuccguguguguucacguguguggaaguuguuauuguuucacugcucuuuuguguacgauagucacuggagagagugaguggccuuuuguuugugcugcgguuuuggagaucaucaaugccuccucaacacugaauggcugccccaucacagagcaacucuguaugagucuguguagacucagucuucugugaggcauggcugcuagacuggagacaggucguccucagagaaugugucuggccaucagggacccugggcccuaggcaggcccacugacacuguggucugauuaucugagcacaacccuuccccuucucccacccugucaguuacuucucuguguucgagaaccccgugaccaguggcggccuccagaggcagagcuuaguuuggcucccaguuccacagggugagaguccaucguggccaagaggcacggccacaagaguaggaagcugagaacuccauccacacacgaagcagaguggacuggaacuggggugagguuguacacccaguaaguagugcaccaccacccccugaagguucccuaaacucccaaacagcaccaccaguuugggaucaaguguucaaaaagccaagcugggagacucucccauucaaccaccacacccuccaaagguuucuuucuucuuacagaaaacaaagaaaccgaagacagcgaccgagugugcgucaaagccggguaccacacaagguacgaccuuaggaaccugggugcggguuguccacggauaccgggcccuugcucugcuuuggcucaagguuuguuuugcugauucugucuucuccagauuccgcagggccaucaaaagugaagucuggcaagccugaggaggcggacccugauccuagagagaagaaaagcaccccggcucccaggggcgcaggugggucuuacugagccagcggagagcugagaacaaagggaugagaaaacucaggcucuccugaucguucacccguggcucccguguccuuugaauuaaagaguagucaaagguucugggcacaaagcccauaucuuacuguugugcaagcuuauggugccauaccacagcagcacacagagcuacccucaaugcuucacacuguggagggcuuaggcacugcagccacacuguguggaggccuuggacacugcagccacacuguguggaggccuugggcacugcagacacacuguguggaggccuugggcacugcagacacacuguguggaggccuugggcacugcagacacacuguguggaggccuugggcacugcagacacacuguguggaggccgugggcacugcagacacacuguguggaggccuuggacacugcagacacacuguguggaggccuugggcacuguagacacacuguguggaggccuuggguacugcagacauacugugucgagggcuuaggcacuucagugccuuccuauuuuccccuuagcgaucuuugucucuacuugccucuuuuuucuuucuuucuuucuuucuuucuuucuuuuuuuuuuccugagacaggguuucucuguguagcccuggcuguccuggaacucacuuuguagaccaggcuagccuugaacucagaaauccaccugccucugccucccgagugcugggauuaaaggugugcgccaccacgcccggcccaacuugccucuuuugccaaguggccaaacugcucuugaaacucaaugucuuuacuucagaggaagcaucguuuacaucagcccaguggcagaggugacucagccaugagcaccaggccagucugggccacaugcuugaguucaggcuagcuuaggucacauggugaguuucugucucaaaaagaaaacaaaggacaggagagcuggcuuagcaguucagagccaauagugcucugcuccuagcacccauaucuggcagcucacugcuuguaccuccaccuccaagagaccugacagccucuucaggccucaccaggcacacacacacacauacaccauacacguacauauaaagaaaaaagaauaaacaaaaaaaggaaaauaaauauuuauaccaugccuggugacacaggccucucaucccagcuacucaggagcugaggcaggaagaucaaaaguuugaggucagccuuggcagcuuagucaacuccucuaucaaaguaaaccaucgaagggaccuggggcagagcucagucaguagaggacuacuuacucuacuuacucuguugagcgugugugaggagagagagaagagagagauuguguuauuauguccagcauaaauaguggccaguggcucccauucuggcgucaaucagcauaguaagccgaccagaacaggccacuggggcuucugggcucuuuguccugguucaauaccaaccugagcggaccaggcccucagccugagugcugagaagcaggggacagucuggugcuggcauacagugcucagcaaggccuuaugugguuggggcucugccuggcuuucaggagacacuaauaagagucugugcuucaagccaggcaucggaggcacaguuaggaaaaucacuccaaauucaaggucagacuggucuacauacuaaguucuaggccagccaagacuacauagugaggcccugacucaaauaauauauuguaggcaggaaauauagcucagugguuagaauacuagcacauaugcauaaagccugggcucaguaugaagcagugugauggcagcuucuguaaucccagcacuugggaggugacgccacaggacccgaaaucaaggccagccccggcugcagagaguucaaggaugggcugggcugaaugugucucugccccuuuacuucagcugcuuuccaaauagcagcaagacauugggagcuuagccaaguggcaugcaugacuuggucccuuuaaaacuuagucauuuggaaugaucuucagccccagccucaccgguuuuggcuuuguuuucuagcaacuaaugggagugcgucugggaaaguuggcaagcccccauguggggcccugaagagguccauugcagacagcgaggagucugaaaccuacaagucuaucuucaccagccacagcucugccaagcgcuccaaggaggagucugcgcacugggucacccacacauccuacugcuucugaagcgggaccgggccuucacccuggguuucccguggccuucugugccacacuugcuugguguggcacugugcuauaaagcuguccucugcaguccucagccagcguggucacuugcugugagaucuugagggcccugggagugagaaguggugugugaccucccuaguagcagguccacaggccguaccucucaccuagccuggugacugcugcuucuauuagguaacaaaagacuccagcucucgguguacacucagcucauaauggucaaggagggaguggccccgagcuuagggacagacuuccaacagucuuagaccuugcuccucacaggguucuucuugccugaucaaggacugcagagaggacgcaugccugacugccuggugcacacuaacauccuuucucugucuuccuucucucucccuccgcuaucuugguaagagaauggcagccauccaggugccgguggcaggcaggaaugacuccuuuuccauccccacaguuaaaauugggaccucugugacacuucauguggugugauagaucugccucugggcugggcagauggcucacucaguggauaaagcacucgccauggacacuuguggaccagaguuuagauccccagaaccuuuaucaaagcccggugagugcaguagcugccugugaucccagccccuguaaggcaggguucccucagcaaggcacugaguucaggguucgaggagaaccugccucagacacuagcuggagugcaguugagagauucccagugucagccucuggccuccacacuuaaagucccuguucccaaaccaaacaugguggcaugucuaauccaagcagucagaagacugaggcaggaggaucgccgagaugucagagcuggcaagguuaaauagcaaacccucaccucaggaaacaaccccagaaaagccccuguuccugcugcccucugguuugcugcuugcaggcgaugaggcuuggccucaaauacacuugcauuuauucugggacagugcugggagcaugguaggagugugcagcagggugggagugagcaugguccaagggacccugggcgcaugaccuuuguacuuagaaaauugaaauaaagguuguagaaauauuu

SEQ ID NO: 1305 - RNA, 488 nt, Mus musculus
ugugucucugccccuuuacuucagcugcuuuccaaauagcagcaagacauugggagcuuagccaaguggcaugcaugacuuggucccuuuaaaacuuagucauuuggaaugaucuucagccccagccucaccgguuuuggcuuuguuuucuagcaacuaaugggagugcgucugggaaaguuggcaagcccccauguggggcccugaagagguccauugcagacagcgaggagucugaaaccuacaagucuaucuucaccagccacagcucugccaagcgcuccaaggaggagucugcgcacugggucacccacacauccuacugcuucugaagcgggaccgggccuucacccuggguuucccguggccuucugugccacacuugcuugguguggcacugugcuauaaagcuguccucugcaguccucagccagcguggucacuugcugugagaucuugagggcccugggagugagaaguggugugug

SEQ ID NO: 1306 - RNA, 10495 nt, Mus musculus
gagaaaugguugacugggaugugcuccugcugugccgugggaauggaggucggaggauagcuugcaggaguccguucucuccuucuaccgugagggagggcccuggggaucggauucaaagcagucaguuuccagagagcuuuucagugaugaaggcgacacacaagucugguguaguguugcucacccuuaauccuucccccccacacacacuggaaggcuaaggcaggcaggucucugagagcuugaggccagccuggucuacauguccaguuccaagccagcaggauacauagugagacccugucucaaaaacagacagacagacagacaggcagacagaggcugaagaggugguuggggacuugccuagcggguaugaggcccuggguucccuccugaacagcacauaugugcaugcacacgaguguacacacacacacacacacacacacagagagagacacacacagaucacacacacagagagagagaaacuggacuggcacuuuuuacuguugguagcuucccauuuaguuacugcuuuuuuuuuuuuuuuuuuuacucccgcccccacccccauagacagguuggguuagcgcagucacaauuaucacaauuaucacacagaagacucggcuuuaugaucagguggaggagacggcaggcagaauaacacuuuauagagauguucagagucagggaggccgagggucuggcuggggugcugguguuucaaaggugacugcacccgccccccccucccaccccuccccugccugugccagaagcaucucagaccucuggguggucacaggagcagccuaggugaugacaucuccucccuccaucuccucugugccaucucugcucuuuuguaccaggaggugaugaaccagcaccagucggcaaaguccuaccaucuccuagacuccucuacaaucaccuugccacuucaaggccgagccuguuucauuuccagcuagacacuaacuucuuguggcuccaggagaaggcucucccugaugcuuggaggagugguugguaccacugaaucagaaccugcccacgagcauccucguugucuguguucaagcaucuaucaaggaugaucugugaaccaacugcagcucugcggucucgggauccagcagugaacaagacagacugacaacccaguccucccgaagcuggccuuccgcugaacuagacccugcaucaaccugcacauggaggguugggcaagauacugagcaaucagagaaccgcuauggagcaagauggggugagggcugugauguggcagccugaauacagacaaguggcccgucuguacuuguuccuuaugugcugucugugggucacgcccucugccccugcuacagcugccagagcauggggaccuggccuguggucacuacugucccaucccaucccccaccuccuccucacaaccuuuuauaucucuucauagaauuacaggggaagauucaucucugguccuauuagauggugugugugucugucugucugucugucugucuguugggguagcgguauuaaaguagaaacuucucucaccagcugaaggcuuuccacaguuucauucaguuugucuuaucucaaaagcuuuucaauuuacuuuggcccgaaagagcagcugagcacaagcugaccacagaaacagugauaucgggcguccacauuucagaaaugguaaagauuuggcuccagcugcaucugugcagggcuccagugcauguuugucauuuuuggguuagcaucguaucauccaugggaccagaugucacacacugggaucaugaugcuucagcacagaucgauuuucccaggacaaaaggagaguguuguauggcaggagacugugggcugcagcugccaucccagcaugaaggagguugaggcaggaggaucaggaguucaaacaauugucaacuauagacagacuacagguggacuauaggagaacuacaggcagacuacaaaaagacuauaggcagacuacaugagaacuacaggcagacuacaagaagacuacagguggacuacagguuaacuacagguagagaaggacuacaguuacaggaggauuacaggaggauacaggagcacuacagguggacuacaggcagagcacuacagguggacuacagguuaacuacagguagagaaggacuacaguuacaggaggauuacaggagaauacaggagcacuacagguggacuacaggcagagcacaggaguaaugcaggcagacuacaggaggauuacaagaggacugcaggcagacuacaggaguacuauaggaggacuacaggcagacuacaggcuacagaacuacaggcagacuacagaagagcaggaugaggguaggagaaaaaaaggaagaaaauuaugcuaguuauuuaaccgcuacaagauguagucaucuucugaaaggacccaaggggccccuggugcauuugggucacaauaucaccauaugauguugauauauaguguuucucgcccugauacauauaggaccagccauauuguauuguuacacacaguggcucucaaccgaggugauuuguccucugggagacaaauauuucuagggaguuugcguggguuuucucuuuucuuuucucuuuuucuugacaaggucucacuaaguagccuagauugcuggagaacuggcuguguagacaggcuggccucaaacucagagaucaaugucuuggccuccccagugccagaaguaaaaggugggugucccuaugcccagccugccuggcccagccuuguguagcucaggcuggccucagacucacgaaguagccaaggcugugaacugcuucuuccucccgccagcuggggccaugggcugggcuaggggccgaaccccucuucaggaggcugucuuuuuuaccuccccuuuguuugcuuuaaugccucuaauguuuuuauaggcgaccccaguaccaguaaauguuguuuuuuuucuuugacacccagcaggguaaaggacaggaacguuuagcauuucaaggacccggacuguuauucgaaaucuccgccugccaagguuuugucuuccuggcuccagagccuacucccauuuccaagcccagaaaucuccuuugugugcuaguucccugaugggcuggugaccucuccccucaaagguccccuagcuguuccaguuuuucugcuuuuaggucaggagauaaagccaagcugcugcacaccugcucagcccugcauuaaagaagcucuagccgccauuagcgcugagucaccaccgggggggaggggucugcaaagauugcacaacuugucaaaggcgaccaucacuagcaagggccuuccuacuacaccagaccccugaauuccauucaccuaaguacauaagagcaggagggaucaccccgcuaccccagcuccaaaugagacccccccccaaggggagggcgcccaagacaccugucugauuggauagcaguaaguuucugagcacaaaguauccagagcagaguguuuacagggagccccagcccuugcuaccaggugguggguuaaggguaggugugacacaggugaugaugaagaaugguuauagaugugaugugagagugacaguggggacggauggcaguggggaugauggcuuuaguaaugagucaugcggugacugaugguaaugaggaugauggggcugcugcugcuggggauggugaugaugaugguguggaggaugaggaugcugcugcugcugaggauaaugauggugaugauggugguggugguggugaugaugaugauggggaugagagugaugcuggugguggugacagugaugguuguggguucgaguuccaccuugugucugcggcgccacaauggugaccugguugcuggagugaacagcuccagaggugugucucaagagggcagaagcagguguaagauguggacacugacuuccuggagcucuccccaguacaggcuaagcauuuccagguuggccccaagccagggcugaacauauauaugucuugucuucacugacccaggcauugagaacuagauauagaccacgcccaccagauucgggcuguuaacuugagagucaggcaaagaaauacauaacuauuuauaaaaccugucacugucuguuucaggcaggagcagcacuuggccuguccuucagacuuuuuaagaggauuuauuuguuuugaauguguguguaugugaggauaugcucaugugugugagugugagcacugugugugugcacagaguccagacggcgucaagcaucucucucugcugcucuucgugaauuccuuugaggcaggagugcucuccgaacccugggcucaaacuuccucagcuaggcuaaaugucagugaguccuggaaaucuccugccucugccccagucggagcuggggguugcaggaugcaagggacaguggccuuguuauaugaguuuugggaucuaguacucauggugggacugcaaaagccagcaaugguugagccuucucuccagccccgcccugccgaguuaaacaaacaaacaacaaaauagcugaacaugguaacuuugcauauuuauuuuuaugggguauaguguaauucucccucccuuccccuucccucccuccgucccccuuccuucccucacucucaccccuuccuucucuuccugguuccuccuucuucccuuucucccuccccuuucuucccucucucccugccucccuccuucccugccucuuuccuuccccuguuccuucccucccucccucccucauccccuuucccucucuucccuccaucacuucuuuccacuucucccuucccuccuucccucccuuccuucuugugcuggcaagcagacauagauagcuucaugcauuguaggucagcauucugccacuuggccacaccccagcucuugagggcagugcucugacaccugucuacaccauguccuagcaggguccuuaguguagguagcacccccuccaacacccaccauuucuuucuugggaacguccuaagucuuuucuccuagcgauucugaaauagacagccagcugucagccgcacugugugggacacaaagguuauucuguuuguuugucuccugccugaagccuggauccaccucucucaccgcugacccacaucacagccccggaagccgcugggcaccucuguccuuaaagauaucuauuuuuuauauuuaugaguauuuugucuaugagcauauccguguaccacgugcacaccuggugccugcagacucuagaucagagcguuggauccccugggacuggaguuagagacaguugagagcugccaugugggugucgggaaucaaaccagagcccuccugaaaagcaagcagugcucuuaaccauggagcugccucugcagcacccccaacucuguuucuaaagacuucuuuaucauuuuaugaacauguguggaugugugcccgugugagguuaugugcacugcugugugcaagagcucccagaagaaggaagggggcaucugguucucuggaguuagagauggcuaugagcagccguguaggagcugggaaccgaaccuggguccuuugcaagagcaguguguggucuuagcgcacugagacauuucuccagcaccaggagcugcaagucuuugauccugggcuuuugaauccaaaaucuaagagggagagaaauuucucuguugucuggagauaagguugagacagcuaaccuucaguaugguugucauugcugaaaauacaccccgguggcccgaccuguaggagaaagcacaaagugugagacuugagauguaguagcuuagccagacaagguaccucaggcaggccuguaaccgaagcacuuuagaaguugagaguugaggcaggagaaugauuguaaguuugagaucagccugggggcuguagcaugaguucuaggauagccugagcuacaggaugugacccugucuuaaaacaaaccaaagcauaguaauuaaugagucauaacugucacaaaauuacugugucaagcaaaauuuauaugcccugccugcuggcugcaagagaucuccuuccuacaaaggaggauaaggaacgcugcccuccaacccugcuacccuggccucagccaucugcucaaacacugcccugucccacccagguucccauuguaaggagccauuuuaucuaaacccgcugggccagggcccugccacucggugacaacuacccccuaauuucuucaguuggcaccuccgcccacgaggaggaucuguccugagcugggaaggguaauaaacccagcuuugcccgauuaacagguuuuucugguggacuuaaaccaauggacuuaaggcccuugaaagcauucaaaaugguucugugugcgcgcgcuuauucuacacaacagaaaaaaccaaaccuggugcaaauggccaccaaauacugcucacaucugacccuuggugucugugggcacccuaagaauguaugacagagucaaaacuuacaauggaguggagaguggaaccuuacggccugggacauugucuggcucuggauagccugacacacaggaggcagggugccuuaguuuguucucuaguacugugauuaaauauucucaccaaaagcaacucggggaagaaaggauuuauuuggcuuacaaauccccaucugggcccacugagcuggugcaucucggagggaguccaggcugcgaccgaagcaggaaucuggaggcaggaacugaugcagagacuauggaggagugcugcugacuggcuugcuccucauggcuugcucagcuuccuuucuuaaaccuccaguccaggugagcugggcccuggcuguccuggaacucacuuuguagaccaggcuggccucgaacucagaaauccaccugccucugccuccugagugcugggauuaaagaugcgugccaccacgcccggccucuuuccuuuucuugaauaacucuggcuacugccaaguugacaaauguaaauaaacaccagcacagagaguggaaaucagaggugggacaaggaagcagacgguugcuggcuucacacaaucaaaaggccacuaacugaagagacauucacuaggcacuggaagucaacacuauuggcaugaccagguagguagucugucacugggcagcuaaaucaucacacaccuuuauggggaccaagcucaaggacucccacaaccacagauguucgccauucucagcccaacaucuguucucuggaggcacacagcugguugccaagauggcacugugucuccaugcagcugaggaagagcaucuauauuucacggaaucgugagcuaggugcugaaggugccacaucgggucagcuugcgguagggcaucuucucucgucuucuuccucuuccucucuucucccuccugucuccccuucucccccucucagccccucccucuccucauuacucuugcuuccuccccacuuucuucucccuccuccucucuugugucuauuuucuucccccuccuccccuagacugcuaacuccuccucuuucucuucucaaucucucuucccuccucaccuuuccucucuccuuauguuucuuucuuuuuccuucuuccuccucuuccuucaucuucuuucuccucccuccuccucuucccccacccucuuccuccuugcuucuuuugcauggcuuuacagauagcacaagacauuugaggcagagaacaauagcaacagcaucccagaugguggcaccgaccaagaggagagcuuauaugguguggaggaggcagcgaucaaaauuccagagaccucuccggagccucugucaagcaccucagcccuccaguucgcaggcacgcaugagucagggauucaucuucuaccucuaccuccccucggcagggacuacucaagugugccugccccacccccccuucccucaagaagcuggaaaaugacucuacccugacaaggaagaacauucuagaaagucacuuuuccccgacucuagcuuuuagaguauuaaaacaguagaugucagagaaugaaaaauuucccuggaacccaugcuggggagcagaagccugggacccggugcagucagagcaggagccuguccccaggaagaguccacagcugggcagacugucggcccaccuugcaggagagacuggagugggcaacgaugggucagugacaggcaggacacaccuugaccagacuccuuagcugcgcacccucugcccuguguuuaagccuaaaccccaugccaggacccuggagauggacuugggggucacuggaccucuuugcgugcucuucucaguguggccacacugauauaucccccuucucucugcuucacugugaucugucucucuaaucauccugguaagggcagguggcugggccuggcuuguuagggccaccagggcccauucucaagaccacuuuuguauagugauaagaucuuaucacuccaaccuggggacagaccucaggagccugagacccaguguccccaggaugucugugacuauugcuuuucuccagggggagaaagcuggauuuuuccaugaggagggacuugggaaaggcuaaaccuugugagcucacuuucuauacuucuagaaguuuccaugcagaccuugacccaugcacccucuugccuguggggcaaaggcucccagccugcugcacggguguugcaacacagcaugcagucucccuguggcugguucccaagccaggcugguugucucugaacuaacaacacgugccuggguucucacacucucagggauccugcaaaaccaagccagaacuaaagccaguacccagagcugaagcuguguagggagagcugcgugguguuuccagucuaaaagcaaagggaaacaaaacaaaaaucccaccuuuuacauuugcauuuauuuuaugccaaguuacuucugugucaugagguguuuucuguuguuuuuguuuuguuuguucauuuuuguuuuguuugcugugugcuguuuucugacaguuuuccauuuugugacccuggcuggcugugaacucacagacugccugucugugccucccaaagacugugauuaaagaugugcaccacuaaacugggacccacgcaccgggcucuaacacaccaugcccuaccacaccaagcuccaccacaccagauucuaugcaccagacuacacccaucaggcgccaacacaccaggcuccaccacaccgggcuccaccacacugagcuccacccaccgugcuccaaccacugggcucuacgcacauggcuccacccaccgggcuccaccacaccaggcuccacccacugggauuuuuuuuuuuucaucuuuuucuucagugcaaccuccucuucuggcuuaggaacaguuuguuccucuuuaaugagggucaccuccaugagacaggaggcacugauacacacggacuccaucuugggugcccuggaccuguuugaugaugagagagaaucuacagccaaaccuuaagugcugcggcacucacagcaaaacuucagcacuguuugggccacggauccugcguccagcccuaccguuugucuugggcaugcguacugacaccauuacaucaccaggauggccgacauuugucucuuuagagugguaucuuccaaauguaagguggcuuuucagauaagcacucccucaauggcuuggccaugauaccgauuugaaccucuugcuuugugugauuugaaggguuuucugggucaaaagacuaguaaauuguuuucuaggucaccucaaggugcuuacaugaggaagauagcugcuuauuauuauuauuuuuuuuuuuggcauugcuguggaacgugauuuuucugcagacaacuacaccaucuaguccucguucaaggacaaacaaaauaucaggcauggcaacucauauuuguaauccuaaaacugaaacagcagagguguugggaguuugaggucagcccagacuguacuaugaguuauagcccagccugggcuacagaaugggaccuuggcucaaaaucaaaaagauguuuaaaagucucaauaggcgagccgacucguuccuuucuccucguugggcgucugaaggcaagaugggucaccagcagcucuacuggagucacccacggaaguucggccaggguucccgcucuugccgcgucugcuccaaccgccacggucugauccgcaaauacgggcugaacaugugccgccagugcuuccggcaguacgcgaaggacauaggcuucauuaaguuggacuaagcgaccuugaauggauucgacugacuacuaccaaguggaaccgaucaugcuagucuuuguacacaaagaauaaaaaugugaagaacuuuaaaaaaaaaaaaaaaaaaaaaaaaaaaaaagucucaauagacacc

SEQ ID NO: 1307 - RNA, 12937 nt, Mus musculus
cgccucggcccucggggagcucucucuggccacucuucugucuuuaaccccugcucacagccggcuccagagcuaacaccaugaguuuccaguugcuaagggugaggagcuuacaggcagaggagggccacuggaggggaccgcggggcuggaccgggcguccguccgugggcgcagggucgcuggcgcgcuguccugccgccaaucuccccagcccuuggccaccgugggccuccucugcgccuggcggcgacuaagauaagugacuuaaggccgcggggcucaucuggccuagagguguguggaagccuaguacccuagaaggccucuagguauaugggucucccgccugcgcucggagcgcuuaggucgcuuggauaugggccccaggacgcccugggaaggugacaagcccgacuccaaguguucgaggguccccgggggcaggguagggcagucucaggauugucuccuucgggguucuagagacugggagagaggccucagauuauuguuuaaaggaagccaauucagauucaccuuugcugccgccgcagagagaaggauuuggccagcgcugagcacaggagugcggccccccgggcaggccuuggacaaaaugggucccggggagccugguaaagucaaggguucgaauuucguuuuacuuugccuguuuguaaagaguugccuaguaggaagacccaaaggcugggaaaccgcuucaggccccugcggcccugagcuagacucacugagcugaguggggcugaggucccuacaucuaugggccuacauuuauucuguuagaaauuuuaaaaaaucgaugggcauuauuuuggagcgcccgaggauuguuaucaacaacaccucugcgcuuaguucuggaagcucuuuguguuuuaaaagguaugucuuuauugugcauguguuuagagugugugcacacgcgcuguguguauggccguggauagguacgcacuguguguauggccguggaucuguggcgggaguagguucucucuuccuacccuguguuuuuaaacuuggcggcaggcgccucuauccacggagccaucccuccggcuuuugcccaaaguccggugcuugcccauucuaggacaggaggguggggcguggauggacacccuccuccagagauuuguggcagaaaccgguuucuagggcccugcccaacccaggcugcuagguaguugacuguaguccuucauugucccuaggggcgcggaauagaguuccccaccccacccccggacguggcgccgcacuugcgaagugcucgggguccaccuuuucuuaggagcccuuucccuaaggccaaaagaggagucuugccgccugcacuucaguccaguuuuauaauagaaaacuccaaacugacuucuuuggccuugggugguggcaggauaggagacuggagaccccaagccacauugacagacgcacccucgcguguuucuuuggaggugucucacauuugggcauuuagggugccggugagcgcgcgcgcgcacacacacacucacucacacacaccugggcggcuccagucucgucccaaugagagggaccgaccugcguugccagagugugagugacugcaggcucccuagggggcggcagagcugagccccuggcagccuuccuuccacucccauaucucugcacggggaccuuagagcaaguucuuagucccggggacggggggaaugggaggugggcaggacaccuuacccagcccuggcugccaagggguacaaccacacgggucaacgucuuuccgugggcgaugguaggagauuguuuggagcgcgggaaccaucagagaagcugagcucucaaggaaggcggaagcuuccugcaccuggacucuguguccaggucccggcccccaagcuggguguggaugggacaggguccuccagagucgaggaaauccugugugcaacuguccucuccaucaagcgcugcgcugucgcuuuagagagaaugaauagccuugucuagcgguucccaaguccccagacucggggcgcggggggggggggggggggcugaggaaaggcgaaugcagacccuucaugcccuucugucguccuccccccuccccacucggccgaaagcuccggugcagaaagcacucggucccccugggcuucuuggauuaucgcugaggugggaagaacagggaaagccugggguagggugagccgcaccgcccccccuggccaggagaggagcggaaccccgccagaccugugacaguugccuuccagagagagccugggaccuggcguucccaguccugagcuugaugcgggcagcaccaguucuuucuggagcaggugcccucuucucccgcuaauuccagggccucuguuuuggaggcucggucuggauugccugccuuuuuaacuuagccggaaaagcccccuugauucccgcgguuucaacuuccugggucuguuagggucaacuggccagaaagcuauuuugcaugcggcuauucucuaagaccaugggggaacgguuggcuugaacaucuauuuuaauuuuaguuacuuuacuucaggccuaucugggucuagggaaaugcuuacagacgaggagcaggaagagagcaaauuauuuuagucuguggauacgggaggcacguucccaacagguccuggccacugggcugauggguaucaagaauuguguaauuggcuucggaaucaauccgaaauagucccugccuccaauuccacuguuugaagccaaucuccauauacuguugggacggacuaacaagauuagcucucgagaacuguggacuuucuguuugggaugaaaaaaauuaacuauaacaauuaggccaauuauuuucguuucguugaauuaaaaaauaacacugaguauugcuuuuuggcuuggacggaaaaucuuggggugcagcagcauucuguggauagaagcuuugcuuucugccucccaugggacgaggugugcccauaucucagggcgaccucccuguagucccccucccacuuuacagcaccucauuccacgcggcccguggcgauggagguuuauucugccuggaaccucuuuuccugggcgaguagaggcuucugaagagccgcccgugacagcugcagaaccggcgcuccgcagggcugggcaucgcagcagggaugggccugggcgggggagcucgggucuccuccagccacggcccgcagccagauacagcuucgggcuauagcugcagcacgcgguuguccgauuuauucacagcagguauuaccgugaguuuccucuuuggagcugggggagcggacuccuucucggaauccuuccccucccuucccucagugggcaggucaguaaaguacccagggagagggaaaggggggggggggcacuagggaacagugggacuuuagcuauuucucagcccaauccuuaaaugucugucggaacagcuggggcgaggugucagggaaccccaggaguugagacacccuggaauggggcgucuucaacucucaagugacauccauuuuuuaggaggaugaaggacgguucuugagguggggaaaucccagcugucagcucugccagucuaaggugugcaagggggcuggcaggcaaaggaagccacguuugggcaccucagcuuggcaggucugcgguugucagagaccgcccacugaugccccugcgagccccucgcgacgccugguccugcaacacgcuaggcagggugcggggcggagcuaggcagggacuggcugggggcugccccgcccggcgccugggccuccgcgcggcgccggcccccggggaggaguuaugauaauuuccuucccauuaaggcguucgggucccccggcuaucgccgggacacacugugagggugaggcuucuccgguccacggcugcggccucuacacacccacggcgaccacaucucugugcacagccaccgaugcgcguccagugacugggacagcaaggccggcgcgcgcggcgggggcggcggcagacgccuggccaccgugaccccgauuguggauuuaccgcucgggggguggggggagccuggauuuaacuggcgacuauuuugggggacgccggacgccauguuguggaaaauaacagauaaugucaaguaugaagaggauugcgaggugagcgggggcuagggaacguagccccgccggcccgagcggggucccagggcugcuggccaaggcuggggacguuugcgcggagcccucgccuucgggagggaugagggccagucuucggccaucuccugggccccuuguugaaucuggucuugucucucggggacaaggccuggcaagagcguggcaaacccacccgcagaacucaacuguggguuccuacgaagcgcacggcccuccuuuccauuuuccccgaagagcgcccugucuccgggucucagacguggcuuuuuucccacgaagucuguccaguguccacggaagcuucccugccagcgacaccuuugaggagucuccuccaaggaaggcuugucaccugccccgcuaccuccucgagaaagaaaaaaaaaaaaagaaagaaagaaaagaaaaguccaaacaacugcaaccugguuuucaagagaaguggggguuggggacuguggggugggggugaagccagauggggccuugagcgcucgcgaguacucuagccugucggacagguugagcuagaguuucggagaguaggagggagggaggcggcgagcgggaagaggaagaagauucaggcggcgcgaggcgagcaccggggaacguggggaggagaggccggcggccaggcugcgggagcgcaccgcacccgcacgaccucgaggggcugccccugcgugcaugcccgggcggcuuccgcuagggggcgacagugccccgcuccugugucccugcuacccuucugaccccugggacugaugaagacacaucuuuuaggaauuaagucugaccgccuuggggcgaggggacgugcgcaggcaaagguugcccaguuuggcagagucuuuucauuccuucucuacaccgggaugugugagaaccuugaccauggccgggcuggaagaccucacuuccuaaggcgcagaaggcacgggcuuggcuagcaaggaucacagcuccgaucccgcgugucggcucccggucucuccggacgacauuacuaugaggccuuaccugagagugucacuuccgcggcgcggccgccucuuaagggagugagagggggaugauccuuggggcggggaaacgcgcccuucgucggcguugcgcauuauccgcgcuauuugcgcgccgcagcgacaugggaggaggguuguugaacgagggcgcugugcgccgaggucgccgcacgccgaaccccuggggcacggguaaccggacuguggcgcggaacgcgcucuuggcaccuccaagcgacgcagcgcgggaaccuucgccagagggcucgaaggauucguccccucaggucuuagaccgauaggcucacaacgaaguccggggagcucauuguccccgggggcucucgggcucuggggcggaucgagacggguggugugagcuugguggggcgcauaggugccccucuccuggcuugcuuguucgcuguagcaggguuucguacuaaccgggucucuccuguuucucucccaggaucgccacgacucgagcaguaauggcaacccucgcaucccucaccucuccucuccgggacaacaucucuacagucccgcgccgccucucucgcacaccgggguugcagaguaccagccgccuccuuacuucccgccgccuuaccagcagcuggcauacucgcaguccgccgaccauuacucgcaucugggagaggcuuacgcugccgccaugaacccccugcaccagccugcggccaccggcagccagcaacaggccuggccgggucgacagagucaggagggcucuagccuggccucgcaccacagccgcucugcaagucuaauaccccauauuucagggcuggaggggggcucggugagcgcccggcgggaagucuaccgccgguccgaccugcugcugccucacgcgcacgcccuggaagccggccuggcugagaaccuggggcugcacgagauggcucaccccauagaggaggugcaggugagcagcgggggcgggaggcugggggugggguggggguucuaccuuacccuccagccuuuccaccuuccuccaaacuuaaaagaaauugucauuucccccccagaauguggacgacgcgcacuugcuccuacacgaucagacugucauucgcaaagguaaacacugacucuuuccgcuugugucuaacacguggcucugaccagugaaguugccccuuuucugcaaaggcugggguauuaaguggccaacacggcucacguaguggagaagaccacgcuugaacgaaagucaguuccuggccugaacgaaaagaacucucaggagcugugauuuuuaaaagauuggguuuuuuuuuguuguuguuguuuuuuggguuuuuuuuuuuuuuguuaguggccauauuuuuuugaaucaaauguuucagucuguaacucagaguggccuugaauuccuuguaagccuccuggcucaaccucccuagugcuggcauuacaggugggaaauacaauuuaacuuaaaaacgggggugggggggagauacaaauaguaccuuaguuuucuuauucuguaacaauuuuuauucuucaacaaacugaccuaauuuuacuuuuuagagguacauuuauugugggggucaacaucuaaccugcugacgucgguuuucacuguccacuauguggguuccagagauugaacuugggugucaggcuuggcggcaagcaccuuucccugcugagccuuccuucuugccggcauaaaagagauuuuacuucuucuguggaagacaguuauaggagaggcucuuaauucugacacuacuuaauagguuucuccuaguaugcugccuuauuaaggacagaccucggguuuauaggagggagggauuggggaaaucggauuacagugaguggguggcucuugauuaaguuacacugacaggguuaccagucuuuuugaggggaaauggaaucguucuaaauuacaggcgguuauggucuugagacugugagcucuauuaguggauugggagagguuuggagaggaaaaccugaaaggaaacaguuucugaguagaccuaagcagaucuggcuaaucuguauuucugaauucccuggugucagcugcacugaagggucuggcgaugaucucccguggcuucaguucaucuuggagggggagggggaggaugccguuuauuucguauugaagcgguuuuucugaaagcaaaugcuuuaauuaaacagauuaccaugguggccuggaacagagagagagagagagagagagggagagggagggaggagagagagaaacaacucuucauggaaucuuaacuaauuaaggucuggagguguuaacucaugauuccagacuccagucuuuaaagcaaggauacggcuuuuaaaaggacuugcaagaagcaaggaguuuucuggaggcagaccucagcuuugguuugcccuuuuguaaaggucucucugccccauccguuucuaauggcgaaccuauucuguccccuacaggacccauuucgaugaccaagaacccuuuggggcucccuugccagaaggaccuggugggaguggucaugaaccccagugaggucuucugcucggucccuggaagacugucccugcucagcuccacgucgaaguacaaaguaacuguggcugagguacagaggcgacugucaccaccggaaugccuaaacgccucgcuccugggaggugugcucagaaggugacacuuguucagggcccccuggggguuggguaguugaaggugacuauguacgagggccuggagguauuuuuaacauuuauguaacuuuuauaucuuaacgcugaauucuaaucuguguuaagagagcuuuuuagugcguaucuucuucuugaaagugccaaaugcagaaugugcuaaaacagcaguaacagguuaucauuugguugggauuaagaggcagcagcugcauggagggggggggcuucuaguguuugguccccccagggaguuuacugcugcagucaugagugaagauuuuucugcaccccuacuagaggauucugagauuggugggggugggggucugguuuguuuguuuguucguuugauuguuuugcaagucgcuaacuuucccucuccaugcagagcaaaguccaaaaauggaggccgguccuugagggagaaguuggacaaaauuggauugaaccuuccggccgggagacggaaagcugcccacgucacucuccucacgucucucguggaagguccgugcgguuugucacucagaaagccauguuaccaaagcuuucacuauucaggaccuaugaggucacgggggaguuggcaaaacuuucccaugacgugagcuagcuuuugaaagauucgguccaucaaggaugggcccggcccaugaggaggcagaauggccauuuuucugguugugggguaucugguuguguucguuguacacaaugggcacuggcuuaguucaccauuucuucccuuccaucaaaggccggcgguggguggggggaaaugaaacccaugguccacaaaugagcuccuucuccaauccugagggcguagcugugucaguccagguuuugaauggggacccgugccccagucuggaagguggccaagaagaccauguuuuagcuuugaaaaggaaaguaaauucuuuuucuaaagcaaggagcacauaugacaggaagccaggaaggugggccuggacacaagugccucagcccaggccccugggccccucuguuguuagccagccccgugcuggcugacuuaagacaggauggccccaagaagccggcucuccagggcagagcugucucugaacacuuuacuuucuuuccuugccucauggcgugacuugugcugaaagggacuugacaggauccccccaugccuuugcacugugccuuuggaagucagggcaggcagaaaggccugacugaagagcuggcuugcauggaguuuaggguugguaccuugcuaagcauuuccagacuuccuuacuagccacucugagaaguuuacagaaagaaguagcuggcccaacucuggauucugacucagcucaggccucuccgcagucuggagcccugaagccagguugcuuuuacuuaaagaaauuauuuuuuuuucccucucugucucucuccgucuccccccccccccccccacauacaccugggcuuuguuuucaauuaggauauccccaccuaccacuuuuuuguuuguuuguuugguuuuuuguuuuuuuguuuuuucgaaacaggguuucucuguguagcccuggcuguccuggaacucacucuguagaccaggcuggccucgaacucagaaauccaccugucucugccucccgagugcugggauuaaaggcaugcgccaccacacccugcaccacuuucuuccuaguauugugguuaaacccaggaccucaaacagcucgacccgaguaccaucuuagccuugaaccucagccuccggagugccaggguugcaggcguguuacacugcuuucuuccuauucauugucuugagaccgagccucuugcacuaggcuggcuguguagccuagaaugaaugaacuucaacuccagagaccccugaauucaccuucccagaauuuaauuucuuuucuuauuuuuugaguuagagagcaaguuacaggcuggucugggcuacuuagugaaugugagaugacgcccagucuugaaagcaagauucuagauaaccaagcuaggcuggguuggugaacgccuuuaaucccagcauuaaggagacagaggcaggcagaucucggugaguucaaggccagccuggucuacacaguaaaucccaguacagccagagaaacccugucuugaaagcccggguaucggggggagguguuagaucccccacuuugugaagcauggcaggcacuaaagacccugucucaaagcaagagagucucuuccugaaggcugaccucugaccggugccauagcacacgcacacccugacucacacaggcauguguccauacguggacaauuaagaagaacagacaggugaacgaacaccuaaugaccagucaaacugcgccgcaggaacaaaguaaccuugcugaccacagccacucgagacuaacccugcugcuauugcaggugaagccguccaccuagcacgggacuucgccuaugucugcgaagcugaguucccuaguaaagcgguggcugacuauuuaacgagaccacaucuugggggacggaaugagauggccacgcggaagaguauguuguuggcugcacagugaguauuugcucucuacagucccuggggcuccaaacccggaagcuacuguggugggcgacggccagagcuuugcagcgucuuucguccuucgcagcaaccucuaguaguguuuagaggagggcauugcuccaucccagguggcgaggggccugcuaacaccacucacagcaggcacagcccccuguuuauugccuuuggguauguguaagaauuuguguagcucaguuaguaggguuugccuaguaugcaugaaacuaggcaacauccucagcuacacauaaaagccaagcauggugguauaugccuguaacgccagcauucgggaagggaggcaagaggagcugaaguucgggucauccucagcuacaaagugaguuccaaggccagccugggcuacauagauugguccucuugaccuuggccagguagccgggcuucacccacaugucuuuucucauuacaucagagauuaaaugagauaguguuuggagaacccuuaaucccuggccuggcauaggggcaugacagucaaggguauaguugcuugguagaaugcuugccuggcauacauguaaacaccagauuugguccuuagugcugcauaaaucaagaguagaggugaauaccuguugugaucuuguacuggggagguagaggcaguaauaaaaccaaggucauucuuggguauauaguggguuugaggcccauuuggagacugucucagaagugaaugcuaaauucuccuuucugagccugccuauccuaauaggauccggggugggggugggggugggagugggggugggggugggaguggggguggggguagggguuuauucggucaagagcugaguaacagucaccaacuguguucacaggcaggugugcaaggaguucacugaccuucuccaucaagaucggacacccaacgggaacaacaggcccgcccaggucuuggagccgaacauacaaaacuguuugucucauuucagccugauaacucauggcuuuggcagccaggccaucugugcggcggucuccgcagugcagaauuauaucaaggaggcucuaaucgccaucgauaaguccuacaugaacccgggggaccagaguccggcugauuccagcaagacgauggagaaaauggaaaagcacaggaaguaaaauggcugcaaggaggccagagagcagaaggagaggacccaggccccuccacuggggcagcccgggaaguguccagagcagcagcagcagcagggaagcaguuacaacccgcccgcccacaccgcacucuggaccugcccucuuggagucuuugugacuuuuccauuuaacccuggacaugcuauccugaagccacuugguuugguucuuuuauucauuaaacauguguguuuuuuguuuuuuuuuuaaauccguucccucucuugaaaggugcuacgaguuuuagaacccuuuguaagaacucccugggcagacaagaaacuccacgcuuagcugcuaacacagcaggugcaugggagucgucagauaaagggaucgaucaaucauaacuuauuucuuuuucaguguuaagauaauagcuggcuuuuauguccacuaaaauauuuaucuaaaaaaaaauaguauuuaucuaguuuuccccaccaccuugucaaucacaccuucugguaggaggcagaagucagagaugcucuuagcaggcagcuacuuaccagugguaugugacaggcuuccagcuacucauucaaaaaagggguccccuguuuuuaaggaacuugaaagcaaagccugcuguuucuuuccuguuuccuuccucuuuuaaaaaaauauugaaaguuuaaaauucuuuagauaauaggauuuuuaaaugaucuguuccuuuaagguagagaaguuuuauuugcauauuuauuucagaucuugauuuuuuuuuuuccacaaaacuugaagaggguaggcacacagcggcgccugccaucccuaaguccccgaggaggcuccgugcugagaaacuguugaguguacagauuuuauuuaugcauaauuuaaugggaucuguaaauacuucuuaugacuuuuugagaaaugggauucgauuuuaaaauuaccuuuuaaugguggugggucauguagccccucuagcuuuuaugcgagugcacacaggguauugaaacugaagaugaagcugggcuuuucucucuuggcuggucaaguauuauuugauuggagcuguuuaggaagcaauaggcaucucauuucugcgggcugaaccggaagagaauggaguuuaguuugugugggugacguguggauugggacuggaccucuaagccuguccgugcuccuuaaauaauuguugugugugauaccuguauaauaaaaaauauucucgauagaaucucugaaag

SEQ ID NO: 1308 - RNA, 1247 nt, Mus musculus
uggaggcugugggagggugguggaggauggcggggcauggagccuggccgccaugagcucagaggucugcaccuucccaccugacguuugauggugagcguucagcuuaacuaacaguuaaggcugcguaaaaaaaugguuucagccacugaaggaagcagagaauuacacaugugagcccugacccuuccuaacagaagccagagacggccagaggucugucugagcaggcuuuaacacgucuccucaacacagaguugcgugguaggagccuucugccuccgcccuguacgguuacccuggcugcagcgugcgguuacccuggcugcagcgugggaguuguucacccaggagugcugugaggggcggaggcuuucugagcacauucuuuuccccgcccccgcugcuucuugggaggggcuguuuucagcuugagaauucuuuccagucguucggaggugcgugcucccaugcccccacccccuccguguacaagugcuggucuuuguuugaccuguuuagggugucggugacagaaagaaugacagguggccccgggccuccauuccaacauguccuuugaguggucccuaaaauaauaccauuagcgggucgcauuaaggcugcuuaucucuggcggagccugcugauaaugccgagcgagcagguccuccuggaaugcuggggcccggauagagaagugccugagagccccugaugaacgggcaggccuuggcauccguugucccgaugacgaugacauuccaucggguuugacaccugcucccgcagcacuaaguuggcagagucagagugggcgcaccugguaugugacagacacuuugaaccauuuugcagucugccugcauggcuggggcugugaggucgagggacauccaggggcugccucauggugcagucgugguccagcugugcuggucaggggugcuuugcuucagcaucgccaucgcgcccacccgcagcgucuccuggccguggcuggcguucauucgguuuuucccagccgugauuaggaaauaaggaagggcguacgggaagaggagaggcaccgcccagaaagcggcucuucuugcuggacacugugaacauuugccagacuuacccgugggugucucucccaugucaacaaagcuuauccuucgucucuguaaccuauuccccugacgcacuguaucacagaguccccacgucauagagcaggcuagcuucaaacauaacagccuccu

SEQ ID NO: 1309 - RNA, 1136 nt, Mus musculus
gcacuuccuccuaaagucuaggcugacaucaggcuaagguguacugcccacagaagccuuaguucaaauccacccuccaucuuugggagcaucucccuagccaacagggagcaaguggggggcuucgaaagggaagagcaggucaguuugcauaugggaaacacucauuugucagggguuccucugggcuccucuaccagaugaaggccugccagaaagaggcucuccguggggaccuucuucccaccacagaagcacacguacacucgcggcgugagugcacacacacacacacacacacacacacacagagcaguuaucuccucaucaagugucuauuggguaaaugguaaucacucagaccuaaccuaaaaggccaaugggggggagguggaccaugagaggccaccccuuucuccccaggccccucucccaggucccuaccucccagaggccaccuuuucucauuccuaagaccccagagauaagauccccuccgaacuccuuccaccccauuaucucucagucaaacccugggggagggagggugcuucugcacuuccuuucccaaagguguccccaagaccucacccagcuguuuccuaagugacagaacaaacacgcaggacagacgccccuggagcauccaggucgccccagagaaggcuuugaggaugucuggggacaaccuuguggggaggaaguggcagccugggucuugguucuuccagcugugcacagugugagaguaaaaauggcuggcuccugccuuaguuuucccaucaaucaaaugggagacugggauccucccaagauugcuugaggaucugcgugucguccccccacccucacccccauggaaagggaccugccaggugcaugggguacagagaacauccuugguaaauguuaguugcuaucugguuaacagaaaacccaccaagaggaaaacccaccaagaagaagcuucugucaguucagaugaaucaaauuuuccacagugcuccacagugaacagaggagcaagaaagacagcccccaucaaacagccauggccugagaggaaaggaggaccccagccagcauuaauguucaucuaucccucaauccccugccagcucccccuugucccccag

SEQ ID NO: 1310 - RNA, 1136 nt, Mus musculus
cugggggacaagggggagcuggcaggggauugagggauagaugaacauuaaugcuggcugggguccuccuuuccucucaggccauggcuguuugaugggggcugucuuucuugcuccucuguucacuguggagcacuguggaaaauuugauucaucugaacugacagaagcuucuucuugguggguuuuccucuugguggguuuucuguuaaccagauagcaacuaacauuuaccaaggauguucucuguaccccaugcaccuggcaggucccuuuccaugggggugaggguggggggacgacacgcagauccucaagcaaucuugggaggaucccagucucccauuugauugaugggaaaacuaaggcaggagccagccauuuuuacucucacacugugcacagcuggaagaaccaagacccaggcugccacuuccuccccacaagguuguccccagacauccucaaagccuucucuggggcgaccuggaugcuccaggggcgucuguccugcguguuuguucugucacuuaggaaacagcugggugaggucuuggggacaccuuugggaaaggaagugcagaagcacccucccucccccaggguuugacugagagauaaugggguggaaggaguucggaggggaucuuaucucuggggucuuaggaaugagaaaagguggccucugggagguagggaccugggagaggggccuggggagaaagggguggccucucaugguccaccucccccccauuggccuuuuagguuaggucugagugauuaccauuuacccaauagacacuugaugaggagauaacugcucugugugugugugugugugugugugugugugcacucacgccgcgaguguacgugugcuucuguggugggaagaagguccccacggagagccucuuucuggcaggccuucaucugguagaggagcccagaggaaccccugacaaaugaguguuucccauaugcaaacugaccugcucuucccuuucgaagccccccacuugcucccuguuggcuagggagaugcucccaaagauggaggguggauuugaacuaaggcuucugugggcaguacaccuuagccugaugucagccuagacuuuaggaggaagugc

SEQ ID NO: 1311 - RNA, 15625 nt, Mus musculus
gggcagucccggaaguggcucguggcgcgugcgcggugcuucugugguaacggggcaguuuccaccggcuugaggcggacgacucggcggucuggggucucccggcugcgcccccucugccccgcgccagagcagguccguggcuucgggccccgccgcgugcguguuccucaggcggccgccgcgcucccuccgggaagcccgggcccgcgugaggagaccgagccccucucugcagccggaccccgugcgcuccgcuagguaggccgggccucuccgcgugcgcacaccgcccaggccacgggggugaggggacggugggggaccgcggcgugcgcggaugggaggggcacggccgagccggcgggcguggucggacgcuugggagcagcccgagcuaacccagucagccaggagaaaggccccugagagcuacgggagcuggagagauggcugcgcugccugccagagguccgaccgccucuucacccccgcugcagggcacccgguacgcccuugcucuucucacgugcgcauggugaucugaaacuaaguccucaaguaaauugcacgggagaggagcgugcggaucccagcacacacugggggucguuucguuuccuaacuccaggauggaggaguuaguuuuuccggugaaaaucaagacuaacucacgcuccggagaaacauagcccuggcugcgugucugugcaucccucucccuguacagacaggcuuguaguccucagccccgagaguugucucccgagccgucuucugagacgugaaugugcaccuuaugguggcucugacacaucguggcugucucgaaggcagcaggagucaaaugcgcucccacaguuccuugcaguuucccuuuccuuguuauuuuaaggaagcgacccucauuaggcuguggauugcucgggccuuagccucgcuuuuggagagguggcugacuugguggaagucuggguuuuaagaauuugcuuuuuaguaacagcuugaaauguggcaaaagcauaugggagucuggagucacagugcacagaugguuuccuuggcaacgacacaguugucaauuacauucaguguuagaccgugcaaauccuuuucuuuaaaugggcucuuuuguagaccaggcuguccucagauuucuguacagucagggauggccugcuccuccugacccugccucccaagugcagagaucaccugugccagcucaccugacuaacccuaaacuuucucugccuguuguguguauggccaugcaugcgugucacaguccacaucugggcagaggacaacuuuggaguucucgccugccuuucuguugguucugagggucgaacucggguuuccaggcuugcacaccaagugucuuuacuaccugagccaacucaccagccacagaggagccuggagaaugugcacuguuguuucaggacagccggaagaugaggcauggcgagggacgguagggcccgguagacugccacgcucaagaaagcagugcugacuaucgauggcuccaagucuacaccgucacaccagaccuucaguacucagugggccaaaguagauugcuuuggauuguucuuuucuuuuuugguguuuugagacggggucucuguguagcccuggcucucuugaaacucacucuguagacaagguuggccucaacucucagagauccgccugccucugccucgcaaaugcugggauuuaaaggcaugugccaccacugccuggcaugaacugcuuuucuuaaagcccugagaaauuguggaacaccugccagaacugguuguucuuucuagguaacaucauguagacauugaccuaaaauagagaggaagggggacccugggcacaggaggccccucugcccacugcugggugcccagugugcaguucugacucuggagagugauaccucuuuccuagcugcugacugaagcacuguaauaugucugcguuggugcccuagugcuagcaagggcauccucccuagacaguaaaguagauguggauguaggaaagucuuccuucauagcuuccagaggcuaacaaugcucuaaaaauaauagugugugugugugugugugugugugugcgcgcacagacacagccucugugugugugugugugugugcacagacacagccucuguguagcccugucuggccuggaauucaguauguagaccaggcugaccucauccucagaucuaccugccuuugcccaaguguucugauuauacuaugcugggcagagcggcuuuuuuucuucccccugaaacaggguuucucuguauagcccuggcucuccuggaacucacuuuguagaccaggcuggccucgaacucagaaaucugccugccucugagaacggcuccuuuuauuaggcauucugcuuguggaauauuuaaaucucuucuaaagagcaaggcuggcuuagcaccacagugcuaguuucuacuguguacuuuguaccuaagaggggccaguccuuaaugguuuccacuuuguguuuuccagccaacaugagucuguuuggaucaaccucuggauuugggacuggugggaccagcauguuugggagcacaaccacagauaaccacaauccaaugaagguaucaccuggacccccacagggcaugcagagagccagggagccucauguugggugaagagaaucgggugggggucucucucacaagaugaagcugaggaaccccggcacacauagcucguccucagcagagcugguguccugcccucacauguccucauuacaacugccaagccaccugagagagccggagcuucccagggccagcuugcugcauaaugugguguggcucucacaacagaccuggagaauguccuguugucugucuguaccgcaggaaagcuaggacugggguaggcguggggcagcuuggccagacagguggagcaggugggagccgccuugugcaaaugccgccuuggugccuuucuuuuagcacauggugaagccugcagcucuaguauuuuccuugaccuguguacugcuccuguguuugaucagaguaaggaaagguaagauccaguuaggucucaaggcagagaugagcucgagguucuggauagaaagagagguaccgccgggcggugguggcgcacgccuuuaaucccagcacucgggaggcagaggcagaggcaggcagauuucugaguucuaggccagccuggucuacagaguaaguuacaggacagcuagggcuacacagagaaacccugucucagaaaaccaaaaaaaauuaaaaaauaaaaauguaaaacaagagagggaugccuuaugguggugaugugugcauuuaacccuggccuucccuccccaggauaucgaagugacaucuucuccugaugacagcaucgguugucugucuuucagcccgccaacuuuaccaggcaacuuccuuauugcaggaucaugggcgaaugauguaagugcuucucaggcaacugccaugcuggcgagccugccugcccuucagcuccacucugucugggugaacugaggccaaggcuuaugcagugugugguccuuucaaagacacaguguagaaacugcauccuucugaauggcagcaccauagccgggcacugcccacagguccucguaccugacucaccugcacuuuaugcugcuuguuaagaacuuuucuuggcacccaggaacuguucuucagaugaaaccugaauuuguuagacuuuagcuaaugaggcagauucuucacagacuguucaucggccccugaacgguacacucacuggcugcagaaagggggguuuguaaaaucuagcaugggcacgcaugucagucaggaggcuccacacagcccagcagcccuagcccauucugcugcuuuugugauuggaauguaugcuacgcucauucccaugggauuagaagaauaagcgucugugaugggucauagugcgagggacaagccagagccuuccaguccugcuagcaggcaggcuaguuggagcagcuccucagaagucuuuccauuuaccuucauucugugacucugcauguaggacuuggggaaagcgccugauacugcccgucacauccucagagcgagacugcucauguccaugcugugggacaguggcuucacauggcugucugugaaacugggaugcagaucugccagcuaaucucagugcccccaaguccaggguuacagcuccagagcagagcacucaccuggggugugugaggcccuggguuccauccccaguaccacagaaagcccaggcuuaagguccacaguuagcuucugccugauccugcuguacaggaccagacucagcuacacagacagacccugauucucaccuggccugcgaagcgagcaugcagggaccggugaggaggaagcaugagagggaugagcaggccuggucucuccucacuugacugcuccuugguguugagugaaaccuagguuuggugccacacaccuguugucuacccccugucucagaaaaaaacauaagccagguuagaagcacggucagagcuggacagggugggccugcaggggaggcggccgcagcagcagcagaagcuggccgcgaguuccagugcugucucugguuuguuggcuguaagaugugugugcauugaaggaagacuggauguaucuggaacuuaacuaguucucccugguggaauuuauuuucuuguuauaguuacaaaaucugcaaaauucauuacuuuaacgggaaagugacaggggaugcauuccaggagagagguggguuuccucuugaggccugagugacugcugagugagcagcuuggcugcaguaugggugcgagcgaucccguuuggguuucagcugcuugcuuguacuuaguuugcucuugaaguagauaaucagauuuaugcaagaagucugaaguaaacuguucuaugcaugugcacaccagagacugggaaaugcccugaucucauuaaucuguccuauucuuacagguucgcugcugggaagugcaggacagugggcaaaccauuccaaaggcccagcagaugcacacggggccagugcuugacgucugcuggagugauguaugucuuguuuccucuuuuaagauaggauuuguauuacuuacagacaaacaaaaaauuguugcuaugucaaaacaccaagguuacuuauaaaagaaagaguucauugagcuuaugguuucagaggauuaggguccaugauggcagagcaaagucauggccacaggaacagcugagagcucacaucuugaccugcagguaggaagccauugggaaaccucaaacguaagagccuauggggcauucucacucagagcaccacagggucuuguagugcagcccugggugggacagaaauagaauucuaugacccucgacuuucugagcuccuaauaucucagcaaagaguuagucuucuguaacaaaaggcuuagggccagaagugucuuaguugccaaagcucuugaauuuaguaagcaguugcuugugguagcagcaccuuggagccugggauuuuggauuaaggauaugaacccugggcugggcagggguggugcgugccuuuaaugggaggcagaggcaggcggauuucugaguucaaggccagccuggucuacagagugaguuccaggauagccagggcuacacagagaaacccugucucgaaaaaccaaaaaaaaaaaaaaaaaagaaaagaaagaaagagaaaaaggguuaugagucugcacuucuaguuguucauguaagguuuguuuucuucccuuucccucuuguggcuuaguggaaggcuuuucccuuucuggaccugugcucuagauaagagcucugugacaggaguggccacccuggcuuucuaagacuguuuuuuuguugguggugguggugguuuuuuuuuuuuuuuuugagacugggccuuuuguuuguuuguaggcuagaauggccuugaacucugagauucaacugcuacgaaaccaccacccaacuuguuuuguuuuuuaaguaauguguguuaugauuuaaauauaaagugaccacagguucuuaguuuuauuuuuauagguguugugucuccccccccccuccaccccccauauauguuuuuuguguuguuuuugaaggguguggaacuuuucagacauggcgcuuagaaaacugagcuauagaggccaaacuagauaauucuuggauacaaugcccugaaaugugacaggugagggucaugugaucagucaggcaggcuaggcagugacuaguacccacuuagugucucgccagccacauuugguuuucauuugcuagcuuucaaagccacucaaauucuuagagaaucuguuucuuuuuguuugguugguuuuuguuuuuuuaacacaugauuccucuguagcccugguuguccaggaauucacucuguagaccaggcuggccucaauucagagagacccaucugucucucugccuucuaagugcugggauuaaaaucaugcacuacaccaccccuugagagccuguuucucugugagcucugaguggucacuuccagcuguaagugugugcugccuaggagacuaguuugcagugugcugguccuuaaaugguaggacaccacaaugcagagaagaugcuuugcccaacuucucgggcguggagacuuauuacuuuugcucagcagacugucccuuuuaauuuaggaugggagcaaaguauucacagcaucgugugacaagacagccaagaugugggaccugaacagcaaccaggccauucagauagcacaggugagaagccuuugugggugggcuuacuagacagcauagaaagacuuuucagaguggucauagcguguuuuguaagcuccuacauuugugcuaguauuucucagagcacuuugccacaaaucucccaugugcaugugaugggaguagugacaucaagaucuguagacaaggggacauaguucuugauacuuaaagcaccugugugugauuugccucugucaguuacacguguucacuuaucauucagcaaguguuggucgagugucugccaugugcagacaccaugggguuaggacaccacauacccauggagccuuuaucacuugucuuaguuaggguucuguugugaaagauacuaugaccgugaaaacucuuacaaaggaagacauuuaauuggagcaggcuuacacuucagaggguuagugcaucauucuuauggcaggaagcauggcaguauacaggcagauguggugcuggagagguagcugagagagaggucuacaucuggacccacagacagcaagaagagaaagugccuggcuugagcauuugaaaccugaacgccuccccuccccccagugacacacuuccuccagcaaagccacacccacucccugugagcccacugaggccauuuucauucaaaccaccacaucaccugaggggcagaagguugggucucagugaagaccacugagaguaguggguguaagugucacagaggccaccuuaggugagggguggggaaggcuccugaggcuguuucacagcagcaccuguacugcaggcaucccccagucucagauggaugcacccuagugacaaauggcuuucccuccacuguucccaaugguucccuggggaugcccuggucaucaccacugauuagugagguugagccuagaucagagcagcacauggggcaaguccuugggcuauguccuggggucuugggaacacaacagugccguuugguuuuguuaguguugaauguaacccagugucugaguaagucaguucuuuuggauuuccagaacuagaguuguugugcuaauuguugaacugucccccugauuuuugucuuguggaaagcaugaugcuccuguuaagaccauacauuggaucaaagccccaaacuacagcugugugaugaccgggagcugggauaagacucugaagguaugcaugcacuugagggguugugcacucuugaagaugggauugcuggguccacgcaggcuucagcccucucacugcuacuccacuuugcuugcaguucugggauacgcgguccucaaauccuaugauggucuugcaacucccugaacgcuguuacugugcagaugugguaaggaaucucacuuccuuuucaacagccaaguaaacauggcucuaugugguaccuugcaguuuguagguauucuaaauccuucaacuugaacagacuguucauacgugacauuugggacugcauguccuaagagugccgagugauaaguuuggggcguuuuccuuuguugucuuugggucuggagaugaaacugcugggcuauugauugagcaugugugcuagccacuugucgauagucccucguggggagacagcgugguguaaugguacaggaaugucagcaggagagaucauguggguaugggugucccuaucccugaucucugggacugccucugagugguuuggaaacugaagugcuuucucagugucuugauugagucuuaaggguuuguagcaacugcccuaguaauuccacagugaggagauccaccuugagaaaagugcauggugggggcugacacucacugcauguuggaacauaccugaccaagcaugacugcccauccuguagccccaggucggaaggcagaggcaaggacagucucugugaguucuaagcuagccuggucuacaguaggaauuccaggcuugcaagagccacaagguaagauccugucuuaacaaaggaaggaaugaaagagacaggaggugucaagacaggaggaaaucacuaagaucauaugacgggguggaggugaccauccauucucacuggugacucguguacuuucugaauguccauacuuuauaguuuaaaaacuguaaagcacauagugacaaaagccuggaacuuaggaugcaccaguaagagaauccagguucaggaugagaucacacuaagcugugcagaaaagaaucccuagcaccagcauaaagcauguuaaguacguggugcucugcuuacaggcggggcuucucuaggcuuucacaaacacuuugauauugcuaaauuauaacauuaaaauuuugugacuaaaauguugacuggucauuuuggugugagagcccugucuuuaccucaagugccugucuuccuucucuucucuagauauacccgauggcugugguagccacugcagagaggggccugauugucuaucagcuggagaaccagcccucugaguucaggagaaucgagucuccccugaagcaccaggugggugccacagcucugagaagcgcacggugagcgccugccaugugcaggguggugcucguguaggggggcacagguacguguucucucucuugaaaagcuugcugcuacguucagaggagguacauuuaaggaagcaaacauaguuugacauaagcaugacugagccgggcuucccuggcccccaaacaucccccgaguagcuuagugcugcuguguucucucugcccagcugggcgggcugcgucuguucuccagcucaguccuacccggggccacaggacugaguccuuccugccucccugaucuaagucuccuccuagcacacaucucagcaaaugggaucaguccuguuagaacagaggacgaagguucaaccauccgugccuucuuucugccgcagcuucuccugcuagaugcuggccaggucuuuggaggcugguuccauggugagcccucuugcccugcagccuuugcaggaaccugacauaguucaucaccaagcauacgccuuuaaucccagcacugaggaggcagagccaggcggcuuucugaguucgaggccagccuggucuacaaagugaguuccaggucagccagggcuacacagagaaacccugucucgaaaaaccaaaaccaaacaaacaaaaaaacccaagaguucucuaacccuucacucaggugugcuuagucuaguugauccugggaaacagaccaaccuggccccuucagaacugccuacaauccuuuucccucugggucaguuuucccacaccucccacucuucuguucuuuguccccagucacugauagcacucaguguaaguccuacagcaucaccaggaauucuccagaguaccuugcucugaguggucaucaucucuggccaggcucccuuugcccuucagacuagaggucacgcuugagucaccucucucacuuaccgccccccaggcuuccccauuccuuucucugucuaccugccacucccagucccaagucuucuuggaguuagaaaaaaacuuccugccauucgaccuugcagugcuaucuugcauaugacaccagaaaacauaggcaagaaauaaacacuaacccagcaggaccacaccagaccaguccucacaggaaggagcagccagcaguaaaaaccuacaggaaacaggccuguaggugguaacaugucaccuuuuaaagggauaaagaacuuuuagcaaaacuaaugacccaguuaaaauccccaaagguaacaaccuggccagcuaccaguaugugaaggcaguguuucuuuuuaucccaggaaagcucggagacagcaucucacacauuguuuucagaaacucagaacauagggugggcgggcucuaaagaauggcuccaugguugagagcacgugaugcaugguaacaaagaccuaaguucagaucccugacguggugacaaggugggccugguucagugcacuccugcaaccucggugcgugggaguuggagacagguguaucccugggugacugccuugagaaaauacacacaaagugacaggggacacuugaccccuccucugguuccuauguauuugcucacaugccugcacauucauaccacaccauucacaugugugaacacacaagagauacaaauaagaaaaaaagaaagauagcagguguuggcgagaggcgaagcuccugcaccucggaaguggcccagcguaccuaagguucugacggucggguagaacuaccgccaggccagcaguucugagaaugaaauggcuucucauugcacaguggaugaacuugggagucugguguacuaagugcagugagccagggcaggaagacacagugugguuggauccuuauacaugauagccagaauacugucuuaggguuuuacugcggugcacagacaccaugaccaaggcaacucuuacaaggacaacauuuaacuggggcuggcuuacagguucauuaucaucaagguaggaacauggcagcauccaggcaggcauggugcacaaggaacugaggguucuacaucuuguucugaaggcaaacaaaagacuaacuuccagguagcuaggagaagcguauucaagccuaugcccacagugacacaccuacuccaacaaggcaagggcacaccucuaaauaaugccacucccaggccaagcauauauaagccgucacacuggccuugcuauguguaguuuaucccacauucccugugagcgagcuggcuguuacaccguuuccaggccagggaaacaggacagacacugggugucugaucuguagguagcugcugauccaaggggcuaagcugagcggggcagcugcguuuguacacgcgugacucugggguccggggcuguaaaagguuggagaguagcauuugcugggaacagaaacgccuucauuucugagucaugguuuaguucuucuaaagccuaagaguaaauaaggugacacugauguucauguuaacugcugauggucccuccuuuauuuuaaccguagcaucgguguguggcuauuuuuaaagacaaacagaacaagccgacuggguuugcucugggcagcauugaggggagaguugccauucacuacaucaacccuccaaauccguaagugacucggggccugggaugcuccuuccaacugguucugaaagcaaacugagacgccuuugcuuuucagggccaaagauaacuucaccuucaaaugccaucgauccaacgguaccaacacuucggcuccucaagacaucuaugcaguacguucuagcagcacuucauccuaaagggaaacccccagaaccagacuuggagcuggcucuccaagugcacuggaaccaggagucaugggagagccugugucugugugcucggacugcgagguugccgcgugucuguggguguccauagacacuuuccacacagagugauagucugcuaaaagaaaugcacacuuuucccugagguugcugcuuauguguguuccucggggagcuccugagcuuggguuaggucuaagcugcugcaccucagacagcaugccuggggagugaaaugugccuggguguuuguuuuccuuucuuagugggaaccuguuucugccucucacuguccauguucaccuucacaggugaaugggauugccuuccauccuguccaugguacccuugccacugugggcuccgaugguagguucagcuucugggacaaagaugccaggaccaaacuaaagacuucggaacaguuagaucagcccaucgcagcuugcugcuucaaucacaauggaaacauauuugccuaugcuuccagcuacgacugguccaaggugaguacuuucaagccaguucuggucucccucucagacucuggagccaaaagucugaguuugaguugucccuauggacaugugugcccuuagccaggcuguugccaccucccugugggcagggaccugacucuuggugugggguuuacccuugcaugggggaaggagggugcuaugucagggagagccaucaugagcuccucccuguucuuggacacaacacaugaacauggauggaggaggucugggccaccaagguacuggaggcagugcagacagagugggccugggguuguaacucgaaccucccuggggaauguguccuggagaagcagcuccacuucauucgugguuuucacuuccuuuucccacccagccuugcuccccauauggcuucuccauccgccucaaccuuugcugcccucuccuaccccacguuucucacuccauuccccuacacuguuuucucacugccaucggcagaguauacaugcccgccugcucagccccaucucagcuucgccuucccgugugcacaugcguacucacuguugccuggccggagugcugagaugcacccggucuccucccugucugcuucccaccacugcuuaaagcgucggucagaggccacuuacaccacugcuugccagucguugucuuccaguuaaggggagacugggcuucuuuagcuguuucuguccugaggugccaguccuggugcacagcugcugccuacucauucccagccaucccacuccuggugccaacuucuguauauacagucaggguucucuauagagucacagaacuaauggguagucucuguguaguaagggaauuuguugaugacuuaaacaucuguaguccaacucaccaaacaguggucagcagcagcugugaauggaaguucaaggaucuagcaguugcucggucccacaaggcaagcaggugaagacgagagcaaaucuuccuacuuucaauguccuuaaguaggucuccaguaaaagguguggcccagauuaaaggugugugccaccaccucuggaucugggacuugcuuugucccagaugacuagaagcucucccugccuuagucuuaggggauucauagccacugugccucaagaucuccaugccaagauccaugucagaaacuuguaucuccuggccuccagauuaggaucacaggugagucuuccaguucugaauuguaguucauuccagauauagccaagucgacaaccaggaauacagcuggaauagcacccucguggcaacuaauaacuguagcuccaguuguagggucugaugcccucuucuccgccuccccccauggaguucacaggcacauaaacagcuguaaacaccugcacuuuucugggaguguuggcugagacugagguggacggaucacaaagccaagacuccccucaaacuugaagugccuguauguauagcucaguagccgagugcuugccuggcauugugacaaggcccuugguucaguccccagcaccaccaaagacaaauguuuaggggggaaaaauuccugcauccucccuggagccacguagcacuuaugcucuugugugcugcccaaagccagaagucaaacagcugagcacaccuuuaaucccagcgcuggggaagcagaagcagguguauucuacugcguucaagaccagccuggucuucauagugggacccugucucaaaaaaccaaaacugaaaaaccaguugaaguuguaauuuguugaagcuugugggcucacaguguuguguggauaaguagaaacaggcucaggaauccucugaucggaacaggagcaucugucuccagugugcagccuggacauagccauucccuaaagcuggacuucacauccugugauaagcuaccauugaccacugacacacucuagagcuuuguaaugcugcuggggugagacuaaaaauagcaagagugugcuucagcugugucacuucuccuggccacaccuucccaagucucaccucaccugcucaggauggugcugcguuccuccucacucugggauccuaauggaaggggggcccagcauucagagccugggcaggcuggcugugucucuuggccccgcccacugaugcccacagccgcugcucuucugggagcuguuccuucuguggacuagguccuuccccugaagcagcauggaugaguucagcccuuugugaaaccucuggucagggcugaugcuaauccugagacccucagcuguugccuuggcagugaagucauugacggaauaccacaggcgccuccgaggguagaggcucugauaacacagaacuguuaacuucccuccauucuuacucugccuucucagcgguggcuccaguucucagagcaggacuugguguguguguggcuauugcuuuuaauacuaaggucauuucuuuguuuuuccuucuuuagggacaugaguuuuauaauccccaaaagaaaaauuacauuuucuugcguaaugcagcugaagagcuaaagccaaggaauaagaaauaguggccugaagcugggacuguuggaguuucaucuccucucugcccaaacuugggcucaagcccucgguggcccacagcccuggccauggguguccacuccuggagggacuguucuuguugagcaucagcacagcauccuggcgacuugccgucucuccauucagcucccugcugcgguuuuccugaaacugagauucucaacuggagucagaucuugggggcacuguguccagcaguguguauuugacaguguugggugggaacuguuggugagcccuguguuguguuuuauaauaaaauauuuugaagauggccugccccuucaucccuuuccccaacuccucaggaaauagccaucaaucucagaauaau

SEQ ID NO: 1312 - RNA, 1157 nt, Mus musculus
ugggagacacuccuggcuacagagacagcgucacccuguucccaggcuucucaugugcagagugaagaugaacacagcucuuuaugcggcaaaguuugcuuaggaugcagggggagguaggugucguguuaguagucaucgauugcuguguaacaaaacagccucaaacucaaaagccucacucaucacugguugggagaucugggagugucuuaucucuccuucucacuguccuaauagucucugccucugccccgagaggaguauccacacacaccacacacacacacacacacacacacacacacgcccaaaggcagugccauuugugucguaauggugugucacaggcagcaucccagccgacaaugaaagcaugcccucuggccuacuguugggcaacgacagacuuggauacagguuccuuucuagaaccacccugaaccucaaggucuggggggccucucuugcagccagaggcaggagcugggccgagugugguagacuuucaagaugguuuccuauuuaaaagcugguugaagacuguccccaaccaccugcuuaucugaggucugcagccugcaggggucuugaccugucaugggcuuccuggccucccauuccagccccucaagagcauuccuggcacugccuuccaaacaaccugcucacucccaaauucucaucugcaggcacugcuucugggccgauccagagagcucuagaugccagacacaggagccagaaggcuuuguugaugggguuggugacacaccuugcgguguaugcacauguagacacucagcaccuggugcccacacgaugcccucuucaagcaucuagcaaauacucuccaggugagugagauuccacuucccaccaguuucucaguucccaaagguuuguggcacagagguaucugagaugcaggaaguguuucugagggauaaacugaggucauuucaggauuauaucuacguggugugaagaaagaccuuuaucuuccacguugcccccacccacaccacaagaucaccagccacugcaggagcuccccucccccaccagcugacuggcuggcccccacccgggcccaucugcucugcauguguaagcauugucaaauuguuugaauaaauugucacucugauuaaaau

SEQ ID NO: 1313 - RNA, 585 nt, Mus musculus
auuuugggccgccgcagccaucuuccaguaacucgccaaaaugaugaacacaaagggaaagaggagaggcaccuggguauauguucucuaggccuuuuaggaaacauggcguuguuccuuuggccacauacaugugaaucuacaagaagggugauauuguagacaucaagggaaugggcacuguucaaaaaggaaugccccauaagugcuaccacggcaaaaccggaagagucuacaaugcaugccgugggcaucauugucaacaagcagguuaagggcaaaauucuggccaagaggaucaaugugcggauugagcacaucaagcacucaaauagcagagauagcuuccugaagcggugaaggagaacgaccagaagaaaaaggaagccaaagagaagggcaccugggugcagcugaagcgccagccugcaccacccagagaagcacacuuugugagaacuaauggaaaagagccugagcuguuggagcccauuccauacgaauucauggccuaauguacacaaagaaauaaaauaccagcaccaggaaaaaaaaaaaaaaaagaagaaacaaaaauuuugcucc

SEQ ID NO: 1314 - RNA, 14778 nt, Mus musculus
aucuuucuucgugaauuuauuaggcagauacugugucacacuugggagaggcugggugugaguaacucaaaacugggugccugacacccuccccccccagcucagucuuacaggggugguucaccaaaaugccuucuagacuggacacagcaguuuaugccagaaaugcuggagucuaaggcauaaggauuccaaguuuuaaggccaguauggauaauucagugagaucuugucucaaaaauaaauaaauaaauaaauaaaaaaggggggcugccaugaagaccgguguggaucugacugauguccaucccacuccuguaggaaagaaaagauaagugaaaggaaagcaaacaaccacaucaaggaaggucuggugcuaggaagcaaguuucccagccaaggauacagaagaguagggagauacuacacaaggugguacaagcccagggaagcagggcacuauuagccuagagcagacaggguggggucaggucucugguaccccaugagcacuaacuggggggcaggacuagucuagcagaggcugccacugggaucaagccaaagacagcaagcauucucuagagccccaagggacuacuuaccaugcgacgcucugcggacaccuucaggagagccuccacccaacccucugaagcgagcacaacaggauugagggggggcccuccagaaaggcccucuugucaccuuccacauaggcuguucugugugcacacagauggagauccccucuuaggggcccugccucugucuccccaaccccaagacccuaggagggucucuuucuguagucucgaaugcccacuaaccuggaucuuggcccgcucacccgcuucccagcuacgugcgcucagaagccacugcaucgacaaugggaagguggcagucuuaguaguaggcucagggcauuaugacaagaccucaaaguucuccauggcuuuuagaaacaucuaucucugacuccaccagcuaccuugaugggugggggaacuuagaggaugaguuccgugugucaaccagcaacauucuccuggagaucggaaggaagcuguuggcccacuccuaagcugagagaaggcuaguuccucccagucauaaaacucaagggaagaacagcccuccucugccaaaggccugggccucuuaugccucuuggugucucuuucaagcacggcaggaacgucccagccuaccucaaauagcuguggugcucaggaagcagucaauugggcaggagcuaguuaguggggguccagagacacucaucucauggccagaucugucuaugaccacuccauccaauggacucacucacuugcauguaguagcacaaagagggccaugguguggcaaguauccuguacaguaaacccucuuguucuaucaaggugccauuaugaaccaaucaaaccauuucuaagcagcccuguagauucccacgcuccaagaaggauccaccuugcugggccucugcuccagcaagacccaccucccaacucaaaugccccaccccaugggugcugacugggucucugugaggugaaaaaucaauccauaccugaggaggaagaacccccaaguucuccuacuuagcaaaccuuuuccucaggacugaauguugugcucacagcagaagcagcugaagaagugcaggcuccaauccuugaggcuccccaucacacaaggcuucaaaggcaggacugugcugagagcucagaggugcuuagaacagagagaugggguagggaauguuaagacauaaacaaaacagacacacagccgcuaaggucauaguuuuaagcucuucaacuuaaugguucuguccuaguagccaaacagccaucagaagacauauuuaugggcaaucuuuuggcuacugucugaccaugugagacacaagagccauguuuuugaaaacacagguccuuuucuaaugaaugcaggucguuaacgaaauaggcuuggaagucaucuucuaaggccuuuguccaugacccuagacaaaucaucuucccagaguucacuuguacggggcccucagccagggcaagcacugaggacaagaaaucaagucuagagacuucagaaaaggcuuccuuucucuuuucugaaacucuuugguugagcagagaagagagacggagcagagccaucaugcucccacgggugcaguagagcaacagugggaggcagaagcaaacagaagaacagugaggcccaucacagaaagacacaucugauggacacccacccacccuugaucccaaccaucaacauggacaaccaacccaggcacccauagguaacaaggcugggacagcuggggauggugucaggcccaagagcugcucagcacagaagggucacaggaauccugcgcuaaguggcucucagaaaaggggugcaucaccaccaagcugugaggggcugagguacuuuguacucccucugaaguccuccccccagaggaagagcacaguuuuagugugagcccuuugcggaguccucuccccucugugcaguuguucccaauacaucugacuuggcggcuagagauguggcuccaaguguuggccauauaagccccuuucccaucacucagaaaacagagaaaugccaggagguacacguagcucuccaggcugccaagaaggugagcuggugacuuuagaggugcugcgagagaagcuacuguaagcgggccccaucaucuucaaggacacucuagaguuguuccuucaaaacuguguagcacucaguccagcucucagcugcaaggagagaggaugcucuguaucuucacuugggguggaugucugucuuaucuguccagcagacuacaaagacccaucccuagcuacaggcugaguugcaaaagagcugaagaucccacaaguacgagggagggugccucuugcuuacacugucagaggccccagagaaagccucucugacuugaccguuucggugaacauugccccaaauccucauucgaggguagcucagaccuccaucagccccagucaccccucagcuucugcucacaugaagaaccacuugacuccugaguguaccagagccccugcaagggcagcuaggagccacgagccacuccuccaaguagacaccucacauguggcccucagugcuuguuaagugugcuccuaugugccuuccuauagcucccagccagcucaucccaaaccuaugcccucagccccagcggcuaucucccucacagcucugcugcaccgaggucucugauggccuaaacucagcucagccuaaguaucaucuuggacccccuucaaaaggcuuuucagugcccgccaggguuggaaaauaggcucuggacaccagcuacccccucagucagaagcgggcuugacuccuacuccucagcgagguggcccucggcaaguugggagcucggcugcagcuaggcuucucucuaguugccaugaaguugaagugaauuaaaugaacacguagucccccaaggccuaggccucugcgcugcagacucuacaaacaggucaauaagaaugaggccuucugaauuacuaaggcugagcuuggagcaauaagcaacucacacagcgacauagugacacagugccauccugaagcccacaggacuuaggccuugggagauagggaucaaccaagucucacuguuuccaagaaaaauaccuuuucccaagaagcaagacugagccggggagaaggaaauggagggaacccaggagacauaggguagagaugaacacaggagccuccuucccugucugcucauaugcugagagaggcaagcugcagauaccaggaccuucuuggugacuucuauccucucuaugccaggcuaggcccuacucaguuggggugaagggaggcccagggacagacagcuuagauguuuuguugccauggcaauugccuaacucugugguacaagccacagguuacuaaggggccacaaggagggaaccaggcaacugugcuggauuaucaagccuaucccaagccccaauggaaguucauuguuuauccccuggucuucucuuuugcagacccagcuuauguucaugaacaagucucagccuccuagaccaaugucauagcaaagucaaagaucacgugcccaacaacucagcuuugacggcccguguuccugggacaagaacagcugcacuacuucagaaaaggcaaagggcaaaugccuacaaaagccagcucccucuucaguugagugacaagguuggcugguagcaggcaccaaagcugaacaacagggggcggccgccccuugcccacagccaucugcggacacguggauggcagauucagaggaccagaggcuccuuuauguuauaaauuaaguaucugauuauuguaguaaaaucgaauauccaaacaucaaugaauaagcuauuauuauucagacagaaagaauggggggaaaugcauggcuaaaguaucauuuaucuagacagaacuaggaccagaggguguuuucuaguucugaucuuacaaugguggguguucaaauuugcucguucuuucugaggucuaggucuuggucuguguuacuuuggaccuauucagcuucuugccuagagcccuaaggaaaaaugcaagaagcccuaggaacaccuugacacucauuucucuuugauaccagaauagguccuggcccacaggccuucucccuauccaguuccugugagagucgguuuaccugggucuuccugcucuagacuguccuugaagcuuccucagcccugccugcacuuggccccagcuccuacuccucaucugucccugucuccggguuauucguuguucucauggcuccucuucucagaccgggcauuguucagucccuaauucugaccauaucuagucauagcgaaugcauccuccaagcccccucccuccacccugcugccaacugagcaaccauuuggccugugacauuuaaagccacacaggagccaaugcucgcaguugucgggcuacugcugccuuccuuggcuccacaugccuggcccccagcacacuugcuuguugacugacagcucaggccagucaaaccccuuuccagucaggcuuucuuaauuuggcuccuucaccucacggauggcccacacaagcccauuccugccccuauaaggagaagccaggcaggggacugggggcguuuugagcggcaggacaagguguaggccaucugugugccugugauaugggagcacaugccuagagcauggugugauguccgccacagcuguccucuucuccuuggcuuccaaccccaguagaccccauggcccugcuauuaauauaauacaaagaggccuagcaacuggcuaggacaaaaucuuuccacacagauagcgacaacugucauuagguggacuccaaguguccccaccacacauucuucccaaaagggcagagcuggaugugccuggugccugcuacugaacauacauugacuuggccuuggaaaaaacagagacugccaaagaccaaucuggaggcuguccaagggguagcuacagggagcucuuaaggcuuuuaucugcacuugaggcccaaggcaguucccauccugggagauggcaccucacaaggaacauggggcggcugcucaaaugcucccuacuuucucucuaggggacagagaagguggguucugcuuuuuuuuuuuuuuuuuuccgagacaggguuucucugugcagcccuggcuguccuggaacucacucuguagaccaggcuggccucgaacucagaaauccaccugccucugccucccaagugcugggauuaaaggugugcgccaccgccgccuggcugaggguggcuucuacuuauccaaagaaccaaaagaccauuaacuggaggauaaggaaagucacuguugucccagacuaccaagggagcuucgugcuuucuauaccuugaaaggcuccaggggagaugcacagccaucaccugggcuugcuagccucaccuguacuugguauacuuaaaaaccgccuuaauaggcguaagaauguguacaugaaaauaggauucuggaaauauuuugaaagacucauguaaaggcucuggcuggaagcagggccuuuccuggcccaaggaaucuaggaagcagcucccugaagccaaaggccacaggucaagcauuuuaugauaaaggcugcuuccucugcaaaguaaacguguccaaagaugguaaaugucacagccaagucccucaagacaaugucuucuuccauguauuauuaggaggcaaaugucaaggaaagaaaauaggcccaagccauuuauccugguugcaauucaacuuauuagaacuagaauccgucuccucuuccccagagcguuaacauccccgcugggcgucaggaggcggcuggcagggggacaggaucgaugucugcucugcuguugagaacuugagcuccauuuccaaaacccacaacuguccugugaccucuguacaugugugcccccacccccacuaccaccacgcauaagucaauuaaaaaaaaaucagucuggguaugguggcauaaaucuuuaauccagcacuggguagguagaggagggcagaucucugaguucaaggccagccuggucuacaaagugagcaugugauagccggggcuacagagugaaacccugucuaggagaaagcaaagggguuauggaacaggcagcuuacucuguuaaaugcacugagagcaauacgacaauagucgucuguaaugaccaccacuacucuacuuacacugugacuaacucaacaaugccaggggagaggcagcagguggggcuggggacaaggaccuugacuucuaaacuugagcgcauucuuuaaauuguggccauuccuagcuucaaaugucuagauccaggauuagaagagggggggucucuuuugggcuuuggugcuauuaaaggaggggugagugccugugauccgagugagcucuuuaggagucaccaccaagguuggcaaauggccuuguacaaguccggucaccccccagacuaaagaaaaugaacccacaaccuagagcuccccguuccuucccuagaccccaccacuacccacuccuccaaguccuuccucacuuuccauucacagcaaagcucagaaauacuguuugcugacauuaaccuaccucucugaugggcaaagagugauuaagccaaggucacgcccuagccccacaagcaaggaaaacaaucccagcccucucccacgcagagacucugagcacaaagugacuuaagccuuagcucuaugugguuuuugugaaguuauuagauaguacauaucauuuagacaaccacauauacccaguggagcuucuagucugccauggguucauggagcagacaucuugagacacagcaggcucgccuuuuuguaccuccacugucuggugcgagguuuaaguaaucaugggagcuuuaggagauggauagacuuuugaauaaccagcagaaaaaguacaccaccgaacuacaucagcuuuugccuuggccaaguccuucuggccuuguguagacuuggccaggcuugacuacuggggcauaguauaguucuauuucuagccuccaaggcacuucuaaguuccugccuuuucaaaaaggagccaguggaaugucagcacugaagugaucaagaaaagaauguggaacugucaaguguccauuugguuguagaaagaaauagaucugaugucaagagggcuggcaucugagugcugggccacucuuccuguggugcauuaaaaucugagagagaguucagacuaugcaaacugagcucacgugcuggcuuuccuagacucuaagacccucccucccuucccucucccagccuguguccuuacuuguaaacugaggguggcuaaggcugggucucucuggucucuucuaguucuagaacuugcaagaccaacaagccagaaguaauguggagcacgcaaagguggguuccuuggcaccggcuuuccuacuucucuccaucaagggccagacugaaacucugcagcaucugaugccuuuuccuguggggcccaagacuacuucgaaccccacagguuagugcagaaggaugcucagcaugugggaacuuggagugcuaucacacaaccagcuguguucccuauuucucucacucaaugaaggauacacagauccaucccaacauggguguugggauguuguccucaagcuuuguggcuggcuucugcauuagucacugaagcucucuuaccaccucccaucucauauauuucuguagucaccaccaacucugguuuucccauuuaucucuuaaaccugguaccagauaagagcuuugaaacaaacuugauuaggcaccuccuggucccaggguaagggcuuccuaccacucaacaacacucccagacucaucccgcugucccacaauccugcugacugccuguaccaccccugccaccacaggaucagccuucagccucagcucaagugcacaggacacauucccaggaaggcaucuccugguauauccaaguaucgguuagcucccugugcugugugcccuagaaauaaaccacugcuccuuuggaggcucuguagcaccuuggcaugcauaagccacucugcagcaugaugccccgacaagaagaguagggaggcaggcucuacaacagacgaccaccauccaaccucacucuggguucucucuauuccauggccuaucuugucucaaaaacaagcaaacccacugaaaggaaauuagaguuguauuucacacagacacaaugcagcuuggcugggucugaccguuggggcucuuucuacccaagaugauuaaguccccuucccuucccaccaccucggccaugggcuuaacaccuuuauaggcauuaccgcccccguucccagcaucaaugcuaacaccaaccaccuaacacgcagaaagcagugacuggagagaaaaagcucuuuaaaaagcaagucaaacaagacugcuccucucuuguguaauuucagaaaacacagugagucauaaauuaagggugaaguaauuagaaaaaacucagaagaauaaaagcagaagccuaacuagauggcauccaacugacuagagcagccgcucucaaccuuaacuuugcaacccuuuuacacaguuccucaugcugugcuuauccaagucauaacauuauuuucauugcuccuuuauaacuaucacucugcuguuaugaaucauaauguaaauaucuacauucuuuccgauggucuugugugacccuaaaagggcccuuugacccuaacaggaucgcauacaauccacaaguugacaaccgacugcuggaugagaacaaaccagaagaaugacaugaaaacaauuuuacaguaaaagacgcucaggccuaccaaaggcugaacucuacccaagagcacacugagcugagagguccuacccugagauuuuaugaugauaaaauuucaaaagaaaucuaugguguuaagcaaaacaaaaauuaccuaaaaaaaaaaaaaaaaaaagccuauugcaagggcugauuuguuuuguuuuggaagcaacucgaagagaccauuucucuggucuccuugggucuguugcuggagcacaugaugugucagguuugugacuguccuguccugugcugacaguguugguucucaggguuuccccugggcuaaggucuucuguguggaaccaugucaucugcuaagaaugcuuccacuuccuccucuccaugagccaugcuugugcuugcuucucugcucucguugcucuuggccuagaccauaauggagguucugauuuguccccacguaguagaaugcuggcugcagaucugucaucuauggccuuuguuacacuacacacagcugcuucuggcugguucaaggaguuuauuacaaagggauguugagaguuuaugaaauggccuugggaguucauuucugugaugucacacacuuaaaauacucugugcaugucuuuaauuaccccuacuucccugaagugaagucuaugaaauugugauaucuuuuuuuuuaaaauaugguuuuaaaguuuuaaaaguauacuuggguauuacauguggggugugccugugccauggcucauggaggaaggaccacagaacaaguuguaggauucagcucuccccuuccaguauacauggguggguggcuaggucuucaggcuuggcagcaggcuuacccacuaagccaucccacuggccccucugaguauuuuguuaggcauuuuuauuccuguguaaaauuggucuauaauuuguguguguuccuguggccaacuugguaugugaagaauacugguuucuuaaaagggagcuugguaauguuccugccuacccuguuccauggaggaaugcgguaaguccuggugcuugguucuuguguuaggucuggucauaugcacagugaaucuaucuaagccuaauuguuucugagucaggagauuauuauuaccgcaccaacaucaccacucgcuauagauuuguuuaaauuauuuaccucaucuggguuugacguuggucagucacaugcaauacaaauucaaaauuuuguauucaaaaagaaaauuucaaaccacuuucuuuguauuuccuaguuuaguggacucuauuugcuuccggaauuauguguuugccgccuuugucacuucugcugucacaggaugcacacaauuagauguaaugucaccuuccuggcuaauuacuagccugcucuuuauccuuuucuuuggguuaguuugguuaaaagccaaucuuacucaucuuuggguuaauuugguuaaaagccugccaaucuuacucaucuuuucaacgauccagcucuuucuuccauugauucuuuguuuuuuuuuuuuuccccucgauguuggcuucugcccugagacaccugucugcagguuacucagcuugguucaacuguucgucuucagugagcuguuuguucagaauuucguggggcuuuaaaaaacauuuugugugucuguacacacacauacacaccuaccgauggaaaucauaggacaacuugaggaaggucagucagcucuuuugaccacauggguccuggagacugaauuagucugaugccugccgaccuuuuccuuaaggaagcacucagaucuauaaaugcucuggaaaccucuucauuaugagccagugacuauguuuguuguauuuauuuccacuugcuucuugggguuucuugauuuccucuuuugccccucacucaccugucuaucacaagaaauucauucauuuuccuauauuuguuaaggcuugucuugugucuuaauaucagcucucuuuuaaauuauuuggggaguaguagaauucaguuugauuaaaaacaaaauuucccacuuaauuuaaaauaucuaaaaacuuaccauauaaaacuucuaauaaucaucuucuguccuucuagaaaacaaaauaggauaaaaaccuaaaagguaggaaagaggcuuagguagccucaguaaagguuagucccucccuaaauuagucuuggcacgaaaacucaaagcccugucuaugugucucucuuccuaccagcagugcugggcauucagugguggaggagcugagcacuccgcacucccuccaggagucagcagagcaugcacuggagagcuagcuacuggaagccucauccaccagacaauucuagauguagcagaauaugagggaaguguacaaaaaccaauaucaucccauaaacacauuauaaacagccuaaaaacccaaugaaaaauauacccauucacaaagcaacacaaguaucaaaugccugagaaaccuaugugugccauuucuucaagcaucaaaugccacauuuuauauucaaauuguauaaagaaaauacaaacucuuaaugugggaaagacuugaauacauagagacuagacuucaggcuuaagacuaaaugcagacgagaucacggugcuuccucauuuaauuuauugacugaaugcaguuccaggcaaaauaccaccaaggccauuacagaacuugauaaaaaugguuuuuaaauuuguauagaaaaauaaaugggcaaaaagcucagagagcgaggacgcagugugcaggaggaagccacaggcucuguccagcaggucuuaaaacaacgaaggacaggcuguaaagcaacugagggacacaccgggaagacaguacaaucuaacaaacucaccgggaauagacaagaucacaguaagaaagugcagaccacaggaugagucaacccuuggagacaaaaaucuccuucaaaacccacuuagcccaggauagacgcaagauucaugcuccuccuacccccgcuuucuuuuucauaagagagacaucagaaaaugucaaggggacaagauggcuauuuucugacucugaagggaaagcagccuuuccuauuuaccuuucccaaguccauuucaaguccuccauuccuaaagcacuuacagucaaaggcagcagauuaagacacaguguucucuaauugugcuguugugcgagggagggacgcugugcccacacauauucugccugcucugucacaccuuucggugggcacccaaacuaccacagggccuucccaugcgacuguggcucccagagaaggaagccacgggagacuacaggacuuuacguuuucauccugcuccaccaugcaaggguucuucccucacaggugguggaugggucaggaggguagccauugccaguaugagaaaaagcucacaauuaaugaaggguuuaauaaucacaacagggaggacugggacuguugccuucauuucuggaccuaagaugacacuccagucauaagcuucauuguguaccaugcaaagucgucauaaguuccauuaggaaucaugucauccuaacacuguacgucaguaaacuggcucaggaucucagggugguguccagagaaagguaaacacagcauggcagaggcugguuaaaggagccugggacagaucacacagccauaugcacaccugagcugagcccacagggguggggcucagcccaacuccugcauagggugggcugggcugggagguccagcagacagccuuugaaaacaaagccaagugagaaacgaacacaugccucagaauccucuuuaccucaaagcaaagcaaagcucugugcaugaggccgauguugcccaguuaucaggacaggcugauuacagagccuagacucauuugccugaagauaauugccucaauucuccacuucacuuugcacauauagaaagagucccaaucuacugcggccucagugacuagacauguaaaauuggucuaaucaucguuugaagagcucaagcugaaaggauucuaugagcccgagccugaaccacgacaccacuaagggcuucuuuccucuggcucgaggcucgcccacucccuggcucccucccccaggucugaagggugacucagaaccucaggcaaaggaggcucucuguccaugguggcuggaggggggagugaguugcucagaaaaguugaacaaaagccuagcuaggaguaaugccuuuuggguagcaaguccagaguagccaacaguguuucugccccaagacgccauucuagguagaagcugaggcagacgauauccaagaucagaagcaccuggacucaucuuacacacuggugucuggcugggaagcaggcagagcccauuucugaccucuacaguacaaaacaaucaucagagcccagaaaggccaagcucuagggccaaacaaaacccaacaaggacacacacacacuuuucagcgggccugugcagcaagcucugugagggaaggaccucccaaguguagacauuacucacuccacagagagggacagacagauucuguugguucuguguugaucugcauacaguggagggcaggaaaggugggucuauggguucagcucugaccccaucuuacuccugacaggaacaacacagauaaacccaaugauggucagggcagaacccagacacauccuauagauaccccccccccccuuuuuggcuuuagcuggccuuucccccuaaauuacaaaaucaggaguuuggaguuuucaucauuucuaacaguuagucaacuaagaucaguguggucugaguacagcaaagcagcaccuggagagacagaccacauguccccaugcugccucgucaacuugcggcacaggagggaaggggcccaugccaaauucucaguugguugagcauuucuggcugacugccacagggagagguggggaauacuucaaagucccucaauucauuucucuccaaaggaaaguuuagaaagcucuccauuuccaaaaaccauguuccccuccagugacugucuaaaagccacguucgagagugcuugugccugcuggccaggcagagcagagcccagccucuauuguaggucugguaccuguagcucugugacgauagccugcaagcccccagacucaugugacacacugguucccaguauguugcucugcacaucaaacagguagaauaggggcaauccucucaguuugaaaaauaaaagccaaacagacgaacuggaagaacuuuaccuguggucucacaugguccacgucgcuggccagcagcugcugcucauccucauugacuuccaucucuccacaaugcuaggaac

SEQ ID NO: 1315 - RNA, 14778 nt, Mus musculus
guuccuagcauuguggagagauggaagucaaugaggaugagcagcagcugcuggccagcgacguggaccaugugagaccacagguaaaguucuuccaguucgucuguuuggcuuuuauuuuucaaacugagaggauugccccuauucuaccuguuugaugugcagagcaacauacugggaaccagugugucacaugagucugggggcuugcaggcuaucgucacagagcuacagguaccagaccuacaauagaggcugggcucugcucugccuggccagcaggcacaagcacucucgaacguggcuuuuagacagucacuggaggggaacaugguuuuuggaaauggagagcuuucuaaacuuuccuuuggagagaaaugaauugagggacuuugaaguauuccccaccucucccuguggcagucagccagaaaugcucaaccaacugagaauuuggcaugggccccuucccuccugugccgcaaguugacgaggcagcauggggacauguggucugucucuccaggugcugcuuugcuguacucagaccacacugaucuuaguugacuaacuguuagaaaugaugaaaacuccaaacuccugauuuuguaauuuagggggaaaggccagcuaaagccaaaaagggggggggggguaucuauaggaugugucuggguucugcccugaccaucauuggguuuaucuguguuguuccugucaggaguaagauggggucagagcugaacccauagacccaccuuuccugcccuccacuguaugcagaucaacacagaaccaacagaaucugucugucccucucuguggagugaguaaugucuacacuugggagguccuucccucacagagcuugcugcacaggcccgcugaaaaguguguguguguccuuguuggguuuuguuuggcccuagagcuuggccuuucugggcucugaugauuguuuuguacuguagaggucagaaaugggcucugccugcuucccagccagacaccaguguguaagaugaguccaggugcuucugaucuuggauaucgucugccucagcuucuaccuagaauggcgucuuggggcagaaacacuguuggcuacucuggacuugcuacccaaaaggcauuacuccuagcuaggcuuuuguucaacuuuucugagcaacucacuccccccuccagccaccauggacagagagccuccuuugccugagguucugagucacccuucagaccugggggagggagccagggagugggcgagccucgagccagaggaaagaagcccuuaguggugucgugguucaggcucgggcucauagaauccuuucagcuugagcucuucaaacgaugauuagaccaauuuuacaugucuagucacugaggccgcaguagauugggacucuuucuauaugugcaaagugaaguggagaauugaggcaauuaucuucaggcaaaugagucuaggcucuguaaucagccuguccugauaacugggcaacaucggccucaugcacagagcuuugcuuugcuuugagguaaagaggauucugaggcauguguucguuucucacuuggcuuuguuuucaaaggcugucugcuggaccucccagcccagcccacccuaugcaggaguugggcugagccccaccccugugggcucagcucaggugugcauauggcugugugaucugucccaggcuccuuuaaccagccucugccaugcuguguuuaccuuucucuggacaccacccugagauccugagccaguuuacugacguacaguguuaggaugacaugauuccuaauggaacuuaugacgacuuugcaugguacacaaugaagcuuaugacuggagugucaucuuagguccagaaaugaaggcaacagucccaguccucccuguugugauuauuaaacccuucauuaauugugagcuuuuucucauacuggcaauggcuacccuccugacccauccaccaccugugagggaagaacccuugcaugguggagcaggaugaaaacguaaaguccuguagucucccguggcuuccuucucugggagccacagucgcaugggaaggcccugugguaguuugggugcccaccgaaaggugugacagagcaggcagaauaugugugggcacagcgucccucccucgcacaacagcacaauuagagaacacugugucuuaaucugcugccuuugacuguaagugcuuuaggaauggaggacuugaaauggacuugggaaagguaaauaggaaaggcugcuuucccuucagagucagaaaauagccaucuuguccccuugacauuuucugaugucucucuuaugaaaaagaaagcggggguaggaggagcaugaaucuugcgucuauccugggcuaaguggguuuugaaggagauuuuugucuccaaggguugacucauccuguggucugcacuuucuuacugugaucuugucuauucccggugaguuuguuagauuguacugucuucccggugugucccucaguugcuuuacagccuguccuucguuguuuuaagaccugcuggacagagccuguggcuuccuccugcacacugcguccucgcucucugagcuuuuugcccauuuauuuuucuauacaaauuuaaaaaccauuuuuaucaaguucuguaauggccuuggugguauuuugccuggaacugcauucagucaauaaauuaaaugaggaagcaccgugaucucgucugcauuuagucuuaagccugaagucuagucucuauguauucaagucuuucccacauuaagaguuuguauuuucuuuauacaauuugaauauaaaauguggcauuugaugcuugaagaaauggcacacauagguuucucaggcauuugauacuuguguugcuuugugaauggguauauuuuucauuggguuuuuaggcuguuuauaauguguuuaugggaugauauugguuuuuguacacuucccucauauucugcuacaucuagaauugucugguggaugaggcuuccaguagcuagcucuccagugcaugcucugcugacuccuggagggagugcggagugcucagcuccuccaccacugaaugcccagcacugcugguaggaagagagacacauagacagggcuuugaguuuucgugccaagacuaauuuagggagggacuaaccuuuacugaggcuaccuaagccucuuuccuaccuuuuagguuuuuauccuauuuuguuuucuagaaggacagaagaugauuauuagaaguuuuauaugguaaguuuuuagauauuuuaaauuaagugggaaauuuuguuuuuaaucaaacugaauucuacuacuccccaaauaauuuaaaagagagcugauauuaagacacaagacaagccuuaacaaauauaggaaaaugaaugaauuucuugugauagacaggugagugaggggcaaaagaggaaaucaagaaaccccaagaagcaaguggaaauaaauacaacaaacauagucacuggcucauaaugaagagguuuccagagcauuuauagaucugagugcuuccuuaaggaaaaggucggcaggcaucagacuaauucagucuccaggacccauguggucaaaagagcugacugaccuuccucaaguuguccuaugauuuccaucgguagguguguauguguguguacagacacacaaaauguuuuuuaaagccccacgaaauucugaacaaacagcucacugaagacgaacaguugaaccaagcugaguaaccugcagacaggugucucagggcagaagccaacaucgaggggaaaaaaaaaaaaacaaagaaucaauggaagaaagagcuggaucguugaaaagaugaguaagauuggcaggcuuuuaaccaaauuaacccaaagaugaguaagauuggcuuuuaaccaaacuaacccaaagaaaaggauaaagagcaggcuaguaauuagccaggaaggugacauuacaucuaauugugugcauccugugacagcagaagugacaaaggcggcaaacacauaauuccggaagcaaauagaguccacuaaacuaggaaauacaaagaaagugguuugaaauuuucuuuuugaauacaaaauuuugaauuuguauugcaugugacugaccaacgucaaacccagaugagguaaauaauuuaaacaaaucuauagcgaguggugauguuggugcgguaauaauaaucuccugacucagaaacaauuaggcuuagauagauucacugugcauaugaccagaccuaacacaagaaccaagcaccaggacuuaccgcauuccuccauggaacaggguaggcaggaacauuaccaagcucccuuuuaagaaaccaguauucuucacauaccaaguuggccacaggaacacacacaaauuauagaccaauuuuacacaggaauaaaaaugccuaacaaaauacucagaggggccagugggauggcuuaguggguaagccugcugccaagccugaagaccuagccacccacccauguauacuggaaggggagagcugaauccuacaacuuguucugugguccuuccuccaugagccauggcacaggcacaccccacauguaauacccaaguauacuuuuaaaacuuuaaaaccauauuuuaaaaaaaaagauaucacaauuucauagacuucacuucagggaaguagggguaauuaaagacaugcacagaguauuuuaagugugugacaucacagaaaugaacucccaaggccauuucauaaacucucaacaucccuuuguaauaaacuccuugaaccagccagaagcagcuguguguaguguaacaaaggccauagaugacagaucugcagccagcauucuacuacguggggacaaaucagaaccuccauuauggucuaggccaagagcaacgagagcagagaagcaagcacaagcauggcucauggagaggaggaaguggaagcauucuuagcagaugacaugguuccacacagaagaccuuagcccaggggaaacccugagaaccaacacugucagcacaggacaggacagucacaaaccugacacaucaugugcuccagcaacagacccaaggagaccagagaaauggucucuucgaguugcuuccaaaacaaaacaaaucagcccuugcaauaggcuuuuuuuuuuuuuuuuuuuagguaauuuuuguuuugcuuaacaccauagauuucuuuugaaauuuuaucaucauaaaaucucaggguaggaccucucagcucagugugcucuuggguagaguucagccuuugguaggccugagcgucuuuuacuguaaaauuguuuucaugucauucuucugguuuguucucauccagcagucgguugucaacuuguggauuguaugcgauccuguuagggucaaagggcccuuuuagggucacacaagaccaucggaaagaauguagauauuuacauuaugauucauaacagcagagugauaguuauaaaggagcaaugaaaauaauguuaugacuuggauaagcacagcaugaggaacuguguaaaaggguugcaaaguuaagguugagagcggcugcucuagucaguuggaugccaucuaguuaggcuucugcuuuuauucuucugaguuuuuucuaauuacuucacccuuaauuuaugacucacuguguuuucugaaauuacacaagagaggagcagucuuguuugacuugcuuuuuaaagagcuuuuucucuccagucacugcuuucugcguguuaggugguugguguuagcauugaugcugggaacgggggcgguaaugccuauaaagguguuaagcccauggccgagguggugggaagggaaggggacuuaaucaucuuggguagaaagagccccaacggucagacccagccaagcugcauugugucugugugaaauacaacucuaauuuccuuucaguggguuugcuuguuuuugagacaagauaggccauggaauagagagaacccagagugagguuggaugguggucgucuguuguagagccugccucccuacucuucuugucggggcaucaugcugcagaguggcuuaugcaugccaaggugcuacagagccuccaaaggagcagugguuuauuucuagggcacacagcacagggagcuaaccgauacuuggauauaccaggagaugccuuccugggaauguguccugugcacuugagcugaggcugaaggcugauccugugguggcaggggugguacaggcagucagcaggauugugggacagcgggaugagucugggaguguuguugagugguaggaagcccuuacccugggaccaggaggugccuaaucaaguuuguuucaaagcucuuaucugguaccagguuuaagagauaaaugggaaaaccagaguugguggugacuacagaaauauaugagaugggaggugguaagagagcuucagugacuaaugcagaagccagccacaaagcuugaggacaacaucccaacacccauguugggauggaucuguguauccuucauugagugagagaaauagggaacacagcugguugugugauagcacuccaaguucccacaugcugagcauccuucugcacuaaccugugggguucgaaguagucuugggccccacaggaaaaggcaucagaugcugcagaguuucagucuggcccuugauggagagaaguaggaaagccggugccaaggaacccaccuuugcgugcuccacauuacuucuggcuuguuggucuugcaaguucuagaacuagaagagaccagagagacccagccuuagccacccucaguuuacaaguaaggacacaggcugggagagggaagggagggagggucuuagagucuaggaaagccagcacgugagcucaguuugcauagucugaacucucucucagauuuuaaugcaccacaggaagaguggcccagcacucagaugccagcccucuugacaucagaucuauuucuuucuacaaccaaauggacacuugacaguuccacauucuuuucuugaucacuucagugcugacauuccacuggcuccuuuuugaaaaggcaggaacuuagaagugccuuggaggcuagaaauagaacuauacuaugccccaguagucaagccuggccaagucuacacaaggccagaaggacuuggccaaggcaaaagcugauguaguucggugguguacuuuuucugcugguuauucaaaagucuauccaucuccuaaagcucccaugauuacuuaaaccucgcaccagacaguggagguacaaaaaggcgagccugcugugucucaagaugucugcuccaugaacccauggcagacuagaagcuccacuggguauaugugguugucuaaaugauauguacuaucuaauaacuucacaaaaaccacauagagcuaaggcuuaagucacuuugugcucagagucucugcgugggagagggcugggauuguuuuccuugcuuguggggcuagggcgugaccuuggcuuaaucacucuuugcccaucagagagguagguuaaugucagcaaacaguauuucugagcuuugcugugaauggaaagugaggaaggacuuggaggaguggguagugguggggucuagggaaggaacggggagcucuagguuguggguucauuuucuuuagucuggggggugaccggacuuguacaaggccauuugccaaccuugguggugacuccuaaagagcucacucggaucacaggcacucaccccuccuuuaauagcaccaaagcccaaaagagacccccccucuucuaauccuggaucuagacauuugaagcuaggaauggccacaauuuaaagaaugcgcucaaguuuagaagucaagguccuuguccccagccccaccugcugccucuccccuggcauuguugaguuagucacaguguaaguagaguagugguggucauuacagacgacuauugucguauugcucucagugcauuuaacagaguaagcugccuguuccauaaccccuuugcuuucuccuagacaggguuucacucuguagccccggcuaucacaugcucacuuuguagaccaggcuggccuugaacucagagaucugcccuccucuaccuacccagugcuggauuaaagauuuaugccaccauacccagacugauuuuuuuuuaauugacuuaugcguggugguagugggggugggggcacacauguacagaggucacaggacaguuguggguuuuggaaauggagcucaaguucucaacagcagagcagacaucgauccugucccccugccagccgccuccugacgcccagcggggauguuaacgcucuggggaagaggagacggauucuaguucuaauaaguugaauugcaaccaggauaaauggcuugggccuauuuucuuuccuugacauuugccuccuaauaauacauggaagaagacauugucuugagggacuuggcugugacauuuaccaucuuuggacacguuuacuuugcagaggaagcagccuuuaucauaaaaugcuugaccuguggccuuuggcuucagggagcugcuuccuagauuccuugggccaggaaaggcccugcuuccagccagagccuuuacaugagucuuucaaaauauuuccagaauccuauuuucauguacacauucuuacgccuauuaaggcgguuuuuaaguauaccaaguacaggugaggcuagcaagcccaggugauggcugugcaucuccccuggagccuuucaagguauagaaagcacgaagcucccuugguagucugggacaacagugacuuuccuuauccuccaguuaauggucuuuugguucuuuggauaaguagaagccacccucagccaggcggcgguggcgcacaccuuuaaucccagcacuugggaggcagaggcagguggauuucugaguucgaggccagccuggucuacagagugaguuccaggacagccagggcugcacagagaaacccugucucggaaaaaaaaaaaaaaaaaagcagaacccaccuucucuguccccuagagagaaaguagggagcauuugagcagccgccccauguuccuugugaggugccaucucccaggaugggaacugccuugggccucaagugcagauaaaagccuuaagagcucccuguagcuaccccuuggacagccuccagauuggucuuuggcagucucuguuuuuuccaaggccaagucaauguauguucaguagcaggcaccaggcacauccagcucugcccuuuugggaagaaugugugguggggacacuuggaguccaccuaaugacaguugucgcuaucuguguggaaagauuuuguccuagccaguugcuaggccucuuuguauuauauuaauagcagggccauggggucuacugggguuggaagccaaggagaagaggacagcuguggcggacaucacaccaugcucuaggcaugugcucccauaucacaggcacacagauggccuacaccuuguccugccgcucaaaacgcccccaguccccugccuggcuucuccuuauaggggcaggaaugggcuugugugggccauccgugaggugaaggagccaaauuaagaaagccugacuggaaagggguuugacuggccugagcugucagucaacaagcaagugugcugggggccaggcauguggagccaaggaaggcagcaguagcccgacaacugcgagcauuggcuccuguguggcuuuaaaugucacaggccaaaugguugcucaguuggcagcaggguggagggagggggcuuggaggaugcauucgcuaugacuagauauggucagaauuagggacugaacaaugcccggucugagaagaggagccaugagaacaacgaauaacccggagacagggacagaugaggaguaggagcuggggccaagugcaggcagggcugaggaagcuucaaggacagucuagagcaggaagacccagguaaaccgacucucacaggaacuggauagggagaaggccugugggccaggaccuauucugguaucaaagagaaaugagugucaagguguuccuagggcuucuugcauuuuuccuuagggcucuaggcaagaagcugaauagguccaaaguaacacagaccaagaccuagaccucagaaagaacgagcaaauuugaacacccaccauuguaagaucagaacuagaaaacacccucugguccuaguucugucuagauaaaugauacuuuagccaugcauuuccccccauucuuucugucugaauaauaauagcuuauucauugauguuuggauauucgauuuuacuacaauaaucagauacuuaauuuauaacauaaaggagccucugguccucugaaucugccauccacguguccgcagauggcugugggcaaggggcggccgcccccuguuguucagcuuuggugccugcuaccagccaaccuugucacucaacugaagagggagcuggcuuuuguaggcauuugcccuuugccuuuucugaaguagugcagcuguucuugucccaggaacacgggccgucaaagcugaguuguugggcacgugaucuuugacuuugcuaugacauuggucuaggaggcugagacuuguucaugaacauaagcugggucugcaaaagagaagaccaggggauaaacaaugaacuuccauuggggcuugggauaggcuugauaauccagcacaguugccugguucccuccuuguggccccuuaguaaccuguggcuuguaccacagaguuaggcaauugccauggcaacaaaacaucuaagcugucugucccugggccucccuucaccccaacugaguagggccuagccuggcauagagaggauagaagucaccaagaagguccugguaucugcagcuugccucucucagcauaugagcagacagggaaggaggcuccuguguucaucucuacccuaugucuccuggguucccuccauuuccuucuccccggcucagucuugcuucuugggaaaagguauuuuucuuggaaacagugagacuugguugaucccuaucucccaaggccuaaguccugugggcuucaggauggcacugugucacuaugucgcugugugaguugcuuauugcuccaagcucagccuuaguaauucagaaggccucauucuuauugaccuguuuguagagucugcagcgcagaggccuaggccuugggggacuacguguucauuuaauucacuucaacuucauggcaacuagagagaagccuagcugcagccgagcucccaacuugccgagggccaccucgcugaggaguaggagucaagcccgcuucugacugaggggguagcugguguccagagccuauuuuccaacccuggcgggcacugaaaagccuuuugaaggggguccaagaugauacuuaggcugagcugaguuuaggccaucagagaccucggugcagcagagcugugagggagauagccgcuggggcugagggcauagguuugggaugagcuggcugggagcuauaggaaggcacauaggagcacacuuaacaagcacugagggccacaugugaggugucuacuuggaggaguggcucguggcuccuagcugcccuugcaggggcucugguacacucaggagucaagugguucuucaugugagcagaagcugaggggugacuggggcugauggaggucugagcuacccucgaaugaggauuuggggcaauguucaccgaaacggucaagucagagaggcuuucucuggggccucugacaguguaagcaagaggcacccucccucguacuugugggaucuucagcucuuuugcaacucagccuguagcuagggaugggucuuuguagucugcuggacagauaagacagacauccaccccaagugaagauacagagcauccucucuccuugcagcugagagcuggacugagugcuacacaguuuugaaggaacaacucuagaguguccuugaagaugauggggcccgcuuacaguagcuucucucgcagcaccucuaaagucaccagcucaccuucuuggcagccuggagagcuacguguaccuccuggcauuucucuguuuucugagugaugggaaaggggcuuauauggccaacacuuggagccacaucucuagccgccaagucagauguauugggaacaacugcacagaggggagaggacuccgcaaagggcucacacuaaaacugugcucuuccucuggggggaggacuucagagggaguacaaaguaccucagccccucacagcuugguggugaugcaccccuuuucugagagccacuuagcgcaggauuccugugacccuucugugcugagcagcucuugggccugacaccauccccagcugucccagccuuguuaccuaugggugccuggguugguuguccauguugaugguugggaucaaggguggguggguguccaucagaugugucuuucugugaugggccucacuguucuucuguuugcuucugccucccacuguugcucuacugcacccgugggagcaugauggcucugcuccgucucucuucucugcucaaccaaagaguuucagaaaagagaaaggaagccuuuucugaagucucuagacuugauuucuuguccucagugcuugcccuggcugagggccccguacaagugaacucugggaagaugauuugucuagggucauggacaaaggccuuagaagaugacuuccaagccuauuucguuaacgaccugcauucauuagaaaaggaccuguguuuucaaaaacauggcucuugugucucacauggucagacaguagccaaaagauugcccauaaauaugucuucugauggcuguuuggcuacuaggacagaaccauuaaguugaagagcuuaaaacuaugaccuuagcggcugugugucuguuuuguuuaugucuuaacauucccuaccccaucucucuguucuaagcaccucugagcucucagcacaguccugccuuugaagccuugugugauggggagccucaaggauuggagccugcacuucuucagcugcuucugcugugagcacaacauucaguccugaggaaaagguuugcuaaguaggagaacuuggggguucuuccuccucagguauggauugauuuuucaccucacagagacccagucagcacccaugggguggggcauuugaguugggaggugggucuugcuggagcagaggcccagcaagguggauccuucuuggagcgugggaaucuacagggcugcuuagaaaugguuugauugguucauaauggcaccuugauagaacaagaggguuuacuguacaggauacuugccacaccauggcccucuuugugcuacuacaugcaagugagugaguccauuggauggaguggucauagacagaucuggccaugagaugagugucucuggacccccacuaacuagcuccugcccaauugacugcuuccugagcaccacagcuauuugagguaggcugggacguuccugccgugcuugaaagagacaccaagaggcauaagaggcccaggccuuuggcagaggagggcuguucuucccuugaguuuuaugacugggaggaacuagccuucucucagcuuaggagugggccaacagcuuccuuccgaucuccaggagaauguugcugguugacacacggaacucauccucuaaguucccccacccaucaagguagcugguggagucagagauagauguuucuaaaagccauggagaacuuugaggucuugucauaaugcccugagccuacuacuaagacugccaccuucccauugucgaugcaguggcuucugagcgcacguagcugggaagcgggugagcgggccaagauccagguuagugggcauucgagacuacagaaagagacccuccuagggucuugggguuggggagacagaggcagggccccuaagaggggaucuccaucugugugcacacagaacagccuauguggaaggugacaagagggccuuucuggagggcccccccucaauccuguugugcucgcuucagaggguuggguggaggcucuccugaagguguccgcagagcgucgcaugguaaguagucccuuggggcucuagagaaugcuugcugucuuuggcuugaucccaguggcagccucugcuagacuaguccugccccccaguuagugcucaugggguaccagagaccugaccccacccugucugcucuaggcuaauagugcccugcuucccugggcuuguaccaccuuguguaguaucucccuacucuucuguauccuuggcugggaaacuugcuuccuagcaccagaccuuccuugaugugguuguuugcuuuccuuucacuuaucuuuucuuuccuacaggagugggauggacaucagucagauccacaccggucuucauggcagccccccuuuuuuauuuauuuauuuauuuauuuuugagacaagaucucacugaauuauccauacuggccuuaaaacuuggaauccuuaugccuuagacuccagcauuucuggcauaaacugcuguguccagucuagaaggcauuuuggugaaccaccccuguaagacugagcuggggggggagggugucaggcacccaguuuugaguuacucacacccagccucucccaagugugacacaguaucugccuaauaaauucacgaagaaagau

SEQ ID NO: 1316 - RNA, 14206 nt, Mus musculus
ucaugaccacuaaauagccaauuuuauuuuguaauuuccaagacagcuccaggaggggaggcccagaggccaauguaaugaauagauggcccugacugacaccuuggcuccaggagugagaacgaaacugaggcagagugggaggcuugaaacccccacccccaccccaagcccucuccuacagcccugggggagcaacuacagagggccguggucaaaccuugucuuagcucuagcaguuucacaagcuccauggaaaccucuaucuaacauguagucaucuguccuuugacuuagcauagcuccugccgacgccgaguccauucuccuucagaguccuacuugcuagaauauuccuccuugggcugaagccuaccuguacacagcacccaucuaggcccucauuuugcccccuggagcuaugucaaauaacuagugaagccauuuccacaggacaguccucuaagcucaaaagaaucuucuucccaauacauccaaauaagaacccuucuauaugauacuguaagcaacuggaaacugccuuccugcccaacuggucuagaagccuccuuccugaaagucuaaagguaauauaugaccacacuuuauuuaccugcaaacacagagaaccccuuguaccccagcugguaacaacugaggucguucaucaccuacuuggccccuuuugaaauucacucugcagcaagcacuuuuuaaaguccugcacauaaugcauuuuaaagagcauuuucugugcagauccauuugcucaaccucggcacuaagugcaagauggagcugucuuuuggugcagcccugcuccuccuggaguccgugcugagcacgugcugaaaugaauuuguaacuguacagaugaccggggcucggaagcguaugcuuuguuaacuguccauagcugauucaaacgcaucuugcaagaaagagcagugcuaaugcagaacccugguccaagauauguauuauguaaugcauaguuuuuaauaaugugggcaguccugguguuucuguacuagugcauaggaugugggcugccaucucuaucacgggcauaaagcuuuccccugaaaaaugaggcacuuucccacacacacuaaaaaccaucauccaccucacugcugacagcuggcaucaguuuccaucaaacgggcauuuaccagcacccacaguccuguuuuccucucucugugugcccuaaaauuggcuagaccaaugucuuugugcuccauaugauguuggcagaacuguuuuaacugaaaaaaaaaaaaaauaagguuaaguguauggaagcggucggaccccucagauacccccauucaucaggguggaaaggcagagauaaggaucugagaucucaaccccaaacaggggcucaagagucacagcaaugcacuaagagucagcagaacaucuagauuacagccacacauuuguucaugagaucugcugauccaaccccacucuaucucaccagcauuuaaggcuguacaugaacuccuagaccacaagaugcagcaccaacagucaagacagagagauucuauaaucuccaaccaugcagggcaccuaggaccuaagucugugacacugcaucugggagccugacucugaggugcaagugugugaggguaaguaagugaccuaggaccagcaccugcuucaagacauaacucacaauuccaccuccaggaaggaacccugggggagcagcuuggagaggcagcaguaccucuugugacucuucacauggacucaagggaaaaacaaaaaaccaaacagcccaccgugugacauguguuccauguaaaaaacaaaucaaaaaaaccucaaaaccaaaaacccaacaacuaaaacacccugccaagacuucaugcaucccuauaacacaacucugcuaguguuaugcuuuuuuuuuuuuaagguacucuauauuuaacaaggcaaaaggcaagauaaacgagccccacacccacuucccacagggcuccauccccuccuggaccuaccugaguccaucggcucuuccaagcgcgcucuggaacaagcaggucguuuuaccuuguucuuccgaguccaacagcaggauccaguggucucuggccgcccccuagccaugaugcucuugcugacguaccuguuuuucucauguagcgugagcuagaugaaguaaugaugcuggaagaaugagcugaugcucugguuaagauauauuaaccccucaagaccccuuucucuaauccaagaccugcuccuguuccucgcuaucuucagcaccuagaacagagcuccgcgagugccgggaacucaaguguguugguugaacccucagcugaaaugcaugaguccguggcucaaagacuacccuaaaaacccacacggagagcagcaguugaagggcauucucguggauacucacucucagcuuccuauggucuuccagcacaccucaguggaacaguguucaccaugagcugacugucggcuugcaaauuccuacaucuacagccgcggggggcgggguuguuugccagugggguucauaccuucuuggaggcugcucuaauuaauuacaguuacuuuaacagcccugacaaaaguaaccaccuuugauaagguuaguguuuacuugaggcucugauccucaagcauucacgcucuucggucauuaacacucauucacguacggauccucauuccccugaauauuuacaauuuugcguucugguuuucaauuguuugguggcuaugcucauggagaaaaaguugaggaguggggacaaccccccgugggaaucuauacuuggcuucuaaaauccgcuaaccuguagcuaucuuacucccuucgcucgcuagaccucgauauccagccccccaccccccaugcuuuggccaaaucuacucaaacaagguucccgccugccaccugccggcccacuagggucugcgccaugagcuaugcgccaacgcacagcucgcggggaggcacucccgcccccaaacaccucccuacugcacaugcccggcagaaguccgcgcaacuuuauagggccccauugccccaucucuccucagucuccucuauccucucccagacgagaggaucaguggaggcaccucucggagucuuagacuucagagucugagacuuagcgagaggagccucgaggagacuccuucucucuucuuuacccaucccuuucuuuuacuuacagccacaagcugaggcgcggagcuuuagaaaguucgcagugguuugaagguagguacaucccuucuuuuugccccgaggcgagauuggggucuucagaccccagcuucucuccucauaagguuaauccuuuucggccccaacaguccuugcgcaguggggccacucucugcagagccagagggugagucggcuucucggugagcaccuaagagaauggaucgcaggucccgggcucagcaguggcgccgagcucgccauaauuacaacgaccugugcccgcccauaggccgccgggcugccaccgcucuccucuggcucuccugcuccauugcucuccuccgcgcccuagccucuuccaacgcccgcgcccagcagcgugcugcccagcgccggagcuuccuuaacgcccaccaccgcuccgcugccgcugcagcugccgcacagguacucccugaguccucugaaucugagucugaucacgagcacgaggagguugagccugagcuggcccgccccgagugccuagaguacgaucaggacgacuacgagaccgagaccgauucugagaccgagccugaguccgauaucgaauccgagaccgaaaucgagaccgagccagagaccgagccagaaaccgagccagagaccgagccagaggacgagcgcggcccccggggugccaccuucaaccagucacucacucagcgucugcacgcucugaaguugcagagcgccgacgccuccccgagacgugcgcagcccaccacucaggagccugagagcgcaagcgagggggaggagccccagcgagggcccuuagaucaggauccucgggaccccgaggaggagccagaggagcgcaaggaggaaaacaggcagccccgccgcugcaagaccaggaggccagcccgccgucgcgaccaguccccggaguccccucccagaaaggggcccauccccauccggcgucacuaaugggugacuccguccagauucuccuuguuuucauggauaaagguuaguugcccugaccaaacuggggucccugagacaguagggugggaggaaagagacagaugggaggcaaggugggaagggagcggugcccauuaaucagcccgaaaugcaccccggaaaaggagagagggcucuucaagucucuccagggcacccaggggcgcuugggaggccaaagguuuguuggacggugaggcauuucuggcgccucgcuggagacaaccugagguccccgagcugauacccggugcgcaacauugaauucggugugccacacugaauucccagcgcgccccagguuuggaguuacauacauaaacggcaaagguaagucacuuguuuucuauguucucuccccuccuacagaaguuagucuucagcaacggaguuggcuuuagguagagcccacugggcucgauauggaggugcacgcaccaacuuuggcgaucugagacugcugcgccauagcuacaguauugcaaugcgcagaaaguaacugcguuugggauugggugacaacucuggagccuaaaucgcacguggcauucagccggcgcggagccuggaaaucggguaccggcauggccaauuuggggccgcgggacccuggagccagugccuccccccacgccgugcaaguagucuugguuaauaccgcucaccucuggagguucgaggaggccugagaucgugaaaaggggcgcgcgcaccucucccgugcguccuaaagccaaccuucccgcgcagaaaggaguuucuugauaguggauagugcuuggaggacacucaguggugguauaggguucuuuacgggugcccuucugggcuaccuggguuggcagacagcuaggaucacaucgggguaucgcgcagcugguuaggcagauccgacuuguccggagagguccgggacugugcgccuaggccauagaggcaggagagaaggaaugagagcaauaagaaguggucuugggaggaaagguaaagcgggucaaggcacaggcugaguacggaggucguggcuaucacucugacaccuucaaagguguacccaaagaucguggcacuuccuaagcugggaagaugucggauccugcgcuuuggacugagagguggcagggaggaugcgcuacagccauuuuggccaucuucagcucggguggggcuguuuuuggaaccuguaaccugugggggaggggagaucacccaccggugaucugccccagcaccaagcacguaacgcaccuuagaaugcuuuccccuccagccuugggcggaaaggcugaucuuaaguaaaacgcaccuacuguaucucacccauuuagaaacuuuuuuuuuuuuuuuaagugugcgcggcuggucuugcggcggcuugagauauuuugaugggaugauuugggaaaucugguuaagaaacgcaguuucaaagcuugaaaucaaagccggcugggcuccugagcuccuaagaggagaauggugcuagaaggaacacauuacguagucuccuuccaggaccuacccucuuuccugggauggcgucgcagcccccagaauuuaagugagggugggcugugcgcacugcggcuaauugcgacuuuggucaacagcaggaagcaguuuguuagcaguggguagagaaugagccgguagcuugcggaaaggaggcgggggcuuuuggguugaaagcgugaaauugccuaagugagacauuauuuuuccuaaguuaaaaugcucggcaacgaaaaagaugacgugacguuuucuugacguuagguaccuuuaugucuuguaauguagccugaguuuaccaagcaacagguuucuaguuaacagguggagaagccgcacuuuuuuuucagcaguuagauuuuuuuuucauuagcuaaaaauuaggaugcugccuuguugcugggauaaauaaaaauuuaaaagugucuccaguuucuauaaccaccaccucacgcuguucuuauagaagccuagagccuggcaagguggugcaaaccucuaaucucagcgggggucggguggggauggggaggcagguggaucucugugaguucuaggccagccugcucuacagagcaaguucccgaacugccaggacugcacagagaaaccccguuuccgggaaaaaacaaaaacaaacacccucuccccccgccaacaaaccaaauuuaaaaacaacacaacaauagcuacaaaagaagcccaagugagcaguguaagagaggcucauacccgggguauucaaacaggaacgcgcauuuugcuuucuauuaguaaccuugcacugucuaccugagucacagcagacgcuuuaguccagccugcuaccggcccgcacaacccuccccucccucucagcaccucccccucccuagcgccauccugacuccagguaaaaaaaccucggcgggcuauauaggagcacaccacccuugggagagccccaccacccacacaagagguuuugauaaaacacccaucccaaggccauuuucugugaaauaguucauucgcucacuaggcucaggauuuuacuuuuccagggcuuuucuagcagguccucaaacaucccuaacuagcccuuugucucacccuguuaaagcgggguuagcauuugaauggacuggcaagcccuuucccuccguagguagacuggcugagggagaugcacgugggacaagugggggucggugacaaagcuaguuaaacugccuuccaagagcuuuuggaucuuuagcugcauuaaucguuugcuuaaugggaaaacuuccuucugugguggaagggugcgauuauugagugucuuuuaagugauuuucuuuuuuaaaauuauguggcaauguucaaauaccgugugguggcaaaugccagauguaaguacuguuuaguuuaucaguaaaacuuuuaauuuuauuugugagaauuggagaaugagaugggagguguaaacucuaggauugauuuguaaguguguuuuuuuguuugcuuuuuuaugugccugaagccuuuuauccucugggauugcuuacaaccuuugacucuuuagccuacauuuuagcagcuguguccccuuaacgagaaacuugaaacaucagaacugguaagaauaaaguuuuuuuuuuuuaauggauuuacuuaauuucuccuuuugucaugucaaaagaaaagaggaugaggaaacugagcagagacaacggugugggggcaagcaggacagcagcccaucacaaaagcaacaaaagcaagucaugauaaucaauuguucagggccagagaccagugaugucaccuuguuagcucaaauacugcuuccucugaagucccacuuaguaacaagaugagaaacucaggccauaccuuugaucccgugcuccacaugagggaaggaauguccuguugugggguuuggccacuaauuaaccuaacucccaaacccagacagaaugagaaaccagcagacugagacaaaaggcauaagauacugggugagcccagggugccucuuucccaccuugcugacugccuccggucuucccucacaccccucugccucaguuucuucuuaaagugugcuagcagaacaaaaucguucucucucuggugucagaagggcagagccgcaccucuagcuccagcgacguucccaaaucucaaauguuugacuaaauaaaaagcacuaacugugaagaaguguguuuguguugucaagacucacugcguccaguccugggggcgggguuggggagugugagcgagcacuccuaagagcaccuaucaaugcuauguugugcuguucccgaauucucccccugugguuagugucuagaaugaaccuuccagaacccaguugguacaagcccauuagggaugcuagcuacgaaauaugggagacagcaagcugacaguacagguuaaguaauggcuuagaggcucuagauaguugggauaaacggggaaguguuucaccuccuguccauuaucauucccucccaggggcuuuuuuuccagccauauccagccagugguuccugucuccaguuuuaguacucacaucuuuuuauaugcugcaaggccugguaauagcuaagcucacucucacacacaccacaaacaugcacacacguaucaaacacaugcacguacucauacaaacacaccagacacucaauacucauaccccagauaccucucacaugcacaaacaccacacucauccacacacauacccgacacaugcaccuacucauccacaaacacgacagacacucaugcucacacacaagcacacacucauccacacacauacccgacacaugcaccuacucauccacaaacacacgacagacacucaugcucacacacaagcacacacucauccacacacacacacacacaaacaucacagucauacaccacacacacucacaagcacaccagacauacucauacacacacacucauacacacaagcacacccacaauuauacacacaccagacacucauauacaaauguacccacucauacacauaaacacagccacucacacaagcacaccauacucauacacacacaaacacacccacacucacucccccauauguauguauacauacauacacacacacacacaccagacacacacaagcaagcacaccacacucauacacacccacacucauaugcacagcagacauacaccacacacucacccccagacacaaacacacagccaaauuuggcuccacugcugaggcaaacaaagcaaacacuucucccaauaaucggcucugcaaauugacuuuuuauugaccauuuauuuauuucauguuuuaaccccuuuggggcauuuaaaaauuuggucuaauuuuacuaguguuuguuuucuccaagucuccuagauagggagccccagcccagccaugaagcagaacagcuggcauggugaggaccagaggacagacauagccuagugacuuggauccccugagugcaggugucugcagugcagagcaacaucacuuauugauagugcucagccacagaggcgggaggccccaggggagcucaaaugugcacauuccuauguuuuuuccuaugagccuauuuuaggguaaacauguuacacacuagcaaggggauguggcugccccaaggugaggggagcaaaaaggguuguggggacccagggaguaaaagaacaugcuauggaggcccgggaaggagcacacagccaacacauuucaugggugcacaaaagcacuuugaagagauagggaaucaaaccauugaggacacaccaacuauggcaggcugaagagggaggaugggaccaggugcaacaaggagcaucgacaccucagggugaggaagaguauuuuuaauagccaaagauggacacuagaggagaauuucagaucagucacccuugaggucaccaucccagucuuauagaccuagcuggggaauuucaacuucagcucuacagaauggaguucucauaaggauaccucaaauucauuaaccaaaaagacuuaagagcuacuaaccuuacuuaaugguuuuuaaagcauuggguuuugacucaagaagaccagccucugaggcucccauuccuauggcacaggaaugcaggaaugugggccuagaguccacaggcuucucccucccgcaggcaauacccggcugauucuccuggcuuaugugucuguuucaauuagacuucauuaggaaaauuugcuuuggaugauugagguugccugaaaaggugaacaacacaauccccucaaauucaaauaauauucaggccccgaagccccugggugccuacaauucccaccaugaguuacagaaaucuuacauagccuuucuauuaaaucuaaccgccuucugggaucccagcccccacuccuuccaccccagcccgccccuccggcagacaccuccccugauuguuucucucaucugcaacaggcacuucucccucguggauucagcugcauucucagcuguucauguggacaccuugugcaggcacagguggcaggagcauggcaagcuaaggcacaauuugguggcucuuccacaaagaaagccauugauaucaagccacugcuaauaagccugagggaggggccugcccuuuaucguggcuuuucauccagaguugaccagcuguauucauaaauaucauuucaucccccuaacaugagccccacaucagucccuaguccaguaucuugcccuaucugcuagagacaucuucccuuuaauuagcauuugucucaaacaggccagccacacagccccuucugcagagcugcugccuccaccggccaaggcuugcagagaugauggcagggagguggggggagggcugcagcagucuuaauugaacaguaauuaauugaacagcuucaaagucuuauugcuacucagggaaacacucagaaaaccuuugucauugggaggcugagcgacuuaguguuugccugaauucuuuuucuaucuucucuuuuucugcaucugguuccuuugccugaaaauuaaugggacacauauguacuauaggcagagaaggcuccuuauaaggcugccccuuccccaaagccauaaaccaaaagaaaccuuacugccaauggucuugcuauuccuggcuucugcauccccccccccccaccaucuugcucacuccacccucccuucuacccaagggaccuuuccuacuuggcuuucucuuuugcggccacagggauaaaucaaagacguuaagaagcaguuacuugggguaucuggaugggccuugggcuuuuagcagaaaacaaaaaccccaaagggggaaauauuauauauacacauaaagcccuaaaauguaaauauaaauacaacuguuguuguaaacaagcacccagcccagggcaccacagaaaagugggaccacgccuuuuuagguaaggaagcugaagccgagggagagucagcuucuuuaugguuggugugacuuucaaaaggucaccugauuauuucugacuugagcgucugggccaacugcacugagcaagcugccuuuccucagagaagcagagcccaauggaaacaggggcacuccuuaccaguccuuucuaauacggaaagagccuccucuccaccugacacaccaucucucucauagccugucacucuagcauacacuguguggauggucgaggcccccaggcuuagcuucugccuuucccaccuaguaagccuuccucugcacccacuccuuucccacccacagcuuuugugacucgccgguggcuuuguuuuacucacaucucucagcauuuaccuccccccaucacaaccauuacagagucagcuggacuagggaugacauaucuuuugccagggagcugaggagaugggcaaacaaaggcgccugauucauggaaccuacacgacaccagaauuagccccaacaaguugucuucugaccuacgcgugaaugcacgcgugcgcgcauacacucacccgagcacacacacacacaacuaagaggggagggaaaagauccuuuccuaguguagaguuguaaugugggaccauuagaaaccucacuccuaguaggguaaggccccaggccaggcacucaccaauugugucagacauguaucgaggcagccagaucaccaacaucaacaggcaccagacagugaaacccaguaaggugacuccaagccaacuuguccacucaucaccuccaucucuuaaccauucuggacuccccaaguccuuuggccaggccauacaguuaccuucugcuacaggcccucuugaacuugcugcuuguguacagcagagccuuuguacuuaggucuaugccaccauaggaaauugagagcacagggcagggcauaaucaggauuaaaucccgagcucuguuuuucccaguaugaauuuaccuuuaaauuaaagugccuuuuuaaaaaaaaauuauuuuuuauuuuuaaagucaauguaaagacuuucucagcuuuuccagccaggggcaacucuguaucagaggccaucuguacaaacucugaggacauugauauuauucauacuaaggggaugucauuggcaccugguagguuuagacuagagaagccauauaauauccugccucacacaggacagucaccauaacaaaacauuaccuauuaccugccccaaguccccagugcgaggcuaagaagccaugaugcacacacaagggcugcucccacuucagccucuggagccugcccugcucucucucucuccuucuggccucuccuuggcuguaucccuccacuggagaaauuuuaucugguucauuuaucucaaaccuuaguaaggcugauggacaauuugaauuuuugccuuguacccuucuccuaaacuucagaccuuuccuucccaggaauuuauuguaaguguauguguauauguguguguguguguauauauauauauauauauauauauauguauauauauauauguauauauauauauacacacacacacauauauauacauauacacauacauauauauauauaguaaauauauauuguauauuguguguguguauauauauauauguauauauauacauauauguauaucaaaucguccaucuuccuuucaauucugccaugucuaaaauuaaaaaaaaaaaaaaaaaagccucuaccucagcaccagccccuccccgacucuauguaauucccaguguccaaaacccaggugguagucuuugauuccuccgucuuuugugacuugucuaauacgagugcuuccaggaagccucuggaacccuuaagucucuuuuauccacugugucugggucucucuucucucagggcuuccgcggcugcagcuucuuugugcacagcccuuccuuuguucccuuuaucggaaccacccuccauguugguucuguccuuucuaaaagcuugauucaaauccugaucugagaaggagggagaaacacacaccuuucaccaucuaccccauuuccuccucuccacuuccugcccaaagagcccggaugcugcauggacgccucagaaagcacauccauuuucucccuucuuucccacugcuccuacaggagcaaagguguccguccgaucauuuauguaaccagaccccacacuuccuuacauuggacccuuuguuccagauaggugaaggugugcccgcucugccccgccccuucuauucagucaagacaucuugcuauggagacccauuccaggcgccauuuucuccaucuggucuuugcaaccccuccuauuggaggccuucucuuuccauuuucaugccguucugcucuuucacaaggagacuggcaugcucuggagguuucucccugucagagaagcacgauauaagaaagaauguggaacaaaggauucucacagaucauaagaaugucugaacaaagagaaccugaaaccauuuuuuuuuccuuuuggaugaauggugcuuuagggaugggugugagaggccuggagagcccacaagacccgcguggcggucuccuugggucgccaaccucagcgucuacugaccuuucaccuugugcaggguucagcaucucugggaaaugaaaucuguccaucuuguacugcucgucugcaucggagcaguaagcucucuuucuccauaggccuggcccaccaccuccaggcccuggaaaagccucucuccgcggugccucggcgauagcccucucuguguagugaguuagccuaccgccaucaugagcccaagggaugguccaugggggucccugaccuucccaccuugccuuggcgauuuagggcaucaaaaagcuuggcccccaaggcacucacggcgaccguggccuucuaggccuggccgccauacgcccgcccgccaaccgcuuccaaccaacccagcaagcacaaccucuuug

SEQ ID NO: 1317 - RNA, 62524 nt, Mus musculus
cggggaggcacucccgcccccaaacaccucccuacugcacaugcccggcagaaguccgcgcaacuuuauagggccccauugccccaucucuccucagucuccucuauccucucccagacgagaggaucaguggaggcaccucucggagucuuagacuucagagucugagacuuagcgagaggagccucgaggagacuccuucucucuucuuuacccaucccuuucuuuuacuuacagccacaagcugaggcgcggagcuuuagaaaguucgcagugguuugaagguagguacaucccuucuuuuugccccgaggcgagauuggggucuucagaccccagcuucucuccucauaagguuaauccuuuucggccccaacaguccuugcgcaguggggccacucucugcagagccagagggugagucggcuucucggugagcaccuaagagaauggaucgcaggucccgggcucagcaguggcgccgagcucgccauaauuacaacgaccugugcccgcccauaggccgccgggcugccaccgcucuccucuggcucuccugcuccauugcucuccuccgcgcccuagccucuuccaacgcccgcgcccagcagcgugcugcccagcgccggagcuuccuuaacgcccaccaccgcuccgcugccgcugcagcugccgcacagguacucccugaguccucugaaucugagucugaucacgagcacgaggagguugagccugagcuggcccgccccgagugccuagaguacgaucaggacgacuacgagaccgagaccgauucugagaccgagccugaguccgauaucgaauccgagaccgaaaucgagaccgagccagagaccgagccagaaaccgagccagagaccgagccagaggacgagcgcggcccccggggugccaccuucaaccagucacucacucagcgucugcacgcucugaaguugcagagcgccgacgccuccccgagacgugcgcagcccaccacucaggagccugagagcgcaagcgagggggaggagccccagcgagggcccuuagaucaggauccucgggaccccgaggaggagccagaggagcgcaaggaggaaaacaggcagccccgccgcugcaagaccaggaggccagcccgccgucgcgaccaguccccggaguccccucccagaaaggggcccauccccauccggcgucacuaaugggugacuccguccagauucuccuuguuuucauggauaaagguuaguugcccugaccaaacuggggucccugagacaguagggugggaggaaagagacagaugggaggcaaggugggaagggagcggugcccauuaaucagcccgaaaugcaccccggaaaaggagagagggcucuucaagucucuccagggcacccaggggcgcuugggaggccaaagguuuguuggacggugaggcauuucuggcgccucgcuggagacaaccugagguccccgagcugauacccggugcgcaacauugaauucggugugccacacugaauucccagcgcgccccagguuuggaguuacauacauaaacggcaaagguaagucacuuguuuucuauguucucuccccuccuacagaaguuagucuucagcaacggaguuggcuuuagguagagcccacugggcucgauauggaggugcacgcaccaacuuuggcgaucugagacugcugcgccauagcuacaguauugcaaugcgcagaaaguaacugcguuugggauugggugacaacucuggagccuaaaucgcacguggcauucagccggcgcggagccuggaaaucggguaccggcauggccaauuuggggccgcgggacccuggagccagugccuccccccacgccgugcaaguagucuugguuaauaccgcucaccucuggagguucgaggaggccugagaucgugaaaaggggcgcgcgcaccucucccgugcguccuaaagccaaccuucccgcgcagaaaggaguuucuugauaguggauagugcuuggaggacacucaguggugguauaggguucuuuacgggugcccuucugggcuaccuggguuggcagacagcuaggaucacaucgggguaucgcgcagcugguuaggcagauccgacuuguccggagagguccgggacugugcgccuaggccauagaggcaggagagaaggaaugagagcaauaagaaguggucuugggaggaaagguaaagcgggucaaggcacaggcugaguacggaggucguggcuaucacucugacaccuucaaagguguacccaaagaucguggcacuuccuaagcugggaagaugucggauccugcgcuuuggacugagagguggcagggaggaugcgcuacagccauuuuggccaucuucagcucggguggggcuguuuuuggaaccuguaaccugugggggaggggagaucacccaccggugaucugccccagcaccaagcacguaacgcaccuuagaaugcuuuccccuccagccuugggcggaaaggcugaucuuaaguaaaacgcaccuacuguaucucacccauuuagaaacuuuuuuuuuuuuuuuaagugugcgcggcuggucuugcggcggcuugagauauuuugaugggaugauuugggaaaucugguuaagaaacgcaguuucaaagcuugaaaucaaagccggcugggcuccugagcuccuaagaggagaauggugcuagaaggaacacauuacguagucuccuuccaggaccuacccucuuuccugggauggcgucgcagcccccagaauuuaagugagggugggcugugcgcacugcggcuaauugcgacuuuggucaacagcaggaagcaguuuguuagcaguggguagagaaugagccgguagcuugcggaaaggaggcgggggcuuuuggguugaaagcgugaaauugccuaagugagacauuauuuuuccuaaguuaaaaugcucggcaacgaaaaagaugacgugacguuuucuugacguuagguaccuuuaugucuuguaauguagccugaguuuaccaagcaacagguuucuaguuaacagguggagaagccgcacuuuuuuuucagcaguuagauuuuuuuuucauuagcuaaaaauuaggaugcugccuuguugcugggauaaauaaaaauuuaaaagugucuccaguuucuauaaccaccaccucacgcuguucuuauagaagccuagagccuggcaagguggugcaaaccucuaaucucagcgggggucggguggggauggggaggcagguggaucucugugaguucuaggccagccugcucuacagagcaaguucccgaacugccaggacugcacagagaaaccccguuuccgggaaaaaacaaaaacaaacacccucuccccccgccaacaaaccaaauuuaaaaacaacacaacaauagcuacaaaagaagcccaagugagcaguguaagagaggcucauacccgggguauucaaacaggaacgcgcauuuugcuuucuauuaguaaccuugcacugucuaccugagucacagcagacgcuuuaguccagccugcuaccggcccgcacaacccuccccucccucucagcaccucccccucccuagcgccauccugacuccagguaaaaaaaccucggcgggcuauauaggagcacaccacccuugggagagccccaccacccacacaagagguuuugauaaaacacccaucccaaggccauuuucugugaaauaguucauucgcucacuaggcucaggauuuuacuuuuccagggcuuuucuagcagguccucaaacaucccuaacuagcccuuugucucacccuguuaaagcgggguuagcauuugaauggacuggcaagcccuuucccuccguagguagacuggcugagggagaugcacgugggacaagugggggucggugacaaagcuaguuaaacugccuuccaagagcuuuuggaucuuuagcugcauuaaucguuugcuuaaugggaaaacuuccuucugugguggaagggugcgauuauugagugucuuuuaagugauuuucuuuuuuaaaauuauguggcaauguucaaauaccgugugguggcaaaugccagauguaaguacuguuuaguuuaucaguaaaacuuuuaauuuuauuugugagaauuggagaaugagaugggagguguaaacucuaggauugauuuguaaguguguuuuuuuguuugcuuuuuuaugugccugaagccuuuuauccucugggauugcuuacaaccuuugacucuuuagccuacauuuuagcagcuguguccccuuaacgagaaacuugaaacaucagaacugguaagaauaaaguuuuuuuuuuuuaauggauuuacuuaauuucuccuuuugucaugucaaaagaaaagaggaugaggaaacugagcagagacaacggugugggggcaagcaggacagcagcccaucacaaaagcaacaaaagcaagucaugauaaucaauuguucagggccagagaccagugaugucaccuuguuagcucaaauacugcuuccucugaagucccacuuaguaacaagaugagaaacucaggccauaccuuugaucccgugcuccacaugagggaaggaauguccuguugugggguuuggccacuaauuaaccuaacucccaaacccagacagaaugagaaaccagcagacugagacaaaaggcauaagauacugggugagcccagggugccucuuucccaccuugcugacugccuccggucuucccucacaccccucugccucaguuucuucuuaaagugugcuagcagaacaaaaucguucucucucuggugucagaagggcagagccgcaccucuagcuccagcgacguucccaaaucucaaauguuugacuaaauaaaaagcacuaacugugaagaaguguguuuguguugucaagacucacugcguccaguccugggggcgggguuggggagugugagcgagcacuccuaagagcaccuaucaaugcuauguugugcuguucccgaauucucccccugugguuagugucuagaaugaaccuuccagaacccaguugguacaagcccauuagggaugcuagcuacgaaauaugggagacagcaagcugacaguacagguuaaguaauggcuuagaggcucuagauaguugggauaaacggggaaguguuucaccuccuguccauuaucauucccucccaggggcuuuuuuuccagccauauccagccagugguuccugucuccaguuuuaguacucacaucuuuuuauaugcugcaaggccugguaauagcuaagcucacucucacacacaccacaaacaugcacacacguaucaaacacaugcacguacucauacaaacacaccagacacucaauacucauaccccagauaccucucacaugcacaaacaccacacucauccacacacauacccgacacaugcaccuacucauccacaaacacgacagacacucaugcucacacacaagcacacacucauccacacacauacccgacacaugcaccuacucauccacaaacacacgacagacacucaugcucacacacaagcacacacucauccacacacacacacacacaaacaucacagucauacaccacacacacucacaagcacaccagacauacucauacacacacacucauacacacaagcacacccacaauuauacacacaccagacacucauauacaaauguacccacucauacacauaaacacagccacucacacaagcacaccauacucauacacacacaaacacacccacacucacucccccauauguauguauacauacauacacacacacacacaccagacacacacaagcaagcacaccacacucauacacacccacacucauaugcacagcagacauacaccacacacucacccccagacacaaacacacagccaaauuuggcuccacugcugaggcaaacaaagcaaacacuucucccaauaaucggcucugcaaauugacuuuuuauugaccauuuauuuauuucauguuuuaaccccuuuggggcauuuaaaaauuuggucuaauuuuacuaguguuuguuuucuccaagucuccuagauagggagccccagcccagccaugaagcagaacagcuggcauggugaggaccagaggacagacauagccuagugacuuggauccccugagugcaggugucugcagugcagagcaacaucacuuauugauagugcucagccacagaggcgggaggccccaggggagcucaaaugugcacauuccuauguuuuuuccuaugagccuauuuuaggguaaacauguuacacacuagcaaggggauguggcugccccaaggugaggggagcaaaaaggguuguggggacccagggaguaaaagaacaugcuauggaggcccgggaaggagcacacagccaacacauuucaugggugcacaaaagcacuuugaagagauagggaaucaaaccauugaggacacaccaacuauggcaggcugaagagggaggaugggaccaggugcaacaaggagcaucgacaccucagggugaggaagaguauuuuuaauagccaaagauggacacuagaggagaauuucagaucagucacccuugaggucaccaucccagucuuauagaccuagcuggggaauuucaacuucagcucuacagaauggaguucucauaaggauaccucaaauucauuaaccaaaaagacuuaagagcuacuaaccuuacuuaaugguuuuuaaagcauuggguuuugacucaagaagaccagccucugaggcucccauuccuauggcacaggaaugcaggaaugugggccuagaguccacaggcuucucccucccgcaggcaauacccggcugauucuccuggcuuaugugucuguuucaauuagacuucauuaggaaaauuugcuuuggaugauugagguugccugaaaaggugaacaacacaauccccucaaauucaaauaauauucaggccccgaagccccugggugccuacaauucccaccaugaguuacagaaaucuuacauagccuuucuauuaaaucuaaccgccuucugggaucccagcccccacuccuuccaccccagcccgccccuccggcagacaccuccccugauuguuucucucaucugcaacaggcacuucucccucguggauucagcugcauucucagcuguucauguggacaccuugugcaggcacagguggcaggagcauggcaagcuaaggcacaauuugguggcucuuccacaaagaaagccauugauaucaagccacugcuaauaagccugagggaggggccugcccuuuaucguggcuuuucauccagaguugaccagcuguauucauaaauaucauuucaucccccuaacaugagccccacaucagucccuaguccaguaucuugcccuaucugcuagagacaucuucccuuuaauuagcauuugucucaaacaggccagccacacagccccuucugcagagcugcugccuccaccggccaaggcuugcagagaugauggcagggagguggggggagggcugcagcagucuuaauugaacaguaauuaauugaacagcuucaaagucuuauugcuacucagggaaacacucagaaaaccuuugucauugggaggcugagcgacuuaguguuugccugaauucuuuuucuaucuucucuuuuucugcaucugguuccuuugccugaaaauuaaugggacacauauguacuauaggcagagaaggcuccuuauaaggcugccccuuccccaaagccauaaaccaaaagaaaccuuacugccaauggucuugcuauuccuggcuucugcauccccccccccccaccaucuugcucacuccacccucccuucuacccaagggaccuuuccuacuuggcuuucucuuuugcggccacagggauaaaucaaagacguuaagaagcaguuacuugggguaucuggaugggccuugggcuuuuagcagaaaacaaaaaccccaaagggggaaauauuauauauacacauaaagcccuaaaauguaaauauaaauacaacuguuguuguaaacaagcacccagcccagggcaccacagaaaagugggaccacgccuuuuuagguaaggaagcugaagccgagggagagucagcuucuuuaugguuggugugacuuucaaaaggucaccugauuauuucugacuugagcgucugggccaacugcacugagcaagcugccuuuccucagagaagcagagcccaauggaaacaggggcacuccuuaccaguccuuucuaauacggaaagagccuccucuccaccugacacaccaucucucucauagccugucacucuagcauacacuguguggauggucgaggcccccaggcuuagcuucugccuuucccaccuaguaagccuuccucugcacccacuccuuucccacccacagcuuuugugacucgccgguggcuuuguuuuacucacaucucucagcauuuaccuccccccaucacaaccauuacagagucagcuggacuagggaugacauaucuuuugccagggagcugaggagaugggcaaacaaaggcgccugauucauggaaccuacacgacaccagaauuagccccaacaaguugucuucugaccuacgcgugaaugcacgcgugcgcgcauacacucacccgagcacacacacacacaacuaagaggggagggaaaagauccuuuccuaguguagaguuguaaugugggaccauuagaaaccucacuccuaguaggguaaggccccaggccaggcacucaccaauugugucagacauguaucgaggcagccagaucaccaacaucaacaggcaccagacagugaaacccaguaaggugacuccaagccaacuuguccacucaucaccuccaucucuuaaccauucuggacuccccaaguccuuuggccaggccauacaguuaccuucugcuacaggcccucuugaacuugcugcuuguguacagcagagccuuuguacuuaggucuaugccaccauaggaaauugagagcacagggcagggcauaaucaggauuaaaucccgagcucuguuuuucccaguaugaauuuaccuuuaaauuaaagugccuuuuuaaaaaaaaauuauuuuuuauuuuuaaagucaauguaaagacuuucucagcuuuuccagccaggggcaacucuguaucagaggccaucuguacaaacucugaggacauugauauuauucauacuaaggggaugucauuggcaccugguagguuuagacuagagaagccauauaauauccugccucacacaggacagucaccauaacaaaacauuaccuauuaccugccccaaguccccagugcgaggcuaagaagccaugaugcacacacaagggcugcucccacuucagccucuggagccugcccugcucucucucucuccuucuggccucuccuuggcuguaucccuccacuggagaaauuuuaucugguucauuuaucucaaaccuuaguaaggcugauggacaauuugaauuuuugccuuguacccuucuccuaaacuucagaccuuuccuucccaggaauuuauuguaaguguauguguauauguguguguguguguauauauauauauauauauauauauauguauauauauauauguauauauauauauacacacacacacauauauauacauauacacauacauauauauauauaguaaauauauauuguauauuguguguguguauauauauauauguauauauauacauauauguauaucaaaucguccaucuuccuuucaauucugccaugucuaaaauuaaaaaaaaaaaaaaaaaagccucuaccucagcaccagccccuccccgacucuauguaauucccaguguccaaaacccaggugguagucuuugauuccuccgucuuuugugacuugucuaauacgagugcuuccaggaagccucuggaacccuuaagucucuuuuauccacugugucugggucucucuucucucagggcuuccgcggcugcagcuucuuugugcacagcccuuccuuuguucccuuuaucggaaccacccuccauguugguucuguccuuucuaaaagcuugauucaaauccugaucugagaaggagggagaaacacacaccuuucaccaucuaccccauuuccuccucuccacuuccugcccaaagagcccggaugcugcauggacgccucagaaagcacauccauuuucucccuucuuucccacugcuccuacaggagcaaagguguccguccgaucauuuauguaaccagaccccacacuuccuuacauuggacccuuuguuccagauaggugaaggugugcccgcucugccccgccccuucuauucagucaagacaucuugcuauggagacccauuccaggcgccauuuucuccaucuggucuuugcaaccccuccuauuggaggccuucucuuuccauuuucaugccguucugcucuuucacaaggagacuggcaugcucuggagguuucucccugucagagaagcacgauauaagaaagaauguggaacaaaggauucucacagaucauaagaaugucugaacaaagagaaccugaaaccauuuuuuuuuccuuuuggaugaauggugcuuuagggaugggugugagaggccuggagagcccacaagacccgcguggcggucuccuugggucgccaaccucagcgucuacugaccuuucaccuugugcaggguucagcaucucugggaaaugaaaucuguccaucuuguacugcucgucugcaucggagcaguaagcucucuuucuccauaggccuggcccaccaccuccaggcccuggaaaagccucucuccgcggugccucggcgauagcccucucuguguagugaguuagccuaccgccaucaugagcccaagggaugguccaugggggucccugaccuucccaccuugccuuggcgauuuagggcaucaaaaagcuuggcccccaaggcacucacggcgaccguggccuucuaggccuggccgccauacgcccgcccgccaaccgcuuccaaccaacccagcaagcacaaccucuuugggcguuccaacgcggcgcccccuauuggaccucccacccauauccgguuuccgguccgaagcccccugcucauucgccaggcauccuugauuggcgugaccccagcccaauagcugaccugucgcuggggucggaggggagugggcuagugguugagacccaguuggccuauucgguguauguucaaaccguuucgccauuuugaguguguguguguguauaugugggggaggguaguuggccaaacuuuggaccaaaguucaaaguguccggcaugcaguguguucagccguagaguugaggugacacgccuucggcaggucgcaggcauucucuggggguucacuuugucugcuuucuucuacucagggugaccacguggacgcuguaggcaaggggcuguagugugccgagccuguagugagaagagggacauguuagacuucagagaauuaaaucugccgcggcacacagcaugcaucuugcaauauacccaucugcauggugcauaauugccgcagccugcuuuauguaccacuucauacucucuuuucucaggguccugcaggccagaccugcccacugccuagcuguauugcaacaaaagacaaugccucgcgccaucgccauuaccuacuggcaaaauguccgcggugugcgcgugccgcgggcgcgcggcaaaacaaaaaaaaacagaaccccaaaggcaaacaauuaacaaaaaaacccugcccaggaauaaucugcagaucccagaccuaaagcauuuuaugauuauucgcugagcccaccgggcaaugugacuguauaaacuccugcagcucugagcccaccccggcaccgcaaggggcgcgcagccgcaggcuuugugaccgcgcuuaauuucgccuggguggacuguugcaguucaacguauagcaaaugcucuauggugcucacaacagaaggaggaggggauaaaagggggcuggagaagggcuugagagaggaaaugaacacggaauccgcagcuggcgcugguggcuggaagaugcgagucucggcagcuguugccaccauggcacgguuggucgguggguuaagugcauuucagguuuucuagucugcgagaccacccuaaaugggccaucaacuacaccccaaaucuccuuuugccuuuacccagaagacagaaguacaagaccugagcuagguggggggucuuccgguaagccuuaagcccccuccccuauuugcacgaaagcggcaaacaugaauaacuccuaagggggcuuugcuugauuuucugcagugcacugcugagaccuuuauuucuacugcaucaccguccauauaaacagagcaagcccugacuacaacacacuauaccacuguugagagcuccgagguguaauggggaugggggacauugaagggauuugcuggagccauccccaacaaacagcaaacauaaacauuaaaaaaagaaaaaaaaaggaaaaaaaagaaauaaagaaaaguacccuagagcauuuacgaaacaaauugcguguuuacauucggcacuuccucacccugucucuacccuuccggugggcucacgaccaccugucgcauuugugugugugugugccucuaccccuuuccuuguauccuaaagccuccauuuccugacuuggagaugaguauggguaauugccugagugugggguccuuagauaaggaauuuaccgcauacugggguaaucuggggugauaaagcccuccugcagucccuccuccccucgagaagaaucagauggggagggaggcuuucagcgucuguacucuaacagaccaaugcccacgucuugcgucacgugucccagcaacgcaagagagcucgcucgcucucuggccagggaaaaagcgagcuagagagacucggaaucaguccgggagaggagaggacggagccgaacgucccuacaaggccuccgcucaucagcccccuuacccaaagucgggagcagccggcaccgggagccagcucccggagccggcucagcacugagaccugcguccucuggcggcagagaaagaguucuauuuacgauuuucgagacgaaucggcacgcucuuaaaugccaagaaggcggagcuaaaguacagcaaaguacgaagagagaacagaaaaguuccuaaaguuguuggccgaccacagcccgaagggguaaguguaacuaggaaggugacagacuucaccagcaagagaugacucacuucagccaugguccuggguucuagccccugauuaucuauccuuacaaaguuuggaaacugaggcuggagaacuuuccaacaaaaauuugaauuuuuuaaaaaaaaauuuuuuuucacccuaguuuggcugggugcuccgucuuacggggccccaaauuuauuuugaaaagucgccaccguguuaugggcauguucaacugccuccacggcaauaauaugucaggacaacacgauauccccccugaagucggggagcagcccgagcaagaaccuuuggaagccccaggggcagcugcccccggugcuggggcuggcccagccgaagaaauggcgaccgaaccggacuccgaaccgucuaacaaugagcccguccccgacgagacuggcagugagaucaguggacccccagaagacuccaaaucugacauccaaagccccugccaggccuucgaggaaguccgaguggguggagacuacagcccaccuccggaggaagccaugccauucgagacacaacagcccagccugggagauuucuggcccacccuggagcagccaggaccaucugggaccccaucaggccuccaagccuucaacccagcgauuuuggagcccgggacccccacuggcgcgagcccaggccugggagccuauacccccccaccagaagaagcuaugccauuugaguucaacgagccugcccagggagaccauagccagccucccuugcaagucccagaccuugcgccaggagguccggaagcauugguccccagagcucuucccgcggagcccgggaacaucagauuugaaaacgcuggcuuccgagaagacuacagcccucccccugaagaaucugugccauuucaggucgguggagaagaauucgggggcgauagcccacccccaggacucccgcgagucaucccacaaaucggcauuggcggcgaguucccgacagucgcggucccgagugcgcucugccucgcucccgccgagaacgcgccuccccucuggguccgaggcgccauugacagaccauuccgcgaggcugucagaucuccuccuaacuucgcaugcgacagccccccgauggagaucaccagaccccugcuugagauuggcagagccuccauuggggucgacgacgacaccgcugucaauauggacagccccccaaucgcaagugauggcccgcccaucgaagucucgggagccccagauaagagcgagugcgcagagagacccccaguugagcgagaagcagccgagauggaaggaagcccuaccaccgccacugcgguggaaggaaaaguccccucuccggagagaggggacggaucuuccacccagccugaagcaauggaugccaagccagccccugcugcccaagccgucucuaccggaucugaugcuggagcuccuacggauuccgcgaugcucacagauagccagagcgaugccggagaagacgggacagccccaggaacgccuucagaucuccagucggauccugaagaacucgaagaagccccagcuguccgcgccgauccugacggaggggcagccccagucgccccagccacuccugccgaguccgagucugaaggcagcagagauccagccgccgagccagccuccgaggcagucccugccaccacggccgagucugccuccggggcagccccugucacccagguggagcccgcagccgcggcagucucugccacccuggcggagccugccgcccgggcagccccuaucacccccaaggagcccacuacccgggcaguccccucugcuagagcccauccggccgcuggagcagucccuggcgccccagcaaugucagccucugcuagggcagcugccgcuagggcagccuaugcagguccacuggucuggggagccaggucacucucagcuacucccgccgcucgggcaucccuuccugcccgcgcagcagcugccgcccgggcagccucugcugcccgcgcagucgcugcuggccggucagccucugccgcccccagcagggcccaucuuagaccccccagccccgagauccagguugcugacccgccuacuccgcggccuccuccgcggccgacugccuggccugacaaguacgagcggggccgaagcugcugcagguacgaggcaucgucuggcaucugcgagaucgaguccuccagugaugagucggaagaaggggccaccggcugcuuccaguggcuucugcggcgaaaccgccgcccuggccugccccggagccacacggucgggagcaacccaguccgcaacuucuucacccgagccuucggaagcugcuucggucuauccgaguguacccgaucacgaucccucagccccgggaaggccaaggauccuauggaggagaggcgcaaacagaugcgcaaagaagccauugagaugcgagagcagaagcgcgcagauaagaaacgcagcaagcucaucgacaagcaacuggaggaggagaagauggacuacauguguacacaccgccugcugcuucuagguaaugcggcagcuucugccccugggcaguagggccgcccgggccgcccggggaggggguggcagggccuuccgguggggcuugggccuugcccgcgggaggaggggguccggaaacccuguuagaaguuccagggagggacccccaacucugcccuggggugggagaggggccuuuuggagaguucggguggccgaacuauaugcccuccagggagaaaaguggugccgagcgacacugagggucguuaccggccggaggccagcgccagcgccagcgaucguaggcuggacaggcgggggcgugaggugagcccagaacugcuggggugggcccuucggggcucccccggcucgauuguucgugaccgcggugggcuagggccauccgggugcgcgcccccgccucgccuggcacggcugcuucgacucagacagcuuguuguugguguguguugguguccauuuucuguguucgccugugcaugacaugcucagugugucccaguauccaucccaggcacuuucaacguacccgccgauuuuauauuuguacucuaaaauagguuaccuugugauuugcgccauggcgcggccaaaacuuuccgugcugguacacucuguaauaaccugugugcagacucucugcagcgagcagagggaaaacgcgcaggcaacgguggcguggcauccuggguaaucugcugggccgaugacuggggggaguggggccugccgccgcgggccuccauaaccuuuucccgguaugucucucucucucuuuuccccuuugcgcuaagcauauccucacuucucaauacguaugucaaacccucccgccuuaacgguugaaaaaccagacacucagggcuuugggguuguucaaaacauguguauuuuguauucugugcacaugcacacacauacuggauccaccugugggggggggggaguagagcaggaggaagguuugggggggguaccuuagcccugcuggcaaggccacauucaaaacacacaggguuaguuucaagggagugggcguggcuggauuuaaauauauaucuauauauauaaaauaauuuucuccuuagcgaagagcccgagguaaggcaaucacuuauauuuuuacaauucguggcaggaagggccuaguuuaagaagguugggaguuguauguugggaguacaaucuugccuuuguauuuuaauugcaauuaaaaauaaaaauaaauaaauacuaaaugugugaacacugcaugggaagcuggggauagccuugugaacuguguauauguuugcaugucgaucuuuuuuucaagcagcuuuagcugaggacugaagguaagaaauucuaugcaucaguugaggaugaaaaaaaauaaagauuuuuuuuuuuaggaugacgauuaaagaaauguuaugccagccagauagguaccuuuugaggcccucaucuuccaccgcccacuccccagcucuccauguccccagcucuucauguccccuccccucgcagaaaccccuccccucauccugcagucagagccccucccaccacagacuucucauuuccaaccugagucguucauucuucuugccagauuaaucaaaacagcaauuaacaauggucuguaucuauagcuuaaauaaaaucuucaugagugaaucuccacaauuaauuuauuuauuuucucaaaccugucaagggaaucucaggauuacagugucuaaggcugugcuccauuugccugugagauauucgauaaucugugaugguauuuauuaaagacauugauggugugacuguguugcugugaugugccacaaaucauuaucuuagacgggauggucauuuuauuuaugccuaccugggggaaguauugguaucauugaaucaaacacacggaaaggggaaguugcuauaaauuucaaaugccccuguuacgugaaaagcauaguccccuacaugacaaggcuuggacuucacugcagguccauuuccauacucugagaagcugaccugugaguugggggugggugggggggacagaugucugcagguagaugaccuaagugacucugcacaucugaaucccgguuggucccuuauacucugaggccuuagucgccucguuugagaagcaaagcucucccaggaaauuuucauucaaguguccugcaguaacaggacuugggucuucugucuuagcccccacccccaauauaggaagaaggagcuuggaaguuuauacucucugcuaaugcagcucucugcaccaaacaucagaucugaggccagcuucuuucagaauagcaaacguuucccccuuauaucccuuagauuuuuuuuuccuggaggggauuauuaaacccaaacagaagcacauuuuggggagggggggggguaccauggcacuggccugucugcccuuuguggaucucagccacucugaccuuucuaugcagcgucauccagaaagcaggcugcucagccuuggccuaggccucgccugagccucuaagauggccacugcucccugcugccugugacugcaguagcgcugucugucaaagcaggcugcaguuucccacuaggcugcuuucauuucgcugaaguaacaagagagggauuguaucugggucccuguuauugauuggggagggucgaagcagaaggagaggauuuacucacaguuaugagacuuuuucacuaacugucuagcuucauuacguuaaacgagguaucuaugccuucugcccccugaaaacguagaucaaaugaccauccugaagcucuucacguaucacauccacagucaucuguugcuuuaaaaaaaaaacauuuuucugugugcauacucuguuuuuauugcccaaacaucauagugcuagaauuauuuuuaaagauagaugauagauagaaaaauagaaagauaauaauucaauaaaaauucuauaaugucuagagagcugaggcuuuuuaacauaauguaaucaaggccuguuuucauguuucuguuaguuuaaaaucuguggauuuuuuuuuccuuucuuuucaaaacuucacuuagauauuauuucuugguuuagaauugcaaggggcuacuagaucagucuauuuuaguaucucuugccuuuauuacaagcagguaaagcacucugaauaauaugaccacuauaguaaugccucauuuuuauagcaaaucauaauuaauuauauaauaauuuauuuggcugccaagugguacgguacugcacugcaauucaccgugcagauuguuuuuuuuuucccccuguauuuuuuuuuaaugcagccauuuucuuuuucuaaauucagaaggccuccacugaauuguuuggugcagugggaagcccauagugucccugacccccaaauuuagaaguuaaggaaaauuugcaucuuauuucccaauaacaucugcaagaauaacauguuuuacagagauccuuuaaaaaaauuucaacuccucucaaaaacauuuuuuucuaaauagguaauuuuauuuuuaucuaacucauaugaucuacccugaggagaugguaugaaccauagggaagggggucacccccaguauuggaaagggggguggcucaugcuuuuaacauuguuaguggccaucaaugauaaugaugacauguuuuaauugcauuuugcauuuuuuaaagucuucuguuuagucacaucagcccuuugaaagaguucugggcaguaagagcacuucaguaccccauuucaugagcacuucaguaccccauuucaugagcacauccacuccacucacacagauuaaaggccagggccucuuuuguuuuuuccucccaaagguagcaagguaaguaugugaaggacccaggccucuaacucugaggugcuaacgcucaccgagcccauuugaaaaauucuauauggcuuucucaaagaugagagcaugacaguuggaguguucucugugaucuuaaaaucccuuguuaaaugacaggugucuaacagucuguugcuuucugaauucuagccagacccugacagaccacugacuguaaaugucuauugagugaacaugaaauguaagcugcccauuugggggaagccauuuuguggaggcuuaguacucauguuugcuucacugcuucccaacauaacacacacauauacauacacacccacauauucacauacauacagcacauauacaacacacauacauauacacacagcacacacacauacacacacaacacaugcauauacccacacacacaacacacacaaugcauacacauauauaccacacacaacacaacacacacauacacacauguacacauacaacacauacauauaacuacacaacacacacaacacacauauacacacaacacacacauacacacauguacacauacaacacauacauauaaccacauaacacacacaaaacacacacaauauaacauaaacaaacacacacaaauacacacauaaaacagacauaauacacacauaacauauguacagagaacacacacacacagaacauacaacacacacauaugcaacacacauaccacaccacacacaaacagucacacacauaccacacauacaacacacacauacacauauaacacaacacacaaacacacacauauacacauaacacaccacacacacauaugcacacaacacauuugcuucaccccacacacaaacacacacacaagcuuuuuuuuuccuuuuguucuuguuuuuguauauaauguagcuuuucuuugacaucuuuuccgagaaaaaaaaauccccgaauaguuuucuuuagcagagcucaagcuuauaacaacaucaacaucaguaacaacaacaacaacuauuauuauuauuaauuauacaauuauaguaaauaacaauaaugauacuacagugcaguuguuuuuguaugcacaucccuggaugcgcagugccacaguacacaaacaggaucuccaauagcuuuucucuuccuuauuuuuaguuuacaacuaagucccauuuuuuuauuuaucaagaauccaugcaugauuuugaaaagcauuugcuuuguugauuuauuuugaugcaggacauuuaaaauuuuuuaaaagagaggauagcauaguugauuaaaauugaaacccucaacucuaggcacauucccccuuuuuuuuuuuuucaaucaguuuccccuccaaauaagauguguccacucacuucuuagcaagacuaugcagcuuuucaaauguugcugugucuucuaggaggcacagaaacagcaaaugaaaauuaguuucuggauuuuuuuuuagccuaugacacagguuaaaugcaccuuccucuucccacaguuuucaugaacuuaaaauuaguaugcuuuuugccucuuuuaaacuaaaacuucacagaaagaggagaacuuuuccaagcagaaacaacagggccacagugagcagaggccaagaacuguggacacuggaauucgguguccaugggccuauggucagcagacaccaagucucugucugacgcccaccuauuaaggucuuuaguccgcuggauggagugcccguuguuacaucacauuccuaggcugaccuauggaccccugaccuagggucaagcucuucagagagacuagaaagaaaauggguccggccuuuccuuuggaguuucagaugaaaaaucuuugaggccuuuaugcagcuuaagaauacuuagugggcaguuucagaugcaagcugccagagggggcuuaguuuccagaagacucugagagaaggauuucuucuucuucuucuucuccuccuccuccuucuucuuucuuuaaagggagagccagauccugggugaagcuuuuuaucguguaagagcuagaguguuucacaugugagcucccccaaauguuaaguuuacaacuucuuuuuuuccccuucucuauuucaagugaggcuuuauuuuauuuuuguauauuuucccugagagaccguuaacuugagccuaggcacuccacacuuccggcuucuacauuuuauaguucacuccuuguuacaggguuuguaaccacaaguuaacucaaacaauagacaaaugacaucuugccaaauuuaggaugauacgauaauguggcagaagaaagagaaaacccuaagagggucauuuuccccccuccugaacaaguaccaucugccauuccugcuuguuccuccucuaccuccccugggauuagcuaccuauguauauacuaguucaggauuguuagauagcucaggggucaaugugguuguuuuacaaaaaaaguugucucuaguuucccuucccauaaccagaucaccgcagaggcagagcagcugaugggagcguggaagaggacaagaccccaagagagagguaaggaccuauuccccuccccccagcccccaaaauguuaacuuuucaaugauugccaaccaccacagacuugaggggacgcggaaugcucuggucucugacacaagaccuuugaaguuagaauuauuggaaguauuuugcaugugccacacuggaagcgguaaccaaggagcaucaggcaagugaucuaugagaggaccagaaauacuaaagaagugugcuuccgggguccugagguaaaaccccaaacugcccuacagagugaguuaugaaggcucaggagaauucaggaauauuuugcguuaagaguccuucccacuaaacccaaauaauggaucuugcuaaauuugaaugauuuaguuaggggugaggagagagguauaaaaguuacaauugguacccgauuuaaaauuugaugugaaucaguugguguuucugacagucacacacauuuugugugggggacagugcaagcacuuaaacuuugucuccuuauucuuugauaaugggaagggggaaaacgcuuaugugccugccuucucaggagugucacggucgagcaugcucacugccaccgcuaacggagagugaccucuuaugaagacuucagaauggccagcuggagccucucuucugacuugcuggcucuugccuguccuucugucaaagguucugaauaccucucuccuccuacauaaccaguuugucccucaccaaacugguuguuaacguguaaacaacuccgaagacauuccuacagguaaccugcacccagguaaguccaaaacugcauuuuuuuucccacaacaaaugucaacaugaauggucaugaugacacacaaaacccaaagcuaggcacagaugagucuaggaccccagagcuguaaaggaagugagagcagguauccuagauauauugaguccccuggggcuucugagacccauccugggccugaaccccagauuuuaaggcaguaaaaguagauuaccggucucacugaucccuucauuccccaaaggauacagugucaagagcagguggcauuccuggggaagugcacagguguauaguugcauaguggauucaaacauguccuuucagaacagcacucucuucaaccuuuuauuacacguggucauccuuaaguguccaagggccaggaccaaagcccaaaaggucacuucuugggaaaggcagaguuuauuuguaauuugucucuuaaguuguuguauguugguguuacuauuuuuagcaugucuggaaaguguacgucuuaauuccuugcauuugcaucgaauggcucuguugggccuaguguaugcuuagauagcuuaucaauaaaaucaugagucacccaggagccuccugccugcugucuccuggguaaucauuuuuuugguggugggcuuuagaaaagucuagagucaguaacuaaggguugauauuucagguggccacuagauggugagaggguauaaggcaggagagagaggacagggaaggccagcaaggugggaaggacucuacuuuacuuucauucuuugcccgcaccuccacauuuuguauauuuugagcuaugacuuauucuuuuuagcuaugcacugagacuauaggaacauuuaaaggguaucuauuuaacaaagggaucuucuaagcaacuccauugacauuuugucacgggggcugggaccuguucugugcacuguagauaucuaauaucagacacacauaaacgugcacacacauacacacacacaagcacacacacauguacacauauacacacauauguacaugaacauacaaaccaccaccaugaucaccaaaagcuaccacuacacacauuuuacacauacauacuacuacuaacaacauauuaacaacagccaccacuacacacaucacacacccacacacagacacacacacacacacacacacacacacacauacacacacacacacacaccaccaccaccaccaccuucccacaauuaaguaugauagcccaaaucuuucuaguguccacuaaaugucacacaugguugagaguuccccucuaucccuuguccugaggaagcuagacaucgcacaugguauagcuuguucaucuacugauaagccaucugaaggaaaguugucccuuuuacuaaccaaucagcaaugugcacacuaaucuuggacacuacauucuugaauagaagcaauuuccacacaugucugagagugacccccagaugacccuaaauaggagagaagaagaaauuauuucaggcaaauaaacaauguauuggucuaggacucugauagguuaauaccuaacuagucaguggguagccaguaucaggggcauacauugauuuuuuuuaacuuuauaguuguacauagggcucuuuaaguuguaauaauuagcaucgugcuagccuguucccucugccuggugugcacugguaaauucuguuacuguagaagggauaugaauauccagacaacaagggagggaccuguaccucccguguacucacagauacuaaaaguaccuucacuuaaccugugcacaccagccuuaaugagguacaugccaaagacagccauccacccacggaaaggugaccugccaccuuugugugugguaaugaaagugaggugaccaccacagugaggagggggaagaggaggaagaagaaggaggagauugucagaaaggaaacagugguuccagaagaaguuccugaccaaagacauuuucuggucaaaaggauugcauuuagggcuuugauaaaaugguugcuauguccccaccuaaaaguagcaucagcaucuauccccaugucuacccuucaggucaaggcuuaguugucacuuuagugggcccaagucaccaaccagcaccuuaucugucucaguucuuuaguuccuggggcugaaugcaaggcuuuaugccaugcugauugggacuguacucccagcuucuaacuucuuaaaagcaaaggcauuuuccaguauuuuccucgucuucaagaacuuaagauuuucauaucuuaaagugagcuaucaggguaaagauuagggugaaucagucaaaacagauugggucugagcaguuagaugccggccaugucagauggggaaccagcauuugacauccaaacuucuugcagauucgcuuagagaauuucagguucugcuaagcaaagugccccaaaaaccuccucacugccucaaugcacaauccuagaaauuaaaaccucagaauguugauuuugagauuuugccugggaccaaguacaacaucuuuccaaggaaaugcuuagaagacucaaggcagaacucagaauccaaugccagauguuagggggaaaguuuuuuuuuuuuuuuuuaaguuggguagccaaaaaacucugggcuauuuauacuucagcauucaugugacuucaguuucuuucauuuuugcucuuaggaggagagcacagaaggucauuuuguuuugccaagcagauaugcaagugaggauuuaagauguacacuuaggagggaaucccacuuucuagugggaguauuuggaaauguuccauguuaucacuuuccuauguugucucaauggggaagaaaguccaauaguugggggagugguguacagagaaucuccaguguuugcagaggguccuaggaugauggagagagcacugguuuaagcucagggguuuugcugggaccuugguugauucuaacacuugaguuuagaguuccaugugcuugcuugccaagugauguccaggaaagacugaugauacaucuugaaguauucaagcuuaccugagguucugccauggccaaagagguaccaaauuucaugaguuccuuuaagaggaagccagaaacuucccaugucucccaggucuauguguaugaaguacucacaagggguuuuaggccaggaacaucuggagaaaguggggcacagaguagaaacucaauuuauuuggcagacaaaucuaaaaccaauguagcgaaagcucacccccagacucaaggugcccagaaguaaaacacuuucacccgggggaguccuugagguagcucccagcgggaggaaggaaggaagagccugauugccuuaaguagaaaagggagcccaucucauuugcaccccaaguucacagcaggagggaggaaacaaaagguccuggggcauuuuaccuguuuguucuuuuccuguucucucucucuucuuguuuuauuuuucuuuucauuuucagauuuuuuucuuuuaaaguaggaucuuuuucuagggagaaccuuucugagccagaauuuauaaaauacauauauacuuuaaaggaaagaagggagcccacuguuuagggcugggaaguaggaaaaucgaaacaaaggagggcuguucagaacuggcuggcagauggcgcuccgaguuuacaauugagagccugguguuagaaaauucaagccugcgccugcuucaggcagcccccucccuuuaucuuccuucccagggacguagcuccgccccaggccuaagaauguguuguuuuggguuuuuuuuguuguuguuguugcuuuuuguuuaagguuucaggacagcaauugauaucuggugacaaguauccccacuuuguagaccuuaggaggucagaaagauaaaauacaguggggugcaaaccuggaagccccuucucucccccccgcuuuggcuuucuguguaacagugcuaagcucuccuucugccaggaacaguucugagacccuaaacauccuucugucuuuuggggaaaagguugggggugggguucuuucccaguuuagaaucuuuuaauucuguuaggagaacuuuuaaauagaagguguugguuagcaucucugcuccccccagguauaacacacacacacacacacacacucucucucucucucucucucucucucucucucucucacacacacacacacacacaccuuuguccuuaccaaaauggcaggugguguaggaaaaacaucuuaggccaucuuuuguccuuuaacaaaugacuauuucuggguccccugccuggagcuaucuuguguagcagcagaggucacaaaguucaucccuuuucacccagccaagggcuggaaaagaaaugcauacauaaggacuaggucccaaagacagugcuuuguacuugcccugaucccacugcccugccuccuccacagcuacugaggaagguacaugggccuuccuagaaggggcugcagacucugcugggaacuuacccucggccacuaaggccagccuuaguacuucauucuccauagcuucuucuauuucucuucuaaaauguaacaaucagagaaauaagauacaaaauauuaguucaggcuaacauuucuguacucugcuagucaauucuuuucaaacuuuguuacaacuuuccuucucucuugcccgcuuuuguuuaucuuuuguuuucuuuuccugaagguuuaaaaggguguuuuuuuccauuucuuuucuuucuuuccuucuuucuuuucuuuuucuuuuucuuucuuucuuuuuugauucuuuacccccacuuucagggcuucugauaugugaacuucaaggcuguccccagguguuagugauauggguauagguaagcagccuguucuaguaccgaugggccuacccaccagaggucagcaaagagcucagaauagcugggucugcuugcaaaugugggaacugguagaauucucuagaucaaauguagacaaccuaaacagaaaaccgccccauauuucaaagguggggguggguggggaggagggaucauccugucuugggucccugggcacuuaguuugaacacacuggaggggaugaaguuuugaucugcugugauuugauggcguucuuucucagaccaacuccaagcacacaaauccuugccuuaacagguaccucacccuccuagagccccuaaucccgucuggggacacaaugcccacuuucacuucccacaggacugaaaacuuucccaugccucagaguuggccuggcccuuuuucuuuuaggaguaauguuauuguuaaaaugaagucauaagauuauaaccccgccccuagcccugacccccagccccaaaccucacuccagccccugcccuguugugaguguccuuaucucuggcuccucacccagauguguagcuaagaaguauuuauuaaccaugggucccaggguucuuuauuuggcuucccccaccccaggcguauguacagaggccaguucccuccuucugccaucucuucacagauccuugacuuaguuuaaccuucucacucugguaggaaacaggggaaaggagucuggauuccucucccccccuugcuuccuuuuuuucugagcuuuugaagucuauggggccuuaagaacuacuugucaguaagaucacuucccuuagcuaguucuuuauuguuggguggugggagggaaaggggagagagggguacaaagggcaugagaaaaagaagccccagaaugauguaugagaagaagagucaagccaagggagaggagagagagcagaaguaaagacuuugccaugucagugcucuaguccagaugaagucccugcccuagggaaacuucaagucuuggagaacaucaggguuucgaguagugaucgcugcccaagcagagauggacggcuaucagugaacaggaauugagcacaucgaggcuuggcugggcuuaauuaaacaaggaggaagaaaagagaaggcucagagggugacuagauuucaagacccacuugggaaagcagcaaccaggaggcuggugguggauccaggaugucaccauggcccuguggggucuggccacuggcuucucugucccaacaggccccauuugcuuucuucagaguuucuuaccugaauccaaaugauuuuguuuaauugucacguuaggcucuccccccccccccccuacacacacaccccuucugccacaaccugauuuucugaguguuuccacaugcuucgcccacugagugguuuuguucuauuuuguuuuaagcaaucuggcacaccauggaccuuuuuugucagaaacagaaaaacaaaacaaaacaaaaaaacaacccacucuaucuuugugaguccuuuguuucaauaauuauccagaacaaagccagggcaguccuauggguggacgugagcacuuuguccacugaacaugcauuucagagauuaaggaaauccugagaauuuuguagguugauggccccaagaauuuggcaccagccagguuccauauggacacuguuuucugucauuuuuuccccuuccuuccucccuuccuuccuuuuuuccaccccaccaccucgcuuugaaaaacaacuuuugaaggucugucuccuggguaccuucaguugggaggagauaauucucuccaguaaggaagaguaagggggaaaagaaggggguacguuaagccagaggacaaggggacaggauugauggcucagcacuggggucagggcacaggcuggaagacaccauaaccagacaauagucaaaagagugcagccucggcuuccuggcuguagucaggaaaauauucugucaaguuuaacaaaacaaaacaacucaaaccccagcccaguugguuaugcuaggacccuauucuuccacauuuggucuuuagauuuggcuccuucucaugauugagauucccccaccaggaaaaguuguugacccucccugacaagcgccaagaguuagaaauguguugcuaauugauuugagcugaauuuguauugcuuugagacuuagcaaaagcggccugagguugaggggagcacaggguugcuguucucauaagccgagagauggacaccuccccaccgcccccaccgccccaccgccccaccgccccacucauacagggaaccuucugugacacuuuggaaucuuuggaaugggggcaucacagugguucugagaaagaaaagggggagauuaaaugggaauuuagcauaaaaucgaugugccagcuuuaggcagagauucacucucuaacaugguuccaaaugaaaacaguugucaccaguuaacguuuccacaguuuugaccauuggcagaccucggguuuacuccucuguagguuuuguuaaccuuggcaaagagcaugggaaacuagucuccuauacauaugagcccauuuucccucccugauaaguugcccccaaauuuccaaucaacauguauguuaaauguucuuguuucuugucugcuugccuaguagccuuacuacgcaugcaguagcugcccacgugucuaccacaccucucaagaggaugaguccugcucaggucggugagucugccuggauuugggcauuuuuauucauucauucauucagucagucaguccauucaguacauaaacacggaaaugugcccuucccugaguggaagccaaaggucuaagacaugguucuccccuuaugguccugugguuaaaaaucagacacaggaaguagacaaugguggguaauuucuaggaaggcauucugugagaguagcuacagaacgcaugcaaagaugguuucaguggcccuucaagagcguucuaacccaagucagcaaacuaaaucagaacugaaaugacaugaugcuguucuaauaaguaagcugcaggaaacccaggagaacuuaucucugagggucagaauaaacagacaucugccucuaggacaaccaacucuucacaucuucgugucagccugaggcugaggaaaguagcuaugguuggcagccagaguacuuucauacugccacagccuucugcccuccuucuuagcucugauccaccaucuuagauccuggccugcccuccaucuuagcucugauccaccaucuuagauccuggccugcccuccaucuuagcugugauccaccaucuuagauccuggccugcccuccaucuuagcugugauccaccaucuuagauccuagccugcccuccaucuuagcugugauccaccaucuuagauccuggccugcccuccaucuuagcugugauccaccaucuuagauccuggccugcccuccaucuuagcugugauccaccaucuuagauccuggccugcccuccaucuuagcugugauccaccaucuuagauccugaccuuuaggacucuuuuuuucuguucccuaaaacagaaagucugcauucaaaugcugccauuaauucuauagaaugaaaauuaucuagaauuugcuuccagguuuucuuucacaaauauuuguagguuaccuauauauucuucuuggaauucaauaucuuaaucuauuccuuucuaauguuuagccuggguagguuccauauacacuuauauguaucuuuaaaauguguauguuugcauacaguuagguuuuguuuuuguuuuuuguuuuuguuuguuuguuuguuuuggcagaugacugaaccaaaagaacuccuaagucaguauucuauaauaaaccaaauuuauaggauccuaaacuucuccuuuacagucucuaccuuucaaagagaacuagaacagggccaugugccuugcuccuuccggauguuuggggaugaguucacagugaauuugagagguggggauuuggcccaggccucuuuccagggcugcagguggcuguguucaguucaguuaaucccaucagcugccaaaggcuuauaagguuacucuuaauaaacaguucugugaggccaaaaugaggaaaagucacauuuuuaauaaugaaguccccagaaauaggagaggggcagcugggcccucauuaccuguuuuucucaccccauuuuccccugcucaggacugccuagcaaccuccaguacagcagaaugguuuuccucuucuguguuccccggauguagaaccccccacccaccacauccccucagcccccauaccuccagggcaacaugcuguguugguaguauggucacuuugauucuuuuaaacaagaaauggaaaguccaggcauggagaaaagacuaagaagagcuaguaaacaagccacaaaauagccucguuguuagcacgaacggcccccuggcuguguggucacaggcagaggaaaaccuggugcuuaguggcacagguugauugcacaccuuaaccuggcgucacugagaggggcauuagccagcagugacucagcugaagaggccuggaugccuauucugacaugccacauacuaacauacccucuagaaacccggaagccugccagguacgcucccuaguguaacuuaaagggggccuuuccgagguguaugauauuuagggagaggaaauuaagcuaauuucgaaagcuccugacaugugaguuuccuuaaaguguaaguaguugaagacaaggaugaauguuacgaaucgcauccauaacauguguuuaaauauaugucacauuccggcagcagagagagcuccacaccccuuagggauaagguccuuuugguguucguuguuguugguuuucagcuuuuggguuuugaauguuaccuaccuucaagguggcuugcaugaagcucugugaugguuaauaggaagaggguaaccuugucacaagaugagacauuauugcagauagacccuucaguaacucaguguccacaccgcauagaaaugaccuucccugcagcuugggugacacucagcuaggaacaaggugauuaauuaugcguguaaguuacagcuuuauugcaagcuugcagcaggaaggcuggcaacaauaguauacacacacacauauacacgcacauacacagacacacacgcacgcacacacacacacacacacacacacacacacgcacgcacacacacgcuuucccuucaagcauuaaaggcauuuggauuuuaucuuuccugaucaaacuucuccacuuccuucuaaauagcuuccucuugccccuuagcuaagccagcagggagaacggccucuggguuuugcuaaauuguggauccugacaaugacuggucugcaaagccagacauggugaggcuaccauuccccaccaugaaaaauggcugugcaggcaggcaccuugcugcagacacaggccagcucaaagcauggacuuuuuuuuucuccucacccucccaagguuaggauuuugcuuagaauucucugcuuccagcuaagaucuccaucagcaaaggggcugauuucaggcagagaaaggaccacuucagcaaaugagagaaaaggaaagaguggcgagcagguucacuccggcagcagcaaagaaaucagccaugccauuucccugacagcuccuuaauuauggugaaagaacaagauguuuucggcuuuuauagagaagucuuauaguagggaaaagggaaagaccugaaagggacagggguugcuggggugcagggagcagacaacugucaccucugaaugacagaugcccuugauaagagaaucucagccccucccugcagacugugcacccaugcccaagucuacaccauuuugcuuuauucuaccaggaggacacugaaaaaagagccagaaaggcuucucccuuccuucuguagggcaaggugagauuuuaguccucgggccagucuuucuggcuggggccuuucuccgguggcuggaagacuuuucaaguggucugccacauacccccuguugaaaauugugcuuucuuuaaggucaguggcuaggucagauaugccauucccauguacaugccuuagaacugaacaggcccagagacaggagucgcuucaggcagaggcuauguuauagugcuggggaggagucagagaccuaaguguugagucuauauauucaugucaagcaaaacucaggaagguccuuauauuucuucccaccucuggacuuaucucuaauccucugaucucaagcaguugcuuggccugcucaaagcucccaaaagcacucuggcaugucuagaaaagaaauaaaagugaauucuaaaugcuuucuuagagauagaaagagccuugguuucuggaaaugggaagguaagagagaagagaguaaacugagcaugcccaagguuagcugugagaucucuggggaugagaacagcaggugugcacgcacacacacacacacacacacacacacacacacacacacacacacacgguguaagccacucaucucugcagccuuuguguaaccauuacacguagaaugucugcuagaagucaugucgcuuuugagagggaccccagccuuaaauguagcucucaggguuauguuuaucuccuacugacuccaggguacacacuacacagucaccucuuccgagacaaugugugguuuucuuuuuccugcccucuccccuuacuccccucacucaguugacacacugucccauacacgggcgauuuugaugauuauuaaccagcagcugacaauaagccaguaaggacuuagggcuuugugguaggugaauuacugcaaucacaaaucaaaccacuuuguuuucuacacgcaggauuaacaaacagaaugccacaucuaugguaucuucuaggaggagggaaucucagguggucaaggguacugcagggucugcucuccucccagcuaagccagguccaagcagggaauuuauccuaaacacuaugcaggguggcucugccugccacagagaugugggaaggaaugaauggccaucucucagauguuaguggauccauguuaggaaaacacuugaaaauauaauagauaggcccuaguuuguuuuguuuucccauuuuuauuuacaaagcaaugcugggggagcugggggaaagauaacaagggcagcaccccaauuuauugcccuaccugcuuauagguuucauuuuaaaaugguuguuauuugaaggagaaaaaaaauauuccagauaccuucaauauggggcuuaggggucagaaaaagccuguguuagagagucagcauucucagugucagaauaagaaaagaguuagagaguuucaucccuuuuuaacaauaagcaggcacucuggaaaaagaaaacagagagauuuuguauaaacacugagaccaugggauccuaaugaugucugaacgacuggguccucaugucagacuucauguugguagagauuggaugguuguucauuuacauuuuauagggugguagaauaaaggaaggcuguacuuuagcuguagcaucaccaaaccgcugugcacaguacagccugaaagccuccuuuucaucuggguagcuuugcucuggugaauuuugagccguuuggcacaccuuaaaaaccuagguuuuccuugguugaaauauguagcccucucugccaucccuauagccuuccaugguccaccccuguggugaccuuucugacuugaguuuuugucuucuuugacacuaauacauccuaucaagcugcuagaaaguucaauuguaaaaacucaucuggaugucuuguccagaagcaaucagucugccugaauauuuucgcccaucagcuaccaccugcccuaauugcacccacacacagccugcaugccguaaggaagcuuaauuuuuaggaaacagaucuaacuacaaaggcagcugaggaagagagcuuacacaugaacaagauguggacaagaugcaggagucucuugccuucucuggguagcugaagaaagaagcuggggaugaggaagcagguuggucccuacaggcaggugggcagggagaggaaaccguuaggaucccagcagcagcagcagccugagaggcagggucugucuagugccugcagccaucuuugauucagaggaagcaaaaucuguucacccuugcuuugucuuagguaacaccaguuugauccaguucaugggggaaaaaaaggcaaugagaaguguuuuuaaucacaaaagacaaaugucuauaauuuuaguuuggggacaaauugacacccccccccuccauuuuuuauuucacagucuccaaaacugagccaagcuaaucaauucccucuuuucucucaucugcauagauaauuuagcuagucucucucggauucuaccucccccccacuucugucuuaucaaugcaguagaaagcuaggcagguggaagagaagauggcaggucagucucuuugugguuuagucuagcucuguuuauaaacaccucaggcaaaggggaaaugcagacagcauccugcuucaccuuccucauuuuuuccucugggguacaggccaggcagaacccaggugugacuugaauauuuuauuuaacacucacagcccccugaacauguaaguuuagcaguuuaccaaguuuugaauagaaaaacgaaaagguuaagaguuaaaaacguagauuuuucaguuguccuguuaagcagggacucaggauucuaaugagucucugaaaucaaagucuuguuacugaaauggagcaauuggugcugaggcugucacaaaacaggcagguggugggacaagggacaagcaaggcuccacugagauaaauuguuuuuguggugauuuuguuucucuccagggcuucuaggcugcuuguagcuagcuggcuuucuuuccuucucucuuuucccuucccuuccucccuccuuuucucucuacccuccacccagguauacauuuucauuuuucucauuuuugaagaaucgagccucuguguuuucuugucauagccucuucuguauccacuuuaaaaaugaaauauuuguuaaaaguccuccccacacccaccccccaaagcuucacuuucucuuugccaucuguaccaaucaaucuagagggcaugaaaguuuuuuuuuuuuuuaaagauuuauuuauuauauguaaguacacuguaguugucuucagacacacuagaagagggcgucagaucucauuauggaugguugugagccaccaugugguugcugggauucgaacucgggaccuuuggaagagcagucagugcucuuaaccgcugagccaucucaccagcccccgagggcaugaaaguuuuacaaaguuaggggaguaagaacaauggaagcagaugaaacuguaaggcauaguuguaaauuauaguauuaagauugcucagggaucaucuuucuaucuacauuuuuguuaucucuaaccuacuucauugacagaaauuaaacuauagagauuauuuaagaaagccguccuuucggugugacaagucacuuuaaauggcuguacuccagaagcuuccgaggugcuuggauuaaaagcucuagcuaggggccgggcaugcucuuagacaugccaccuucuuuaaugacaccaauuuuggugacaagcuuccucgaacccugagcuugcuccagucacagaaacuccgucagaugagcauuagagaagcuagcugcuuucuucugccuucccucaggaagagucaucccggcuuucugguucugugauuagggagcugcaguucccuucuggcccaaggcugaugcuguuguuaaaauguugaagacugagaacacaugcucugcugugccuguagcuggaggcucuuuccuggauggauguaauguuggcaucaguuaauuguggggaaaaucugaguuagaccuuguaauuucagcuggucugugcaagugaugguacaccugucacucaagcuaguguccaagcuacaagucacagcuguagcgugcuuucagcauuagcugguaucguacuguuccuuaggaaaaagaaacuauuacaugugguuaguguuuugcuuauuaacccuuagggaauuucuugggguccuuuauuuguuuggcuaauaggggcgauauuuaaaaccaaucuguuauccucacccaauuuuaaauuacuuuaucguuuuauguaaauguccucuaaaggcaacacacauuuuuaauacccacccccagauauauaaaaccagucugcuuuguauucuuugugaagucagugacauucuuuuaauuuggggguguaguuagcacaaaaggaauuguaaucugagaauauaguagagacuaauauaagggacagacaggaauguucaagaaagggagagaggccacuugcccaguaaugaguggcaugcagaggcccugggauguggcuguagguacagcuaaggccuguagcucauaagacauguccauuuauccaaucuccaggcuucuuacacaugucugguacuuuggggcuacagaauuuucucuaguuggacacuucaagagcgaggcagagaccucagaaggccacagugccaucugggccuggcugguguugagggcacuaccacuggcuucccagcuagcacugagcaugaguccacacaaggucagacagggacuucuucacaucucccuuccaaagagccuuccucacuggaggggcuguacauucuaugcccugggggaaacagguggaguuaaauaauaauuuuacauuuuuccaauuuaaacgugugugagcaaacacaaaaagaugaaaagguaccuacaccucuagaugaauuaaacaugugauuagguaugucacauugauaacuuaauuugggguuuccuaacagcagacaaagagagcgcuguggaacugaaggaccccuggcucccaucagaaucucaguugucccaaaguaggacuuaucaaaucauucacuauuugaaaaugcuuuuuggucagugaaaaccaaagauauaaauguauacucacaaaguuacauucugcuacaaaauauuugcugccagcuuguguuuuuagcuagccuagcucuuacaauagaacuaauuuugaaaaacugaaugcaagggguuggggaguggggagauuguucagaaucugaagauaauuaaaauauaaacauuuggcagaggcuauuuuuuguguguuuuauugagauaugguauuacucuauagcccaggcuagccucaaacucaaacaacuccucuugccuuaaguucacgaguucugagauuauagucaugaacugccauacccaauguaacaaacuuaccuuaguugaagacauuguauuuuagcggaggguuucaauaccuacucuucuucaugucggaucacaucaccaguugcaccaacuuuuacuuuagggaaaguagcuguuaguugggagaacucuuugauagccuuucacccaguaguacucucugcuaggcugguaucccguugaagcuggugugcccuggguaaauggagcugcccucucuuccuucugcacguugcucaugaggccugugguucaugauuaugcugcucacaucuuccuaguggaucuuucucuucuuuaucucuugcugucuagagugguuagccaggagaaucaaacaccguuuagaguuaaauuucaaagggaagagagcuccuauaaucuccuuccaguccccuauuuuauacguuauagggaggggaauuaggcuuguuucucguacagguggcacuugccuaucugggucacagauagucaaugaaggcuacaaaaaaaaccaaaccaaaccaaaaugcacacacugaaaaaaauggguccaaucaccuuggccaguuggauugaacuagacugagauucuauucuaaguuaaagauauauuauuugaggauuagcugauggauauuauucaacugggaaauuucacgugcuuaguucauucuucaguaguugacuuagaacuugugaaaugacauuuaaauaucuaauguagaaugcauguuuggaguuacuuuguaguugaaauacuaaccaguggauaugacaugaaaaaaaaaugucaugaauggucaugacauuggauguuuuaaaauuuaaaauuuucuaguucugaguauuaaagccuucuuauggagauuagccaggccuagaggagcuccacacaguaccugcuuucaccuucaauauggccaaaguugcaaguaacauuuaucugcagccacaguuccagucaucuagcuaauuaaagugcggaaugugcuuugaagauagaaugcaucacuaaguacuauuauuaaagccuuacagcuaaggguucuguuucaguggaagccuaguuauuguuuccugggcuauuaaaauaauaucauaauuguguuuucucuaggcucuuggaaaguagcuuacaaugaccccaacuaaugaaaggcucaagaaaacauucuugucuuaaaacucagcgacaucauuaaguaguaauacaauuucgaagauucuaaccuauagcaauguuguugcuucugaaagcagaugaaacauucacacucagaaagaaagauacagaagggcugaggaaaaaaaauuacaagccggcagaguucaaaccgcaagcuugaagugugccaucaagcuguauauuaggugacccaguauuucagguuaggaauguguuauuucaacuuuuuggcuuuagcaugagucagggaggagccugcauccucucugccaauauauuuuauggucucacuuggagcguuaagguuucuguaauguccacgugucccugacucugaugagaacacuuucuagugcaguguuccaggaauuaugguaauucauuugcuuuacuuucaaaacaauaauguaagugucuaaagcugcagggcaaucuacuaaaaucaauugguaacucacaaguucuacacugugaguucuaacucuggaagacuuuugaaaagcaaaacauauauguagcuuucagggcuuugggcaggucaaugcuaggccgaaaccguagauggugucagcuaaccauaccaauuaaauaaaaucucuucuuucacuuugugucaagugaaaacagaaaaccgaacagaccacaaagcagcuuguguuucaggcucuugguguccuuugcuuaccuauaaacccucgauuccaccugcugccguuuauuuacaaaguaaauccuuucuuuauggaucccugguuagucauaauaaaauacagguaaaacuuaacaguuaaaauuaaaaaaaaaaaaaagcccucccccgaauguuuaaguuaggaguugaauggagagaacccugacuuuguguuacacauuuccaggacaauggucccaauugugccuugccuacaugugucacuguauuccaucagacacuucacucuuuuuaaagauugggugugauauuuaucuaauaggagaagacccacagccucuucauuacacucagcguaugauuauguuguuaguguagaggcauggaggcuguguuggcuguuguuaacuccuuaccuuuuaaauacaauguaucugugccucagcacacuggaagccggaaggaagaggcuuuugaacaacuggagcggaaccgaaauuuuuggccagguccucucucuucuaagucuuuaauuucacaaaugacagaugaaucaaauucaaucaagaaguuuuuguugacugugugaaaaaguaaaagguagucccugucuucaggcuaucccuugccgagaauuaggaacgcaagcacagcuggagucuucccauccacucugguuagguuaaaaaaaaaaaaaaaaaaaaaaaaaaaagaguaucaaccuggggcaguaguugcuuugagguuuuuggacuuuuuaaaguguguguuguaaugaagagaagccauaaucagccguggauaagaaguaaauuuugaggacacagagaaagucagagacugaguuaaaaucagcaaaggcccauuugauaggcucagcuuccugcucuuaauuccaaggcguccuugguuacuuucaaucgcuuucuguuguucuuucgaaaccguuuuuguuuuguuuuuaaaguagacuggagguagagcuguaguagcaaagaccaagaaaaacagugcgcaggaguuuuauauggugcagccuuucugacuuuugaggugguaaacuugagagaaagaguacccuaaaacugcugagcgagugaucaaaagguguccuccuaguuucaaagauagagcuguccacaauaacuuauucgaagcccuucucccucuccccuucaggccccuggguguguuuguauucagagucuacauuucuauuuccuucuccccagcaucccaaguuuugcgaacuguguucgaaaaugaaaggaagacuacguuagaagagaguuuaugguuacuuagcagaucugggguuacuggcgccugcuuugucccauucagggaaggugccaugucuuagucugacccuuggcucgguccaccugggcacaagguacuugugggccgauuauugaaugaaugaaggaaugaauuguuuccaaauagaccccgguggcagacccucaaguccacccgaggaaggugguucaaaaucuuugacuuagcccggugcucucuaccauguccuagcguggccaaggaguggggcgggacacucuugaguuuugaaacaauucuccaaaaaguucauguucgguaaaguacuuuuccccuuuuauucuagagccccguguggcgcccgagccaggcuaccaccucucccaccuagaaggacuccgugugcaccaccgccauggcucuucuucucggcuguugccucgccugcauaaugcugccugcuucuucuauccgugguagucggguauacauaauacuacuugugaggagauccgaacccccauauggggcauugcgauuaauuagcucgccgccacccacauccacgagcacgcgccgcagggugggaggggugugccgccguccccgcgugcgcuaucugggaagcugagguaagaaggcgcacauggguaagcgucguugucaucgucgcauaguuuccacgcugcccagggcuacaccacuacacggaaaauugggaggcaggucuaggaggcggggucgggugcccaccgucuugggcgugcccguaccccucaauagauuguucuccgcgcccccuacccacacuagaggugcccgcgcauuggaccucaccccccgccugcggagcagcccauuugagcacguccucagugggccgauuuuuugcgcguccccuucgcuuuauaggggccauugccuaugggucgguccucugaagagguuggggcgucaucaggcugguuagaaaaacccgcuccgcggcggggacacucagucgcgucggcaccgcggagcggguugcuucagguggcugguaccagcggcgcucgcuagcucccggcucucugggcucggggcugcagcaccggcuggagcgaacccuugucccagcgcuuggcggcggcaggcagacgggcaggcaggcgcugcuuugcgugugagugcgucucacucacauguaaguccgggagcguggggucuucccgcccaagugcgaggugcccgagcaggcaagagccgggauagggcagaggcgccuggcgccgcugcccugccucgcgccuuucaggcacccuccaauuuucucucuuuucucuuuucucuucuccauuggcauccccaagagcuaacccaaggagcaccuaaggguaauagcaaacucuugucaucugcaccuuugcacuuuccuuucucuuguguuauuuuuuuuauuuuuuuugucuuuucuagacucucuuccccccuuuuugaguuguugggcaguucuuauuucuugcuugcuuuucgguuucuugcuguuguuggguguuuuuuuuguuuguuuguuuguuuguuuguucucgcuuuuuuuguuugcucauccuauuugacgcuaacucuuaggcagccaguccaucagcccccuacgaagcccgggaagccgcacucggugaccccaagacagcacagcggagacugcagcugagccccccgacacggggcgcacaggagccgggaagcccgaggccgggggcaagcagaccgcccgagccaggcgcgaaccaagcaccccgagguggccggggcaccaugcugaagauggccaugaagcucaaagcccgagcggccgagagcgagaggaagacagccgcggcugccgccgaaguggcugccgaagcugccguggcggcugcggugcuggcagaaccguucgcuucgcagaagaacgggauccccgcgaagcccccgaaguccgucaggguccucgugaacgccgggcgcgaugugccgcccgcaaaguugcugaccgacaaagagcgcaagaagauggagaagaagcugcuggagcagaggagaaaggaggagaagaagagagagaaagagaggaagaaguuggagaagauguugaagaagaagaagaagaagaaugugccagaagcuccgccagaggcccgaggccccgagggcgccgccgccaccgccgcaggcgaagacgagggcgccgcgcagggcgccgccggguucggagagggcgccgccaccgggggcgcgaguagggccugggccgaaugggacagugacacugaugaagaagaugaugccuacuacgcgccuccccgcguggggggcgucguguggcggccugggccugccaaggcaggcgcacucagcgcgcacaugccccucgugguguuccugguguucucgguucgcagccccucaugggugcuuaacuuccugcuacagaggcgcacagagcagggccgcggcugcggcuucguguucggggcgaccugcugcuucagaguguuccugggcugcgccuucuucuccuuccugaguggucgcgccaagcgcagaggccgugggcgaucccgggccaggggcaccgggcgccgggggcgcgacgagcggcucaucuagucagccucccccccaccccuccaccaucaucaucuacaucgccaucgaccaccaccaccaacaccaccaacacauccaccaccaccaccuuccaccaccauugcuguguaguguggaucuuuauuagugcuuguguguggacacauuuuccuuuuugguugcucuguccuaugcuuagugcucuccuagcuuuucuccaagcucccugcuuucuggcucucucagugucucccucucucucucucucucuccuuuucgaaauuuuccuaaguccgggcccgcacucccucccuuuccgcccaccccggccccuuggcggcgccugcccgcccugcugcugcaggaggagggggaucgggggccgcccggcccggggguggagcgcuggcaucgugugaggggucgucaccaccgcggggccgcccccuuuuccccccgccgcacggccaggccccggccccgaacugcggguggggcgagggggcgaccccuccguggagccggcccgagccggacgugggugcugggaccccugcccggccucugggcaccgccucccggcgcccgcgcccgcccucccagccgcggcccuccuccuccuccucuucuucccaccccccucgccgccgucgccuccgccuccccccgcucccccgcccgccgcggcgcuuuugggucggggcggcgggcccgggccgaggcaauaagagcggcggcggcggcggcggcggcagcagcucccgcggcuccugcucugcuccgccucggccccggagcgaggggcggagagccgcgcgcuugccuuaguccgagccgccacccuccccgcguuccccgcuuucccggcccgcccgaggccgcccgccccguccccgccgccccgcagcccggccgcgccccgccgccgccaugggcugccucggcaacaguaagaccgaggaccagcgcaacgaggagaaggcgcagcgcgaggccaacaaaaagaucgagaagcagcugcagaaggacaagcaggucuaccgggccacgcaccgccugcugcugcuggguaagggcggcccgggggggagcgggcccggcccgggagugccgcggggcgacccgcaaggccgcgcgcgccgagcccgccccccuccccggcgcucuagcgcucgcucccaggcccuccggcccgcugggccgcgcgcgugcagggggcgaggccgucaaggggaccccggggcggaauucggccgggcgggggcugcaaauugggcgugggacccccucguucggucucguccccucaguuggccacacucccccccgucccuggcuucgcguccucgcgaggccuacuuagugccaggggccagggugcgugucgggagggggaggggaggcucacagggccccucggacugcgacagaguagggcuagggacaggaaacgggccggcgggcccagggagggggacccgccucacuggggugugcgauuuguugggagggggcccaaagagaggccaaggccacuaggggggacucggggaccucggccgggagacucuggcgagggaaguagccgccggggugggggggcgggugacaucagccccucggaaaggacggggcgguaaagguggugcagaggggggagggggcgcgggcaagucguggcgccgaaguggggggggccagggaggagggagcguggcggacucugggcgcgacucggggcgauucgggcaggaccgacugacugugcgcggagcagacguguccugagcuaggccaggccguggaaggaagagaagaagaaucaaaucgaauaagaucaaaaaauuaaaauuaaaauuaaaaaaaaaguacgcaaagugcccagugaagccaaaugacacgucauuuuacaaugugaccuuccccccccccccuucuagacuuacaggcuuuuuugaaaagcaaagaggagcauuaaaugguagcagcugaccccccaacugugcccccucccgugcagccaacaauuaacacacagguuuuccuguuacucggccucuuugggaguggagacacaaguaaaaaauaaaauccuguuuuaaacagacucauaaauaagauaaaacuggaaaaugacauuugucuguaaauggcuucuuaguuucgaaauggcguuuuuaaaauuuuuguccuuuucaaggugggaggggggacucagcgcucugagaagacucugggguggcagcugaugaaaagacaguaauuaguuguuuggcaagugacauuugcuuguuugguuuuucuucucuuuuuuuucacugcggcuuuuccuccuuggcaaaaaaaaaaauaaaagaaagaaagaaaagaaaaaagaaagauaaaaaggaggggggaaucccaagcuaaaaggaugucucuccuuacuuuuuuuaaaguacuggggugggggcagcaaaagcacacagacacacacgaaaauuguugaaaugaccacagaaacaucacacaacacuaauuagaauggaaacuuuccacgucucaguauuuuggcuaucugaauaaauuugugaauucacugggaacagggucacuuuucaacaaaauaguucgauuaucaaaaauaaaauguagaaggcuguguuaauucgcgguggcguuugguuugaucuuuuuggauggggucaagucuuuguucucccugggccacauugaguaaagcagaaaauuguuaauaagugaaaauaauccuguugguguuggugcguuugcaauuucagugauuagaugauauaugggaaacuucuaaaagcguaauucugcuguaaaugugaauauguauacagucugauuucaaaguacacaccuggaaacaucuagaaucuucuguaugguucauucuugcucauaugagugcuuauuuaaguucacuaugauguuaaugauacaucaaauuccuaacaucuuuuuuuguguguguuuacagugauuucaaauguccccacuuauuugagacugcaguucugagcccaccuugccuccuuucaagucucuggucuacauggcugcauugugccacaauuaauugaugaccuuuggcacagaaaucuguugcccuggcuauuggcgacauuuuacauuucuuaaaaaugaaauaauuacccacaaaggaaacuuaauacccccaacuuccuuuucuuuaacccauuuuaacuucuaucagguaaauuaaguaaauuugcagaaccacaaaacaaacaaaagccuggcaguuauuuuucagcccaguuuucuauucuuacaaaaguggaaacugaggcacggaucuaguucugucucugaaaaaaaccuggugucacaaauguucccauuucugaggguggagugcugagggaccugaugaguccucuguuuccuucauggaagccucccaauauugccuuuuauauuuaauuuaugagaauuuugcucauuaggaugguguuugcuuugaaaucaaugcugcuguggaaaccaauuuuaacuuuuacaaaucuugcuuauggacuuguggagggguggaaaagaggaggggugaagaaauggagggguggagaauuucggggagggggaguguugaacugaauagggugggggagugaaugccuuucuaucugggcaccaaaacagaaacaauauggagaaaaagaacaagauuuuuuuaaaaauuagauuguugugggaggaggggaaaaaccauucccacagggaauacgggcugaagaguacauuugcagaaacuugguggaaaugggguggggcuggaggguccuccaaauacuaccuaugaaagaaagaaagaaagaaagaaagaaagaaagaaagaaagaaagaaaggugauuuaaaauggaggccuguguuccuauuuacuuccuuaguuggggaaagccuagaaucuucuuauucaggaccuuccaggaauauuugugcauauaauuaaagucuuauccuuuuuuuuuuuuaaacucuugguacuguugaaguugcauguugccugaugcucaugaggucucaagugccauguuugauaacgaaauguguuuauuuuuuguuuuuugcuuuuuuuuuuuuugcucccccgccccccgcucccgccccucugcugcugacagauaauugauggucuaccauuucccucugcaacauggugguuguauccagagaaaaauguaucuuuagaaagauuccuuuugcaggggaagggaguggauacaguggauacaguguagcccugugguuuuaggguggaccugaagcaugcuugagagcagcugcauuguggcguugggagggaggugcugcagcggggcgugauagugggagacugcagugucuaggcauugucugccauuccuaaguauuuuaaccauaaaaugacuaacaaacaggaaauuagguggcugcugcauagaguaccuuugaccacauuucaauacuaaauucacaguuuugacuuaaaauuuucacccuuccagugacaauuacgucauuccuucaucgccucaugaguuuaaaaaacccaaagagaaaacaaaacaacaacaacaaaacucaaaagggaaaaaaaaagcuauuuaaaaacagcagagcccuuaauucuugcuuguuacucuauggugagauacuucagguagaugcuauguuggaugugucuguuguuuuucacugcgucgucaugugaaggagguuugcaguugugucauugugugucuguugugugcugcuucugcugcuuuccaaggccaucauccaggugaagugugacaagccuguuucuuaacccacgcccucacuuuccuuucucaggugcuggagagucuggcaaaagcaccauugugaagcagaugaggauccugcauguuaauggguuuaacggagaguaagugucaaaucugagcagggcacugagcaggacaggugguauggaccuggccugcaggagacaggacguuugaaggaguguauacuaaccucuagaaagcacagcugcuaauugccacuaaucauuuuuuucuaauuugcauauuagacagcccaagaaagagcugaugggugcacccccacacccuucucaaccuuuggggcaacaaauaggaauaagaguagaagcaccgguguccacccaaagcagccccucgcgcuggaacauggugccugguugcagaggacagugaacagcacuuggccgggugacagcgucucugaggccagguccucugcggccgcagccucgccugcugcagugcagcuccaacauggccgacgggccuuggccaccccuuggccagccagagcuggccagcacaggagguucccacccaccacccugcagguuucacuggagucaacugguguaggguuuuguacucucaggaaaacaucuuuucaguuacaucuucacuuaaaaauuggaauccacaacccuugccgacaggcucuaagcuuccgagucccucccugcuucagaauuggugggauaggcagagacuuauuucucuaauuaaaaaaaaaaaucaauacuucuaccugaacaacugaaaaggagguaugaaaauggcgcagagacagggaguuagcuacuucugcccaauccaggagcuguuuugccuuugaaaugaccuuccuggcuuaagacaauauggcgaggcaauaccacagugagagugacgauuuuucuuaaaaagagacagauacauggcaagcaagggguccugccuuccaugaagaaugcagaccgaggagacagccaaucaguaaggaauuggccuuuccccuuggcccccguuguucucagugcugauaagaaacagcaagggucagggacuuagcugacccuagcgagggggaccagcuucuguccccuaccaugcaccgagugcuggggagacaaaauugagcagcaccuuucaggguaccacaagcgaauguucauggaaacuucuagaauuuguuaguuuaacuaauccgguuuaaaaaacaagaugacaucagccacaugaaagcuuuggguccgugugugcuccuuaaguuacagccccaaaauucauaguuaguuaauaugcagaagggaggggggcuagcucacuggcuuuaggauugacucaauuacuacuuuguaccuauaaucuauuaaauaauucauuguugccuaucagacacaaauucuggaacuauugauuccugauaugccucucucaagaagucuauacaaggagauuggcaccugucagucaacaaaaaagaacccagauaacacccugccccaggugugagggacucuucaauaugaggcugguuaagcaaauauuucuucaaaaauauucguggugaaagcuggaggaggcugcuaagcagcuuuuaaaaugcgguagccauugucuaaccugaugagagccgugucaucccugaggcuuaauugcuucacaaauuucccuaaaaucuuacuuuuuaauauuaguuuucccugaguguuaaugugguggaggauucuaaaccaggacuucucauuucuauuuucucucugaaaagaggaagaagccuucgcaguuugccuuccuugugggucuccaagauguuaaauuuagccugagaaagugauauucaggccuccauggggggcuggauuccuuauuuugacccagucgaacgaugguucucucacugugguauagcaguaaaagcggcuccgucugacccucaccucagucccgcucucaguucuuggacagagcuauuaaauguguccuaacuguccauggccugccuaccacuacauuuuucgagaguagaacauaauauuuauuugaccuucagaaauacagagggcaaaguagauuuuccuaacacagagcuaacuuucugaaguuuaaugccagaagaaaaaaaugaauauugguugagcuaaucgaucucaaggcugagugucaaugcccuguccauagcuccccccaccauagaaaaaagucaggaauaggaaugucccacuugugcuuuggauuggacacggagaagauucugaggagcccuauucucaagaguuaggucugugucucuguucccuggugcaugugcauuuagcgaaagcagaggaaaacaauuacccgucccuccugucuccagccugagucuccugagggcccugcuaaugcaggaaggaagguguggagucucgguagacauccccauuuagccagaaaagcgaccuaaggauuaaccgggaggaugguacgcaggacugucagguuuucuuaccugacuguuuaaagaugcagagacuguguggguuuuguaugaaauugcagugccuugcagauaggugagcuuucaaucucucuuuaaaaggggcggcgaagaggacccgcaggcugcaaggagcaacagcgauggguaggcacauucaaaaacagaaaacucuucuaacaaacaaaacaaacaugaagaccauagcgggggaaacugaggacacagacuggggaacaaagcagagaucaucccagggccaucagccaucuuggugugcauuugcaaaugacgugucaacaaguaaagugcaaaacagagaagguuuuaagaauaacuagauacagccgggggaagguuagccauuucggcuuccgaugagaacuuaagauuuugagucgauguuucccauauggucuuuauuucccccaguucuccauuuaaaccaacagacuugccuuucaaaacugcuaaauucugcccacacaauggucagucugacuuuaaguuuucagaccuauuuggaaaaaaauaaucuuaacuuauuuccucaauuaaaaaaaaauaugccuaaugcugcagcccuuaggcagcaggccguugacaaccucuggccuuagaaauuauuuaaaaaaaaauuuaacuguuaaugcaaggcacuuuacguuacccagcgaacaagagcauuugugacggcaccccacucauuaucauuguuuauuauuuugcuuucucauccccacaaccaucucaugcccacacacauacgcacacgcaugccagacauccaugcagcuccauucgcgcucacuagcaugcaggaugcaggggcuguuucucaugucaauccauagagcagcuuccagccuagaacauggacgaggaaugacuucugagaccgggcacgggcgggucaaaggaucugggggucggggacaaagugacugacacauguuuguucaucuguuucuuuuagagucuauuacccccacuagaugauggcuacaguccuccaucuucgcuauguccuaccccaguuaucccaauuugcaugcuggaauugcccggucuuaggaaacuacuaauaagaauacuauucuguuuuccuggggaugggggggggugggggaggggggaggggucccuaaccuaaccuuuaggcguaaguuaaaaacagaaagaugggaugaagucuuuaauuggcaacagcauaguagaacagcaaucagaaaaggcaucgauauauugauaaucuacuguaccaaaaguuggcauccgagaaguguggcaagccccuacugagagagccuccuauauauugugugcugugcuaaccccuucaaccuuacuaauaccugcacgucuuucuuccuaugacucuacaaguaaaaauaacuauuaacgcuccugauaaauaaaacucucugcauguuucagcaaucccuguaucuugcgucugucuucugucugcucuuuugucugucuuuuccccacaagcacaaagauaggguagagaggaggaggauggguaucacauagccuucccuuaccacuuaacaggagaggggcaggaccuacuaaacaaaaugcuaaccccacuaaucugccuuacacuuuggggggggggagcggggaggggagcaucauccuauagauaccgcccacuccaacuuuccagucaguuagaaucccgaaaccgggcacacaucuugccucuguuaaguaguuuagagacaucuaaggaauuuucucugaauuucacaaucaacguuaaauucauuaagcaguauuacaaaugaggauaaaccugcuggccccagcaagauggcuucaucuacauaguaaucucuucaaugaagagguuuguuuuaguacuacacgcccgaauuagauuuuagauuuucuauuuuagcuguuuuauacuggauacacucccacaccuauucacauacguagaugaaugcugaacacguucucagaauaucuguauuuuaagacuggaagcuuuccaauuaucauacuacuacuuagaacgaaauaucaagcugaauggagacucuucccuggggaaaugcuuccuucuaccuguaugucgacggggguaguuaauacccagcuagccucauuucuuuuuguuauggggccuuaaaaccaggcaucuggggcucaguaccaauggcaggaagccauuuuuuaaaaacagaguagauuagccccaaggcaggauaggggaggcuccucugaacucuccauuagaguacugggggcaucaaacacaugcuucuagacuccgacaucuauagcuagucccagagucuaaaaccaacucagaaaugcauaacuucagagcugagcuucaacgugcgccgccccucucacaccguaacagaaucagccccucugagggugggcacgccgugucucuaaaacacugggugguaccuggagcuuuaagagucugugggccccaagcagcuuuuggguguguacagaucccacauccugagugcuugccccagccccaggauagccccuccugccugcaguggccauggggacucaggguuuccucuugccuucuuuuccuguucugaguggugggcuugcucuaauuacaguguggagcuagaggcagcuugcagggguugggcucugauuuucccacugucauggccaugucaaaauccugguagccgagcucucgcccccucccuccuguugagaacacccccaaccucuaaaccuugcaggcccucaccuaagagauggacaccaauaaaaaauauauagugagaucauucagaacacagggccccucccaaaauacacaagccugcauggaaagaaagccccaaauaucagcuaugauaagucuuuguugaaagaauggguucuuugggugugguccuauuggugggcaugaacaugacccccauauucccacucuauuggcaggcacucacauggccucagacccccaaccaauuugcaggcaugcacaugaccccagaaccccacccaacuuacaggcaugcacaugacccccagacccccacucuugguggguaccccagaaacccccagaucaccacuauuggugggcaccuccagauucccaucccuuugguggguauccacaugaugccagaccccuacucuauuggcagguauccccaugucccccaagucuccacccuauugguggguaugcacauggccucacggacucccaccccauugguggguauacauaugacccccagacccccaccccauuggcaggaaugcacaugccucccagaccccuacccuauuaggagaucuacaugccucccagaccccaccccauuagcagauaucuacaugccucccagaccccaccccauuggcagauauccacaugaucccucagacccccaccccauuggcagauauccacaugacccccaggcccucaccccguugguggguauccacaugacucccagaaccccaccccauuggcagauauccacaugccucccagaccuccaccccauuggcagauauccacaugauccuccagacccccaccccauugguggguauccacaugacccccagacccccacuccauuggcagauauccacaugauccuccagacccccaccccauugguggguauccacaugacccccacuccauuggcagauauccacaugaccccccagaaccccacccuauuggcagguauccacaugccccaagaucucuacaccucugucaggcacauggccccccagaucuccaccugaggccugccugccaccccuccuggcuauaguagccucugguccccaucuugcaacuuuacuaauuaauuuucuacccuguuccauggggagggggcgugauuuaacuuucgcuaucuugugacuucaauuuaaugucaguaaaagcaccucugcccuaccucugucacugccaccuaguccucuaccucaguuuccuuaucagaaagggucuguuccucuccaaugcccuguucugugcuaccaggccucacccugagggugcagugcaugcuggucuucuaaucccccauuggccaugcagaagauuaggcucagacaaaauggagucugcuccaagcagggaaguggggcuuugcugcuccccuaaguacaagcucgagauucucuauggcugugccuggcauauaggcugucuccuaaaagacacagcauuuugaaccacuguaaccuccauaaauuagcauuccuucugggggggacaccauccacccccaaaaccagaagaugugaccugugaccugugggaucgcugacucugacugcauacaaaucaucccagaaaggccacagaaguuaucccagaggcugguuuaaauaagcaaacaucuagccaacuccuccuccaguauccaugaacccaaugcccaccaacaauguggggacccaggacuccuagccacaacugggggccuguucaaaagugcugugagccacagaaccccaaacaacaucuucccucccuggugacagaugcauagauacuuaaauaauuagaucuacaaauauggaaauggaaaacccuaauaucaauaauaaacacuugucaccucugggucucacaaacuacugaaucccaaguucagcauguacuaacccuaccuccauacaacccucccugugcuaaucaagagccacgcaggaagcagcagggugugguuggaauggacaguagaccaggugcaauuucugguccaguuaaucaagaucucgaugccaugucucuaacccagccuuaucaggccuguccucaggacaugauugggaaauuaugauuuauuuuuauuuggaugccuucaaucuauagaucuagcccacaauuccuuggaaaacagaauacuaugcuuuuuaguugacgugucucaaugacgauaacacccuggugggcaggaugcaauaugauuuucuuuuuuuuuuccuuucaaucccacuguagugagaaggccacuaaagugcaggacaucaaaaacaaccugaaggaggccauugaaguaugugucuagcuccuugcucuuaucuuuuagcaagccccucgccccacggugcugccccccccacccccacgccugaccaauuugcuaaacuguuuucagaccauuguggccgccaugagcaaccuggugcccccuguggagcuggccaacccugagaaccaguucagaguggacuacauucugagcgugaugaacgugccgaacuuugacuucccaccuguaagcuccacccuaacccugguuuccucugccccucucaccuuagucccagugggaacacgagggccagacuugcaucaggccagagugaccagacacauaccugccgugugaaugcauaaguuaacuccaggcauaugccuaagacuaaaggaugauaaagacaugauuagggcuuuguccaaaauggaugaacaaaguuccaucaccuuuucuagaccucaaccuaguccuccauuuaucagauagugaguuuuuuuuuauggaggagagguccugagcuaaggcaagcucaauuauuccccucauacacaugaggacagacaaaaccacauguuuguuacacauggcacacaaguccuaauuguccaguuaauccagccuaguacaaauaugcaccuuccaauguucagaucuaaacauaaauuacaaaauggaacauuauaagaaaaaaauuguucucaucagcccuuugccgggagccugacccucuugacaagggucucuuggcuuucuaaaagcuuuuuuuagagaggguagaacugcccugcgucaagcauauguacacuuuaacccuucguggggggagcaaagauuuuuaaagccaaaagaagagacuugucuaaaguuaagaagucauugcugccucuucuuaagcuuuugugggguuuguguuuuuuagauggguuuuggcuacaaacuugugagaaaaauuaguacaggcagguacauuaaaaaaaaaauagcuguugauuaaaacaauaagaacaacagcaacagcaacaacaaaaaccaacccucccaacagggaaacacagcauggauucuauagucaucugauucccaugauucacagagacaaaauggcagccuacccacaaugcaucugaugucauugacaucugcuacucugauaucuggacaauauucuaaccuuggcccaugucccucccacaggguaguacauaucccuccuguacacauaauucuagggggaguuuacucauuugguuugcucccaccccucacaagacuaacagaagcagccacccaagacugugagcacuccccagagaugaaagcaugcuaauucauuauauagauuucugggaguuuaacagaacugcaggcucuuuccaagcgcugguuaacccgggggcucacacuuggacucacauagcgagcgauggccuuagaauuccagggguggggucccugauugguuugagcucagucugucagccaacguuuuuccuggguucucuuucaggaauucuaugagcaugccaaggcucugugggaggaugagggagugcgugccugcuacgagcgcuccaaugaguaccagcugauugacugugcccaguaguaaguagcuguccccccauggcaaaacagaagcucagaagccaggaagcuacaaacccaccaguagucagagaguuccagucugguucauuuguuuuauaaagcuuuuaauugcacuuuauagaccacugauacuguuuuacauaaacaauuaauaccugcuagagcaaggcaaaauacuuacuuguaauaaagugguauaacucacggauaugaacucuaagcauuuaggggcgcacacaguguagcaaacacauacuggccuccucauauaaaauacacagacuuuuuauuguucaguaccuuauaaggcacuucagcuucaugaugggagggggacagugacccuuuccuaggcucacucucccauggggacuuguugcuacauauauagcaugucaugacuuaauacacacaguuauauauucuuucaaggaacugaaaagcagccccacaggccccagcccccacaccuccuccagcaaaguuccugauuuuucucaaaaguuuguacuaaaagcuggaagcacuaauuauagaaacagaaaacaaauggagauccuggaauuguuugugauuuguauuuuggauccaauucaggaguuaaguacagauacaagaugaggaggcucagcuacccgguagggaauugcuggggucaguuuccuaacugauuaacagugauuuagccagguucuuuggggaucacaccacuuuaaggaugucuuguuguugaaagcagugcaaucuacuccugaacacuguaccacguggcaccaacuucaagaaaaagaaaacaacuuucaaguuguguaagaggccucuccccagccugagugcacaguggcccgcucauuugucuaacugccuuuuugcuggaggcacugggccuggaccugguugguucuuaaacugccagguuuguguuuguugagcugcaguuuggcuggccccacuccagaugucuucucacaagauuuggugcuaaggaucuauuuauagaauugugguucuguugccauggcaacaugcuggaggccaggguggcuggggagcuauuugugggccugugcuguaauguaagauugauugggccaguuaguguauccucuaagccagacuaacucggaacugguaaaaaggaaggggaaggagaaaaaaaaaaaaaaacacaaaacaaaaaaacucaggggcuuucuuuaaauagacuaugcuccuuucugguuggucuacuuuaaaagaguucccagcccucuggcccuuggcccccaaauccuccaaacuaguauuaauauuacuuuuucauauuacauuaucucaguccugcaaaaggcaaaaguuaauuuuccuguguuuauagucgagcaacuuuucuuucuucuuguuuuguuuuguuuuuguuuuuuuuaaacuaaaaguuugcuaucucaaacuuuuucuguuucacagacccaguagauaggaagggaacuucgucuuugcuuccuguucaaaguggugaaugcaagaacagccccuuugugcccacagcuugucuuggcucaguucucaauaaugaaugagagucuuccaaagcagacagggagagggcuggcucugcuuuguccuggacagagaccugugcacccuuaaacccgcacuuguacauugcuuuaggaaagggaugaaguuuuaaacuucucuuacaugucaaaagcaagggcggaucccaccaccacuugccuuacgggguacacacuuggcacacacugaccaccgugucuccuuuucuuucaagcuuccuggacaagauugaugugaucaagcaggccgacuacgugccaagugaccagguacgcgugcgccucuguccucaagccugggguuccacguugcugguucuucuccgggcaauuagggugagaccuacugaccccccucuuuguucuaggaccugcuucgcugccguguccugaccucuggaaucuuugagaccaaguuccagguggacaaagucaacuuccaguaagugaaucguugucccgccccaacuaucuggccuggagaguggugggcccaggguaacccaguauuuuccgguuccagcauguucgaugugggcggccagcgcgaugagcgccgcaaguggauccagugcuucaaugaugugacugccaucaucuucgugguggccagcagcagcuacaacauggucauucgggaggacaaccagacuaaccgccugcaggaggcucugaaccucuucaagagcaucuggaacaacaggugcguggggucucccugacuuggcucaaccuguaggucugcagcuugcucuggccccagcucucaccuggccccucucuccucagauggcugcgcaccaucucugugauucucuuccucaacaagcaagaccugcuugcugagaaaguccucgcuggcaaaucgaagauugaggacuacuuuccagaguucgcucgcuacaccacuccugaggaugguacggucauggcgcugguuuagucaggugguucuugggcacaagguguggcugagagucccuagccccucccacuauggggaagccagggacauuuauuucccucauuuucauaggcagagaucaagaguuugggggugaugagcuacaauggugucagacuaggucuucuaagcuaauuagcauaauuaauaauuuuuuuuuuuguagcgacucccgagccgggagaggacccacgcgugacccgggccaaguacuucauucgggaugaguuucuggugaguaggacuuguagucccuuacuccuccucacgaguauucuccagucagugcuggauuuggagacugagcgguccaggccuuccauuguauuguacuaugaguugauggcugguccucuggugguggggugaggggcuccuggagaggguugcuugaccgagccccucucucugccuacagagaaucagcacugcuaguggagaugggcgccacuacugcuacccucacuuuaccugcgccguggacacugagaacauccgccgugucuucaacgacugccgugacaucauccagcgcaugcaucuccgccaauacgagcugcucuaagaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaaaauacg

SEQ ID NO: 1318 - RNA, 5924 nt, Mus musculus
ucagcuucccagauagcgcacgcggggacggcggcacaccccucccacccugcggcgcgugcucguggauguggguggcggcgagcuaauuaaucgcaaugccccauauggggguucggaucuccucacaaguaguauuauguauacccgacuaccacggauagaagaagcaggcagcauuaugcaggcgaggcaacagccgagaagaagagccauggcgguggugcacacggaguccuucuaggugggagaggugguagccuggcucgggcgccacacggggcucuagaauaaaaggggaaaaguacuuuaccgaacaugaacuuuuuggagaauuguuucaaaacucaagagugucccgccccacuccuuggccacgcuaggacaugguagagagcaccgggcuaagucaaagauuuugaaccaccuuccucggguggacuugagggucugccaccggggucuauuuggaaacaauucauuccuucauucauucaauaaucggcccacaaguaccuugugcccagguggaccgagccaagggucagacuaagacauggcaccuucccugaaugggacaaagcaggcgccaguaaccccagaucugcuaaguaaccauaaacucucuucuaacguagucuuccuuucauuuucgaacacaguucgcaaaacuugggaugcuggggagaaggaaauagaaauguagacucugaauacaaacacacccaggggccugaaggggagagggagaagggcuucgaauaaguuauuguggacagcucuaucuuugaaacuaggaggacaccuuuugaucacucgcucagcaguuuuaggguacucuuucucucaaguuuaccaccucaaaagucagaaaggcugcaccauauaaaacuccugcgcacuguuuuucuuggucuuugcuacuacagcucuaccuccagucuacuuuaaaaacaaaacaaaaacgguuucgaaagaacaacagaaagcgauugaaaguaaccaaggacgccuuggaauuaagagcaggaagcugagccuaucaaaugggccuuugcugauuuuaacucagucucugacuuucucuguguccucaaaauuuacuucuuauccacggcugauuauggcuucucuucauuacaacacacacuuuaaaaaguccaaaaaccucaaagcaacuacugccccagguugauacucuuuuuuuuuuuuuuuuuuuuuuuuuuuuaaccuaaccagaguggaugggaagacuccagcugugcuugcguuccuaauucucggcaagggauagccugaagacagggacuaccuuuuacuuuuucacacagucaacaaaaacuucuugauugaauuugauucaucugucauuugugaaauuaaagacuuagaagagagaggaccuggccaaaaauuucgguuccgcuccaguuguucaaaagccucuuccuuccggcuuccagugugcugaggcacagauacauuguauuuaaaagguaaggaguuaacaacagccaacacagccuccaugccucuacacuaacaacauaaucauacgcugaguguaaugaagaggcugugggucuucuccuauuagauaaauaucacacccaaucuuuaaaaagagugaagugucugauggaauacagugacacauguaggcaaggcacaauugggaccauuguccuggaaauguguaacacaaagucaggguucucuccauucaacuccuaacuuaaacauucgggggagggcuuuuuuuuuuuuuuaauuuuaacuguuaaguuuuaccuguauuuuauuaugacuaaccagggauccauaaagaaaggauuuacuuuguaaauaaacggcagcagguggaaucgaggguuuauagguaagcaaaggacaccaagagccugaaacacaagcugcuuuguggucuguucgguuuucuguuuucacuugacacaaagugaaagaagagauuuuauuuaauugguaugguuagcugacaccaucuacgguuucggccuagcauugaccugcccaaagcccugaaagcuacauauauguuuugcuuuucaaaagucuuccagaguuagaacucacaguguagaacuugugaguuaccaauugauuuuaguagauugcccugcagcuuuagacacuuacauuauuguuuugaaaguaaagcaaaugaauuaccauaauuccuggaacacugcacuagaaaguguucucaucagagucagggacacguggacauuacagaaaccuuaacgcuccaagugagaccauaaaauauauuggcagagaggaugcaggcuccucccugacucaugcuaaagccaaaaaguugaaauaacacauuccuaaccugaaauacugggucaccuaauauacagcuugauggcacacuucaagcuugcgguuugaacucugccggcuuguaauuuuuuuuccucagcccuucuguaucuuucuuucugagugugaauguuucaucugcuuucagaagcaacaacauugcuauagguuagaaucuucgaaauuguauuacuacuuaaugaugucgcugaguuuuaagacaagaauguuuucuugagccuuucauuaguuggggucauuguaagcuacuuuccaagagccuagagaaaacacaauuaugauauuauuuuaauagcccaggaaacaauaacuaggcuuccacugaaacagaacccuuagcuguaaggcuuuaauaauaguacuuagugaugcauucuaucuucaaagcacauuccgcacuuuaauuagcuagaugacuggaacuguggcugcagauaaauguuacuugcaacuuuggccauauugaaggugaaagcagguacuguguggagcuccucuaggccuggcuaaucuccauaagaaggcuuuaauacucagaacuagaaaauuuuaaauuuuaaaacauccaaugucaugaccauucaugacauuuuuuuuucaugucauauccacugguuaguauuucaacuacaaaguaacuccaaacaugcauucuacauuagauauuuaaaugucauuucacaaguucuaagucaacuacugaagaaugaacuaagcacgugaaauuucccaguugaauaauauccaucagcuaauccucaaauaauauaucuuuaacuuagaauagaaucucagucuaguucaauccaacuggccaaggugauuggacccauuuuuuucagugugugcauuuugguuugguuugguuuuuuuuguagccuucauugacuaucugugacccagauaggcaagugccaccuguacgagaaacaagccuaauuccccucccuauaacguauaaaauaggggacuggaaggagauuauaggagcucucuucccuuugaaauuuaacucuaaacgguguuugauucuccuggcuaaccacucuagacagcaagagauaaagaagagaaagauccacuaggaagaugugagcagcauaaucaugaaccacaggccucaugagcaacgugcagaaggaagagagggcagcuccauuuacccagggcacaccagcuucaacgggauaccagccuagcagagaguacuacugggugaaaggcuaucaaagaguucucccaacuaacagcuacuuucccuaaaguaaaaguuggugcaacuggugaugugauccgacaugaagaagaguagguauugaaacccuccgcuaaaauacaaugucuucaacuaagguaaguuuguuacauuggguauggcaguucaugacuauaaucucagaacucgugaacuuaaggcaagaggaguuguuugaguuugaggcuagccugggcuauagaguaauaccauaucucaauaaaacacacaaaaaauagccucugccaaauguuuauauuuuaauuaucuucagauucugaacaaucuccccacuccccaaccccuugcauucaguuuuucaaaauuaguucuauuguaagagcuaggcuagcuaaaaacacaagcuggcagcaaauauuuuguagcagaauguaacuuugugaguauacauuuauaucuuugguuuucacugaccaaaaagcauuuucaaauagugaaugauuugauaaguccuacuuugggacaacugagauucugaugggagccagggguccuucaguuccacagcgcucucuuugucugcuguuaggaaaccccaaauuaaguuaucaaugugacauaccuaaucacauguuuaauucaucuagagguguagguaccuuuucaucuuuuuguguuugcucacacacguuuaaauuggaaaaauguaaaauuauuauuuaacuccaccuguuucccccagggcauagaauguacagccccuccagugaggaaggcucuuuggaagggagaugugaagaagucccugucugaccuuguguggacucaugcucagugcuagcugggaagccagugguagugcccucaacaccagccaggcccagauggcacuguggccuucugaggucucugccucgcucuugaaguguccaacuagagaaaauucuguagccccaaaguaccagacauguguaagaagccuggagauuggauaaauggacaugucuuaugagcuacaggccuuagcuguaccuacagccacaucccagggccucugcaugccacucauuacugggcaaguggccucucucccuuucuugaacauuccugucugucccuuauauuagucucuacuauauucucagauuacaauuccuuuugugcuaacuacacccccaaauuaaaagaaugucacugacuucacaaagaauacaaagcagacugguuuuauauaucuggggguggguauuaaaaauguguguugccuuuagaggacauuuacauaaaacgauaaaguaauuuaaaauugggugaggauaacagauugguuuuaaauaucgccccuauuagccaaacaaauaaaggaccccaagaaauucccuaaggguuaauaagcaaaacacuaaccacauguaauaguuucuuuuuccuaaggaacaguacgauaccagcuaaugcugaaagcacgcuacagcugugacuuguagcuuggacacuagcuugagugacagguguaccaucacuugcacagaccagcugaaauuacaaggucuaacucagauuuuccccacaauuaacugaugccaacauuacauccauccaggaaagagccuccagcuacaggcacagcagagcauguguucucagucuucaacauuuuaacaacagcaucagccuugggccagaagggaacugcagcucccuaaucacagaaccagaaagccgggaugacucuuccugagggaaggcagaagaaagcagcuagcuucucuaaugcucaucugacggaguuucugugacuggagcaagcucaggguucgaggaagcuugucaccaaaauuggugucauuaaagaagguggcaugucuaagagcaugcccggccccuagcuagagcuuuuaauccaagcaccucggaagcuucuggaguacagccauuuaaagugacuugucacaccgaaaggacggcuuucuuaaauaaucucuauaguuuaauuucugucaaugaaguagguuagagauaacaaaaauguagauagaaagaugaucccugagcaaucuuaauacuauaauuuacaacuaugccuuacaguuucaucugcuuccauuguucuuacuccccuaacuuuguaaaacuuucaugcccucgggggcuggugagauggcucagcgguuaagagcacugacugcucuuccaaaggucccgaguucgaaucccagcaaccacaugguggcucacaaccauccauaaugagaucugacgcccucuucuagugugucugaagacaacuacaguguacuuacauauaauaaauaaaucuuuaaaaaaaaaaaaa

SEQ ID NO: 1319 - RNA, 862 nt, Mus musculus
ucugaaaauguugggaauaaugaaugucuguuaaauuccaacuauggcucuuagauacugucugaguggaaagcaggcagauucauuuaugaauaauuaauugcacguacagaagcagggauugucuaacucaccucucccuuaaccaauaaauggcuaauuaugacagugguuaacaagccuagcagcauugcauccagccuaugucacuguugcuagaauaacugaucgcuagccuccugagauacuacuguucucuggaaagacucauccagccugauuuccuuagcuuucauuaccugaaauuaauccucuaguuauuuguucccuugguuaagaggucuaugggagggcuggagagaugacucagcagguaagagcucugacugcucuucugaagguccugaguucaaaucccagcaaccauaugguggcucacaaccgcccguaaugagaucugacaccuucuucuggccugucugaagacagcuacaguauacucacauacaaugaauaaaucuuuaaaauaaaaaaaaagaggucuaugagagcuagaaguuguggucucaugugauccauuaaagaaauauucagugagugccucccagguagcaugggcuaagaccugagcugggcacacagccugucaaucacuaggaaagagaagagagaaaggggaaucugucacagauaggaaggaaggcagaagccuaaagcaggggucauucggaaguuuuccagggaaauguugagacuuaagguccugaagcugaagggugaggagagaagagagacgcauguugacaguggggucacugaggggccucagcagggaagcacuugcccccagccuggggacacg

SEQ ID NO: 1320 - RNA, 12183 nt, Mus musculus
cagggugagaaaggcuggaugaggaucgugaccagcaccuacaagggaggcacaggugacagcuacaaccuugccaucgagagugccugcacauuuggggaccccauuguuuagguagaugucucuggaagcagcgcugugaaccaugacagggaggggugauuaauuacugacacuggacauguccagacagcuauaaacagugcuuguggacaugaggaccagaguguggacugcaucccgagaggagacgguaaaggaugaaacacaacugcacugggacccuccgccguacccuccaggccugccuccuccaccacugagcccuccaggccugccuccucuucuacagugcuugccuucagccacccggagaagagagcuaugguuuaggacagcucaacuuaucaccagaucuggagcccuggaauccaugggaggggggaacaaguccagacugcuuaagaaaugaguaaaauaucuggcuucccacgcuuguguacuuuauuuacacgagacuagcacacacaacacacgcacacucccacacacacacauacaacucaacauuacucuuggaaacuuaaaguaacugaccaucugggucauaggaaggaaacuuacauaaacccuucaugaagugucccagcugcuagauucccacuacccagaggcccacugggucccuguucagagguggcacacgccugggaugugacauguagcacagagccacacugcgacacaggggggcugucugccacagaagcuaccuuugagaagaguugccugcuucuucccagcagacccugcuuccaggaggcugguugagccucuucacagagcagcuuucugaacgaguccucugguccccccaccccaggcuggcauggaaguuucggcuucaguuacagaugcgcucaguucaccacgaugaaguucgacuugcagugagcuguacagaaacacauggccacugcauuagagcaggugaggaguaaggugggccaucauggcacaggguaccucgaggccuuaccaaugaacuccgucacggggucaugcucgcccucugccuugauggugcccgcgaugcugucauuuuccaagauggggaggaaaagcugcacaaagucugagguguacggaggggcgaugacauccagaaccuaguggggagaccucagggugacugaccugcugaugcgggagaccgcacuccauaauagucagggaggugugagaggcccugccgggcuuuuccagagacaccgcagcccccaccuacaccacccagccagaagggcugggcuagugaagagugacccgugaccccacggugcgcucacugcugaccucagugacaaaguagcggaugagggagauguccguguccagcuucuccagacauuugcggauauaacugaccaccggcaggacguagccgcggcucagcaggugcaccauccuguccagcagggucuuuuucaacucgagcuguggaagaacagagaccgggagcaggucagagcugcaagucuccagcaucgagacacucuggggugcagcucaccugcuccaucacgucuagcugggagugcucugucucaaaaagcuuaacaagcagcugcagaaccugggggugcaggagcugguggcaggugcugaucugugaacacccagaagacaucacugaggcgccugccacucucagggcuuauuagcagaacauggggaguauacagaauugucacacccacccaaaguggcuuacugccgauggggacaccaccugucagcuucuagguuuccucccccuaacacuugauaaaaacacaucuacagucaagugaaacuagauacuuaaggaaaagcugguaggacacaaacuaccccaacgcaaaggucuaagacacagagcacuaugcaucuuacaagugguccuuccgaccucucaccucauccaacaaggccaggugaacuggagugugaucagucugcagcuggaaguaccuuggcuccgauacgguccaaucuacccacuugagcacgcccaucgccaccacuggaaaccuacaggcagaguggggaaacugaggcugaauaugccagagcagcaaacagcugggaaucagaaaaggcagugucugcggacacaguggcuccccuucacucugcccugagguaguggcuugugacagaagugguuugaugagguccucccagaagggaucuguucucagcuacuuccaaacccaucaucccuccccaugaggaaagggccaugcggagggcgcugccuggcagccugggcucccguuuaccuuuacuucagacccuuccuuaguccccagaaaagugaaagugccuaagacgguacauacguaccgucauacguacgcagucacgagucacuccuauccaggcaaugcuuguugguuuaacagugugauuacagaugaacccaguuucucuaauucuggauguccuuucuuuagucuacucugugaaggucugcugggcagauuucuggccaauaagcccuccugcugcugcagcugcuaaguuccccaugugugcuuaagcacgagaaacccaaguuucuuacucagcgcaagaguacaugcucuaaccauggaagcaugagggcuugaacuccagggaauggaugggggaacaggugucacacucaccuacuagugcacugacagagugacgggugucacacucaccgaaugcacugauaaagugugcucagcucagccaccagcucagaggccccuuuguucucguugcagcacagguuguggacagucucgauagccuuugacguggacuugagcucgucuuugccaaugcugacccgcuuguucugaaagcauacaagcugcugagggaugaugggaguguggccuugccgugggguaucccggcacaaccucuuuucuccccaagucccuuucccuguuuccacgucaaaaauucacucaaccaucagacuacacagucgcacagcccauagaaaccaauuggaggcagcugauugggugguccagggaaguccuaguguaagagaugccacacaauuccuguggcaccgggcucucacuaucuugugcacaaugguaaagauauugcugaugcuggguaggcuggagauuucuugcugcccaaacccccacagaguagcagaucuagggaggccacuggucugagagcccauggggucucagcacggacuguaccuucuuccaggucucaaccacacuggcagcguaagccaggauguggauguacuuguguuugugguccugguugaucuuggccccuggcuugaagagcgacugcaugaacagguccaggaaggccggcacccggaucuaaggagaggcacacuugggagugggcugguagggaggcccuggcucucccaaccauagggcucugacagagggaaggcugaggggaaggauaaauugacaguuuaaugguguaggaugugccuguguggugaaccguuugccuagaaugugacaggcccuggcuuuaauugcaguagugccagaaagcaagguugggaggagggcuuaugccagguguagccaugcuuguaaccccuggcaugucacucagagaggcuagggcaggacaacuggcucuguuugagaccagccugggccagagagcgagaccuugcguuuaacaacaucaauaaaaacuacuauaacaaagaucagcaugcauggccuuaagagaaugaggggaacuuggagaccccccaagacaccugacaccuaguguggggcaccuggccucacugaagcacgggcagcuuacgaguuccacgggaggaggguccaugcuggugaacaucuugaacaagaccgugaugucugcaggauucagggcuccucuggacagcauggcgccaagcgcuuggcaggcucggggguaggaggcagcugugcccaaggccagcgugaucugacuggcaucauggccccugguuggaaaaccacacaccaucacuaacagcuuucuuucuuucacuuuugaacauccaggacugagcugguaggaccccugugcuuucugacagcucuauuauucgcuccuucaacaaacugaccccugggaacaacagcuacagugagcugcgaaaggcccugaugcagcuacagccuccaugagggauucacacacccuacacauguuagcagaggaggcucagcagcagacagugaauugccuugggcuccuggagaaccaggcuggacuguuuucaugucacuccuacaacaugugugcacacgcccagccuaccagaguaaucguguccuuggcaaaauggucaccaacaaggccuagagacacugaguucagcuccacagguaaguaaaggugaccuagaauugauggagcuggaagcgggcugugggccugaggaagggaggcagagcaggcaagcagaugucucacuucuccugggcgaagcgcuggacuuccugagcgacccugcgcacugcagaaccacccuguuccuccugugccagcacggacaucauggccugugcaaacagguacgugugcucgccauggcauaccaucuucuagaaaguuacagggagacaaggucaggucacaguguaagugcagauaaaggaguuucuggccagggguuuucugaccuggagaaucuuuacagagugaggacgucucaugcucagaagacuggccucagccagccgucuccauguagccugagauucagagggacuuacugcaaacucagggagauuuuucucaagguuuucuucucccccauccaagaucguggcuagagagguccgaagcacucuggagaacacuuccaacugcuggcaggcuguggacacgcuggugaucuccccuugguaccccgcaucagaaaugagcugccacacaacgcaaagccaagggucagcaccuggggcgcccgccaccuuucagagcagugagccagucaacucuuuguaggggcugagccaagcaagaacugcucuugauccccaacuuuuccuaugcuucaugcggugccaccauguaggugcuugcuuaacccagacucacacgucuccugggccuuggcaucugaaaaaaggcagccaggucgggucugccugaggccugucagcgcauaugcgccaucuaagcucagcugugccccacacugcgacagucagcacugcccuaagcacagacaccaucucugcuccucgcacccagggcugaccugcuucucgucuuuccuggaguccagcguucucccuaccuucacagugaaguugagcaucaaacagucaggaugggccucggccaacuuauaaaacagaucucuccauguugugugugcgaucaucugcucaagccaagcuggggucuaccaaagacaaaggacaaggccaaagaccucacuuuagacucggaagucugugcuguacaagccgugguuccaauugaagagaccuaugggccccagcucugggaggagcagggcuugccuugcacaggcaguuuagcugaauggucacuuccuggaugucgggucacaacucuggaaagaugugccuaaccagagaggguacagaacaugcuuccuggaagacacaugaaaugucccauggaagcacggaucccuuggggccacaucacguacaacuaacucauguuuaccgagcccuuugccuuuggcagcggggagaaaggcaucccugccacugcgggagcacaauggggcucccagagaagacagagucaccuggaccacuggcugguccugaaggaagacggccagaagccgcagcagucugugacauuuccuauaccuuccuuccaagcccgccucccuccaccaggggcugagccacagaccagauccacaugauuuauauacacucugcacaagcucugcuccaugguuuccuguguaccuaguguuugucaugcuugcgucuuggaggacccgcgggcagccuucaagccagaccugcacgcaguagucgggggagacacugggugcuccuggccucagcacuggaaccucccaugcaagcaccucacuccucagagugcagagaggaugcuggccaaggcuguggcaugcuggggcaaggacagcgucccucaccucuccuucuucagugaaaauagaaucugcuuuccgagggucgaagugcuugaucagcaaacucuucaagugguuuuccacagucuccugcaccugcacaggcucaacgccugggagaagauggaagcuuuaccugaagcagcacccccuuccgaacccccaaaacagcauggccagucuaccaguaucgcagagcucuaccaccaccacagcaacagcagccaagauucuggacccuguagaauuagccucuaagucuauucagugguaacacccaaaagaaagaaacacaguguggguccaugagaugucugcccuuucuauauggccaagagagacaucuucaaacuuauacucaucaaaaacagagggccaggugaggagcucaaagagcacucuggcccuguggagauggcaggugcagucaagagccucacuaggauccagucacccugacagccgugaggcagcugguuuccggacagugcuugaaugacgucaguguacccaauucaguggauuuacaguaaggcucuguucugaucacauuagcuaaaagccaucuucagagccaguccuaaauuauccaucauuuagugcuggcuguaacaggccucuugaaaggagacacugagcauacaccguggaacccuguaauucuacggcuggggaagcagcucggugagaaucaguucacaggcugccugcaaacccagcaacugaaucagagcucagagcugagcacacaaagcgggggacucaguccuucugccuuugaaucuuggaaaccaggaaugcuuggaaggcuaaucuaucagcauuguaaggacccaaaggucucuugaagaagaugagcagaaguuggcuagauggcucagugguuacagugcuucucauacaaacauggggaccaaacuuggaugucuaaaacccaugcaaaaguaccaggugggcauaguggucaacuuguaacccagcacucagcaggaaggacagggucuacagcagcacucagcaggaaggacaggggucuacagcagcacucagcaggaaggacagggucuacagcagcacucagcaggaaggacagggucuacagcaagcuggcuggugagaguagccaucucagcaagcccugggcuugaccgagaccccaugauaaugagugaggcaguaaagcaagccaacaagacuccaaacucaaccuugaacccccaucugcaucuaugcccaucacacccauguguacacauaugcuugugcacccacacaucuauguauacacacacacacacacacacacacacacacacacacacacaacuuguaaauggaaaaugaaacaggaggguaaguggccaggacagggacuacccucccaagcaccugucugaaugagccacucagccagcagguucacugucugggccacugccguguaguucucagauaagagcuggaugacguuuucuggagacccuccugccuggaaauaccugggaagagcaaaaggucagcuuuuacacugaggggacacagaggagcugggguagacaggugggcaggacaggcagucgggguucagggucuucuaaggggccaaggacucuagccaacuucccugccgaggucacauucuucacacccccgagugugcacacugcccucgcacaccucuucagaguguugaagauggagggcuccaugauguagucccggguggaaaacuuaugcaggcauuccugcugcaccucagcaucguccucuccuucuccggaaucaucuuccugaugcugggaaaggcaagagccccgagagguccccuuaauauauaaaugcccugcaaucuugcucuagagaucucaaagaccauuuucaaagugucacacgcaugaucucaucugacccuauaacaaccucacgaugugagcuagacaagaggcagcuucaaaggggucaggaaccacaccaagcacgcuaucugcuggaugguccacaguggugagucuuguacaccaggccuggcauucucuuucaacaaaggcauucaugacuccauuccagucaggaguggggucuaugagcuggccuagggaggaccaagagugacagcugacauucagcucaacagucagccaccgacacuacuccacaccggcuccccgaugcucuccaguaaagacuaacagagugacucuugacaguaagagccaccaaguuacacuuacuaucaccaacccuccaaaugacaggcuugucuagauuuagacauacuucuagcuggaggccacccacgcuggcugucugaccugcuaacaaauacaugguaugagccgggcagugguggcgcacaccuuuaaucccagcacuugggaggcagaggcaggcggauuucugaguucaaggccagccuggucuacagagugaguuucaggauagccagggcuacacagagaaacccugucucgaaaaaagaaaaaaaaaaagccaauaaaaaaacaaaaacaaauacaugguaugguggaccgagugaccucaggucugucuggcugcaaagcugucgucaaaauagcaagcagauacucuguaacaaugacugcacugagucugggaaccugaaaaauacaagacauaguguuuccaugggaggaguucgcaaaguaggaggccaaccuccaggcaacugacaugaugagguaagagccaggccaggaaccagcaaaagagccaaacucaauccucucccuguucucguaaagaaaauauugaaacacaauuauagccacucuugugcauuauuauccgugacuacuucuccuaaucugguuguuaaguaguuaugaaacagccccacacaaccuaagacacauacaauguggcucuuuacaagaacuuugucccaguggucuagacucucugacagcaaugugcuaggagcagacagaguccaccgacuucauucugauggcugggguguauucucucggaccacaucucuaaagggugccugcagaagguugcacuucaaucuaagagccacucaaacgaugucagcauugccaggcuucuacccugccccccacccugacaauauuucuccgacacaccaggccuugaagccucucucaugucuacagcuucagccggcuggaccugucuugaccacuucagauggaagcaugcaacacccuuucccacucuacaucccaacaggacucugaacucucaaguucaacugauccggucuuugccuggaaacagagcagcccgcacaacgagacuucaauaaaugacuccucuagucagccaugugccacccagaaaccuuggauguguccucaguuucuccuccucucccuucccuccuacugucugccagcaagcccccccaccccccgcacuccaucucccauucgaggguccaggaugcuuccugcagcaacaccuccauacgccugccucaaucugugaccccacgaaaucaccuuucacgucgaugcuacccucguuaagucacaaaucugaccuagcugcuuaguuuccuguuucccucggcagggaaaagaaccccagcucugauguaacccuguccugcuuaccugugcagucucagcuaccaucagucccguguacauccuguggacaacucaucuaagugucuauaagucaauugcuuugagcucccaccauccggacucaacagcacuguaggcucucuaccucguccuguccccaaaccagggaagauggacccagcucaagucuccauccuccagcccucuggacuuucgccccuucaaguacagucagagaauagagaugaagcaagugggcaaagcgcaggggugugcaguguuuucacacugucacauucccaccuacaggcgugcugaaccacagucaggacaccuaagucacaggugugacaccccacuagcucaucccucucauuggagagaacacauuagggucaacaggucaaaccagcgucacuaagacugaaauucagugccagguauaguggcgcacaccuuuaaucccagcacuugggaggcagaggcaggcagauuucugaguucgaagccagccuugucuacaaagugaguuccaggacagccagggcuacacagagaaacccugucucgaaaaaccaaaaacaaaaaaaaaaaggacugaaauucaguggacucuaggccagggccuggcacgccuaacccucaacagacacagaacauggacgacaaccaccaagcuaauccacagaguacuuucuugugucuguguggucuccugagauguuccuguguguacauugucuguguguagauguuagagaucaagguugggugucuucuccagucacucuccacaccccuuuuugaaggucucucgguaacacggacgguucagcuggcuggccagggggcuccagggaucccccggugcuggauuacagacaagagcuuuuuauguggaugauaguuucugaacucaggaccuagugcuccuguggcaagcacaguacucgcuaagccauccccgacucuuacugaaucugaaccaccucaguuacugagccacuuaagugacacaaaggacaucacucugagucuucuuuccuuccuuaugcccugggcagguggcugagucuuucugccuuauuuuacuuaugaauaacacucaauucaaacucuagaacagugguucucagccuuccuaaugcugcaacccuucaacacaguuccucaugcuguggugaacuccaccuguaaaauuacuuuuguuguuacuucauaacugucaucugcuacuguuaggaaucacaaugugaauaugcaagauaucugauaugacccccacagggucacagcccacagguugagaacugcugcucuagcgccuagccugcgauaccacacaaaagcacuuagcccaacauccaaauuagcuaaauccaacucuauauauccaccuccgaguucccaagugauguaguaugcucuagcauacaaacagaugcccagggucuuauguccuacuggucagcagcuagcucuauaggaccccuggaagcugcaacugaugacugacagcuccugguccagcaaccaaccaaccaaccacggagggcuucccucacucgguuccagaaaccccucaccuuuccuccaucacccucacugcaccacugaccacuccacugguauaccucacugcaucccauauucauucaaagcucaucucacuuccuguagaaaagccaaauuccagggccccuacucacuguccagaaggauaugggaggcuuaagucagucauacagcuggguggacuucugauuuccuaacccugguguuuggggggacacugaacgauacccguuccccaucucucacccaaaucuuggacagucggggcuacgagaucuuuccuguccuguacucuaaggaugaaugaaaucacccaaaaguggaaaaaaaaguuuggucuguccagcaccggagaguguuuucccaaccccagaaugcugcuggaguuuggaguuaguuuguucacuguaucacugugguccacuucucccuuagagucuguccugcccccucgggcaccauggcuucugcuucgcagagaucagccccaggugucacugggaaucggaaugcaugggaaacugaggucccuaacggggcaggaccggcccgaagcccugagugcaguuccuggacccgcuuugcuaggguccggggucggaggucagggagucaagggucacggguccccguacccgggucuggccggagcaggagccgcgaggacaggacacaaacccggcuuccuggcggaacgccuacggcccucucaccuggccgccgucugccucuucgccccacucugaggcauucccgaaguagucuucucccauaauuguacccggcgccggacccgccauaucugccgcgucuccucacugcgcgugcgccggacacaacaaauggaagagcgcgugcgcgguucug

SEQ ID NO: 1321 - RNA, 12014 nt, Mus musculus
gccccgcccucgggguguguccaacuugggcgccuccuaaaggaccgggcggggcgucccgagcgcgugggccugcgggucgggucaagaggucgaaggugcugcgcgugauccaggauccgaauuggcccggagcaggagcauggcgucgucggggucggugcagcagcugccccuggugcugcugauguugcuguuggcgagugcggcacgggccagacucuacuuccgcucgggccagacuugcuaccaucccauucgcggggaccagcuggcucugcuggggcgcaggugggcgcggggcugugccuagggaggaaaagggucaacuucuaggccaggcgcgcacccccugacacuugggaccuugccccauccucccucauuaggccugggaagcacaaaucccaucccuuccuuuugggaugauuuucacauccggggagcucugggguuugcugguuugggcaguucucgccucuacugccuuuguuagugagcauuagcguauuucggagaugcucugucacauucagcuuccaauaguccuggguucugcugguggcucuucugggucaaguucugaaccgaccacaguuugggaagaaggccaacaggagaaaugacuggauuuguggcccugguggggguagggagaggggaggcccuaugcguuccagaguugguuuccauugccaugauguccucccaggacuuauccucggccgcaugaguaccuguccccagcggaucuccccaagaauugggacuggagaaaugugaacggugucaacuaugccagcgucaccaggaaccagcacaucccacaguacugugguuccugcugggcccacggcagcaccagugccauggcagguagguggccuggcgcuccaugcuaagccuagggcagggccaguaucuuggccagguggguggcugcacuucaccauccaaucuaccuuuaggugagccaugauagccauagcccggggcuacaggggcccauggcccuguaccaugauucagacuuggauuuccccucagccagagugagguggcugugucauucuggaguucucuccugugggccuacuagggccucugugggacaggcuugggcuggaaucuggugacaaguggcucccaggaaccuucccuuccucagaacuugugacuucagccauugagaaccaugggaccgguguugcaaaaucacugaguucacaguugguuuguggggcguggaagugaaacugcuucucaguagcagcuggcauuugaggugaacauguuccccaguacgaaauggcccccccagcucucuucuucgaaccuuagccuggccgcccaagagucaaguagaaguucauucaguaggaagagagaggccccagagggcugcugugcccuuccuugguagaggaagcaggagccagggagugccaaucuaccuguagcauggagauucagcuuugccauccccagaggugguuccuggaaaccaauggggaagggagucuccugccugggagugggacucagccaguguccucucuugauuggguaucuuuuuggccaagucuguuguagguggagccuagguugaggauuaagaaaaugaaauuucauuacugaaauggcagugcucuugcccguagggcuuauguaggucuugccugccaguuggcucucagugcccagccuaggaagccucuuucaggucgggagacugcguugugagauggauggcagcuucaguucagcccaucagccuggacucucuuuugaggaugagggguuccugucugagggcagucuguaccccagcaguagccaggggcagauguagcuguggccccucauagagccaccucugagggcuggggcauacugcugacuuuucagaaagaggaagaaagaaagaaggugggcugacaagagguacuuaccaagcaggcaggggguaaggagugggcagccauagcagaggaguagagcaaaguccggggcgcuuaggaaugguguggccagacugcuguuggggaagcgaaaggccccucucagcagagcauaguguggggugagugugacauggagugggaaagauccuugggucucuggaucgaguuaaacgaggaggguguagaacauugcaggaucaggagagauggccagaggcuguugggccuaccccucuugggugggcacuaggcccuaccgagguuguaucuucccaguugcuacaaggcaguguccuuggggaaaauggcugcuucguucuuuucuucuucuucuucuucuucauuuuuuuuuuuuuuuuuuuuugguuuuucgagacaggguuucucuguguagcccuggcuguccuggaacucacuuuguagaccaggcuggccuugaacucagaaauccgccugccucugccucccgagugcugggauuaaaggcgugcgccaccacgcccggcuccguucuucuuaaguccccgacaucuucgucaguagcagucagagccuugcuuccucuuucgaugaguagacaucagagaggacuuccguggggcccuggccauuugccagggacagagcaggagacuaguauaccuuuccccgucucuggguuaaggggcguguggguucuuuaaugaagcguuugccaaugguugaugcgguuaagcauccaagcggccucuccuugaccagucacuucugauaggugaccaagagacccuuggucccacccgucucucacugcccuguugcuccuguuggguuagcuggagccagccccaucccccgcccacgugcuccucugugcccucaccagccucacuuccgcauugccucacgucgaguuuuuuagcuccucaggccaggcuaccaggcuuccuaacauccuaacgaugggguggagcgagucccucgcuguaccacacccggcucugccuccuuccuaggaccuuugcuucgccaguccccacacuucugaguucuggguucccagcagugaccuuuuccuaacuuuccuguccgugugcugcugcccucugaccuccauuccugcggccuucagccccagacauucaggucaucuuacucaccaagcccauccugccccugaggacacucaagcaaaagcuuagagguuaucaaacucaccuuacguuccuccugcaaacuggucccagguucuuuagcuguuccauucgucccuagugagggcacuacauggugucuuuccuaacaccuuggcuccugucuggucacagaccguaugcuugcuaaaccugaguuccauccuauuucuuuauuugauaccaucucaggauuccaaagacagguccuucucugaccuccagagccugcacaguuaucuggcuccuccuccuucuuguccucaugucagcaggugaggaauagucaccuucauacccaaguugcuccucuccuuuucuaauguccucucgcuccucuccuuggaugagaguuuugguuauugcucuauugcugcaaugagacaccaugaccaaggccacuuucaaaaggcagcauguaacuggggcuuugcuuacgaccgucauggugggaagcauggcagcaggcauggugcuggaacagucgcuaaggacuuacaaucugauccagggcccagagguagagaggugcgggcuuuuuuaaaccucagagcccaacccuagaggcacagcuccuccaaggccacaccuccuaauucuuccccaaauaguccaccaacuggagaccaagcauucaaacacaugagacuaugggggccguucucauucaaaccgccacggauaaacaucucccaggcugugcuauguacaugauaacuuagcccccggaugguccccaccacaucuccuugcaguguuguccugcuugcccucugccuugccuccagugccauggcacaagccccacaaagcagaacucgcuccugcuggccaguccuacuguguguacugcacggugcgcagaggugugaauggagauaucaugaugggacuaaggcuaaggacgcagagcgugguuguguagacaggccaucucaagaagccugugaagucuggagcugguugguuggucagguuggagcuagacauuaagucaggucuagaagauggcaggccugagguuauccagacagccccugacagcgggucuuagcugaggucaccagagggaccugagaagaagaaagggaccucagcaagucagagugagaagcacucuucugagguggagugcagaagagccaugccaggcagacaugccaggcgcuucagaagaccgggguggccccucugcugucagaugaggauggagaagggauuuggauggaugggugguguggagauugggacccugacaagaguggcuugaaaggccaaagagagacgugcacgcaauggugaaucccucucucccagugcugagagggaaagcguggagccauugaacucugggaaagaggucugugcuugaaggugcccucucauggaaaggugaccugcugcuggggaugcagagggagaaggcuagagggagccgagcuugggggaaggagacaggagggaggguccaucugccuuggacagcugggagccugcuugccuguagcacagaaagauaucccaggcacagaaacaggucuaaaaugguggcgagacaaggucugcuugugcguuguuccguggcgagcccucugaggugguggagugugacuagggcgugugagggauggcucagagcugaagaccaugugaaggagggagagaaaacaaagguaagcuuugcuuuaggggaggaguggguggggcuauaggggaaauggccuggggugcuugguugcuuuauacgggcgggcgggcgggcguguagagcuuaagagugaagaacaagauggcuuuucaggaaguaggucagccauccccugguggauguugugaugauccuaucuaucucuuagugggggugggggugggggggugguaguacgugagcacugagugcugguguccggccccccacugagacucaucuggcuccccuaggcugcccuugucccuggagaugcccaccccagccuuccccguauggugugucuggucucuagccuccucacaggaguaguuucguugccauccuauagugaugcuuuacaaguucuugggaccucuaaacccggcccugccucaugucacuugcagacagacaggcagaugucauggcgcugaggaagaccagagaaagucucugaaggaccguggggcagagcccugggacguuugcuggggcagucuugguguugggggaacgugggugcugaccagagugcugccucuuacagaccgaaucaacaucaagaggaaaggugcauggcccuccauccugcuguccguacagaaugucauugacuguggcaaugcuggcucuugugaagggggcaaugaccuuccggugugggaguaugcccacaagcauggcauccccgaugagaccugcaacaacuaccaggccaaggaccaagguagacccugccuauguucccacauugcuacacaccugucucguuccaagggagaguggcugagagcucacauuuacuccauaucugucacacuaugugguuggaaugcugcagaggacuccagacuggggauuuagcucagugguagagugcuggccuacuuacuuuacaugaggcccuaggcucaaucucaauuuuuuuuuuuuuuuuugucuuucuacacaggguuucucuguauagcccuggcuguccuggaacucacucuguagaccaggcuggccucgaacucagaaaucugcuugccucugccucccaagugcugggauuaaaggugugcaccgccacugccccacccaaucucaaaucuuaaaaguaaacaaacaaacaaauaaaauaaagcagagcaccgcaugacuggauguggcaugugcgugugcacagcuggcauguggauggucucaugggccuuacuuacagagaaagaauucucugcuguaauuggguguccuuuguucuggaugagcaaacccagcagggaccagagaucccaccagggggacagacacaggguggagggaaggcaauggacugcuuuauggaauaacccaggggccuuaucccuuuuccuucauucccaaacuggcgagugacauccagcugagguuaggucccuuugaccuucacuggugguuagggucaucaggaccacugaccaguuuccucuucccagagccacuauguuccuggugcaacucacgcugggacuggugccugggggguggggaugacuaauuaaguugaugauguaauccuuaaggaguuuacugacccagggaaggaucuaaauagaugauuguuaaguacaggucagccucggugucuuccuuagucucuuuccaccuugcucucucucucugagccuaaagugcauccaguuugcuagccuggcuggcaagcagacuucagagacccacuagucuucaccccccggggcugggaccacagacagguggcaucaugcugacuuucugugggugcuaaggaucugagcgcugguccugcaacagcucuuuacuaccugacuaguuuccccagccuuaaaccugauucuuuucuuccuucauuuuuuauuuuuuauuuuauuauuauuauuuuauuuauuuauuuauugguuuuguuuuguuuuuugagacacguuuucucuguguagcccuggcuguccuggaauucacuuuguagaccaggcuggccucgaacucagaaauccucagaaauccgccugccucugucuccagagugcugggauuaaaggcaugugugcuaccacgcccugccccauuuuuuacuuuuaaaaacaaacuacaaaguauucagcaacagugauauauuguagaaucgcaacauacaauguaaaaagcagguuccuuucuuuuucucccccccucccccccuccaacucagaaauccaccugccucugccuccuaaaugcugggauuaaaggcgugugccaccacugcccggucaaaagcagguuuuugagcaucuccaaguccccacccagcauguuaugcuuugagauuuggguacaauacaucacuauuuuaucuuaggauucccaagaaugcuggaaaauuccaaaauuaggauuacuccuaacauacuuuuagcaaacuucacauucuguuagacagcuauaauuuuuguuucacaaauacaaguuuaguaauuuuucaaagagcuauguccugcaguaguguucaauaugaaacauaauuuacaauuccgaucuccccagugaggcaauggccccacgugaaaucacugcccauuagggguauguucuguauuaagaaugugugauuccuccuugaaagaacaaaggacaaaauauccuagcuaugugauuucacuaguaagcaguuugcccuuuuuuauuagccuuccuuguucucuccaaauguuacacuguacacacgugcauuuguuuucuuacauguauguauuaugggacagauaggcucucccuauaaaggugaacaggguuuccuggguuugggucacuuugcuuaauauuauacaagcuaaaguccauucauuaucucugcaaacuuugugauuccauuuuucuucagcauaguaaucauuuuauaugugccaggucuuuauuauccauucaccuguuggugggcagcuaguuccauuccacugucugccguacugauccauuccacugucgucugccauagugaauaaagcagcaguaaacuugggcaagcaaagaacucacggggaggcuauggggucaggguaugugugcagagguggaacagcuggaucguacgggguucucaggguaugugugcagagguggaacaucuggaucguacaggguucucaggguaggugcccagggguggaacagcuggaucauacgggguucucaggguaugugcccagggguggaacagcuggaucauauggggccucaggguaugugcccagggguggaacagcuggaucauacaggguucucaggguaugugcccagggguggaacagcuggaucauacgggguucucaggguaugugcccagggguggaacagcuggaucauacgggguucucaggguaugugcccagggguggaacagcuggaucauauggggccucaggauaugugcccagggguggaacagcugggucauaugguaguuuuaauuuuuugaggaaucuccaaacugauuuccauaauggcuguguuaauuugcaucuccaucagcaaugaauaagggcuccuuuucuccaaaacauccucuccaacauuugcggucaggucgcuugaugacagucauugugacaaugaugagguaguuucucaaaguaguuucaauuugcauuucccugcuagcuccaugacuagggauauugaauuuuucuucuucuugagacaaggucucacuauguacccuuggcccuccuggaacucaauauguagaccagguuucaaacucagagauccuccuaccccucucccccaagugcugggauuaaagaugucugccaccaccccuagaccuacuuuugaaaaacucgaugcauguggccauuuguugacuggcaggcagucuuccuuccuugcuguucaauguuugaagugcuuaguaaauucuggauguuucaaguguagcugguaaagauuuucuucuauucuguggauccuguguucugacgcuguacaaaaacauuuauuuucagguggucucauuuguuauuuggggcuaaucccuguucuacugauagucuauucagaaaguuccagccuauccauguaucuuaagggggauuuaacauauccuugucuagaagcuuguguuucggguuuuaaguugaggucuuugaucccacuugaauugaucuuuauacgggauaaaagguagaaaucuaacuuuauuuuucuuauguacauauguaguuuucucagcaccguugguugacugggcuuuuuaauuguuuuuuuuuuuuuuuuuuuuuuucggagacaggguuucucuguguagcccuggcugucuuggaacucacucuguagacgaggcuggccucaaacucagaaauccaccugucucugccucccaaguguuggucuuuuuccugauguauguuuuugccuccuuugucaagaauuaaggggcauaauguugucaggucuguccagauguucuguccaucugucuguuacuaugucagcgcuaguuuugaucacuauagcucuguaguguaagucgaggccagcuuuggcuguuccuguaaaccaaauucugaugcuucucaaugcaagaagaggaugcacgucuucaaaucaaguacacuggccugcucagucacuagccugcagugcaauugccugguucauuuuaaaaaucugauugcauucaguuuuuaauuccagcaugcugugagggccuccuggccuuuaaagcagaagagaagggcuacuguagagggcucugcuauguacuaauccugcuauguauccugccauguacuaauccugccauguaguaauccaacccgcuuguucuuucuguucugcccaggccggggugggggaggggcuucucuuugcagcugagagaagcauguaauuagggagcaccugagcuggauggcuuccgcugucagcuaaugaauggcacacuaaaugagaaaaguggagaagauggggcgggcuucguuagcggguuaaugaggagcuagugucaugcugacuucuuguguuguagacugugacaaguuuaaccagugugggaccugcacugaauucaaagagugucacaccauccagaauuacacccucuggagagugggugauuacggcucccuguccgggagggagaagaugauggccgagaucuaugccaauggucccaucagguaaggagaggucucuucggguaguggugaagccacagcuaggucugugcacauuccuguaccuuguucgucuuuccuaccuugccauugugacccccuagcuugaguaccacauaacguuuuuugccuguuggcuuucucagaaguaaacaggagccauuagccagucugccccagggaacuccuguguaagcuagaagccccugacuggugaaucuggauguuggugggaccacugaagcaggguuuggacuccuguagcccgagucacacaaacacccaugugccacuuacacugauaacuuuucacagcugcgggauaauggcaacagagaugaugucuaacuacacugggggcaucuaugcugagcaccaggaccaggccguuaucaaccacaucaucucuguagcuggcuggggugucagcaacgauggcaucgaguacuggauuguccgaaauucauggggcgaacccuggguaagauagcuccccuuucuuaagguuagacuggaauccacaacccuccucagcuucacggagagcuggcugcagcuaugucaccaggacacaagcaacgucagggcugugcaggacugcugcugucccgugcguguagcacuggguguuagaagccccugaggugccaguggcuccuccccaagccccggugcucgggaaacaguuaaggcuggggucaaacaguccuguugguggcgacugacuggcuacgccuugaggaccagcucaugcuugcuccugccauguguuucauucaccguguguuucauucgagcugggucaaagguccaggggaggauaaguggccacaagugggguauuaacagggagacaaucacauuuucuugcauuauuuagcugccugcagaguuaaacauuuaacugagaggggccguaucagagcuuugcugcuuaugugggccugagggagccugucuggacccucagauucuauagggcuagucuacggaugguggcugagggcagggccugggucuacagaacagagggaccauguccugaggcacuaaugcagaguucuugcuccuuacagggugagaaaggcuggaugaggaucgugaccagcaccuacaagggaggcacaggugacagcuacaaccuugccaucgagagugccugcacauuuggggaccccauuguuuagguagaugucucuggaagcagcgcugugaaccaugacagggaggggugauuaauuacugacacuggacauguccagacagcuauaaacagugcuuguggacaugaggaccagaguguggacugcaucccgagaggagacgguaaaggaugaaacacaacugcacugggacccuccgccguacccuccaggccugccuccuccaccacugagcccuccaggccugccuccucuucuacagugcuugccuucagccacccggagaagagagcuaugguuuaggacagcucaacuuaucaccagaucuggagcccuggaauccaugggaggggggaacaaguccagacugcuuaagaaaugaguaaaauaucuggcuucccacgcuuguguacuuuauuuacacgagacuagcacacacaacacacgcacacucccacacacacacauacaacucaacauuacucuuggaaacuuaaaguaacugaccaucugggucauaggaaggaaacuuacauaaacccuucaugaagugucccagcugcuagauucccacuacccagaggcccacugggucccuguucagagguggcacacgccugggaugugacauguagcacagagccacacugcgacacaggggggcugucugccacagaagcuaccuuugagaagaguugccugcuucuucccagcagacccugcuuccaggaggcugguugagccucuucacagagcagcuuucugaacgaguccucugguccccccaccccaggcuggcauggaaguuucggcuucaguuacagaugcgcucaguucaccacgaugaaguucgacuugcagugagcugu

SEQ ID NO: 1322 - RNA, 565 nt, Mus musculus
cucuggagucaucuuguuuaucuguuagcucccauuguaagucaucccccagaaagccagcccuggccugucuccaucauggcacucagcaccucuggauagcagggguuuaaagguuauugaaaaugaaauaguuauuugaggaaugaauuaauuaggccauuuaguuuaucugcuugacuucuagucuguaggcacgugagggugaggcucuugcuaggcuuguucagugauuuccucccuguaccuaauaauuacagaugacauucgugagagaaugacuaagaagugagggggcaggagcggauggcaugugguucuauucagagaugugccggguaagauggacgaacugcuuggcuuggguuucagguguagcuucccaccucugcgcacccuguuccccgcauccugugccucccgacagaacaauuugccuuuugaaaugacaguuggaggaaaaucuuugcaucucgguacuuaaagagcuacuuagaauuacccuuugucccuaguuuguucaauuguuaaaaacaaauaaagccagguuaauuuaggagggugg

SEQ ID NO: 1323 - RNA, 927 nt, Mus musculus
uggagacuugagacaaggacucaaagaugaagagaggcuaagaaggacuuccauaucucugacagggaugucuucaguuuguccuuuaagcuguggcuguggacaguuuugauccuuguguagugauaugcacuguaccagccaaguaagcuucacacagaguuucaugaaaggcaccuccaggacaccuugaaggaguggaguauuugaacagaacuucaaaaagguaagauuguugaggguaaauacagagagaguauauucagggagcagaaagcccaggcucgaaguccaaggguguggaaggauauggucauaggugucagguugcuuaagcugcaauaaaguagagaaugguugggcaguagggacagaggguccaagcuagccauguaaguggaccauguuacuagagccugucagccacacaccaggauugccauccugggaccucauugacauuggagcuacauucuuuuuguuguaggacaccugucaccauccugugcuugggaguugcugagcagccauccuggccucugcccacugggugccaagagcaaccgcaccacuaacagaggcaaccaaccaugucuccaaacuggccagggccucauggggaagcugcucagacugagaacaguuaucggaggaaaugaggaaagcaguggccucuaucagaggucaccagaagcuaugccuguagugaaucaaggcaggaagcaaagaaaacagacugaaaggauuaacaggaggcugagucaaguggaugaagaaauucuuguucacuaagguuuccacuguagaagcuugaagacccaacuacacugagcaacacccacauaaaaaugucaggcaugaagcuaacaaccaacagagccaguuaguaagggucaaguucagugagagacccugccuccaaagagg

SEQ ID NO: 1324 - RNA, 183492 nt, Mus musculus
cagucagaagaggaggcggcucuuccaggucaagcuugcaagcuccuuucuguaacucagcggucaugggaguuucugugugauguguucugcgugacucuacuggguguugugagagaagguuagucaagcucagaacuccaaacaugguaagugccaggucaucuccugcggugccgucgguguggggaaaagaggggagugggagagaacucgcuucuggccagagauccauugcccugggcaggcaggagcgggaggacugcaggacgcuuuccacauggccgcggguggcugucuggccaugggaaggcacggacccaacucggugggugguggaaaagggcagcucuaggcaccagguucccagccuccagcaucccacgcuggauaccccggaagugcuuaggacagaauggggucccagggguggcacuggcuucggggccaaagggaggagaaguugggggauaggggccacugaaugguucccacgcgagcgagcguccuuggucagguccggggcuggaguacuggaguacaggauugccuucuggcgggagguuuucuuuuuaauuuuuguuacugugugaauuugauugcaguuuggcugcagggcuucccaaguaugaagcagagauggcugcacuggacauugccuguauaauuuaauaaugcucuuuaauugcaaagaaaggcucugugccuuuaaaaaggaaaauaaguggagucuggaaaauucuagugaaugcaaauuucccagacuagagcucugucugcaacuguggcggaauugcugagccaggaaagcuucagcugucugaaucauuugcucugugaucuuacaguggaggagcugcuguuguccuagucccagcuguguuuuccaggcuaaugagggacucuguccaugccucucuaucaggaacccuaguggaagguagcuugggguucuuuaugggagucucuucagagccaucuguugcaaacugugaagaaggccaaaagccaugucauggugauuguaauugucuccuuugccaggccaggaggagcaaguuuccugaguuaucugagucaguucugcuauuuccaaggacugugguucuguugguccauguggugaucauagcagaggcccuuuuccuuugacccuuccugaguguggauuaauggggaugagggaagcucaguagcccuaguagcuuguggacuuggguaccaaagguuuuccacggagaucucuugccagccuuggugcgaggguuccagcaaauacaaaggaaugcaggcagggaggggaaguugcaaacccacuucugcagugccagucaacucuaccuccgucucugcugugccaugcaguaauucugugccacccugcacugaguaggguccccaagugcacugggggcuuggucaguaauguuuuuuuuuagauacuuggcaguucccuugugcaggguuguuuuauuagacuucuccugaauuugucccaguguauucuagcuucugcaaacuucauagaggucuccauuucuuuccacuuaucccuguaaguaggauacaagaugcuacuuuuuuuuuuuuuuuuuugauuuuauuuuugagacaggguuucucuguauagcccuggcuguccuggaacucacucuguagaccaggcuggccucgaucucagaaauccgccugccucugccucccaagugcugggguuaaaggcgugccccaccacgcccgggugaugcuacucuuaaaaaguuuacuuggcauaagacauagcuuguguaagcucuccccacugcagcuguuguaaauucuaccuucuacuuuugcuauuuuucucaucuccugcgaccuccaacucaggaacccaucucugagaaauggcuugcuauuucagggcucugagacacuuaaucagugauucugggggucuuugcuguguaaaucuccuagcagucuuaaguaggauuuguaaucuccaguccauauuaaaauuguucaaaauaaccuggggacugaacaggaaagaaacuuaugggugagagcauguguggaauccaaaaccuguuuuuggcugccuggucuuugagcauuagccgcagcugaauccaugcugucauuaagacauuuuuccuaauuaauauuuuaguuguauauggagagauuuuuucuggggugacaugucaguucugggagagcugucucuucuuccccauauagagauguuucuaagacaagcuauuuugacucagguagccuugauccuggucugcugcuacccaggacaauggccuugcuuuccucuugauauaaauuccuaaauucuugaguuaaagaauguagcgggcuggugagauggcucagugggaaaagagcacccgacugcucuuccgaagguccggaguucaaaucccagcaaccacaugguggcucacaaccaucugaaacaagaucaagacuccuucuucuggagugucugaagacagcuacaguguacuuacauauaauaaauaaaaaaaucuuuaaaaaaaaaaaaaaaaaagaauguagcaaaaaaguguuuuauaauugcucauuugagucauauaaugaacccuccauaucuuccaccuuuagauaagaacgggagcaaugguuuacuguuaucucugucaggugaaacagggcgggagauagcuugaucauagauaaaaccauaagagaaucugcuccaggugucaccauucuagagaaggauaagagucaggcagggugaauaauuuuguaauuuaacagcauguauuaaauaaugcaugauauuaaauaaaauuagauuggugggugcuuaguuugugcagguuagcuugagccagugauaaugaauuucuguuuuaggaucuguacuauauagauagaauguaucagaaauguaaaacacaugccauuagcuggagcugugugugucagauuauagaucucaguaguuaacaaagcacauaggaacaaggucaaacacuaucuuauuaaugccauuccuucuaccaagaaaggccugaucuuuuucaaaucaguacagugauauauuuuucccaauauagguguggguuuguuguuguuauguuuguuuuaccaacccagugaggacaauuguucugauuaaugcacugagugcuccucagugacauguguccugcuuugcucugagcuuugucucauagccauuagguggaaaguacuugcaauuuaccugaacccagccugaagccacaaaacaaaguuuguguccaaaaaacccucuucaguugcuaauauucuggcacugaccaccuguggacaguuugguaacuccagugucagcugauuaaugggauaugcaagcuauccagcuugauuccaggaggaagaagggaaauugccuccugaguccugucauuggagcucaggcaagcuccaaagcagugaacccagggucacugaccagaaagguggagaggcaggcagguaagcagcagggaucaggaaucuuagccccucccaagggcuuggcgggagaacagacagguaggcuauuggaggagacacauuggugcuacugaacuggaaaucugcagauauggaaaaggauuggcccaggcuggaaacacuauauugugucccuucagcaaacucuaacccuaaggguguugcucaugucacucaagauucaauagccaaucagaaccuccacauggagcugccaguuagaagaggcggugacuuccggguaccaagccugcaaguuucucuguguaacucagcugaucucaguguuucugugugaucuguucuuagugucuucgcuggaugcugugaauuuagcucaagcaagcucagaacuucacacaugguaagugcagugucaugucccacaaagaggaggagcuagcaucuuagcaaaggaugccuguguacuaggucuucccagagccaggaugguaagcaucagccagacagauggggccaccugugaggucuuuuguggaccuagucucuccuuuuggaccaggcuguggccucugaguaacuuuauuauaagacugcacuggaaaaaaccuuugugucaggggcuuguguguggaaauacacuuggcaggugagaaccagaggaacagcuuacuguguacacugucagguaaaacagugcugacaagagcuaggucacagaccaaaggaaaggggaguaugcugcaggggccacuguuauguagaagggccugauuagggcagugagaaugauuuuguaauuucacagauuguauuaauuaugcauggacguauauaaaacuagauucguggguguuuaauuugggcagguuagcuugaaccaguggguaaugaauucccauuuuaggaucuguauuaugagauaugugcaauccuugggugacauauuuaagugagcccacaaauauuaaacacaugacauuaucuguagcugugugugucacauuguagacaucaguaguuaacaaagcacuuaggggcaaggucaaacacuaucuuauuaaugccauuccuucuaccaagaagggccuggucuuuuucaaaucagaacagugauauauuuuacuaauauagguguggguuuguuguuguuauguuuguuuuaccaacccagugaggacaauuguucugauuaaugcacugagugcuccucagugacauguguccugcuuugcucugagccuugucucauagccauuagguagaaaguacuugcaauuuaccugaacccagccugaagccacaaaacaaaaucuuauauccuaaaaucccucuucaguugcuaauauucuggcacugaccaccuguggacaguuugguaacuccagugucagcugauugaugggguaugcaagcuacccagcuugauuccaggaggaagaaggggaaaugccuccugagcgcuggauuuggagcucaggcaagcuccaaccuuucaaagcagugaacccagggucacugaccagaaagguggagaggcaggcagguaagcagcagggaucaagaaucuuagccccucagaagggcuuggcaggggaucagacagguaggccauuggaggagacacacuagugcuacugaacuggaaaucugcagauauggaaaaggauuggcccaggcucgaaccauugugcugugucccuacagacacucugacccuaagcaugguccucaugucacucaagacucaauggccaaucaaaaccuccacauggaguugccaggcagaagaggaggugacucuuccagguacuaagccugcaaguuucucuguguaacucagcugcucucagauuuucuguggaaucgguucuuauuauuuuuacugaaugcugugagguuagcucaggcaagcuuagaacuucagacaugguaagugcaacuucaucuccaacgaaguggggugagcaagcaucuuagcaaaggaugccuguguaauaggucuucccagaggcaggaugguaagccucagccagacagauggggccaccugugaggucccuuguggacuuagucucuccuuuuggaccaggcuguggccucugaguaacuuuauuauaagccugcaucuggacaaaaccuuuguggcaggggcuuguguguggaaauacacuuggcaggaugagaaccagaggaacagcuuacuguguacacugucagauaaaacagugcugacaagagcuaggucacagaccagagggggaguaugcugcaggggucacuguuauggagaaggaccugauuagggcagugagaauaauuugauaacuucacagauuauauuaauuuauggauauaguuuaguaaaaucugauugguggguguuuaauuugggcagguuagcuagaaccaguuaguaaugaauucccauuucaggaucuguauuagauaaacaugugcaauccuugggugacauauuuaagugagcucaaaaauguaaaacacaugccauuacuuguaacugugugugucacauuauaggucucaguaguuaacaaagcacauaggggcaaggucaaaugcuaucuuauuaaugacauuccuucuaccaggaagggccugaucuuuuucaaaucaguacaggaauauauuuuuucaauuauauugaucuuuuuaaauauuaaauuuugguauuacuuuucugaauuucauuuucauuaugcauaggugauuugacgucuuacguguuucuauucuccaauauuuuccccaaauuaagaauuucauuccuauuuuuaaagagauuucacaucuguauguuuagagaaacaucuccuguagcuccuacuuucuuuaugccaugcaguuaagacuugcuuugaacuccuaauccucccucugcugcccagggcuuggaaaacauuccuacaacugcuuucaggcuggguucugacugaucagugagacaaaagacaccagggaaugaguguugucuaaccucccuggguuacaggguuacaaauuaggggauuacaaauaaagagggacagguauaagguugaguucacugaccaacuuugaagcuggucuacuugcagcacagaaaaggaggaggaauaagguaggugaggccuuucugcuuuggcagugguugacauucaccgugaggagucaaguaaucaauuuuacacaaucaguaaaauuccauacuggucaucuucaggcauuuuucagauuagggcaaugucaaaugagaucacaggcccucguugugacaccauauugcuggcauaccucaccaucuaccccagcaguaggacugccaaucucccagcugccauuccuuaugcaauucaaucauuuaggaacuggacuuuucaucuaucauuaaucauccugaucugacucuugcuucugcccuccuuccucucuccacaaggucccaggucaugucuacucuauacuaucccagguauaacugggucuggcuguguucacucuuuuguguauaauauacuuucuccuccaccauaccuagaagcagugaugucuuuacauuuuauuucuucauuuucuucccucuuuuugcccauuaaaaguuucuaucuuuaaaauucauagccacuuuuacuuuuaauauuguuaauguaugaauuugaucccagguugucugcaggaccaccccacuaugaagaagaguuggcugcaugcauaauugaauauacaaagaaaggacccuaggccuuuuaaauggaaaauacuuggucugcaggacuagaauauucuuuucaauguaaauuuuccagacuagggcuaugucugcuuguaggguguaacaguugagcuuggaagguuucagcugucugagucuuuugcucugugaucccacaguagaggagccacuguugcccugaggccccgcuggcuuuuccaagcuaaugagggacuuugggcaggacuaacaaucaggaacacuaggggaagguagcuuacagguucuuuacaggauucuccucagaugcauguguuacaagcugccuggaagacuacaagccauccccugguuauuauaguaaucuccacugagaauacaggaggagcaagucugcagagcuauuugagucugaucugcugguucuaaauggacuaugggucagagugugguucuguugguccauguggugaucauaacagagcuccucguccuuugacucuuccuaaguguggauuuacagggcucccagaggcucgguagcccugggaguggcaagguaugaaacuuaaaugucacuaugcaguguguauauacaggaauugccuuugguguguaguaggacaacauuggaaaagcaaugguuugauuucuagaauuccugacccuucuguauucaguuuugugugacuaguuuuauaaauacuuuagaaguuaguaguaaagagcugucagcgaucauccuucagaaauauuugauuagauucguuuuaccuuucuguuaacuauugucaaaauggcaugauucacagaaccucaauucuugguuacaaaaaaagcuucugacaugcagaaguuucucagguguugauggugcuggguggguggauaggacagauuggaacauaaugcauauggcaggaagcagacauuaaauuaucauucagcauuguuuuguauacuucgguggggcugguuuaacaugaaauuacuaagggucauaaacagcuauugagccauaguccaacuuucucaucaucaacaauuucaaugagaacucuagagcauggggccucucuguuugaagacagaucaguaguaucuggagggucagauuuauaacaguuucagggucacuuauuuauguuauuuuuaucggagucaggaaauaugauuuuauuucuauacacauacuagcacagguaacauuggucaaguucacauuguuccugguguaguuguauuaguuauugaagaaaaguugaaaauuggccacauggaaaugggcagaggaagcuuucccugauauuguguugcaguucugugggcuacugugagaauuaugucuaggauaacagauaguggucuuggucuuuagacagacugcuuguucuucgggaguacuggcuaugguugagaagggugugucugcccauacuugggggcuaagacacagacauguggcaagaaaggaaggggagauggaaaaggucuuuuguaucugcagguagcauggacaggugagaggaaacugcaguccuaagggcacucuugcauauugggucucagggaacaaaaaaugggugaaggucuagcagcauucuacaugguuccauguauuaacaucuuaauacuaaggcaucagguucccagagaucauuuauuuacuuaaguuuuuguuguccaacugugaaagacuggauaaaaaguacuaugugggugggcagggcagucagcgaauacucauuuugaaguacaccuuuacacuguugucuguaucauauuuuuuuauauacacacguaucgaaucuuuuaggauuuagucaccuaugaugacgugcaggugaacuucacucaggaugagugggcuuugcuggauccuucucagaagagucucuacaaagaugugaugcuagagaccuauaggaaucucacagcuauagguaauauuaugauuuuuuuauuuacuuuauaacauguaugcacaacuguuucuuuguuauuguuauuuguuuuuauaauuucaauugagaaugaggaagaauaugaugaauaaaucacucaugguuuuaaaguucaauggaguuaauaaauacuguuuaauagccaauaauguaacauacuuucucugguacuggguuuagguuacauuugggaagaacauacgauugaagaccauuuucaaacuucuagaagucauggaagguaauuuuacucugcaagcugaggagaaaaugccuaugaagaaaguuuaacuugugguacaaguaguaaagaaaaccaauaggguacaauaagcacugcuuucagugauggauguuuacugacuuucauaaaaaucauauauguuuauggcagauauguaacuguuguuugcaagacauuccauuaggucaaagacagagaaauaauggcuuaacacauauguuacuguuuaaaucaagccuaguacagccaugcuauacaagugugagugucuucagucucauaucacuuagcuauugcaaaaggaacacacagugauuaggugacaaguauaugucuaaaaccuaguaaugagcaaauaauccauaguauaucugagcucaaugauauacuuguaauaacauugcuaaauuuagugagaugaacaguucauaagauucaaaaaugguuuuguggaaaaaccuuaaucucuauaccacaucucugugacaaaaaaaagucagcugugaauguaauguggaauuuucacuuguuauucuucuuuugauguggaugucauagguuacgauugauacaagccuugugaucacuggggcauugaaagaagccacauaccuuucacuuuuccagaacaauuagaggauaugcaguauaacauauuuugaacaacauacuaaaugugcuauauuaguuuauaaaaaauuuguuuccgaacauuccuggggacauuuaccaacucuaacugcugaaaauaguaaugagaauuaaggcaguagaaauuuuuuuuucuuuugcauuuguucauauuccaaauguaguauuacucucaugauaacaaaauuugugaaugcaaucauugugcaaacacugugaguucuuccuguuuuuuuucaaauaugugaguaacauuuuauagaaaaaguauguuauaaaugugagccugauaaucaauacuguucccauuucauauauccucgaagauguaaaacaauucauaauuuauuagaacuccuuugaauauaaacaaaguaauauuauguuaacauuagauugcucuguucaaugaaaccaaaauuuaaaacaauucauacagauaaaaagacucaucaguauaaucaguguaagaaagauuucacgugugcaaauuuuauuugcaggcaugaaagaaguuguucugcagagcaacccucugaguuuauucaaugugguaaagccuuugcauaugagagugguagacaaaggcaucaaauuaaacauaauggagagaaacaccaugacuguaaccaaugugguaaggacuuuagaacauggaauguccugcaaauacauaagcgaacacauacaggagagaaacccuaugacuguaaacaaugugguaaagucuuugcaagaagcugucaucuccaaauacauaaucgaacacaugcaggagagaaacaguaugaauguaaccaaugugguaaagcuuugaaaagaaggagugaccuccaaauccauaagcgaacacauacaggagagaaacccuaugaauguaaccaauguggaaaagccuuugcaaguaguggugaccuccaacaacauaaacgaacacauacaggagagaaacccuaugaauguaaacaaugugguaaagccuuuucagaaugcagucaucuccgaauacauaagcgaacacauacaggagagaaacccuaugaauguaaacaaugugguaaagccuuugcacauagcagucaucuccacaaacaugagcgaacacauacaggagacaaacccuaugaauguaaccaaugugguaaagccuuugcaguaaucuauacucuccaaaugcauaagcgaacacauacaggagacaaacccuaugaauguaaccaaugugguaaagccuuugcaguaaucuauacucuccaaaugcauaagcgaacacauacaggagacaaacccuaugaauguaaccaaugugguaaagccuuugcaguaaucuauacucuccaaaggcauaagcaaacacauacaggagagaaacccuauaaauguaaacaaugugguaaagccuuuacaagaagcugucaucuccgaauacauaagcgaacacauacaggagagaaacccuaugaauguaaccaauguggaaaagccuuugcaagaaguggugaccuccaaaaacauaaacgaacacauacaggagagaaacccuaugaauguaaacaaugugguaaagccuuugcacauagcagucaucuccacaaacaugagcgaacacauacaggagacaaacccuaugaauguaaccaaugugguaaagccuuugcagaaagcaguacucuccaaauccauaaccgaacacauacaggagagaaacccuaugaauguaaccaaugugguaaagcuuuuauaacaaggagaguccuccaaauacauaagcgaacacauaccggagagaaaccauaugaauguaaacaaugugguaaagccuucgcaagcaguagugaccuccaaaaacauaaacgaacacauucaggagcgaaacccuaugaauguaaacaaugugguaaagcuuuugcacaaagcagucaucuccgaauacauaagcaaacacauacaggagagagacccuaugaauguaacuaguaugguaaagccuuugcaggaagcaguguucuccaaugccauaaaagauaaauacaggagagacaccauaugaauguaaccaaggugguaaacccuuugaaggaagcaguggucuugaauaucauaaucgaacacacacagcugaaaaacccaggaauguaaccaaugugguaaagucuuugcaggaaggagugaccuuuaaagagaaaagaccauacaggagagaaacucuauguagguaucugauguuauaaagccuuugcagcaagcauugaucuccaaguacauaaaugaacauauaccagagaggaaccuuuuaaacguaaccaaugugguaaagcuuuuucgaaaaccaauagucuuuacacacauaaaagcacauauaguugagagaaaugcuuugauuuuaaccaaugugguuaaacuuuuucaaaaagcagucaucaacaaaaucaugaaagagcacguauaggagagagauuuuugaauguuagcaauggugcuuuuauagcuuuuucacaaagcaguggccuccaaauauauaaagcaacacauacaggagagaaacccuaugaauauuggcaauguuuuaaaacacuucuacaucacaaucaucuucaaaucuguaaggaacaugagguuuugagaaauccucugaauaacaccaauuagggaaagcaauuguacaaaagagucaucucccaacacaaaaguauacacacuagauauaaacccuaugaauauaggcaaugugguaaacauuuuauaagucacaguagucucuaaguaaauaaaaagagacacaguugagaaaaacacuaugaaaugaacaagugaacagagccuugugcauuaaaaucuucaaauacauaaaagaagacauagaggugagaaauccgaugucuacaagccaugugguauugcuuucacuugucagucauauucaaagacacaaaagaaaacaaaauguaacaaaaggcugaguguguuuaauauggugaaacuuuuugaauauuuuagagucuucacaaugaaacaauucauacugcaaauaaauuuaggaauauaauauggugaaaccuuuucagauuucccaaaucuucaucauuaugaaugggaaacccauaaaugcauucaauauggggaagccuuuaaacauuucuaauucuuuauaauccugaaaauaaucauacaaaguucaaggggauacaagaaauguuucuuauugucuugcuugaguuacaguccugacauccuuugguaugaauaucaauguggaaauugugaguggaugcccuuuccuccccaacugcuucuuggucauaauguuuaugcaggaauagaaacccugacuaagacaaauugguaucuggagugggguauuccugugucaaccugaccauguuuugggaggacuguggaaggacuuuggaacuuuggguuagaagauccauucuguguuaagaacgcugugggauguuguguaggagcuuggaagauaauguugagaaccgugcagaagauggaagccuggcuugugaaauuuuagagggaaaaugaaagccucuuuucagggccauuguuacuuugugaagauucugugguucugguuaacuggggcugaagaaucagcugugauuaacaagauaccagaacuacuagagugaaaacuuugcauuacugggacuguugaugcugguuagcaggagcuaagaaauuagcagugauuaagaagaaaccagcaucauugaaguggcaucaucugugaaguguuuucugagagcacagaggaaguguucuagagauaaucaaggugguaccuugugcuguggcuggacuugguagugugugagucuuaaccucgugguacugguuuugaaggcaugaagggauaaugcagagcagcuaaggcccagcacuuugagaggucauggaaggcaacuggugaaggugcagacucaggugaaauugauggcccaguacugaagagaucaugcaguguguuggaguugacagguccaugauugaccacgaagaacagcagcagcaguaaaguacaugcaucuggagcauagaggacaaguugugugcuacaaaggacaggguuggaaaagugacccaagcccuugguucuuuuggaguuguccaaaagaucgugaguuggaucccagacauuggacaguuggaguuuaauuuuuacuuuugauugugacugugcccugauguuuuucccucuugaaggaaacaaguauuuuaguggauuccauuguaaaaggcuuuggauuuugaaggauauuggauauuuuaaaagcauugaacuuuuaauauguaaagucuguggggcuuucaaaguuguguauaucuugggcaugaauaagaaacuaagaguugagcauuacuagugauguguuugcgugucaaauugacaaggugucaauuauacuggcuaauuuugugucaacuugacacaagcugaaguuaucacagagaaaggagcuucaguugggaaaugccuccaugagauccagauguaagacauuuucucaauuagugaucaaggggaaaggccccuugugggugggaccaucucucugcacugguagucuuggguucucuaagacagcagucugagcaagccaggugaagcaagcuaguaaagaaacauccuucuguggccucugcaucaguuccugcuucuugaccugcuugaguuccaguccugacuuccuuggugaugaacaguaagcaguaugaaaguguaagccaaauaaacccuuuccuccccaacuugcuucuuggucaugauguuuguguaggaauagaaaccaugaauaagacaagggguauaagguauggauuguaaaaaaaaagauuagacaauaaagaaaugaagaaauaaaauuaauuuuuuuuaaaaaaggaggaucagacagaaacauuccuuccaaauuauaccuuuauuuucacaccaaucaggauuuagggauaggggcuuauguaguuuacagugucaucuguuauauauuauggguguuauagcuuaacuaaucauauggauuuguucuuuggugguaaaguacaggucuuauguuuugaggggcacaaugaaaagcagaaagcauuguuagagacagucauuauguuuuaaaaagaaaauaugaguaaagugagguuggaucuccacaauaccuaauccuuggaaacaaacuuaguuucaccauaugauuaaauucaggauaauaacaaaaaggcaauacuuagggccugguguuuggauuugauuuguuuuucugcuaauucccaauuguguauugauucuuaugcuacuccuguuaaauucuucccaaauuucaugauaauccuguacugggacacugagauucccugccccaagcugauuauaaauggguaacaaaagugccagcagccaauggcuaggcaggcaacaaaggcagaacuuuuggauucauggcaagggaaacaaagaggaucuccaugccaguaaaggauuuggaugccagcuucagagcugggaaagacacaauaccagccacauaaaagcuaggaaagagugaccccaguguucccuccucugauugguucuggagaagcaaagauggccucuagauuuaggaaauuagguguaucacaggggaaccaauagcaauguggauguuugguagugucccagccaaugagcugauuuggcauauuacauaaugcuguuugucuuucauuucagacuccaaaguacuuguaugcuaagcuaagaacuuaaacagguggcauccuauaguagagcagaguaaccaacugagucuacagaaggcaucacaccuacaggauggaaugcaauauuaaaaacuaauuggggauucucaaaugaaaaccaaaugcuaagaugugaaauuaagggaugaggaaaauugguuucuuaguggauucacuuguuuugcugagccauuugaguccucacuagcugugcagguucacaacuaaaacaaaaguugagcuaaaaugguaugcauaauucuuggauuuguggaaugagcugggacucagaaaaaugucccaagcugauccagacauccuuguuggucuggauuuuccaugagcccucuuccaccaugagcccuucuaaaagauuucugucugccucaaauaguuuaagcuuggaggugcaguacaaagagacaggcugcucagaaagcaacaacagagguagaugguagaggcugcccagagcuauaaucagaaaaaaagaauagagagaaaucgaugagauuuguuuuaacuucuuuuaaggaaaaaugagcagguggugauuguguaagaguguuugaggcaaucucugugaagggcccuaaugucugcagaggauucuccacauggcuggcacccuagcacacccagguccuugagaucagugguaaguggaaugcaauauaaguuccaaaaaauacagagggucuuguaauaguaggaacagggacaaaggacagcagcgugaccagcgacugagguuaacuucugguuggagccacccucucccacccccaugcaaucuuuggccagaucucagcagagggcccaaagguccccagaggacucuucaugcugaaggcccccuagcacacucugguccuugagaucacuggugaguggaaugcaacaucacuuccaaaaaauccagagggucuugugcuagcagcaacagggucaaaggacaaaggcaggcccuagcacauccagaaucuugggaucacugagaacugguuaugcaggagaguaagugggcagcagaaguaacuaagcuucuugaacaaggucccuacaggccuucauccucagccagaagacagaccuaacacccagaacccuagacacuuucccugcgagaggggagucggccuccagggagggcucugaccccaggaaucaggauguggaucugaacuccagacuucugugcaccuucucuguuggcacuuucucuuuauguuaccuaggucacauuauauuuaguggauaggauuaaagacaauuaagacuguaguaagauuaagggagaguuucccuuagaauuuaagacauauuucaaacaaccagaauggagauuuuuaaauuauguuuauucuuuaauuauacuccagucauuaucacccccccauuccaaccacuuacaguuucucaucccauaucccgaccccucuguacaucuccaugaggguguccucacacccacaaccauucaacaacauccugccaggcuuccccaaucccugggacuucaagucucucgaggauuaggugugucuucccucccugaguccgggccaggcaguccuccucuguauauauguuagggaccuuggaccaacaaguguaugcugccugguugcuggcucagagucugagagauuuccaaggucaagguuucuugagacuguuggucuucuuguuggguuguaagacucccgggagccuuagcuuacuggggaccugugagugaaccauguggggcuggaaucaauggaaaaagcaagaggaauuuauuguuccacuaaacuggggucaucccagacccuaaggagagguggugacccgcgugccuguucggcgagcuuuuauaugguugucaggggcaaaauagagcaucaaccuggcagugguggcauacaccuuacauuuaaaagcucauaguggauugcccagaccccuuaaugagggcaaugcugcagcagguuugcauaucaggcagaguauaggcauuacacaggaauaguucagccaaacacucucuuucuuuacaucauuaaaaagcaauagguugagacaacaauuugguauuucuugagaaugugcaugucaaauuguaaagacuuucaucaguguccucaauuucuuccuguaucacacaaagguguuaauccucuaggaguuaauccucuaggacugguaccuacucaguuauggcaaauagacauuacuuauauaucugaauuuuaaaaauguuaaacaauguacauaugugcuacauccaauccaguagugagaagcgcgacaggccccgaaaaccugugugcuguccugaggcgagaaguucacggaaacuuagucuccuggaaucuugccaucacguauaaagaaugcuccaauguccuugcuuuaguugguaaacggaucuugggcuuucccuuaauguugcuuuauuauaaguccuccuaagggggcuggagagaugacucggugguuaagagcauugacugcuguucugaagguccugaguucaaagcccagcaaccacauuguggcucacaaccacccauuaugacaucugaugcccucuucugguguaucugaagacagcuauaguggacuuaaacauaauaaauaaacaaaucuuuaaaucacauaauuauaaaaaaaauaagugcuccuaaguauugauuuuuuuuuuuuuuuuuuuuuuuuuuuuuuuuuuuuuuuuuuuuacauauagcuaaguuagauucuaagcagucguugauccgacccugggcauggauagcuaagucauugcccuauguaggaauuuaccaauaucuaggaagagggaaguuagugaccuaaggaggaaccagaguagauacuuagaacuauagauagcugaguuacacccauauacaaguguuuacaauggccuagggggaacaggaacccagaccccuuaaugagggcaaugccacagcagguuugcauaucaggcagaguauaggcauuacacaggaauaguuccgccacacacucucauucuuuuuguuuguuuuuuuuuuucauuuuuaaaauucuauuuauuuauuuauuuauuuauuuguuuauuguauguaaguacacuguagcugucuucagacacuccagaagagggcaucagaucucaguacagaugguugugagccaccauguggaugcugggauuugaacucaggaccuccggaagaccagucagugcucuuuuuuuaaaauauuuuuauuggguauuuuccucauuuacauuuccaaugcuaucccaaaagucccccauucccuccccccacuccccuaccgacccacucccacuuuuuggccauggcguuccccuguacugggacauauaaaauuugcaugaccaauggaccucucuuuccagugauggccgacuaggccaucuuuugauacauaugcaucuagagacaagagcuccgggguacugguucauucauauuguugucccaccuauaggguugcaguucccuuuagcuccuugggugcuuucucuagcugcuccauugggggcccugugauccauccaauagcugacugugagcauccacuuuugugugugcuaggccccggcauagucagaugcacuaaaagaaacacucucauucuuuacaucauuaaaauacuaauagguugagacaacaauuugguauuucuagaaaaugugcaugucaauuuauaaaaacuugucuucaauguccucaauuucuuccuguacugcauaaugguguuaauccuugagaacacauaccuaaucaaguauggcaaauagauguuacuuauguaucugaauuuaaaaaaauguuaaacaauguacauaugacuauugauaucuucucaugcuuucuauuugcaacugcuuuaacaggauaagcaacuaaauaaggaacuagucauugccuacauuguuuuucuauucuugauguucaaaaugacaggaagacauaaaguuacuggccauuacagucaggcauuugugauguuuuguuaacaauuuaauacuugucauauuacugggauuccuuauuauucucaaagacuagguauuguggagcacacccauggaacuuuaaaacaauucucaauuuagcacaaucuucaaucaucagguaggaaagugucaaggaggcaucaucugaaucagguuagccuuucacaauagcugugggauacugucauaguuauauuaauuaagaugaagagacuuagcacgguuaaguugcuccauuuccuaagcagggacccugguuguaaaagaauggagaaagugaacugugcacuagcaaaaauccucugagcacucucugcucuugacuguccauaggugugcacucuugucucaggcucuugacacugcaacauuauaccaccauggaccauacuacggaacuaugagcuaaaaugaccuuuucuuucccauuugcuuucccuggguauuuuauuguaagaauagcauugagacauacuaauaaauuuaaacauuuuguuucucuuuugaggauuuuuaaaaaugaaacauaaaguauauauggcaugaaaggcauuguccaaagaaugccaagugcacacaucucacuagucuaucucuugauggacagccucccucagucucacucucugucaggcaucauugauuucuccagccaggaaacaguagauuccuacuaugcuaacccuggcuugagucacagcuguauacuaccuccaaucugaaacuaagucagaaguagguuaugggacucacaguguucccaaugggguuguauaagcaagaaccaguuccuaagugagagaugacucccugguagcacugccugcaagcaguauagcaaacuccagggauucagcuccuccaaggcaucacccauguuggguugcuuuguuaaugacucagcuagcugacuaugccagccauaauuggaaaagcccaauaauaauuucucucccauucacugagcuuuaaaucacuucagagacaaaguuuugguuguuuugggaguuugagagaagcuaaaaaaaaaaaaaaaucaaagccacccagaaugaaauggcuccaaauguuggcccagcuaagguggaaaaugagaggaacacuuuuuaaucucccuaugucaggacaaaagaugaaaugugauaggcuacuuucaacucugaacccugcauuccacaccuaccuagcuccuucuccccuccuaucucccucuucccacuaguucccuucuuaaucacuugucucugccuccucccaccuaucucacuguccuccccauccugucucccacuuccaacacugccuuucacaccaugauggacuuccaacaaucaugggccaagauaaacauuuccuucccauaauccuaaaauauuuuuguuggguauuuauucgcagcaacaagaaaacccacugaugcuccaaagcaauacuuggguggagccaucuccuaucucucaacaugcucuaucuggaaggaaaggaaguuccuucacaucuccccaggauacauuuaacaacaaacaccccauuaagaacuugcuguaaucauuguccagggucagugccuuggguaguugacacaugagaagcuccugugauaucuugugaacugucacugccauggagcaaggaucccaccucaguguugagacaucagagcugggucuaauguacagacuucaaggaugugcccgucuaagaugaaaaguggaugcacggaggacaagggcaaaagugacagaauuuguccaaagaaaaacaaagcaggggcuucucaaaaagcuaucuugucauuccccccucaccaucccucccacucccuaagaaucccacaagucaggaagguuuuuguugcccucuuguggcgaccucaaauauugcucaauguuuuuugguugcaucaugcaggugguagcagccugauacaaggcaugaaauaaaacuauuuuaaagguuucuguguuuucaaauaauucauuuaaauuguuaauaagaaaaucuaccagugauuuuauuuguuugaaauacccguguguucagacguauugcaggucaucaccauacuugauuucaaauuaugcuacaaagcugaaguaauaaaagucagaaugguacugacacauaaccagacaaggauugaaccacuggaauacaauauccauauauaacugcauaaggucacauuauuucugacaaagacacacacacauacacauacacacccacacauucauauaugaaccccacucacauguucucacacauacacacaugcacaugcuuauguaccugucacaugcagaaacauacacacaugcaucucccauucucggucacaugcucacauccacauaugcacacauacuuacacauaaacaugcuaacacacaaaugcacacauaccugacccucacuuucacacauguucccuuccacacacauacaaacacauacacacaagaaacucuuucccccacaugcucaaacaaacacaaaugcaaccccaaaacaacuuaacagacagacauucacacaugcacugucccauauucucauacacacauucacacauguaaaccaagcacauuugcucacacucacaaacacccacaaacaccggaggacacacauacaugcacacaugcacacacacacacacaagcauaugcaugugcaaacccugugcucacacauacacaugcacccuaccuacaugcucaaacacaaacaggaucacauacaucuccacacacaugcaaaaacacauccccacagucaaacacauuccuccaugcaccacuauaucugacaaucaauauucaggaaaaagaagccaaucuuuucauccugcacagaacuuaauuccaauuggaucaaggacaucaacacaggacucuguacuccaagccugcacgacaaacaucaacgaaucugcaucaacauagaaguacaggagaggaauuucgaaacaagacccuugugcagcaaaggaugagagcaauuacugagaaaggggaccauaugcagcuguacacugaagugucaggugagugaagaggagaagcucacaagacaggagaggccucucugccagaugcucaucugaaagagaaucauagauagaauguacaaagaacuaaaaagaaagucuaaccauuaagaaccuuuaaaaauaaaugaaaaaaaaaaaacgggcccugagugguuaaagagaugacucagaguacuuuggggacaaaauuuuguugacuauauaugccuggguugauuuuuugggcucucuuuuuacuaggcuaucuucuccugguuuguagaaaugcuauugcugauuuucuauccagggugucuuugaggcagguccacacaggagagcacgugggcugcagaaggaaaagagguucuuggacaggaucccuucaguccuucuuccucagccaggagguggagcugauccucaguccucuaugcaccuuuccugacaaaggagaguuggccuguagggagugcucugacccaggaacucaggagagagcuugucucccaggaguacugacagaggcuaacagacacacagaaggaacaagcuccagucagagacagcuagaacaucuaacaccagagauuaccagauggcaaaagguaaacauaagaaucuuaccaacagaaaccaaaaacacuuggcaucaucagaaaccuguaauuccaacacagcaaauccuggauaacccaacaaaccauaucucgugaugcugguaaaggauuuuaagaaggacauuaauaauccccuuaaagaaacagaggacaacacaguuaaaccacuagaagaccuuaaagaggaaacacaaaaaucccuuauauaauauaggaaaacgcaaacaaacaggugaaggaauugaacaaaaccauccaagaucuaaaaauggaaguagaaacaauaaagaaaacccaaagggagacagcucuugagauagaaauccuaggaaagaaaucaugagucauagauuugagcaucaccaacagaaaacaagugauggaagagagaaucucaggugcagaagauuccuuagaaaacauggacacaaaaauaaaaggauguguaaaaugcaaaaagauccuaacccaaaacauccaggaaauccaggacacaaugagaagaccaaaucuaaggauaaucgguauuagaggcgaaugaagauuuucaacuuaaagggucaguaaauaucuucaacaaaauuauagaagaaaacaucccuaaccuaaagaaagugaugcucaugaacauacaagaagccuacagaacucauaauaaacuggacccgaaaagaaauucccccccuacacguaauaaucagaaaaaaugcacuaaauaacgauagaauauuaaaagcaguaaggggaaaaaagucaaguaacauaaagacagaccuauuagaauuauaccagaguucucaccagagacuaugaaagcaacaagauccuggacagauguuauacagaccauaagagaaaacaagugccagcccaggcuauuauacccagcaaaacucucaauuaccauagauggagaaaucaaaguauuccaugacaaaaccaaauucacacaauaucucuccacaaauucagcccuucaaaggacaauaaagagaaaacucaaacacaaggacggaaacuacacccuagaaagagcaagaaagcaauccuucaauaaaccuaaaagaagauagccacaagaacagaauaccaauucuaacaacaaaaauaacaggaagcaacaauuacuuuccuuuacuaucucuuaauaucuaacagacugguuacauaaacaggacccaacguauuguuguauacaggaaacccacauccaggacaaagacagacacuaccuuagaguaaaaggcuggaaaacaauuuccaaguaaauggucccaagaaacaagcugggaucauuugaauaaaauugacuuuuaaccuauaguucucaaaaaugauaaggaaggacacuucuuacucaucaaagguaaaauuuaccaagaugaacucucaauucugaacaucuaugcuccaaaugcaggagcauccacauucauuaaagaaacuuugcuaaaacucaaagcacacaucacaccucacacaauaauagugggggacuuuaauacccuacucucaucaaugaacagauccuggaaauggaaacuaaacagacaaacagagaaacuaacagaaguuaugaaccaauuuuaacaauugucuguagaacauuucauccuaaaacaaaaggauuuaccuucuucucagcaccucaugguaccuucuccaaaacugaccauaaacugaucaaaacugacuggccuggucacaaaacaggccucaacagaacaaaaauauugaaauaauuccaugcauccuaucagaacaccacagaugaaggcugaucuucaguaacaacauaaauaauagaaagccaccauucauguggaaccugaacaacacucuacucaauaacuuagucaaggaagaauuaaagaaauuaaagacguuuuagaguuuaaugaaaaugaagccacaacauacccaaacuuaugaggcacaaugaaagcaguccuaagaggaaaacucauagcucugagugccaacaaaaaggaacuagagagagcacacauggcacaucuaaaagcucuagaacaaaaggaaacaaauucacccaagaggaguagauggcaggaaauaaucaaacucagggcugaaaucaaccaaguggaaaugaagagaacuauacaaagaaucaaccaaaccaggagcugguucuuugaggaaaucaucaauauagauaaacccuuagccagaauccaagaacaucaaaaugaucaucccucacgaucaaguaggcuuccuaccagagaugcagggaugguuuaauauauggaaauccaccaacaaaauacacuauauaaacaaacucaaagacaaaaaccacaugaucaucucauuagaugcugagaaagcauuugacaaaauccaacauccauucaugagaaaaguguuggaaagaucaggaauucaaggcccauaccuaaacauaauaaaagcaauauacagcaaaccaggagccuacaucaaacuaaauggagagaaacuugaagcaaucucacugaaaucagagacuagacaaggcugcccgcucuuucccuaucuagucaacacaguacgugaaauccuagcuagagcaauuaggcaacaaaaggagauuaaggggauucauacugaaaaggaggaagucucuugaucuuugacaaaggagcaaaaaccauccaguggaaaaaggaaagcauuuucaacaaauggugcuacuucaagugguggguagaauggagaagaaugcaaaguuauccauucuuaucuccuuguacaaaacucauguuuaaguggauccaggaacuccacaugaaaacagagacgcugauauuuauagaggagaacauguggaagagccuggaauaugggcauaggaggaaaauuccugaacagaucagcaauggcuugugcuguaagaucaagaaucgacaaaugagaccucauaaaauugcaaagcuucuguaaggcaaaggacacugucaauaagacagaaaggccaacaacagacugggaaaagauaguuaccaauauuaaaucagauaggagacuaauauccaauauauuuaaauaacucaagaagguggagcccagaaaacuaaauaacccaauuaaaaaugggguacaaagcuaaacaaagaauucucaacugaggaauacagaauaucugauaagcaccugaaaaaauguacaacauccuuaaucaucagagaaaugcaaaucagaacaacguugagauuccaccucacacuggucagaaugacuaagauaaaaaauucaggagauaucauaugcuggugaggauguugagaaauaggaacacuccuccauugcuggugggcuaucaagcuuuuacaaccacucuggaaaucaguuuggugguuccccauaaaaguugacauaguacuaccagaagauccaauaauacuacuccugggcauauacccagaagauguuccaauuuguaauaaggacacauacuccacuauguucauagcagccuuauuuauaauagccagaagcuggaaagaacccagauguuccucaacagaggaauggauacagaaaauguaauacauuuacacaacugaguacuacucagcuauuaaaaacagugacuuuaugaaauucuuaggcaaauggauggaucuggagaauaucacccugagugagguaaccaaaucacaaaauaacacacaugauaugcacucacugauaaguggauauuagcccagaaucucagaguacccaagauacuauuugcaaaacacuuaaaacucaagaagaaggaaaaccaaaguguggauacuucaauuguucuucgaaggggaaaaaaaaaaccaugaaggauuuacagagacaaaguuugaagcagagacugaaggauccucucagcaaacucuuguuggcaucuacagcagugucugguuuuggugguuguuuaugggaugcaucccuagauuggguagucuuggauggucauccuugcagucucugcuccaaacuuugucucuguaaauacuucccuucaggagaacacaagaugucuuagucaggguuuuacugcuaugaacagacaacaugaccaaggcaagucuuauaaaaaaaaacccaaaaaacaaaaaacacaacauuuaauuggggcuggcuuauggguucagagguucaguccauuaucaucaaggugggagggagcaugguggcauccaggcagucauggugcaggcagagcugagaguucuaugucuucauccaacagcuacuaguggaagacugccuuccaggcacauagggugagaguauuaagcccacacccacagugacacacauacuccaaccaggucacaccuauuccaacaaggccacaccuccaaauggugccacuucgugauucaagaauauacagaccauuacaaauauugcuuuaaagaaugucuucccuguuaauauuaaugacuccauuauggcuacaagaccaggaggcaaagggguggcuaaugucucaguaaaaugguaaaugcugcaaccuucaggacagcccuuagggcuguggaaaagaccucuaagaucuuggguuccaaauauguaauuccucaaaaacaaugaugcaaauugagcuaugaggggcuucacaaauguaaaggaaaaaaaguaggugcgcugugagccaacuuaucagacagauacuaaggaaggauguagaagauaaugagacuuagagagugguaaguacaagagauucaacccagauaaguuuuuguuguuauagcuguuuuuuauauuuacaaagccaaacagauuccugaguuccauaucagccuggaacagaucaagguuaaguccagguguuuuggaaaugguaauuucaggacuggguagcacucagcuaguuuagcaucugugcuuaacagaggcagguagaucucuaaauucauaugguacagugugguacggugugaacagauaaaaaguaguuuugacuuuugacuuuugaaaaaacaugugacaguuaaaugagaauggcucccauagacuuuuauguuucaauacuuauuuuuuaguuggugggacuguuuucaaaggagcacagguguggccuuuuggaaagaagugucauaugggugcauauucagguuuuaauaucuucugaccaugcucacuuugcuagcuaccucuugucucagguuuaaaauaugagcucucagcucuaccggaugucauguguuuacgcugccaauauugacucuaaugcuuuggaacuguaagcccaaauugaugccuucaauuauaauuucuuuugucuaugguguguuuuaugauaucaauagaaaauaaauauacaaaagaguugcauggaaaaucagaacacagaaaaccaucacuucuaauuucagaaaacaacgaggaacacuauuccaacuaucucuagggcacuaugaucuguuccaugccauugaaauuaucagcgauuccaagauugacaauuauauauuucucugaaaaagcaaccauuuuaagaacauucuacuuuacuuauaacccaaccaauaccaaauaacauuucaacuccaucuuguguugaagauucauguaaagaauugaggcccaaaagcauaggauuacauacauacuacuccuucuuuuuuugaccacuccuuauuuuuuauugaauauuuucuuuauuuacauuucaaauguuauccccucucucaguucucuccucacaauucacuauucccuaccucuaccccugcuucuuugaggguguuccuccaaccacucacuccugccucccugcccuggcacucacuuacacugagguauuauacuucucuuuauuacacauucaauaaauguuguaaauuaugguauauuuagugaaucaaguuuggauggcauucuaaauaaggcccucucucaaaaacaacaacaaugauaaacaucacaauuauauuuugaagaacuauuuuuuauuuucuguuccaaauuaauccuaaauauaauguuugauuaauucuauauuguuaauaacgguguuuucucuaaucaugucccaaguuaaaggccaacuugucauuuuuacuuguuuuuccucuauaaucuugagauuuacacaguauaaauugcuucgacuguucaugguauguuuuuaaaacugcagaauuuaauuguauuacuaagugcaaagcaauuccaguuugugauaauuaguaugcaucuuacccuugaauuugacuacaaaaaguuucucuguuuguacucuggggugaauaucuuuccuaauucagaggagaaugcaagauugaccuggaaauaaaauacaauuuuacuucacaucauuuuggucauuucuuccugguucuugacaguguaaacauaucuacccuuuuaaaaacuaggccuuuuugaaauggguuauauuauggaagugacuauggagaccaguguggccugaaauucaggaauaugaauuugccuccaaacuucugggauugauagcacauacuaccaugcuuggcaauauucauuuugaacaugauuguaagguacuuauucuaaacaucugaaaugacuguaagaauuauuguauugucccaauucuucagugcuuucauuaucuuaguuauucauuuuguuuuuuuuuuuccuaucuucucucuuaccucuacucucucuuuauucuccuucucuuucuuccuuuccuccccccacccucucuucugucaguauaugugugugccuguugauuuugcagcacuggcuauccuaaaacucaguaaucucccagccucuguguucuaaguagaggguuugaaguaaugcuuugcugagugucucaauauguucucucaccaucaccucccucccucaacucuccacccccucgccucccucuaccucugucucucucaaagaauuuuauuuguaugguuauucuuccucuguauuuugguucuccauccaugucuuauacacacgaagacaaggaaagccagcaaagccaccgugucuguuaugugcuuccugcucuguucugaagcuuguucauaaccuucacguggaacauacaugcaguggaccugaacccagucggaagccacagaacaaaauauuguuuccuaaaaucgcucuuuaauuucuuuaauuccuaauauccuggccaacuguccacuugugggacaaauuguuaacuccaauguaaacugauugaugggcuaugcaagcuacucagcuugauucuaggaggaagaaggagaagugccuccugagugcagugcuuugacaucaggcaaguucuaaauuugcacagcagugaacaaaggggcacugcccacgaaggggagaagcaggcagguaaacagcauugaucuggaaucuuagcuccucccaaggaauuggcaggaggaaagacaggucagcuauuggaggagacgcacuagcuacuguagaacaaagcugcagauguagaaaaggauuggcccaggcuggaaccacuaagcugugucccuucaacacacucuaacccuaaggguggugcucaugucauucaagacucaguagccaaucagaaccuccacacggagcugccagucagaagaggagguggcucuuccggguacuaagcccccgaguuccucucuguaacucaggugaccugaguguuucuauguguugcuuucuuaggugucuucagugagugcugcgaggguaacucaggcaagaucagaacuucagacaugguaaguacaaagucaucucccauaaagccuggggagcaagcuucuuagcaaaggaugccugugugguaggucuuuccagcgcauggaugguaagcgucagccaggaauaugggaccaccugcgugcgccuuuguggaccuagucucuucuuggucccggcuguagccucugaauaacuuuauugucugguagcaucuggacaaaaccuuuguggcaggggcuugcguggagaaauauacuugacaggaugagaaccagaggaacagcuuacuguguacacugucagguaaaacugcagacaagagcuaggucacagaccaaaggaaaagggagugugcugcaggggucacuguuauggagaaggaccugauucagggagugagaaugauuuuguaacuucacagacugcauucauuuauggauauaauuuaguaaagcuagguuaguggguguuuuauuugggcagguuagcuugagccaguggguaaugaauucccauuuuaggaucuguauuauguagauuugugcaauccuuguugacauauuuaauugagcucagaaauguaaaacacaugccauuagcuguagcugugugugucacauuguagaucucaguaguuaacaaagcauauaggggcaaggacaaucacuaucuuauuaaugccauuccuucuaccaggaagggccugauuuuuuucagauaaguacagugauauauuuguucaauuauauuuaucuuauuaaaaaguuaauuuuugguaauccuuguuaaauuucauuuuucuuauggauauugaucucuuacuuguuucuguuccccaauauuuccccaaauuuaagaauuucauuccuaauuuuuuuuugaaacagggauucucuguguaccccuggcuaaccuggaauucacucuguagaccaggcaggccucgaacucagaaauucaccuaccucugccuuccuagugcugggauuaaagggaugcaccacugcccggcucauucuuauuuuuaaagagauuuuauauaugucuguuuagagaaacaucuccuguagcuccuacuuuuuuaugccauguaguuaagacuugcguugaacuccuaauccucccucugcuccccacugcuuggaaaacaguccuacaacuucuuucaaguuggguucugacugaucagugagacaaaagacaacagggaaugaauguugucuaaccucccuggguuacagauuuacaaauuaggggauuacaaauaaagagggacagguguguaagguugaguucacugaccaacuuugaagcuggucuacuugcagcacagaaaaggaggaggaaugagguaggugaggccuuucugcuuuggcaguaguugacauucaccgugaggagucaaggaaucaauuuuacauaaucaguacaauuccauauuggccaucuuguggcauuucccagauuagaucaaugacaaaugagaucacaggcccugccuguuacagcauauugcuggcauaccucaccgucuaacccaggaguaggacagccaaucucccagcugucauuccuuauucaauccaaucauuugggaacuggcccuuucaucuaucauuaaucauccugaucuccuggucuggcucuugcuucuccccuccacaaaguucaaggucaugucuacucuauauuaucccaaguauaacuaggucuggcuauguucacucuuuuguguauaaagacuuucuccuccaccauaccuaggagcagugaugucuuuuacuuuuuauuucuucuuuuucuucccuuuucucucuuaaaaacuuaauaguuaacugcuucuagcuuuaaaauucauagccacuuuuacuuuuaaauuauuguuaauguaugaauuuuauuucaguucagcugcaagacuuuccuauuaagaaauagagauggcuguacuggguauugcaugcauaauugauacacaaaguaaggacccugggccuuuuaaauauaaaauacuuggucugcaggacaagaacauucuuuuuuguuguuguuguuuuguuuuguuuuguuuuuuugcuugcuuuuugagacaggguuucucuguguagcccuggcuguccuggaacucacuuuguagacuaggcuggccucgaacucagaaaucugcuugccucugccuccucugcugggauuaaaggcgugcagucaccacaccuggcaagaacauucuuuuaaauguaaauuuuccagacuagggcuaugucugcuuauaggguguaacagcagagcuuggaagguuucagcugucugagucuuuugcucugugauccuacagugaaggagcugcuguugcccugaggcccagcuggguuuuccaugcuaaugagggacucugggcaggccuaacaaucaggaacacuaguggaagguagcuugcagguucuuuacaggauucuccucagaugcauuuguuaaaugcugccuggaagaccacaagucauucccugguuauuauaguaaucuccauugacaguacaggaggagcaagucugcagagcuauuugagucugaucugcugguucuaaauggacugugggucagagugugguucuguugguccauguggugaucauagcagaggcccuuguccuuugacccuucuugaguguggauuuacagggguccggcuugguagcccugggcgugggaagguauggaacuuauaugucacuaugcaguguguauauacaggcauugccuuuguugugcaguaggagagcauuggaaaagcaaugguuugauuucuagaauuugugaccauucuguauucaguuuugugugauuaauuuuaugaauaguguagaaguuaguaguaaagagcugaucaggaucauccuucagaaauauuugauuagauuccauuguuuuguauaugggcucgaguggggcugguuuugccugaaauuacuaagggucaugaucaccuauagagccauagcccaacuuucugaucaucuacaauuacagagagagcccuagagccuuggggccucucugcuuggaagacagaucaguaguaucuguagggucagaauuauaaaaguuuaggagucacuuugaguuauuuuuauuggagucaugaaauaugauuuuauuuuauuuuuauacacacacuagcacauguaacauuggucaagaucacauuguuccugguguaguugccuuagcauugaagaaaaguugaaaauuggucacauggaaauagacagaggaagcuuuuccugauauuguguugcugcucugugggcuacuaugagcaaugugucuaugguaagagauagugggcuuggucuuaagacagacuacuuagucuucaggaggccugacuaugguugagaagggugugucugcccuuacuugaggucuaagacacagacauguggcuagaagggaaggggagauggaaauggucuuucguaucuacagguggcauuaacagguaagaggaaacugcaguccuaagcgcacucgugcauauugugucucaggaagcaaaaauggggaaggucuagcaguauucaauauguuuccaaacccaacaucuuaauacuaagacaucagguucccagauaucauuuauuuacuuaaguuuuuguugucuaacugagaaagacuggauaaaaaguacuauguggguggacaggguagucagcaaauauucauuuugaaguacaccuuuacacuguugucuguaucauauuuuuuuauguacacacguaucgauucuuuuaggauuuagucaccuaugaugacgugcaggugaacuucacucaggaagagugggcuuugcuggauccuucucagaagagucucuacaaagaugugaugcuagagaccuauaggaaucucaaagcuauagguaauauugugauuuuuuauuugcuuuguaaaaugucuauguuauuguuauuuguuuuuauaauuucaauugagagugaggaauaauauggugaauaaaucacucaugguucuaaaguucaaugaaguuaguaacuuaaauguugccuaauuucugauaauguaacauacuuucucuggggcuguguuuuaggguacauuugggaaggacauacaagugaagaccauuuccaaacuucuagaagucauggaagguaauuuuccucugcaagcuuauguuaaaaugccuauaaagaaaguuuaaugugugcuacagguuguaaagaaaaccaguaggguacaauaagaacugcuuucacucguggauguuuacugaauuucauaaaaucauauaugucuauagcagguauguaauuauacuuugcaaggcauuccuuuaaguucaaagacagagaaaugauggcuuaacauauauauuaguguuuaaaucaagccuaguacagccaugcuguagaagugcaagucucuucagucucauaucgcuuagcuauugcaaaaggaacauacagugauuaggugacaaguauaugucuaaaaccuaguaaugagcaaauaauccauaguauaucugagcucaaugauauacuuguaauaacauugcuaaauuuagugagauggacaguuuauaagauucaagaaucguuuugugguaaaaccuuaacucuguaccacaucucuguggugaaaaagucagcugugugaauauaaaauggaacuuauucauuuguuauucucuuuugauauggaugucauagguuaggauggauacaggccuugugagcauugggguauugaaagaagccacauaccuuucacuuuuccagaacaauuugaggauaugcaguauaccacacuuugaguagacauucuaaaugugcuauaaauuuauaaauaauuaguuucccaauauuauuggggacaaauaccaacucaaacugcugaaaaucacaauaagaauuaggauaguagaaauuuucuuuuguuugcauuuguucauguuccaaauguaguauuaaucucauuauaaaaaaaaaauugugaaugcagaguucuuccuguuuuuuucaaacaugugaauaaccuuauauggaaaaaguaugcuauaaaugugagccagauaaucaguacuguucccauuucauguauccucaaagauguaaaacaauccauaaugcaggagaacaccuuugaauguaaaagucauauuauguuaacauuagauugcuccuuucaaugaaaccaaguuuuaaaagaauucauagagacaaaaauacccaucaguacacucaaugugagaaagauuucacgugugccaauuguguuugcaggcaugaaagaaguuguacugcagugaaacccucugaguuuauucaaugugguaaagccuuugcauaucagagucuuagacaaaggcaugaaagaacacauaaaggagagaaagacuauuacuguaaccaaugugguaaagccuuuauaauaagcagucaucuccaaauacauaaacgaagaaauacaggagagaaacccuaugaauguaaccaauguuguaaaaccuguacuguaaggagugaccuccaaauacauaagcaaacacauacaggagagaaacccuaugaaugcaaccaaugugguaaagccuuugcaggaaguggugacuuccaaaaacauaaacgaagacaaagaggagagaaacccuaugaauguaaccaaugugguaaaaccuuugcuguaaggagugaccuccgaauacauaagcgaacacauacaggagagaaacccuaugaauguaaacaguguaguaaagcuuuuauaagaaggggagaccuccaaauacauaagcgaacacauacaggagagaaacccuaugaauguaaccaaugugguaaagcuuuuauaagaagugcggaccuccaaauacauaagcgaacacauacaggagagcagccuuaugaauguaaccaaugugguaaagcuuuuauaagaaguggggaccuccaaauacauaagcgaauacauacaggagagaaacccuaugaauguaaacaaugugguaaagccuuuacaaaaagcaguaaucuccaaauacaugagcgaacacauacaggagagaaacccuaugaauguaaacaaugugguaaagcguuuauaagaaguggugaccuccaaauacauaagcgaacacauacaggagagaagccuuaugaauguaaccaaugugguaaagcuuuuauaagaaguggggaccuccaaauacauaagcgaacacauacaggagagaaacccuaugaauguaaacaaugugguaaagccuuuacaaaaagcaguaaucuccaaauacaugagcgaacacauacaggagagaaacccuaugaauguaaacaaugugguaaagccuuuacaaaaagcaguaaucuccaaauacaugagcgaacacauacaggagagaaacccuaugaauguaaacaaugugguaaagcuuuuauaagaaguggugaccuccaaauacauaagcgaacacauacaggagagcagccuuaugaauguaaccaaugugguaaagcuuuuauaagaaguggggaccuccaaauacauaagcgaacacauacaggagagaaacccuaugaauguaaacaaugugguaaagccuuuacaaaaagcaguaaucuccaaauacaugagcgaacacauacaggagagaaacccuaugaauguaaacaaugugguaaagcuuuuauaagaaguggugaccuccaaauacauaagcgaacacauacaggagagaaacccuaugaauguaaacaaugugguaaagccuuuacaaaaagcaguaaucuccaaauacaugagcgaacacauacaggagagaaacccuaugaauguaaccaaugugguaaagcuuuuauacauagugguaaucucaaaagacauaaaagaacacauacaggagagaaacucuaugaaggcaucuaauguuauaaagccuuugcagcaagcauggaucuccaaguauguaaaugaacacauaccagagaggaaccuuuuaaauguaaccaacgugguaaagcuuuuucgaaaaccaauugucuuuacacacauaaaagaacauauaguugagagaaaugcuuugacaucaaccaauguuguuaaacuuuuucaaaaagcagucaugaacaaaaucauaaaaacauguauaggagagauuuuugaauguuagcaauguccuuuuacgccuuauucacaaaacaguggccuccaaauauguaaaggaacacauagaggagagaaacccuaugaauaucaucgauguucuaaagcccuucuacaucacaaucaucuucaaauccauaaagaacaugagauggagagaaaucuucugaauaucacuaaguagguaaagucauuguacaaaagagucaucucccaacacaaaaguauacacgcuggauagaaacccuaugaauauaagaaaugugguaaacauuuuauaagucacuauagugucuaaguaaauaaaagaagacacacuugagagaaacccucugaaaguuaucaaagggacaaagccuuguacauaaagaucuucaaauacauagaaguagacauagaggugaaaaacccuuugucuguaagccaggugguauugccuagaguuuucagucauauucaaagacacacaaaaaaaucauaauagagacaaaauccugugagaguauuuaauauggugaagcuuuuugaaaauuucuagagucuucacaaugaaacaauccauacugccaagaaauuuaggaauauaauauggugaaaccuuuucagauuucccaaaucuucaucauuaugaagagaaacccuaugaaugcauucaauauggggaagccucuaagcauuucuaaaucaucaucaugaaaauaaucauacaaaggagaucaaggggauacaagagauguuucuuacugucuuacuugaguuacaguccugacauccuuuggugaucaacagcaauguggaaaguguacgcuggauuaaacccuuuccuccccaacuguuucuuggucaugauguuugugcaggaauagaaacccugacuaagauaaauugguaucaggagugggguauuccugugacaaccugaccauguuuuggaaggacuguggaaggacuuuggaacuuugggccagaagauccauucgguguuaagaacucugugugaugacugugugggauguuguguaggagcuuggaagauaauguugagaacagugcagaagauggaggcuuggcuuuugaaauuucagagggaaaauuaaagacucuuuucagggucauuacuauuuuggauugugaagauucugugguucugguuagcuggggcugaagaaucaggugugauuaacaagauaccagaacuacuagagugaaaacuuugcauugcugggaauauugaugauaguuagcuggagcuaagaauuuagcagugauuaagaagagaccagcaucauugagguggcaucuucugggaaguguuuucugagagcacagaggcaguguucuagagauagccaagguuguaccuuuuacuguggcaugacuugguaauguguaagaguuacccaggugguacugguuuugaagguaugacggaaucaugcagaacagccgagacccagcacugugggagaccaugaaaggccauuggugaauguguagccucaggugcaauugauggcccagaaauuaaggggucaugcaguguuuuggagaugccaggaccaugaaugaccaccaaguacagcagcagcaguaaaguacaggcaucuggagccuagaggacaagcugugugccacaaaggacagggcuggagaagugaccaagcccuuguuggaggccaaaagauggugaguuugaccccagacauuggacaauuagaguuuaauuuuugcuuugauugugacugugcccuaauguuuuucccucuugaagggagaaaauauuuuaguggauuccauaauuaagagacuuuuaauuguaauaggcuuuggauuuuaaaggauauuggauauuuuuaaaggauugaacauuuaauauguaaagacugugggacuuucaaagguguguauaucuuggggaugaagaagaaacuaaggguugagaauuacuagugauguguuugugugucaaguugacaaggugucaauuguaauggcuaguuuugugucaacuugacacaagcugaaguuauaacagagaaaggagcuucagaaaugccuccaggagauccagcuguaaggcauuuucucaauuagugaucaagaaggaaaggccccuugugggugggaccaucucucugggcugguagacuuggguucuauaagagagcaggcugagcaagccaggggaagcaagccaguuaagacacaucucuccauggccucugcaucagcuucugcuuccugaccugcuugaguuccaguccugacuuccuuggugaugaacaguaguauguaaucauaagcccaauaaacccuuuccuccaaaacuugcuucuuggucaugauguuugugcaggaauagaaacccugaauaagacaacggguauaaggucuagauuguaaaaacagauuagacaauaaagaaauaaggggaaaaaaguauuaaaaaaaaaaggagggauagacagaaacauuccuuucuaauuauagcuucacuuucacaccaaucaggauuuagggauaggggcuuauguaguuuacagugucaacuguuauagaauauggguguuauaguuuaaccaagcauauggauuuguucuuuggugguaaagaacauguguuauguuuugaggagcacaaacaagaugaaaagcagaaagcauuguuagagacagucauucuguuuucaagaacaaaauaugaguaaagugagguuggaucuccacaauaccccaugccuggaaacuugaacuuauuuucaccauaugaguaaaugcaggguaauaacaaaaaggcaauacuuagggucugguguuugguuugguuuuucugcucauucccaauuguguauugguucucaugcuacuuguguuuaauuguucccaaauugcaugauaauuuuccauuugagacacugugugggaagccacaugugccguugcaggguggcgcuggcuucugcuggccaccacgcauacauaggcaguaaaguuuuuuuugccaagaugagguuuugagaauuaaccaaaauuaaccaaucagaugagagacaaguuaaccaaucagaugagagagaaguuaaccaaucagauguaggcaugcaaaugagguaguaagcauaacccaagcacaaccaauccgggugugagacacgccucuccuaggccuauauaagcagcaccaauucugggauuggggucacuucgccucuacaaucaaucucuccaaauaaaugugugcggaaggauccuguugcagcgucguucuugcuggccagucaggcgcacgcaagaaguggugccgaagacccaguaaaagaaacaucuucaggcaguagaaaagacccccugcuacagggaggauucagaauugcaucguggggaaggagcggguaauaaaguauucccauaaaacagacugcugagaaggauccggugugcauucagaacucuucagcuggggaauggugguaccaguaaguauaaagaaauuaaugugagucucugagaggcaugcucuccuacgaaauagauucgauaauugccgcugggguugugcugcuugcuaucuuucuugccuugauuuuaugccauugccuuaauugucaaugcccaaaauguaaagauacaaaagauaguauaaaaaauaaaaagcagaaaauuaagucaauuuacccuccucucaaggacucugaguuuuuagaauugucuagcucaguggauucggaauuaucagcaggggaggaggaagauuugaaggaggcugcugcggaguaugaggcagaaagaucugguccaauagggaggaguuucggugcucccccaccuacucugccuuaugcagauaagaaagcaauuggcaauggucacucuuuuugcacuccuagaggguugcgaaaaauaugucaggcuuuuccuguuuuucaggaucaugcucaacagcgauauuaugagccaauaucgcauaaacaggugaaagagcagagucaguaaggaccuauggaguuaaugccucauuuacucagucccaaauugauagacuggcucacaaugccaugacuccuuuugauuugaugagugugguaaaggcaugucuuacgaugggacaguaucuagauuggaagucuauauggcaugaucuguguuugaguuaggcccgugcuaaugcuacugcaggacaacaagcauggagcuuugaaaugcuuacaggucaggguauauggacaaacaaucaauuaggauacccaguacaggucuaugaucaaaccaaucaggcagcagugaaagcuugggaagcauugccuaaucgaggagagguaucugguaacuugacaaaaauuauucagggaaauaaugagcuguucucugaauuuguggcucacaugauggaagcggcagaacgcauauuuagugauucugaggccgcaaugccauuaauugaacaauuaguuuacgagcaauguaccaaagaaugcagaaaugcuaucacaccuuggaaagggaaaggacuacaauuuauuucaagggguggggcugaggguacuacuuccucagguagggcaaacccuugagaaucugaagauucaaaauucucagcuucaacauggucuucccacacauccccgucccauguuauaggaucccauucuuugccaauuagagcccuuacuuuaacugucgacacacucugaggcugagacuugaauuuucgcuguaguucagccaaccuuacaaugagaguuuccguuugauuuucugcaacuugagcucuauugcuacaagagagaagauuuucuucaaggacacacuuagcaacuuuuagaucguuuacuugugucuggagccuuuccauuuuaucacacaacuccuuccucucauucaucauuuuuuccacagauacuaagagcagccagccaguaaaaucauuuuccgauuuuuuccccaucuuguagaaagcuuugugcacugaaucaccuaauucauuaagaaaaucaagggcauuagcuucuuuaaguucggaauauaguuucaaccaugggucuucaaaauucucugagcucccaggagggagagaaucuggagagguuucaauaguugaaagugcugguggaucaacaagccaauuccaguauuuuaaaagauucauccuuguacuucuguuacucuagaaccacuccugguaccaacuucuguauuagucaggguucucuagagucacagaacuuauggauagucucuagauaguaaaggaauuuauugaugacuuacagucggcagcccaauucccaacaaugguucagucgcagcugugaauggaaguccaaggaucuagcaguuacucagucucacacagcaagcaggcgaaggagcaagagcuagacucccuucuuccaauguccuuauauugucuccagcagaagguguagcccagauuaaagguguguuccaccacacccuuaaucccagaugaaaagguguagcccagauuaaagguguguuccuuaaacucggagauucaaucuucuggaauccauagccacuauggcucaagaucuccauaccaagauccugauaaggaucuccaagccuccagauaagggucacugguuagccuuccaauucuggauuguaguucauuccaaauauagucaaguugacaaccaggaauagccacuacaauggaugaaagccuguagagaaauaggaggaccccuuucaaaugcagggcuggcugccgcaguuuugauggugcaaacaaaagaaauaaccugcuauaauuguggacaaacaggucauaugcaaaagcaguguacuaaggguagaaagaguagguuugaaaagacaguaccagguauuuucccaaaaugugggaaaggaagacauugggcaaaugaauguagaucagucagagauauaaaaggaaggccaacaccucaguuuaaaguacaacagccaaaaaacagaaugaggggcccccauccccagggcccccaaauguauggggcauuucagaccacaguguccaugaggccacccagagaccgaggagagccacuccggguucagcaggauuggacaucugugccaccuccagaguaauucuuacaccucaaauggggugccaaccuauuucaucagauuuuagaggucccuuaccaaaggauauaguggguccucuucugcuuugaaaggauugaugauacaucccagaguuauagacucagauuaugagggacaaguuaagauuauguguucugcaccccgagguaucauagccauuucuccuggagaucgcauugcucaauugcugauucuuccuaguuuguauaacauguucccuaguagccaggauucccgaggagauaagggacuugguucuacaggaacuaauguggcauacauaucuuuagauuuggauaaucaucccacuuuacaauuacaaauagaaggaaaaccuuucaagguauaauggauacaggagcagauaaaagcauuauaaccaguaauugguggccugcuucuuggccuguuaaucaaucaucacauagcuuacaaggauuaggauaugaggcuaccccaacuauaagugcaaaauccuuacaauggaaagauaaagaaggaaggacagggcuuuuucaaccuuauguacuaccuuuaccuguaaacuuauggagaagagauguguugucagccaugaacuuuauauugacuaaugauuacucucagaaaagcaaagaaaugaugaaaggaaugggauauauaccuggacuaggaaaaaacuuacaagguagaauuucaccaguuuuuucuuggaaaaaaacuuacaagguagaaugucaccaguuaaagcuacagaaaaagcagauaagaaagggcugggcuuuuucuaggggccgcugaggagccuuugcccauucuguggcguacggaggaugcggugugggugccucaguggccuuuacucucugagaaguuaaaagcagcuaaagaauuaguacaagaacaauuagaccuggggcaugugaaacccacacaaucacccuggaauaccccuauuuuuguuguaaagaagaagucagguaaauggagauuguuacaugaccuaagagccauuaaugcacaaaugcaaguuauggguccuguacaaagaggacucccccuacucucggcucuaccuaaggauuggagaauuauagucauagauauuaaagauuguuucuuuuccauuccauugaauaagaaagaucaaccuagauuugcauuuacccugccuucuauuaaucauauggagccugauaaaagguaucaauggcggguauggccccaaggaauggcaaauagcccuacaauaugucaguuauauguaagaaaagcuuugcaaccacuuagagaugguuuccccuccuuaaaauuuuaucacuguauggacgauauugugauauguggaccugaagaagaaaguauacagcaagcuuauggcuugcuuaaugaaacuuuaaaaaauaauggcuugauuauugcaccagaaaaaguacagcagucuaauguuagucauuuuuuaggagccacuauuacucuauggugugucaccccacaaaagauuaguauaagaaaagaucauuuaaagacauuaaaugauuuucaaaaauuauuaggagauauaaauuggauuagaccuuauuuaaggaucccuacuuuggaauuaaaaccuuuauuucaauuuuuagaaggagaaucacauauuucuucauugagacaauuaacaccugaggcuucugauguucuuaggaagguggaaagagcuauccaaaaagcacaguuaaaucauauaaaugaguaagaaccuuuguaucuaugcauauuaagaaccauaaauuugccaacugcuguguuauggcaagaugguccuuuaguauggauacacccacauauauccccuaauaagacuauagagcauuaucccaccaugguggcaaauauggcccauaaagguauaaaaaguucaauuacucacuuggaaaaaaugccugauagcauaauuguucccuauacugccgcacaaaugcaaauguugugugugacuauagaugaaugggccauucuuagaugcaguuauucugguuuaauugauaaucauuauccuaaacauccuuuauuacauuuuaugcuauugcauccagugauauuuccaaagguaauggcuaauacuccuauaacgggagccguugauauuuauacugauggauccaaaacaggaauuggaaguuaugugauaaaugaaaaggcuguaagguugcaauuuacaccaggagccccucaauuaguagaauguuuggugguuuuagaagucuuuaaaagauuucuuauguucauaaauauuaucucugauucuguuuaugugguuaaugcuguacuagcauuagagacugccagaaauuuuaagcagucuaguccaguaucugaaauuuugaugaaaauacaagacuguauuuugaugugugagcaccccuuuuauauucaacauauuagagcacauacaucauuaccugggccuaugguuaagggaaaugcaauugcugauucagccacuagagauaaugguuuuccuaucacaaaacucuauagucagugcuaagaauuuucaucaacuuuaucaugucccugcuucuacauuaugacaaaaguuuaagcucacacgaacagaagcucgagauauuguccuacagugugguagauguguagaauuuauuaaugcaccuuucgugggcauuaauccucguggauugcaaccccuagauguuuggcaaauggacgucaugcauaucccagcuuuugggaaauuacaauauguacauguguccauagauaccauuucugguguucuauaugccucuccauugacaggggaaaaagcaguucaugucauaacucacugcuuggaggcaagcccuuagugcuaaagacagauaaugguccagcguauaauucuucuaaauuuagccaauuuugcaaacaaaugcaagugaaacauauuacaggguugcccuauaauucacagggccaaagcaucauugagagagcccaucguacuuugaaacaauauuugcaaaaacaaagaggggggauagaggcuaugacaccaaagauggcucuaucccuuacaauauuuacucuuaauuuuuaaaaauuggaugaugcuggaagaucacuagcugaaaggcauggacaauggccucaaucgcccaaugaaauggucaaauggauaaacguccuugauaauaaaugguauggcccggauccuauauuaaucagaucccagggagcuauuuguguuuuuccgcagggugaagaaaauccacuuuggguuccgacacgacugacaaggaccgugaaagaucaagaugaaucccaagaugauccugcuauucuuacuccugaugauugagaccgggauaaguauaccuuugugggucauaauaagaucauggccaguaccuuuaccgguacauuccaauucuucuaccuagccuuuguuuuuugcaaaggaauguuuuuuggaugugccuuaugcacgacaaacuccucaagagccauggguguauaagagcacuaguuuucauuuaaauuauacacuaugcuuugugcauaauguggauaaaccuuuuacacccuguauauuuccuaaagaaaaagauuuucucuaauuggucagauuaaauuaauacugcugacaaugcaaaucuuggauggaauacacagacuaugauauaagauuagaaaaagggaaauauuggcaucugagcaaguuacaaauuuagaccaagccauguggggauuuuauucagacguuuagaaguauacaaaauuuaggcuuggaggugcugggagccacuacuguucaaauagauaggcugcucagaugaaggcggagaaagccagacaauauagguuaccagccucuaacaagcugauaaucauaugagagagauaaauuaauuuugauuuaauuguuuguaaggcuagaggagaauaugaugcuaauuguuuagauauuuuuaaauauauauggaauaaagaaauucaagucaggcagugguggcccaugccuuuaaucccagcacuugggaggcagaggcaggcagaucucugaguugaaggcuagccuggucuacagaaugaauuccaggacacucagggcuacacagaaaaacccuuucuugaauaacuauuaaaaaagaaagaaagaaagaaagaaagaaagaaagaaagaaagaaagaaagaaagaaagaaagaagagaagagaagagaagagaagagaagagaagagaagagaagagaagagaaagaaauucaagccuuugaucucauauauauaaaacaaagacacacagaggggugauugauugagaaaaaugcuuuaaagaaaauucaaaaaugucuaugccagggcaaauaaucaggaucuuugaacaugggcuacauagggauucugggauuguucagccugguaugacaaauguagagccuggaaauggccuuguacaguacauagaaaggaauucaaaugaagugaaaugcauaaaugaauaaauauaggccuugaucucagguaggucaaagagcaggggaugaauuaggcauauaauaauaauaaucacuuauauuguauucauugcuuuuaguuauuuuaauuauaaaaaugcauaucguuaugaguuucaugguaauaccaaauucuucugggaguggggaaaagcuauuaaauuaauccagucucuaccuuaaaugauuuccaguuacuggacaagugacaugcuauuuugggagagaggcucuauguuugcuuugacaggaaaagagaaaggucuuuggaggucuuccagaguauuaggaucagaugagacaggggaaaacccacaagauuuuggcuagggaaaagaaaauuucaagaaaauuaaacuggacaagaccccucugccuccugaaguuuuuuuucagagaauugcuuccaaaacuacuucaggaauagcuggagauuucagaugaccucauuucauccauccuuucagagugauccagucagcacuucagucaaauccugugcccucugaacagauaaggccuggauagaagaaacuaaagcuaauuuucuuuuuuuguuguuguucuuuuuuuuuuccgagacaggguuucucuguguagcucuggcugcccuggaacucacucuguagaguacuacucagcucuuaaaaagaaugaauuuaugaaauuccuaggcaaauggauggaccuggagggcaucauccugagugagguaacccaaucacaaaggaacucacacaauauguacucacugauaaguggauauuagcccagaaacuuaggauaccugugggaagccacauaugccauuacaagguggcguugacuacugcuggccaccacccauaaguugggguaaacaaccaaugugcgcaugugcaguagaguuuuuuugcugagucacugccuggucggaggcauguaaaugagguacugaaaacauaaccaaucggguguagacacgccucuccuaggccuauauaagcagcgccaguucuggggcuuggggucuuuucaccucugcaaucaagcucucccaauaaacguguacagaaggauccuggauccuguuguggcgucucucuugcuggcaagccgggcacucacaaguggugcugaaaccagggaaaagaaacaucuucaggcacaagcguagacccccuauuacagggaggauucagaacugcaucucgggaaggagcggucaaugaaguguucccacaauacagacuguugagaaggauucgacugcgcagauucagaacucuucagcuggggaacgguguuaccgguaaguauuaagaaauuaauauaagucucugagagguaugcuuucuuuuggaauagauccgguaauuguugcugggguuguguugcuuguuuucuuucuuguccugauacuggccagucuauccaggacaagaaaugugaaccagcuguuaaggaagggcagcgacuuuugcaggagcaccaggaaagcaugucagaaacagagagaaauaaaaaggaaggagcgugcagaaaaauaaguaaaggaagagauauaaaaagagaaaaggaaaagaaaacaaaauauagagauucaaaagauaauauaaagaaugaagaucaaaaaaucaagucaauuuacccuccucucgaggacuuugacuaaagaggcagccuucaucaaggcuuaaagauagaucucagggaaagaggaguaacuaucagaagcagccacugugccuccucucccuucucuggcagaauuuccagaagaaggagauaaagaauuagagucugaacaugagagugagaaaauaaguuucagaaaagcaguuauccccuguuugggaucuuuuagcaaaaaagagaaaaaaaugaaaauaagcgauuucagagcucuccuagggacagaaggaaaaugggagauguccuacuuccucucuggcuccuauggagauauucuuagcucugguuaggauaucugggucccuuugagacaucaaguucuauucccugucugucuauugucuguuuuuagugcaccaaauuguccauaugucugucaauucauguuuguuguuugaaugauuacuguucuguguuucauguugaaaaauauaauugguuaaaacuuuaucugcuugcuguccauccuuuaacuuguuuaaaaagaagucucaauuugcacagcagagacugauaaguuagcugcacuguggcugggagucgaguacagcugaaaaagcccugcugagggccgauugcaaauggagcucuuaaaugggcaggaagccuuuugcuuguaacaaaaaguuagcuuaaaauugggaacucaggguuggggucauucuaaacaacaugaacgaacccaaggaaacaggucuuuaaggauacuucaaaauagggauaaucuuugguccaggacucuggcagaguguucagauugagaaaaguuugcauuuggauugaggcugagcucggaggggagcagccucagcacggcuuguguggcacuucuuuuguuuugcaaacugugacuagggaaaccuggaacuucagcacucccucccuuucuuuuagcugaaagagccuuguuacagaccuagccagauguuguucuaaauaaaguuuaaauucaaaguucauaaaaggucaaucaggcuguggaauuuaucaagacauugcaauuugacuugccuacuuuauauaauguuauaguguacagaguuuguuuauauguauaagugucuuuuccuuguuccaaacagccauuaauuugguuauuacagaauauugauguuugaucuauugcauaccaucauauuaaguaaaauugauaaucauuaucccauagauaaguuaaaaauuguuuuauucaugcuccuauaucuucuauaaauucaugcauacaugcaucccauuuacuguguuuaaaauacagccuuuauaugggagaaaaguaugugugaauugaaucacaugcuuauucuuuugaguuuccuccuguuuuagcacagauaauuaaauugugugcuguagauggugucuaaaaauguugaacaaucaaacuuuaaguuguauauuaauagucaauauuauaucucaagcuuacaauugcuuaugcaacuuauaagaaaaaauacuguuacuuuaagaagauuguuuuggggcaguuaagaaauuguccuggguugccuggaaaagauccccaggauuugcuuuuguguuauagagguuuacauaaagcuuuaacugauaaagauuacagauagcuccuaaaaggauacaaacucaggauccuuauauuuauuuggguuuuagacuuacuacucaagcuguuuuucccuagaagauaguuauucucagagacaacuuaaagacuacaccuggcaucaaggcaaccgacucccacaggcuauguccuggggaggaaacaaaauguauaugaaggccucucucucaaaccggucauuagguaacuaggagaauuaaaacuucuuuaaaaaacaaaaacaaauucaacauuccuauagaaacagcacuuuggagugaccaguguuaggugcuagcaucaauuaaccacagaacaguacauuccuucccacuuagucuaccaaacaaaccaacaccaucacacauuagaaagaccauccuauaagcugcuugguuccaguccaaaagaagccucugcuuuccuaggugguccuugaguaagagccuagcucauggguccucagaggccaugucagggagagaugugcuagguggcuacgugggcaggagaagaaauagaaacaaauucccggaggauguuuuuagcuauuucaauguuguugugggcaaugaccaaagcuuucugaauguccugguaggaauagcccugacucauggggcguucaaucucacuugagagcuguggugagggugcuguggccacaggguuagcaguggcaccucugccuuguugauagcuacuggcuuuucauucugaguugauuaccuggaccuaugguuaagggaaaugcaauugcugauucagccaccagagauaugguuuuccuaucacaaaguucaauagaaggugcuaagaauuuucaucaacuuuaucaugucccugcuuauacauugcgacagaaguuuaagcucacacgaacagaagcucgagauauuguccuacagugugguaaauguguagaacuuauuaaugcaccuucugugggcguuaauccucgaggauugugaccccuagauguuuggcagauggacaucaugcauaucccagcuuuugguaaauuacaauauauacauguguccaucgauaccaguucugguguccuacaugccucucccuugacaggggaaaaggcaguucauauuauaucccacugcuuagaggcuugggcugcauggggcaagccccugcugcuaaagacagauaaugguccugcauauacuucuucuaaauuuagucaauuuugcaaacaaaugcaagugaaacauauuacuggguugcccuauaauccacagggccaaggcaucauugaaagagcccaucguacuuugaaacaauacuugcaaaaacgaaaggggggaauagaggcuaugacgccaaagauggcucuaucccuuacaauauuuacucuuaauuucuuaaaauugaaugaugcuggaagaucaccagccgaaaggcagggacaauggccucaaccgcccaaugaaaugaucaaguggaaaaauguccuugauaauaaaugguauggcccagauccuauauuaaucagcuccaggggagcuauuuguguuuuuccacagggugaagauaauccacuuuggguuccaacgcgacugacaagaacugugaaagaucaagaugaaucccaagaugauucuguuauuccuacuccugaugauugagacagggauaaguauaccuuugugggccguagugagaucauggccaguacccuuaccgguacauuccaauucuucuaccuugccuuuguuuacugcaacugaauguuuucuggaugugccuugugcacaacaaacuccucaagauccacguguguaugauaguaugaguuuucauuugaauuauacacuaugcuuugugcauaauguggauaaaucuuuuacacccugcauguuuuuaaagaaaaagauuaucucuaauugggcagaucccauuaaccaaaauaaagugagcucuggaguguuauuuaaugcuuuaacgcaaguuguucaaggagcacaaucagacucaggugauuuuggaaauaauguuacuucaccuauaaacaucaccacuauuaugauaaagggaaaugugacuaugcccaaaagaucacgauggccuguuggccaugcuacugcuauacacagcaugccuuggugucauccggaccuuacauuuccuauaguuuuuucaccuugucaaucaaaaauuuuuccucggaaagaaauagcaaaggguuuuguuuugucaccuccauuggauuuugccguaaugaaugauaaaggagaugcuauggggaaagcaaauauuuggccauauuaccaauagauuuuaaguaaugaggcaggugcuaguaccaguuugucagccuuugcauugaugacugaaaccuuucaugagauauuuaauguuucugccacacucuccaauaacucugcucauuuagauaaugugacaucuaauagaguuaucagaaauaugacuacuucuccaguagaaguuuguguuaguccuccauuuuucuuuauauuggcugaauuucaaaauaauacagaacgguuagauuguacaaaugucacuuguuuuuugacgcaaugcuggaauggaaccaaguucuuagccuuagugguacaucuaccaaccuuugucccugugccuguugaggcagauccagagaaauucccaaucaugagucuuguucagcaaaagagagauuuuggaaucacagcugccauuguuauugccauuguggugucugcagcaucagcgguuauugcaggaauugcuauggccaaucaaguuaauacugcugacaccauaaaucagguagcagaaaaaacgucugaggcauugauuacccugcaaaggguggauucucauauccccucaggguuaauguuagugaaucaaagaguggauauuuuacaacauaacauggaacagaugauggaugucauacaaauuaguuguguggcaucaaccccgcaugugugcauuacucccauuacguauauuaaugauucuuuuauuaaaaguacagauuuauugaauuaucugaaggggaacuagucgcaggagcuggaaagguugcagacaaagcugcagauacagauccugaaccuuaauggaaccagaguggaaccagugacccuuggagacuuuaccucuugacuuaccucugcauuuucuuacuuuaaggaaugaaugggagugauuuuguuugaugcugccauaugcugugaacugguguucaugcuuugguugguuugcaaauucagaacccaacaaaaacgugacaaggugauuauaacucaggcacuuuuagccguugaaaacgccaccuccccugaaguuugguuaucuaugcucaagaauuagucggcagcugaguccucugcucuugcaccccacggauuuauggauccauugcacugggaugagagagagacucaaugaucauugaucagcccuugcacaucgcugagguuuccucauugcacgcgguagggugaucaugauuuccccgcuaauucauuuccuuaaaacuuggcuggccucuuuuguagaguucgcccuaggucauuuagcaguuacugucacacagcgccgcgguauccagagacgggcaacuuuccucgugcacagaccaaccuaagacacagggccugguagcgauaggguuacccuaugacggguaaggcugugacacuagaggaacgaccuaaaacaggagccacggcggauggacauaauugcacaggccuaguccagcaucauuuuacuaaaauuaaaagggggagaugugggaagccacauaugccauuacaagguggcacuggauacugcuggccaccacccauaaguugggguaaacaaccaaugugcauaugugcaguagaguuuuuugcugagucacugccuggcccggggcauguaaaugagguacugaaugcauaaucaaucggguguggacauauaaaugagguacugaaagcauaaccaaucagguguagacacgccucuccuaggccuauauaagcagcaccaguucuggggcucagggucuuuucgccucugcaaucaagcucucccaauaaacguguguagaaggauccuguuguggcgucucucuugcuggcaagccgggugcucacagauacccaagauauaagauacaauuugcuaaacgcaugaaacucaagaagaacgaagaccaaaguguggacacuuugccccuucuuagaauugggaacaaaacacccauggaaggaguuacagagacaaaguuuggagcugugaugaaaggauggaccaucuagagacugccauauccagggauccaucccauaaucagcuuccaaacgcugacaccauugcauacacuagcaaaauuuugcugaagggacccagauauagcugucucuugugagacugugcaggggccuggcaagcgcagagguggaugcucacagucagcuauuggauggaucacagggcccccaauggaggagcuagagaaaguacccaaggagcuaaaggaaucugcaacccuauagguggaacaacauuaugaauuaaccaguaccccggagcucuugacucuagcugcauauguaucaaaaaauggccuagucggccaucacuggaaagagaggcccauuggacuugcaaacuuuauaugccccaguacaggggaaugccagggccaaaauguggaaguggguggguaggggagugggggggaggguaugggggacuuuggggauagcauuggaaauguaaaugaggaaaauaccuaauaaaauauauuuuuaaaaaaagagaaaaaaggaagucugguuuucaugguaguacaacuuaaaguuagaacauaauaugggcaugaaauuguaaacucuuuaagucaggauagcugguagaauacuuuuucuaaucgacaauaugauggacuauauguuaauuacauaccauuguuuguaauuuagauaauuguuauggcuaugguuaauuuauguuugagggaagagucuuuuguuauuucauguguuagcuagggaauuuuccagaauaguaagagagaacugcuugaagaaccaucuccagaagaaccaauggggauggggagggagggggaucugaggcucuccagagaaagcaugucagagagaaagaaagcaaaacagagagaaagcaauuggguuggauuucacuacucccagauaccccuucucucagaaccccauucuaaggucaggcuugguucuuggcaacagagguauauuuugauaucacugauuuuuaaugcuagaugucaggacuuucagaaaccauucaagucaaugucaggucccagcuaauacccaacuauuuugauuuauagcucuuauggaaguguaguuacagacuauggugagugccacgugaguacaaggaaaugaaaaggguuugaaaggugcaauguaauguaaaugaaguaaauaccuaauaaaaauuggaaaaaaaagaagaucuuucacuagggauugacucuuguauguauuggagagcuuggcuauuuuaccuucaauuuuugugucaauagaaagugcuguucucugucucuuauggaggcaccauccuaauuuuuuguucucuuuguugccauaugacaaugauucuaugucuaguuuuuucucuguguugaaacaauugugccuaaaugaguucuaauauuacauggauauguuuagcuuuucuguuuuuagggacugucucucaauuuuauauauuauauuacacagaagacuucguuuucuucacuaugaguauuuucuguauauccauuugauaaugucugacaacaaauaguucuuaauguaggugugagcauuacuuuauuuaacauuuuugcuuagucauuacccaguuucccagugauuucauacugucggaaagcugguguuucuaugauaagcaugcaucagauugaaaugcuaauuauuguguacuauggccaaugcucaagaaaaauacagaaaauuaauagacaggaauuugagguacacgagccaagauaaugaccuaaugaaucuguuuuuuuuuuuaaauauagauuuuaaauguuaaaauggcauuugugggcuggagagauggcccagugcuuaagaguacuagcugaucuuacagacauacugaauucaauucccagcaaccacauugugccucccaaccaucaguaaugggauccaaugcucucuuuuccugugucugaagaccacuaugguguacucauuuacauaaaauaauuaaauaagaauuuuuaaaaauggcaaaaaaagaacugaaggauccuugcaguccacuaacccacuuucaauagaaugaaagagaauacuauacacaaaagauucaauccaacgaccagcuuugaggacagcagcaugaagaauauagugguguuuguaggaaagaagcuauguaggggcuggaagauggcucagcaguuaagaacacugacuguucucuugaaggucuugaguucaaaucccaacaaccacauaguggcuuacagccuucuauaaugacaugugauauccucuacuggugugucugaagacagcuacaguguacuuacauauaaguaaaaaauaaaucuuuuuaaauuuuuuuaaaaggaaacuauguaugcaggaggugacacagcuagaggaguagguauaccuaagaccuuagagucagggcaauuucaucauaauuucaaauugcugaacaagaagcuauaaguuuugguguuuucccugcugaauuuuggucuuguuuggucuguuuauucuuuccuauccucugauuuuuuucugguaaggugugcuucuauuauaacacuguauguugaaaacauaauggcugucuuaaggauauaguacaguauggucagauaaaaauaguuuuuacuucugaaaaaacuuguaguaguuaaaugagagugguucccauagacucauauguuugaaaacuuauguuuaguuuguggaguucuuugggagagagaucauacauguagcccuuuugcaagaggucugucacauggguacauuuucagguuuuaacaucuucugaccaugcccauauugcuagcuaccucuugccuguggaucaaaacaugaauucucaucucugccugaugccauguguuuaugcugcuaugauugacucuaacacuuuggaacuguaaacccgauuuuaugccuucaauuauaauuuguccaugguguguuuuauaauaacaauagaaaaguaaauauacacccguguuguguggaaggucagaacccagaaaauccccccuuucaacuauaggaaccaggauggaauacuguucaaacuuuaucucuagagcaguuauaaucuguccugugucuuugaaguuaggcaugaucccaagauugacaauuauagacuucccugaagaagcaaccccuuuaugaacauucuccuuuacuucuaacccaaccaauaccaaaucaugaaucagguccaccuuguauugaagacucucauuuaaguaaugguggcccaaaacacaggauaaaauaaauacuacucuuuauuacagauccaauaaguguuguaaauuguaguuuauuuagugaguaaaggucagcugcauuauaaaugagaaccugucucaaaaaaaaaaaaaggaugauaaacaaucuaaacuauauuuuaagggccaguuaaagacuauucuuuuuccuguuccaaauuaauccuaaagaaaaaaauacaguaauuucuauauuguuuaguacgguauuuucucuacucauguucuauguuaaaggacaacuuuucauuuugacuuguuuuuccccaauaaucuuaagauuuacaugguguaaauuguuuccaguguucaugguaugguuuuugagcugccagguuuucaacuaaauuacugacugcaaagcaauucuaguuuuguaaucaccuacuaugaaccuuggccuugaguugaaauagaaaauuuccuguguuuuuacucagggcugcuauucucuccuaauucagaggagacugcaggauuggccuggaaauaaaauaacuuuuuacuucacaucauuuaggucauugcuccuuuguucuugacagugcaaccauaacuauuuuuuaaaaauauggacgugacuauguagagcaguguguccucaaauucauggaugugaauuugccuccaaacuucuggaauugauagcacaugcuauuauguuuggcuauauucauuuuugaaaaugauuguauggcauugguuccaaacaucuuaaaugacuuuaaggguuaucauacugucccaauuccccaaugcucuuuuuaucauguuauuaauuuuguuuuucuuuucccgugaguuugugaguguguguguguguguguguguguguugauauguaacaauggcuauccaaaaucucagggaucuccucugaguucugagugccuggacugaagaaaugcauugcaugcuacugaaaaggugagcucagcaacuuugggaaauuccacaagaccccuccccuccugaaagacaauggucauagaacauguaggcaccccugugcuccagaagggagaagcuaauuuaauuaaauucugcagaccacaggggggaccuacugcugaccacaugaagauaagggaaacccagagcacauagacacacuccucaaggugaagagacaggucccauccccccaucaccucucuuuccuccucugaacuccccccacccccacagccaagaaaagcccuugcuaccucagcccauaaagaccaaacucuuuaaaggguacacucuuccacuagucacauugugucuacuugcugcugcucugacaacuguauaaaaaaauuaacgaaugggcugcacgaggucaccaccucuccuucagguguaguauaaucccaaaacauucaaacaauaaauccucuugcuuuuugcauugauuuucugcucugcauuguucacucaggggguucccuguaagcugaugcuuggcagagucuuacuuuauccacagcuucgcaauaaggucucuugaaaaggucaacucaggaacuuugcaaaggucaugaaacacuugccccuccauaagggagaggguaauuaacauuucucagaccaagggcaggaaccaaccuguggguggggacacauuccacaggauggaccauugcccccuuucagacaagggaaguuccuugucaccacauucccuaaaggccaguuuaaagggugcacuguuccaccaaucauauugugccuaguugcugaugcucuuuucugccccuugaaaccauauaaaaaguugguuacuacagaauggcgugguuucugccccucccauaggaccaguggaugugagccucugaaagugcuaaugacuaccaugagcuuaaggcuuguuuacagaaaaauguacauauuuuacaauucuccuuuaaggaauguucucccuguuaacauuaaugagugcaugaugaucagagacagcacaaguccaaaagcgaagguguggcuaaagucucagccaaaugguaaaugcugggacuuucaagcgagcccuuaagacuguggaacagaccccuaaaacauugauuaaaaaauauauuauuucucaauaaauaauaauguauauaaauuaugagggacgucaagaaucuaaaggaaugaaagccaacuucucagaaagauacuaaggaaggagauaaagagauuuggaaaguggugaucacagaagaucucacccagcuaauguuuuuguuguuguugaugaugaugaugcuuagaaaggcugacaaauuggugauuucaggaucagccugggaaagagcaaauuuagucucaugugugguagaaaugguaauuucaggccugggucccacccagccaguuugagcuuagccuuuaugcuucacagaggcaggcagauaucugcuuuuguaagguuaaaagaaaaugugugcuuccugucucauaagaaauaaguuccuguggacacaggaugcuauuucuuaagacaaucaaaaggaaaccuggaguaaauggcuggguugagagauauaauaguagauuguguuuaugguaugcaggagaugaccuacugagugaauuuuuuuagaauagcaggagauagcugguuggugaagagucuccagcagaacauagacagagagcugucuggagaccugcagagcaagcagaucagagagaaagcagaacacagcgaaaggaggaugggaagcugucuccugcagagcauagacugacagcuuggacacaggacuugacuaccaguccuuuguuuucaugcucccagacaccccuucucucucuaccagucuccaagccuaggcuugguccuugacaacaagguauacuuugauaucauuaaucuuacaucuagaugucaggacuuagagcaaauguaucacuuauguaaccauccaagccaaugccagguaccagcuuauacucaaguauuuucauagaaguguagcuacagaugagugaacucccauuugagugcuaggaagugaaauggguuugagcagugcuuuuaacaacaacugaaugaucccuguagcccacuaaccuacuuucaauaaaauaagagagagugcuauacauuauagauuugagauacaaacaccagcuuugaggaaagcugaaagaagauagugacuuugaggaaacaaagcugugugugcuucaggugacagagcuagaagagugggaauuccuaagaccuuguggcuaaggcaauuucaucauaaucucaaguugcugaacaagaaacuguaaguuuugauggauucccuguugaauuuuggucuuguuuguucuguucauuguuuauaaugcucugauucuuucugguaaggcuucuuuugugacauuguguguugaaagcauaauaggcucucuuuaggauaugguacagugauguuagguaaacagguguuuucacguuugaggagacagaugguaguuaaauuaauauggcucccauagacucauagguuaaauuaauauggcucacauagacuuccuaguuuguggaacuguuugguuaggaacacaggucugccuuuuuggaagaggugugacacuugggugcauuuucaggcuuuauccucuucugaacacgcccauauugcaagcucccacuuucgugaaguucaaaaugaguucucaccuuucccuugauuuacagcuaagaccuuguaauacaagaggaacuuuccagaugcauuuauguccaacauuuuuauaauuuauggaugauucuggaugacuaugagguaagaaugcccuucaauaucucagcuuuuacauuugaccaucuucagaaaagaauuuaacuuaacuuucauaggaguaggcaaacuuauguguaaaugugucuagauucccugaguaaaaucucaaugcucccacacuugaagaaaggcauugcuuuggaaauggcuccugugcucuccuuacccaucaccggaaaaaucguuugcagcuguucugucuugucugcugugcuagguauucuugucagucaaauugaacacaucuggaauuagcugaaacagaaagaguuggguacugugagggauuuuucuuaauuguaguuuucaaucugggaaaaguauuuuuaaucugggucuuuuggggugauaagauccaccuuggaucuaggcaacagcuuauggugacagccuacauauauaauagacauugaagaugguagcucuaucucuuugccuuaaugcccuaccucuuucuaacaacuuuguuguuguuguuauuuugugugugugguuuuuuuuuguuuguuuuauuuuuuggcaguagugcauaauuuugaaaauuaagguauauaaugaagacuaguugagacgucaagccacaugaacugaaccacuauuggaaauuuuaauuguguagacagccauuuuuggacugguugaauggcauccugugagucauucuaauaaauacauuaacuauauaauagagauucauucuaucagcucuguucaucaggagaaucuuugauagcacagcugucaguuugugguuguuguuuccugcuuugcucugaggcuugucucagaaacaccaggugaacacuccuugcaguguagcugaacccagccugaaggcaccaaacaaauauugcuuucuaaaaucuuucuuaauuguuaauauucugggcacauuuccacuuuugggacagauuuaacuccauuguaaucugauuuauugacugugagagccaucuaacuugaauccaggaggaagaaguggaaauaucuucugagugcugugauuggagcuuaaggaagcuccaaauuugcaaagcagggaagcauagaguuacugcccacaaggggguagaagcaggcaguugaauagcaggggugugaagucuuaaguucucccaggggcuugaugggaggacagaccgguaagcaauuggaugagaggcacuuguguuaaugaacuucaaaucugcagaucuggaaaagguuuggccaaagcuggaaccucuaugcugugucucuuuaacauacucuaacccuaaggguggugcucaugucacucaagacuccauaaccaaucagaaccuccacauggaccugccagucagaaaaggaggcggcucuuccaggucaagcuugcaagcuccuuucuguaacucaggggucaugagaguuucugugugauguguucugcgugacucuacuggguguugugagagaagguuagucaagcucagaacuccaaacaugguaagugccagaucaucuccugcggugccgucgguguggggaaaagaggggagugggagagaacucgcuucuggucagagauccauugcccugggcaggcaggagcgggaggacugcaggacgcuuuccacauggccccggguggcugucuggccgugggaaggcacggacccaacucggugggugguggaaaagggcagcucuaggcaccggguucccagucuccagcaucccacgcuggauaccccggaagagcuuaggacagaaugggguccccgggguggcacugggcuucggggccaaagggaggagaagucggggagagcgggcgcugaaugguucccacgcgagcgagcguccuuggucagguccggggcuggagcacaggauggccuucuggcgggagguuuucuuuuuaauuuuuguuacugugugaauuugauugcaguuuggcugcagggcuucccaaguaugaagcagagauggcugcacuggacauugccuguauaauuuaauaauguucuuuaauugcaaagaaaggcucugugccuuuaaaaaggaaaauaaguggagucuggaaaauuuuagugaaugcaaauuucccagacuagagcucugucugcaacugugguggaauugcugagccaggaaagcuucagcugucugaaucauuugcucugugaucuuacaguggaggagcugcuguugucugagucccagcuguguuuuccaggcuaaugagggacucuguccaugccuuucuaucaggaacccuaguggaagguagcuugggguucuuuaugggagucucuucagagccaucuguugcaaacugugaagaaggccaaaagccaugucauggugauuguaauugucuccuuugccaggccaggaggagcaaguuuacugaguuaucugagucagaucugcugguuccaaggacugugguucuguugguccauguggugaucauagcagaggcccuugucuuugccccuuccugaguguggauuaaugggggugugggaagcucaguagcccuaguagcuugugggcuuggguaccaaagguuuuccauggagaucucuugccagccuugguucuaggguuccagcaaauagaaaggaaugcaggcagggaggggaaguugcaaaccugcuuuugcagugccagucaacuccaccuccaucucugcugugccaugcaguaauucugugccacccugcacugaguaggguccccaagugcacugggggcuuggucaguaaugguuuuuuuuagauacuuggcaguucccuugugcaggguuguuuuauuagacuucuccugaauuugucccaguguauucuagcuucugcaaacuucauagaggucuccauuucuuuccacuuaucccuguaaguaggauacaagaugcuacucuucuucuuuuuuuuuuuuuuuuuuuggauuuuuuuuugagacaggguuucucuguguagcucuggcuguccuggaacucacuuuguagaccaggcucgccucgaacucagaaauccgccugcgucugccucccaagugcugggguuaaaggcgugcgccaccacaccggacugaugcuacucuuuaaaaguuuucuuggcauaagacauagcuuguguaagcucucccuacugcagcuguuguaaauucuaccuucuacuuuugcuauuuuucucaucuccugcgaccuccaacucaggaacccaucucugagaaauggcuugcuauuucagggcucugaggcacuuaauaaauguucugggggucuuugcuuuguauaucuccuagcugucuuaaguaggacuuguaaucuccaguccauauugaaauuguucaaaauaaccuggggacugaacaggaaauaaacuuauggaugagagcauguguggaauccaauaccuguuuuugccuggauggucuuugagcauuagccgcagcugaauccaugcugccauuaagaaaauuuuccuaauuaauauuuuaguuguauauggaguauuucuuucugggaugacauguuaauucugggagagcugucucuucuucccgucauaaagaugugucuaagacaagcuauguugacucaggaagccuugauccuggucugcugcuccccagggcaaugaccuugcuuuccucuugauauaaauuccuaaauucuugauuuaaagaauguagcaaaguaguguuuuauaguugcucauuugagucauauaaugaacuauucauuuuuuccaccuucaguagagaacaggagcaaugguuuacuguuaucucugucaggugaaacagggcgggaaauagcuugaucauagauaaaaccauaagagaaucugcuccaggugucacccuucuagagaaggauaagagucaggcagggugaauaauuuuguaauuuaacagcauguauuaaauaaugcaugauauuaaauaaaacuagauuugugggugcuuaguuugugcagguuagcuugagccagugauaaugaauuucuguuuuaggaucuauacuauauagauagaauguaucagaaauguaaaacacauuccauuagguguagcugugugugucagauuauagaucucaguaguuaacaaagcacauaggagcaaggucaagcacuaucuuauuaaugccauuccuucuaccaagaaaggccugaucuuuuucaaaucaguacagugauauauauuuucccaacauagguguggguuuguuguuguuauuuuuguuuuaccuaccgacugaggacaaugugcugauuaacaagagugcuccacagugucugacauguguccugcuuugcucugagccuugucucauagccauuagguagaaagugcuugcgguuuacuugaacccagccugaagucacaaaacaaaguuuguguccaaaaaucccucuucaguugcuaauauucuggcacugaccaucuguggacaguuugguaacuccagugucagcugauuaaugggauaugcaagcuauccagcuugauuccaggaggaagaagggaaauugccuccugaguccuuucauuggagcucaggcaagcuccaaagcagugaacccagggucacugaccagaaagguggagaggcaggcaggugagcagcagggaucaggaaucuuagccccucccaaggguuuggcgggagaacagacagguaggcuauuggaggagcacacucuaacccuaaggguggugcucaugucacucaagauucaauagccaaucagaaccuccacauggagcugcuaguuagaagaggcagugacuuccagguaccaagccugcaaguuucucuaaggucuucccagaggcaggaugguaagcaucagccagacagauggggccaccugugagguauuuuguggaccuagucucuccuuuuggaccaggguguggccucugaguaacuuuauuauaagccugcaucuggacaaaaccuuuguggcagggguuuguguguggaaauacacuuggcaggaugagaaccagaggaacagcuuacuguguacacugucagguaaaacagugcagacaagagcuaggucacagaccaaaggaaaggggaguaugcugcaggggucacucuuauggagaagggccugauuagggcagugagaaugauuuuguaauuucacagauuguauuaauuaugcauggacguauauaaaacuagauucguggguguuuaauuugggcagguuagcuugaaccaguggguaaugaauucccauuuuaggaucuguauuaugagauaugugcaauccuugggugacauguuuaagugagcccacaaauauuaaacacaugacauuaucuguagcugugugugucacauuguagacaucaguaguuaacaaagcacuuaggggcaaggucaaacacuaucuuguugaugccauuccuucuaccaagaagggccugaucuuuuucaaaucaguacagugauauauuuuacuaauauagguguagguuuguuguuguuauguuuguuuuaccaacccagugaggacaauuguucuaauuaaugcacugagugcuccacagugucauguguccugcuuugcucugagccuugucucauagccauuagguagaaaguacuugcaauuuaccugaacccagccugaagccacaaaacaaaaucuuauauccuaaaaucccucuucaguugcuaauauucuggcacugaccaccuguggacaguuugguaacuccagugucagcugauugaugggguaugcaagcuauccagcuugauuccaggaggaagaaggggaaaugucuccugagugcuggauuuggagcucaggcaagcuccaaacuuucaaagcagugaacccagggucacugaccagaaagguggagaggcaggcagguaagcagcagggaucaggaaucuuagccccucccaagggcuuggcgggagaacagacagguaggcuauuggaggagacacacuagugcuacugaacuggaaaucugcagauauggaaaaggauuggcccaggcuggaaccauugugcugugucccuacagacacucugacccuaagcaugguccucaagucacucaagacucaauggccaaucaaaaccuccacauggaguugccaggcagaagaggaggugacucuuccagguacuaagccugcaagugucucuguguaacucagcugcucucagauuuucuguggaaucgguucuuauuauuuuuacugagugcugugagguuagcucaggcaagcuuagaacuucagacauggggggcuggugagauggcucaacagauaagagcacccgacuguucuucugaagguccugaguucaauucccagcaaccacaugguggcucacaaccaucccuaacaagaucuggcgcccucuucuggagugucugaagacagcuacaguguacuuacauauaauaaauaaauaaaucuuuaaaaaaaaaaaaaaaaaaaaaagaacuucagacaugguaagugcaacuucaucuccaacgaaguggggugagcaagcaucuuugcaaaggaugcucauguaauaggucuucccagaggcaggaugguaagcaucagccagacagauggggcccccugugaggucccuuguggacuuagucucuccuuuuggaccaggcuguggccuaugaguaaguuuauuauaagccugcaucuggacaaaaccuuuguggcaggggcuuguguguggaaauacacuuggcaggaugagaaccagaggaacagcuuacuguguacacugucagguaaaacagugcagacaagagcuaggucacagaccaaaggaaaggggaguaugcugcaggggucacucuuauggagaagguccugauuagggcagugagaauuauuugauaacuucacagauuguauuaauuuauggauauaguuuaguaaaaucugauugguggguguucaacuugggcagguuagcuagaaccaguuaguaaugaauucccauuucaggaucuguauuagauaaacaugugcaauccuugggugacauauuuaagugagcucaaaaauguaaaacacaugccauuacuuguaacugugugugucacauuauaggucucaguaguuaacaaagcacauaggggcaaggucaaaugcuaucuuauuaaugacauuccuucuaccaguaagggccugaucuuuuucaaaucaguacaggaauauauuuuuucaauuauauugaucuuuuuaaauauuaaauuuugguauuacauuucugaauuucauuuucauuaugcauaggugauuugacgucuuacguguuucuauucuccaauauuucccccaaauuaagaauuucauuccuauuuuuaaagagauuucauaucugucuguuuagagaaacaucucuuguagcuccuacuuucuuuaugucauguaguuaaaacuugcuuugaacuccucuuccagccucugcugcccagggcuuggaaaacagucuuacaacugcuuucaggcuggguucugacugaucagugagacaaaagacaccagggaaugaguguugucuaaccucccaggguuacaggguuacaaauuaggggauuacaaauaaagagggacagguauaagguugaguucacugaccaacuuugaagcugguauacuugcagcacagaaaaggaggaggaauaagguaggugaggccuuucugcuuuggcaguaguugacauucaccaugaggagucaaguaaucaauuuugcacaaucaguuaaauuccauacuggucaucuucgggcauuuuucagauuagggcaaugucaaaugagaucacaggcccucguugugacaccauauugcuggcauaccucaccaucuaccccagcaauaggacugccaaucucccagcugccauuccuuaugaaauccaaucauuuaggaacugggcuuuucaucuaucauuaaucaucuugaucuggcucuugcuucugcccuccuuccucucuccacaaggucccagucuacucuguauuaucccagguauaacugggucuggcuauguucacucuuuuguguauaauauacuuucuccuccaccauaccuaggagcagugaugucuuuacauuuuauuucuucauuuucuuccuuuuuuuugcccauuaaaaguuucuaucuuuaaaauucauagccacuuuuacuuuuaauauuguuaauguaugaauuugaucccaguuugucugcaggaccuccccacuaugaagaagaguuggcugcaugcauaauugaauauacaaagaaaggacccuaggccuuuuaaauggaaaauacuuggucugcaggacuagaauauucuuuucaauguaaauuuuccagacuagggcuaugucugcuuguaggguguaacagcagaguuuggaagguuucagcugucugagucacuugcucugugaucccacaguagaggagcugcuguugcccugaggcccugcuggcuuuuccaagcuaaugagggacuaugagcaggccuaacauucaggaacacuaggggaagguagcuuacagguucuuuacaggauucugcucagaugcauguguuacaagcugccuggaagaccacaagccauccccuguuuauuauaguaaucuccauugagaguacaggaggagcaagucugcagagcuauuugagucugaucugcugguucuaaauggacugugggucagagugugguucuguugguccauguggugaucauaacagagcuccucguacuuugacucuuccuaaguguggauuuacaggggucccagaggcucgguagcccugggaguggcaagguaugaaacuuaaaugucacuaugcaguguguauauacaggaauugccuuugguguguaguaggacaacauuggaaaagcaaugguuugauuucuagaauuccugacccuucuguauucaguuuugugugacuaguuuuauaaauacuuuagaaguuaguaguaaagagcugaucaggaucauccuucagaaauauuugauuagauuccuuuuaucuuucuguuaacuauugucaaaaugccaugauucacagaacuucaauucuugguuacaaaaaaagcuucugacaugcagaaguuucucagguguugauggugcuggguggguggauaggacagauuggaacauaaugcauauggcaggaagcagacauuaaauuaucauucagcauuguuuuguauacuucgguggggcugguuuaacaugaaauuacuaagggucaugaacagcuauugagccauaguccaacuuucucaucaucaacaauuucgauaagagcucuagagcauggggccucucuguuugaagacagaucaguaguaucuggagggucagauuuauaacacuuucagggucacuuuguguuauuuuuaucggagucaggaaauaugauuuuauuuuauuucuauacacauacuagcacagguaacauuggucaaguucacauuguuccugguguaguugccuuaguuauugaagaaaaguugaaaauuggccacauggaaaugggcagaggaagcuuucccugauauuguguugcaguucugugggcuacugugagaauuaugucuaggauaacagauaauggucuuggucuuuagacagauugcuuguucuucgggaguacuggcuaugguugagaagggugugucugcccauacuugggggcuaagacacagacauguggcaagaaaggaaggggagauggaaaaggucuuuuguaucugcagguagcauggacaggugagaggaaacugcaguccuaagggcacucuugcauauugggucugagggaacaaaaaaugggugaaggucuagcagcauucuacaugguuccauguauuaacaucuuaauacuaaggcaucagguucccagagaucauuuauuuacuuaaguuuuuguuguccaacugugaaagacuggauaaaaaguacuaugugggugggcagggcagucagcgaauacucauuuugaaguacaccuuuacacuguugucuguaucauauuuuuuuauguacaaacguaucgaaucuuuuaggauuuagucaccuaugaugaugugcaggugaacuucacucgggaugagugggcuuugcuggauccuucucagaagagucucuacaaaggugugaugcuagagaccuauaggaaucucacagcuauagguaauauuaugauuuuuuaauuuacuuuauaauauguauacacaacuguuucuuuguuauuguuauuuguuuuuauaauuucaauugagaaugaggaagaauaugaugaauaaaucacucaugguuuuaaaguucaauggaguuaauaacuuaaauacuguuuaauugccaauaauguaacauacuuucucugguacuggguuuagguuacauuugggaagaacauacaauugaagaccauuuucaaacuucuagaagucauggaagguaauuuuccucugcaagcugaggagaaaaugccuaugaagaaaguuuaacucgugguacaaguaguaaagaaaaccaauaggguacaauaagcacugcuuucaguuguggauguuuauugaauuucauaaaaucauauaugucuauggcagauauguaauuauuguuugcaagacuuuccauuaguucaaagacagagaaauaauggcuuaacacauauguuacuguuuaaaucaagccuaguagagccaugcuguacaagggcgagugucuucagucuuauaucgcuuagcuauugcaaaaggaacauacagugauuaggugacaaguauaugucuaaaaccuaguaauaagcaaauaauccauaguauaucugagcucaaugaaauacuuguaauaacauugcuaaauuuagugagauggacaguuuauaagauucaagaaucguuuugugguaaagccuuaacucuguaccacaucucuguggugaaaaaaagucagcugugugaauauaaaauggaacuuauucacuuguuauucucuauugauaugaauagcaaagguuaggauggauacaagccuugugagcauugggguauugaaagaagcuacauaccuuucacuuuuacagaacaauuuguggauaugcaguauaacauauuuugagcaacauacuaaaugugcuauauaaguuuauaaaaaaauuuguuuccgaacauugcuggggacauuuaccaacucuaacugcugaaaauaguaaugagaauuaaggcaguagaaauucuuucuucuuuugcauuuguucauauuccaaauguaguauuacucucaugauaacaaaauuugugaaugcaaucauugugcaaacacugugaguucuuccuguuuuuuuucaaauaugugaguaaccuuuuauagaaaaaguauguuauaaaugugagccagauaaucaauacuguucccauuucauauauccucgaagauguaaaacaauucauaauuuaguagaacuccuuugaauauaaacaaaguaauauuacguuaacauuagauugcuuuguucaaugaaaccaaaauuuaaaacaauucauacagauaaaaagacucaucaguauaaucaguguaagaaagauuucacgugugcaaauuuuauuugcaggcaugaaagaaguuguucugcagagcaacccucugaguuuauucaaugugguaaagccuuugcauaugagagugguagacaaaggcaucaaauuaaacauaauggagagaaacaccaugacuguaaccaaugugguaaggacuuuagaacauggaauguccugcaaauacauaagcgaacacauacaggagagaaacccuaugacuguaaacaaugugguaaagccuuugcaagaagcugucaucuccgaaugcauaaucgaacacaugcaggagagaaacaguaugaauguaaccaaugugguaaagcuuuuaaaagaaggagugaccuccaaauacauaagcaaacacauacaggagagaaacccuaugaauguaaccaauguggaaaagccuuugcaagaagcugucaucuccgaauacauaagcgaacacauacaggagagaaacccuaugaauguaaacaauguggaaaagccuuuguaagcaguggugaccuccaaaaacauaaacgaacacauacaggagagaaacccuaugaauguaaacaaugugguaaagccuuuucacaaagcagucaucuccgaauacauaagcgaacacauacaggagagaaacccuaugaauguaaccaauguggaaaagccuuugcaagaaguggugaccuccaaaaacauaagcgaacacauacaggagagaaacccuaugaauguaaacaaugugguaaagccuuugcacauagcagucaucuccacauacaugagcgaagacauacaggagacaaacccuaugaauguaaacaaugugguaaagccuuugcaguauucuauacucuccaaaugcauaagcgaacacauacaggagacaaacccuaugaauguaaacaaugugguaaagccuuuacaguaaucuauacucuccaaaugcauaagcaaacacauacaggagagaaacccuaugaauguaaacaaugugguaaagccuuuucacaaagcagacaucuccgaauacauaagcgaacacauacagaagagaaacccuaugaauguaaccaaugugguaaagccuuugcaagaaguggugaccaacaagaacauaagcgaacacauacaggagagaaacccuaugaauguaaccaaugugguaaagcuuuuauaagaaggagaguccuccaaauacauaagcgaacacauacaggagagaaaccauaugaauguaaacaaugugguaaagccuuugcaggaagcagucaucuccgaauacauaagcgaacacauacaggacagaaacccuacgaauguaaccaaugugguaaagccuuugcaaaaagcaguacucuccaaauccauaaccgaacacauacaggagagaaacccuaugaauguuaccaaugugguaaagcuuuuauaacaaggagaguccuccaaauacauaagcgaacacauaccggagagaaaccauaugaauguaaacaaugugguaaagccuucgcaagcaguagugaccuccaaaaacauaaacggacacauuccggagagaaacccuaugaauguaaacaaugugguaaagcuuuugcacaaagcagucaucuccgaauacauaagcaaacacauacaggagagagacccuaugaauguaacuaguaugguaaagccuuugcaggaagcaguggucuccaaugccauaaaagauaaauacaggagagacaccauaugaauguaaccaaggugguaaacccuuugaaggaagcaguggucuugaauauuauaauugaacacacacagcugaaaaacccaggaauguaagcaaugugguaaagccuuugcaggaaggagugaccuuuaaagagaaaagaccauacaggagagaaacucuauauagguaucugauguuauaaagccuuugcagcaagcauugaucuccaaguacauaaaugaacauauaccagagaggaaccuuuuaaacguaaccaaugugguaaagcuuuuucgaaaaccaauagucuuuacacacauaaaagcacauauaguugagagaaaugcuuugauuuuaaccaaugugguuaaacuuuuucaaaaagcagucaucaacaaaaucaugaaagagcacguauaggagagagauuuuugaauguuagcaauggugcuuuuauagcuuuuucacaaagcaguggccuccaaauauauaaaggaacacauacaggagagaaacccuaugaauauuggcaauguuuuaaaggacuucuacagcacaaucaucuucaaaucuguaaggaacaugagguuuugagaaauccucugaauaacaccaauuagggaaagcaauuguacaaaagagucaucucccaacacaaaaguauacacacuagauagaaacccuaugaauauaggcaaugugguaaacauuuuauaagucacaguagucuguaagaaaaggagacacaguugagaaaaacacuaugaaaugaacaagugaacagagccuuguacauuaaaaucuucaaauacauaaaagaagacaaagaggugagaaauccgaugucuacaagccaugugguauugcuuucacuugucagucauauucaaagacacaaaagaaaacaaaauguaacaaaaggcugaguguguuuaauaucgugaaacuuuuugaauauuuuagagucuucacaaugaaaccauucauacugcaaauaaauuuaggaauaugauauggugaaaccuuuucagauuucccaaauuucaucauuaugaaugagaaacccauaaaugcauucaauauggggaagccuuuaaacauuucuaauucuuuuuuuuuuuuuuuaaagauuuauuuauuuauuuauuguaaguacacuguagcuguccucagacacuccagaagagggagucagaucucguuacggaugguugugagccaccaugugguugcugggauuugaacuccugaccuucagaagagcaguugggugcucuuacccacugagccaucucaccagccccaacauuucuaauucuuuaucaucaugaaaauaaucauacaaaggagaucaaggggauacaaggcaugauucuuauugucuugcuugaguuacaguccugacauccuuuggugaaaaauaucaaugcggaaauugugagcuggauuaaacccuuuccuccccaacugcuucuuggucaugauguuuaugcaggaauagaaacccugacuaagacaaauugguaucaggagugggguauuccugugacaaccugaccaugguuugggaggacuguggaaggacuuuggaacuuugggcuagaagauucauucuguguuaagaaugcugugggauguuguguaggagcuuggaagauaauguugagaaccgugcagaagauggaggccuggcuugugaaauuucagagggaaaauuaaagccucuuuucagggccauuguuacuuugugaagauucugugguucugguuaacuggggcugaagaaucagcugugauuaacaagauaauagaauuucuagagugaaaacuuugcauuacugggacuguugaugcugguuagcuggagcuaagaaauuagcagugauuaagaagaaaccagcaucauugaagugacaucaucugugaaguguuuucugagagcacagaggaaguguucuagagauaaucaaggugguaccuugugcuguggcuggacuugguaguguguaagucuuaaccucgugguacugguuuugaaggcaugaagggauaaugcagagcagcuaaggcccagcacuuugagaggccauggaaggcaacuggugaaggugcagacucaggugaaauugauggcccaguacugaagagaucaugcaguguuuuggaguugacagguccaugauugaccacgaagaacugcagcagcaguaaaguacaugcaucuggagccuagaggacaaguugugugcuacaaaggacaggguuggaaaagugacccaagcccuuggaucuuuuggaguuguccaaaagaucgugaguuggaucccagacauuggacaguuggaguuucauuuuuacuuuugauugugacugugcccugauauuuuucccucuugaaggaaacaaguauuuuaguggauuccauaguaaagagacuuuuaauuguaaaaggcuuuggauuuuaaaggauauuggauauuuuaaaagcauugaacuuuuaauauguaaagucuguggggcuuucaaaguuguguauaucuugggcaugaauaagaaacuaagaguugagcauuacuagugauguguuugcgugucaaguugacaaggugucaauuauacuggcuaauuuugugucaacuugacacaagcugaaguuaucacagagaaaggagcuucaguugagacaugccuccaugagauccagauguaagacauuuucucaauuagugaucaaggggaaaggccccuugugggugggaccaucucucugcacugguagucuuggguucucuaagacagcagucugagcaagccaggugaagcaagcuaguaaagaaacauccuucuguggccucugcaucagcuccugcuucuugaccugcuugaguuccagucccgacuuccuuggugaugaacaguaagcaguaugaaaguguaagccaaauaaacccuuuccuccccaacuugcuucuuggucaugauguuuguguaggaauagaaaccaugaauaagacaagggguauaagguauggauuguaaaaaaaagauuagacaauaaagaaaugaagaaauaaaauuaauuuuuuuuuuuaaaaggaggaucagacagaaacauuccuuccaaauuauagcuuuauuuucacaccaaucaggauuuagggauaggggcuuauguaguuuacagugucaacuguuauauaauaugacuguuauagcuuaacuaaucauauggauuuguucuuuggugguaaaguacaggucuuauguuuugaggggcacaaugaaaagcagaaaacauuguuagagacagucauuauguuuuaaaaagaaaauaugaguaaagugagguuggaucuccacaauaccuaauccuuggaaacgaacuuaguuucaccaaaggcaauacuuagggccugguguuuggauuugauuuguuuuucugcuaauucccaauuguguauugauucuuaugcuacuccuguuaaauucuucccaaauuucaugauaauccuguacugggacacugagauucccugccccaagcugauuguaaauggguaacaaaagugccagcagccaauggcuaggcaggcaacaaaggcaggacuuuuggauucauggcaagggaaacaaagaggaucuccaugccaguaaaggauuuggaugccagcuucagagcugggaaagacacaauaccagccacauaaaagcuaggaaagagugaccccaguguucccuccucugauugguucuggagaagcaaagauggcucuagauuuaggaaauuagguguaucacaggggaaccaauagcaauguggauguuugguagugucccagccaaugagcugauuuggcauauuacauaaugcuguuugucuuucauuucagacuccaaaguacuuguaugcugagcuaagaacuuaaacagguggcauccuauaguagagcagaguaaccaacugagucuacagaaggcaucacaccuacaggauggaaugcaauauuaaaaacuaauuggggauucucaaaugaaaaacaaaugcuaagaugugaaauuaagggaugaggaaaauugguuucuuaguggauucgcuuguuuugcugagccauuugaguccucacuagcugugcagguucacaacuaaaacaaaaguugagcuaaaaugguaugcauaauucuuggauuuguggaaugagcugggacucagaaaaaugucccaagcugauccagacauccuuguuggucuggauuuuccaugagcccucuuccaccaugagcccuucuaaaagauuucugucugccucagauaguuuaagcuuggaggugcaguacaaagagacaggcugcucagaaagcaacaacagagguagaugguagaggcugcccagagcuauaaucagaaaaaaagaauagagagaaaucgaugagauuuguuuuaacuucuuuuaaggaaaaaugagcagguggugauuguguaagaguguuugaggcaaucucugugaagggcccuaaugucugcagaggauucuccacauggcuggcacccuagcacacccagguccuugagaucacugguaaguggaaugcaauauaaguuccaaaaaauacagagggucuuguaauaguaggaacagggacaaaggacagcagcgugaccagcgacugagguuaacuucugguuggagccacccucucccacccccaugcaaucuuuggccagaucucagcagagggcccaaagguccccagaggacucuucaugcugaaggcccccuagcacacccugguccuugagaucacuggugaguggaaugcaacaucacuuccaaaaaauccagagggucuugugcuagcagcaacagggucaaaggacaaaggcaggcccaagcacauccagaaucuugggaacacugagaacugguuaugcaggagaguaagugggcagcagaagcaacaaagcuucuugaacaaggucccuacaggccuucauccucagccagaagacagaccuaacacccagaacccuagacacuuucccugcgagaggggagucggccuccagggagggcucugaccccaggaaucaggagguggaucugaacuccagacuucugugcaccuucucuguuggcacuuucucuuuauguuaccuaggucacauuauauuuaguggauaggauuaaagacaauuaagacuguaguaagauuaagggagaguuucccuuagaauuuaagacauauuucaaacaaccagaauggagauuuuuaaauuauguuuauucuuuaauuauacuccagucauuaucacccccccauuccaaccacuuacaguuucucaucccauaucccgaccccucuguacaucuccaugaggguguccucacacccacaaccauucaacaacauccugccaggcuuccccaaucccugggacuucaagucucucgaggauuaggugugucuucccucccugaguccgggccaggcaguccuccucuguauauauguuagggaccuuggaccaacaaguguaugcugccugguugcuggcucagagucugagagauuuccaaggucaagguuucuugagacuguuggucuucuuguuggguuguaagacucccgggagccuuagcuuacuggggaccugugagugaaccauguggggcuggaaucaauggaaaaagcaagaggaauuuauuguuccacuaaacuggggucaucccagacccuaaggagagguggugaccugcgugccuguucggcgagcuuuuauaugguugucaggggcaaaauagagcaucaaccuggcagugguggcauacaucuuacauuuaaaagcucauaguggauugcccagaccccuuaaugagggcaaugcugcagcagguuugcauaucaggcagaguauaggcauuacacaggaauaguucagccuaacacucucauucuuuacaucauuaaaaagcaauagguugagacaacaauuugguauuucuugagaaugugcaugucaaauuguaaagacuuucaucaguguccucaauuucuuccuguaucacacaaagguguuaauccucuaggaguuaauccucuaggacugguaccuacucaguuauggcaaguagacguuacuuauauaucugaauuuuuaaaauguuaaacaauguacauaugugcuacauccaauccaguagugagaagcgugacaggccccgaaaaccugugugcuguccugaggcgagaaguucacggaaacuuagucuccuggaaucuugcaaucacguauaaagaaugcuccaauguccuugcuuuaguugguaaacggaucuugggcguucccuuaauguugcuuuauuauaaguccuccuaagggggcuggagagauggcucagugguuaagagcauugacugcuguucugaagguccugaguucaaagcccagcaaccacauuguagcucacaaccacccauuaugacaucugaugcccucuucugguguaucugaagacagcuauaguggacuuaaacauaauaaauaaacaaaucuuuaaaucacauaauuauaaaaaaaauaagugcuccuaaguauugauuuuuuuuuuuuuacauagagcuaaguuagauucuaggcagucguugaucugacccugggcauggauagcuaugucauugcccuauguaggaauuuaccauuaucuaggaagagggaaguuagugaccuaaggaggaaccagaguagauacuuagaacuauagauagcugaguuacacccauauacaaguguuuacaauggccuagggggaacaggaacccagaccccuuaaugagggcaaugccacagcagguuugcauaucaggcagaguauaggcauuacacaggaauaguuccgccacacacucucauucuuuuuguuuguuuuuuuuuuucauuuuuaaaauucuauuuauuuauuuauuuguuuguuuauuguauguaaguacacuguagcugucuucagacacuccagaagagggcaucagaucucaguacagaugguugugagccaccauguggaugcugggauuugaacucaggaccuucggaagaccagucagugcucuuuuuuuaaaauauuuuuuauuagguauuuuccucauuuacauuuccaaugcuaucccaaaagucccccauucccucccccuacuccccuaccgacccacucccacuuuuuggccaugguguuccccuguacuggggcauauaaaauuugcaugaccaaugggccucucuuuccagugauggccgacuaggccaucuuuugauacauaugcaucuagagacaagagcuccgggguacugguucauucauauuguuguuccaccuauaggguugcaguucccuuuagcuccuugggugcuuucucuagcugcuccauugggggcccugugauccauccaguagcugacugugagcauccacuuuugugugugcuaggccccggcauagucagaugcacuaaaagaaacacucucauuuuuuacaucauuaaaauauuaauagguugagacaacaauuugguauuucuagaaaaugugcaugucaauuuauaaaaacuugucuucaguguccucaauuucuuccuguacuacauaaugguguuaauccuugagaacauauaccuaaucaaguauggcaaauggauguuacuuauauaucugaauuuaagaaauguuaaacaauguacauaugaguauugauaucuucucaugcuuucuauuugcaacugcuuuaacaggauaagcaacuaaauaaggaacuagucauugccuacauuguuuuucuauucuugauguucaaaaugacaggaagacauaaaguuacuggccauuacagucaggcauuugugauguuuuguuaacaauuuaauacuugucauauuacugggauuccuuauuauucucaaagacuagguauuguggagcacacccauggaacuugaaaacaauucucaauuuagcacaaucuucaaucaucugguaggaaagucucaaggaggcaucaucugaaucagguuagccuuucacaauagcugugggauacugucauuguuauauuaauuaagaugaagagacuuagcaugguaaguugcuccauuuccuaagcagggacccugguuguaaaagaauggagaaagugaacugugcacuagcaaaaaugcucugagacuccugcucuugacugucgauagguaugcacucuuguugcaggcucuugacauugcaacauuuuaccaccauggaccauacuacggaacuaugagcuaaaaugacccuuucuuucccauuugcuuuuccuaggguauuuuauuguaagaauagcauugagauguaccaauaaauuuaaacauuuuguuucucuuuugaggauuuuaaaaaaugaaacauaaaguauauauggcaugaaaggcauuguucaaagaaugccaagugcacacaucucacuagucuaucucuucauggacagccucccucagucucacucucugucaggcaucauucauuucuccagccaggaaacagcagauuccuacuaugcuaucccuggcuugaccuacagcuguauauuaccuccaaucugaaacuaacucagaaggagguuaugggacucacaguguucccaaugggguuguauaagcaagaaccaguucaugagggagagaugacucccugguagcacugccugcaagcaguauagcaaacuucagggauucagcuccuucaaggcaucacccauguuggguugcuuuguuagugacucagcuagcugacuauaucaaccauaauccgaaaagcucaauaauaauuucucucccauucacugggcuugaaaucacuucagagacaaaguuuugguuguuuuggggaguuugagagaagcaaaaaaaaaaaaaaaaaaaaaaggaucaaagccacccagaaugaaaugacuccaaauguuggcccagcuaagguggaaaaucaugggccaagauaaaccuuuccuucccauaauccuaaaauauuuuuguuggguauuuauuugcagcaacaagaaaacccacugaugcuccaaaacaauacuuggguggagccauguucuaucucucaacaugcucuaucuggaaggaaaggaaguuccuucacaucuccccaggauacauuuaacaacaaacaccccauuaagaacuugcuguaaucauuguccagggucagugccuuggguaguugacacaugagaagcuccugugacaucuugugaacugucacugccauggagccaggaacccaccucaguguugggacaucauugcuggugcuaauguacagacuucaagaaugugccugucuaagaugaaaaguggauggaggaaggacaagggcaaaagugacagaguuuguucaaagaaaaacaaagcaggggcuucucaaaaagcuagcuugccauucccccaucacccucaacucucccauucccugagaaucccacaagucaggaagguuucgguggcccucuuguggcgaccucaaauauugcucaauguuuuuugguugcaucaugcaagugguaccagcuagaaacaaggugugaaauaaaacuauuuuaaagguuucuguguuuucaaauaauucauuuaccuuaauaauaagaaaaucuaccagugauuuuauuuguuugaaauaccccuguguucggacauauugcaggucaucaccauacuuaauuucaaauuaugcuacaaaacugaagugauaaaagucagaaugguacugacacauaaccagacacagauugaacaacuggaauagaagauccagauauaacugcauaaggucacauuaucucugacaaagacacacacacacacaaacacacacacauacacacacacauccauacaugaaccccacucacaugcucacacacacaaauaaaagcacaugcuuaugcaccugucacaugcagaaacauacacacaugcaucucccauucucggucacaagcucacacccacauaugcacacauacuuccacauaaacaugcuaacacacaaaugcacaccacauaccugacccucacuugcacacaugcucccuuccacacacauacaaacacauacacacaagaaacucuuucccccacaugcucacacaaacacaaaugcaaccccaaaacaacuuuacagacagacauucagacaugcacugccccauauucucauacacacauucacacauguaacccaagcacauuugcucacacucacaugcacaaacccccacgaacacuggaugacacacauacaugcauacauguacacacacacacacacgcauaugcaugugcaaacccugugcucacacauacacaugcaccuuaccuacaugcucaaacacaaacaggaccacauacaucuccacacacaugcaaaaacauccccacagucauacacauuccuacaugcaucccuacaucugacaaucaauauucaggaaaaagaagccaaucuuuucauccugcacagaacuuaauuccaauuggaucaaggacaucaacacaggacuuuguacuccaaggcugcaccagaaacaucaacgagucugcaucaacauagaaguacaagagaggaauuucuaaacaggacccuggugcugccgaggaugagagcaauuacugacaaaggggaccauaugcagcuguacacugaagugucaggugagugaagaggagaggcucacaagacaggggaggccucucugccagaugcucaucugaaagagaaucauagauagaauguacaaagaacuaaaaagaaagucuaaccauuaagaaccuuuaaaaauaaaugaaaaaacgggcccugagugguuaaagagaugacucaaagaguacuuuggggacaaaauuuuguugacuauauaugccugcauugauuuuugggcucucuuuuuacuaggcuaucuucuccugguuuguagaaaugcuauugcuaauuuucuauccagggugucuuugaggcggguccacacaggagagcacguggguuacagaaggaacagagauucuuggacaggaucccuucaguccuucuuccucagccaggagguggagcugauccucaguccucugugcaccuuuccugacagaggagaguuggccuauagggagugcucugacccaggaacucaggagagagcuggucucccaggaguacugacagaggcuaacagacacacagaaggaacaagcuccagccagagacagcuagaacaucuaacaccagagauuaccagauggcaaaagguaaacauaagaaucuuaccaacagaaaccaaaaacacuuggcaucaccagaaaccuguaaucccaccacagcaaacccuggauaacccaaaaaaacauaucucgugaugcugguaaaggauuuuaagaaggacauuaauaauucccuuaaagaaaaacaggacaacacaguuaaaccgcuagaaguacuuaaauaggaaacacaaaaaucccuuaaggaaauauaggaaaaugcaaauaaacaggagaaggaauugaacaaaaccauccaagaccuaaaaauggaaguagaaacaauaaagaaaacccaaagggagacagcucuggagauagaaaucauaggaaagaaaucaugagucauagauuugagcaucaccaacagaaaacaagugauggaagcaagaaucucagguguagaagauuccuuagaaaacauggauacaaaaauaaaaggauguguaaaaugcaaaaagauccuaacccaaaacauccaggaaauccaggacacaauuaaaaaaccaaaccuaaggauaauagguauagaugcgaaugaagauuuucaacuuaaugggccaguaaacaucuucaacaaaauuauagaagaaaacaucccuaaccuaaagaaagagaugcccaugaacauacaagaagccuacagaacucauaauacacuggaccggaaaagaaauuccucccuacacguaauaaucagaacaaaugcacuaaauagagauagaauauuaaaagcaguaagggaaaagugucaaguaacauaaagacagaccuauuagaauaacaccagaguucucagcagagacuaugaaagcaacaagauccuggacagauguuauacagaccauaagagaaaacaugugccagcccaggccacuauacccagcaaaacucucaauuaccauagauggagaaaucaaaguauuccaugacaaaaccaaauucacacaauaucucuccacaaauucagcccuucaaaggauaauaaagagaaaacuccaacacaaggacagaaacuacacccuagaaaaagcaagaaaguaguccuucaacaaaccuaaaagaacauagccacaaggacagaauaccaauucuaacaacaaaaauaacaggaaaaaacaauuacuuuucuuuaauaucucuuaauaccuaacagacagguuacauaaacaggacccaacguauugcugcauacaggaaacccaccuccaggacaaagacagacacuaccuuagaguaaaaggcugaaaaaaaauuuuccaagcaaauggucccaagaaacaagcugggaccauuugaauaaaauugacuuuuaacuuauaguucucaaaaaugauaaggagggacacuucuaacucaucaaagguaaaauuuaccaagaugaacacucaaguaugaacaucuaugcuccaaaugcaggagcauccacauucauuaaagaaacuuugcuaaaacucaaagcacacaucacaccucacacaauaauagugggggacuuuaauacccgacucucaucaaugaacagauccuggaaauggaaacuaaacagagaaacagugaaacuaucagaaguuaugaaccaauuuuaacaauugucuguagaacauuucauccuaaaacaaaaggauuuaucuucuucucagcaccucaugguaccuucuccaaaacuguccauaaacugaucaaaacugacuggccuggucacaaaacaggccucaacagaacaaaaauauugaaauaauuccaugcauccuaucagaacaccacagaugaaggcugaucuucaguaacaauauaaauaauagaaagccaacauucauguggaaccuaaacaacacucuacucaauaacuuggucaaggaagaauuaaagaaauuaaagacguuuuagaguuuaaugaaaaugaagccacaacauacccaaacuuaugaggcacaaugaaagcaguccuaagaggaaaucucacagcucugagugccaacaaaaagaaacuagagagagcacacccuagcagcuugacugcacaucuaaaagcucuagaacaaaaugaaacaaauucaccaaagaggaguagauggcaggaaauaaucaaacucagggcugaaaucaaccaaguggaaaugaagagaacucuacaaagaaucaaccaaaccaggagcugguucuuugaggaaaucaucaauauagauaaacccuuagccagaauccaagaacaucaacaugaucaucccucaugaucaaguagacuucauaccagagaugcagggaugguuuaauauauggaaauucaucaacaaaauacacuauauaaacaaacucaaagacaaaaaccacaugaucaucucauuagaugcugagaaagcaauugacaaaauccaacauccauucaugauaaaagucuuggaaagaucaagaauucaaggcccauaccuaaagauaauaaaagcaauauacagcaaaccaguagccaacaucaaacugaauggagagaaacuugaagcaaucucacugaaaucagggacuagacaaugcugcccacucucucccuaucuauucaacauaguacgugaaauccuagcuagagcaauuaggcaacaaaaggagauuaaggggauucauacuggaaaggaggaagucacuugaucuuugacaaaggagcaaaaaccauccaguggaaaaaggaaagcauuuucaacaaauggugcuaccucaagugguggguagaauguagaagaaugcaaacuuauccauucucaucuccuuguacaaaacucagguguaaguggaucaaggaacuccacauaacaccagagacacugacacuuauagaaauaaacaugugcaagagccucaaagguaugggcauaggggaaaaauuccugaacagaucagcaauggcuugugcaugagaucgcaaaucaacaaaugggaccucauaaaauugcaaagcuucuguaaggcaaaggacacugucaauaagacagaaaggcuaacaacagauugagaaaagauauuuaccaauauuaaaucagauaggggaauaauauccaguauauguaaagaacucaagaagguggacuccagaaaacuaaauaacccuauuaaaaaaugggguacaaagcuaaacaaagaauucucaacugaggaauacagaauaucugauaagcaccugaaaaaguguucaacauccuuaaucaucagggaaaugcaaaucaaaacaacccugagauuccaccucacaccggucagaauggcuaagaucaaaaauucaggagauagcauaugcuuuugaggguguugagaaagaggaacacuccuccauugcuggugggcuaucaagcauuuacaaccacucuggaaaucaguuuggugguuccccauaaaaguggacauaguacuaccagaagauccaauaauacuacuccugggcauauacccagaagauguuccaauuuguaauaaggacacaaacuccacuauguucauagcagucuuauuuauaguaaccagagcuggaaagaaccuagauguuccucaacagugaaauggauacagaaaauguggugcauuuacacaacugaguacuacucagcuauuaaaaacagugacuuuaugaaauucuuaggcaaauggauggaucuggaggauaucauccugagugagguaacccaaucacaaaagaacacacaggauaugcacucaaugauaaguggauauuagcccagaaucucagaguaccuaagauacuauuugcaaaacacuuaaaacucaagaagaaggaagaccaaaguguggauacuucaauuguucuuagaagggagaacaaaauaaccguggaaggauuuacagacaaaguuuggagcagagacugaaggauccugucagcaaacucuuguuggcaucuacagcagugucugauuuuggugguuguuuaugggauggaucccuagauugggcagucuuggauggucauccuuucagccucugcuccaaacuuugucucuguaaauacuuccguucaggagaacacaagaugucuuagucaggguuuuaaugcuaugaacagacaacaugaccaaggaagucuuauaaaaaacaaacaaacaaacaaacaaacaaaaaaacaacauuuaauuggggcuagcuuauggguuaagagauucaguccauuaucaucaaggugggagcaugguggcauccaggcagucauggugcaggcagagcugagaguucuaugucuucauccaacagcugcuaguggaagacugccuuccaggcacauagcuugagaguauuaugcccacacccaacgugacacacauacuccaaacaggucauaccuauuuuaacaaggccacaccuccaaauggugccacucugugguccaagaauauacagaccauuacaauauugcuuuaaagaaugucuucccuguuaauauuaaugauuccauuauggcuacaagaccaggaggcaaagggguggcuaaugucucaguaaaaugguaaaugcugcaaacuucaggacagcccuuagggcuguggaaaagaccuuuaaagucuuagguuccaaauauguaauuccucaaaaaacaaugaugcaaauugaauuaugaggggcuucacaaaucuaaaggaaagaaaguaggugugcugugagccaacuuaucagacagauacuaaggaaggauauagaagauaaugagacuuagagaguggugaucacaagagauuuaaccaagauaaguuuuuguuguuauagcuguuuuuuauauuuacaaagccaaacagauuccugaguucaauaucagccuggaacagaucaagguuaaguccagguguuuuggaaauggaauuucagaacuggguugcacucaaguaguuuaguaucugugcuuaacagagaggcaugaagaccucuagauucuucugcaauauuaaaagaaaauguguacuugcuuucugcuaagaaucaggugugugcucagggaugcacauucuuaagauaaucaaacggaaacuuggaguaaaugacuggauugguauguaaaauaaaagacuggacucugaucuccaagagaugaccuacuaagagaauuuuuuagaauagcaaaagagaauuucuuguagaagauucucauggagagcugcuugaagaucuccagagaggcagaucagacaaaaugagcacagaacagaaugaacgcaggguagaagacuguuuccagcagagcauagguuguuacccuguagugaugauucaacugccuucccuuuauuuuugaugcucccagauaccccuucucucagaacacuccuucuagcccaggauuggaacuuggcaacagaggaauauuuuuaugccacuaaguuuuuaaucuauaucaggacuuauaggaaaggucucauuuauguuaacauaaauguuccuuaguaucugucugauaaguuggcucacagcacaccuacuuucuuuccuuuagauuugugaagccccucauaguucaauuugcaucauuguuuuuugaggaauuacauauuuggaaccuaagauuuuaaaggucuuuuccaaugccaauaguagcuuauacccaacuauuuugauuuaugguucuuauggaaguguaauuaaagaccauguugaucagcugugugagaccuaggaaaaguaauggguuugaacagugcucuuaaccacugaaugaucccugcgugccaaguaacccacuuucaauaaaauaaaauaaaauaaaauaaaauaaaauaaaauaaaauacugaacacgagauauuagaucuucaaggaccagcuuugaggaaagcuacaaaugguuaauggagcuugcugaaaagaagcuauguuugcugcaagugacagagcuggagaagugggaguaccuaaaaccuugugguuaaggcaauuucaccauaauaccaagaugcugaacuggaaguuauaaguuuuguuguuuucacuguuaaauuuuggucucauuuggucaguucauuuuuuccuauguucugauuauuucugcuaaggauuguuucuuuugugacauuggauuuaugaaagauaacaaucucucuuaaguguaugguacaguguggacagaaaaaaguaguuuuggcuuuugaaaaaacaugugacaguuaaaugagaauggcucccauagacuuauauguuucaauacuuauuuuuuaguuggugggacuguuuuccaagaagcauagguguggccuuuuggaaagaugugucauaugggugcauauucagguuuuaauaucuucugaccaugcucacuuugcuagcuaccucuugucucagguucaaaauaugagcucucagcucuacuggaugucauguguuuacgcugccacuagugacucuaaugcuuuggaacucuaagcccaaaaugaugccuucaauuauaauuucuuuuuucugugguguguuuuaugauaucaauagaaauaaauauacaaaagagugcauggaaaaucagaacacagaaaacaaucacuucuaacuucagaaaacagggaggaacacuauuccaacuaucucuagggcacuaugaucuguuccaugccguugaaauuaucagugauuccaagauuggcaauuauauauuucucuuaaaaagcaaccauuuuaaggacauucuccuuuacuuauaacccaaccaauaccaaauaacgucucaacuccaucuuguguugaagauucauguaaagaauugagguccaaaagcauaggauuacauacauacuacuccuucuuuuucuaaaaguuucuuauuuuuuauugaauauuuucuuuauuuacauuucaaauguuauccccucucucaguucucuccucccaauucacuauucccuaccucuaccccugcuucuuugaggguguuccgccaaccacucacuccugccucccugcccuggcacucacuuacacuggggcauuauacuacucuuuauuacacauacaauaaauguuguaaauuaugguauauuuagugaaucaaguugggaugacauucuaaauaaggcacucucucaagaacaacaucaacgauaaacaucacaguuauaucuuuaagggccugugaagaacuauuuuuuauuuucuguuccaaauuaauccuaaagauaaaguuugauuaauucuauauuguuaauaaugguguuuucucuaaucaugucccaaguuaaaggccaacuugucauuuugacuuguuuuuccucuauaaucuugagauuuacacaguauaaauugcuucgacuguucaugguauguuuuuaaaacuucagauuuugauuguauuacuaacugcaaagcaauuccauuuugugauaauuaguaugcaucuuacccuugaauuugacuucaaaaaguuucucucuuuguacucuggucugaauaucucuccuaauucagaggagaaugcaagauugaccuggaaauaaaauacauuuuuacuucacauccuuuuggucauuucuuccugguucuugacaguguaaacauaucuacccuuuuaaaaacuaggccuuuuugaaauggguuauauuauggaagugacuauggagaccaguguggcuggaaauucaggaauaugaauuugccuccaaacuucugggauugauagcacauacuaccaugcuuggcaauauucauuuugaacaugauuguaagguacugauucuaaacaccugaaaugauuguaagaauuauuguauugucccaauucuucagugcuuucauuaucuaauuauucauuuuguuuuucuuuuccucucuaucuucucucuuaccucuacucucuuuauucuccuucuuccuuuccucccccccucucccucccucucccucccccccccucucucucucucucccccucucucucucucucaaagaauuuuauuuguaugguuauucugccucuguauuuugguucucgauccaugccuuauacacacgaagacaaggaaagcgagcaaagccaccaugucuguuaugugcuucaugcucuguucugaagcuugcucauaaccuucacguggaacauacaugcagaaccaaagccacagaacaaaaucuuguuuccuaaaaucgcucuuuaauuucuuuaauugcuaauauccuggccaacuguccacuugugggacaaauuguuaacuccaauguaagcugacugaugggcuaugcaagcuauucagcuugauucuaggaggaaggagaagugccuccugagugcagugcuuugacaucaggcaaguucuaaauuugcacagcagugaacaaaggggcacugcccacaaagggaagaagcaggcagguaaacagcauugaucuggaaucuuagcuccucccaaggaauuggcgggaggaaagacaggucggcuauuggaggagacacacuagcuacuguagaacaaagcugcagaucuacaaaaggauuggaccaggcuggaaccacuaagcugugucccuucaauacacucuaacccuaaggguggugcucaugucauucaagacucaguagccaaucagaaacuccacacggagcugccagucagaagaggaggaggcucuuccggguacuaagcccuugaguuccucucuuuaacucaggugaccugaguguuucuauguguugcuuucuuaggagucuucagugagugcugcgaggguaacucaggcaagaucagaacuucagacaugguaaguacaaagucaucucccauaaagccuggggagcaagcuucuuagcaaaggaugccugugugguaggucuuuccagcgcauggaugguaagcgucagccaggcauagggggccaucugugugcugcuuuguggaccuagucucuccuuggacccggcuguagccuaugaauaaauuuauuaacuggcagcaucuggacaaaaccuuugugucagggguuuguguguggaaauauacuuggcaggaugagaaccagaggaacagcuuacuguguacacugucagguaaaacagugcagacaagagcuaggucacagaccaaaggaaaagggagugugcugcaggggucacuguuauggagaaagaccugauucaggcagugagaaugauuuuguaauuucauagacuguauccauuuauggauauaauuuaguaaaccuagauugaagaguguuuuauuugggcagguuagcuugagccaguggguaaugaauucccauuuuaggaucuguauuauguagauuugugcaauccuuguugacauauuuaauugagcucccaaauguaaaacacaugccauuagcugucucugugugugucagauuauagaucucaguaguuaacaaagcacuuaggggcaaggucaaacacuaucucauuaaugccauucuuucuaccaggaagggccugauuguuuucaaauaaucaguaauauauuuuuucaauuauauuuaucuuauuaaaaaguuaauuuuugguaauccuuuauaaauuucauuuuucuuaugcauauugaucucuuacuuguuucuguuacccaauauuuccccaaauuuaagaauuucauuccuaauuuuuucuuuugagacaggguuucucuguguagcccuggcuguccuggaauucacucuguauacaggcaggccucgaacucagaaauccaccuaccucugccucccuagugcugggauuaaagguguguaccaccacugcccggcucauucuuauuuuuaaagagauuuuauauaugucuguuuagagaaacaucucuuguagcucuuacuuucuuuaugccauguaaucagacuugcuuugaacuccuaauccucccucugcugcccagggcuuggaaaacaguccuacaacugcuuucaggcuggguucugacugaucagugagacaaaagacaccagggaaugaguguugucuaaccucccuggguuacaggguuacaaguuagggaauuacaaauaaagagggacagguauaagguugaguucacugaccaacuuugaagcuggucuacuugcagcacagaaaaggaggaggaauaagguaggugaggccuuucugcuuuggcaguaguugacauucaccaugaggagucaaguaaucaauuuuacacaaucaguaaaauuccauacuggacauuuuguggcauuucccagauuagggcaaugacaaaugagaucauggucccucucuguuacagcauauugcuggcauaccucaccaucaaccccaggaguagggcugccaaucucccagcugccauuccucauggaauccaaucauuugggaacuggccuuuuuaucuaucauuagucauccugaucuccuggucuaacucuugcuucuccccuccuuccucucuccacaaaguucaagguuaugucuacucucuaccaucccaaauauaacuaggucuggcuauguucucacuuuuguguauaauauacuuucuccuccaccauaccuaggagcaaugcuauccuuuacuuuuaauuucaucuuugucuucccuuuucucucccauuaacugcuucuagcuuuaaaauucauagccacuuuuacuuuuaaauuauuguuaauguaugaauuuuauuucaguucagcugcaagacuuucauauuaagaaauagagauggcugcacaggacauugcaugcauaauugaauauacaaagaaaggaccaugggccuuuuaaauauaaaauacuuggucugcaggacuagaacauucuuuuaaauguacauuuuugugauuagggcuaugucugcauguaggauggaacaucagagcuuggaagguuucagcuuuuugagucauuugcucugugauccaaccgugaaggagcugcuguugcccugaggcccagcuggguuuuccaagcuaaugagggacuaugggcaggccuaacaaucaggaacacuaggggaagauagcuugcaaguucuuuacaggauuuuccucagaugcauguguuacaagcugccuggaagaccacaagccauucccugguuauuauaguaaucuccuuugaaaguacaggaggagcaagucugcagagcuauuugagucugaucugcugcuccuaaauggacugugggucagagugugguucuguugguccauguggugaucauagcagaggcucuuguccuuugacccuucuugcguguggauuuacagggguccagaaggcucgguagcccugggagugggaagguauggaacuuaaaugucucuaugcagugugaauauacaggcauugccuuuguugugcaguagggcagcauuagaaacacaaugguuugauuucuagaauuugugacuguucuguauucaguuuugugugauuaauuuuaugaauaguuuagaaguuaguaguaaagagcugaucacgaucauccuucagaaauauuugauuagauucuuuuuaccuuucuguuaccuauugucaaaauggcaugauucacagaaauucaauucuugguuacaaaaggagcuucugacgugcagaaguuucucagguguugauggugcuggguggguggauaggacagauuggaacauaaugcauauggaaggaagcauuguuuuguauaugggcuggaguggggcugguuuugccugaaauuacuaggucaugaucaccuauagagccauagcccaacuuucugaccaucuacaauuacagagagagcucuggaguauggggccucucuguuuggaagacagaucauuaguaucuguagggucagaauuauaaaaguuuaggagucacuuugaguuauuuuuauuagagucaugaaauaugauuuuauuuuauuucuauacacacacuagcacagguaacauuggucaagaucacauuguuccugauguauuugcuuuaguuauuuaagaaaaguugaaaauuggucacauggaaauggacagaggaagcuuucccugauauuguuuugcugcucugugggcuacuaugagcaaugugucuaggguaagagauagugggcuugguuuuaagauagacugcuuaaggaggacugacuaugguugaggagggugugucugcccuuauuugagggcuaagacacagacaugugguuagaagggaagggaagaugaaaagggucuuuuguaucugcagguagcguggacagaugagaggaaacuucaguccuaagggcagucuuguauauugggucucagggagcaaaaaugagagaaggucuugcagcauucugcaugauuccauguauuaacaucuuaauacaauggcaucagguucccagggaucauuuauuuacuuaaauuuuuguuguccaacugugaaagacuggauaaaaauacucugugggugggcagggcagucagcaaauauucauuuagaaguacacauuuacauucuugucugugucauauuuuuuuuauguacacaugcauugaaucuuuuagaauuuagucaccuaugaugacgugcaugugaauuucacucaggaagagggggcuuugcuugagacuucucagaagaaucucuacaaagaugugaugcuagagaccuauaggaaucucucagcuauagguaauauuaugauuuuuuuauuugcuuuguaaaaugucuauguuauuguuauuuguuuuuguaauuucaauugagaaugaggaagaauaugaugaauaaaucacucaugguucuaaaguucaagggaguuaguaacuuaaauauugccuaauuuccaauaauguaacauacuuucucuggugcuguguuuuaggguacauuugggaagaacauacaauugaagaccauuuucaaacuucuagaagucauggaagguaauuuuccucugcaagcuggugagaaaaugccuauaaagaaaguuuaacgugugcuacagguuguaaagaaaaucauuaggguacaauaagcacuccuuucacuuauggauguuuacugaauuucauaaaaucauauaugucuauagcagguauguaauuauacuuugccaggcauuccauuaguucaaagacagagaaauaauggcuuaacauauauauauauauauauauauauauauauauguguguguguguguguguguguguguguaucuaucuaucuauauauauauacauauauauauauauguauguauguauauuaguguuuaaaucaagccuaguagagccaugcuguaaaagugucucuacagucucauaucacuuagcuauugcaaaggaacacaaagugauuaggugacacguauaugucuaaaaucuaguaauaagcaaauaauccauaguauaucugagcuuaaugaaauacuuguaauaacauugcuaaauuuagugagauggacaguuuauaagauucaagaaugguuuugugguaaagccuuagcucuguaccacaucucuguggugaaaaaaguccgcugugugaauauaaaauggaacuuauucacuuguuauucucuuuugauauggaugucauagguuaggauggauacaagccuugugagcauuggugcauugaaagaagccacacaccuuucacuuuuccagaacgauuagaggauaugcaguauaccacacuuugaguagacauucuaaaugugcuauaaguuuauaaauaauuaguuuuccaacauuauuggggacaaauaccaacucaaacugcugaaaaucacaauaagaauuaggguaguagaaauuuucuucuguuugcaguuguucauguuccaaauguaguauuacucucauuauaaaaaaauuugugaaugcagaguucuuccuguuuuuuucaaauaugugaauaaccuuuuaaaaguaugcuauaaaugugagccagauaaucaguacuguucccauuucauguauccucaaagauguaaaacaauccauaaugaaggagaacaccuuugaauguaaaagucauauuauguuaacauuagauagcucuuuucaaugaaaccaaauuacaaaagaauucauacagauaaaaagacucaucaguacacucaaugugagaaagauuucacgugugccaauuguauuugcaggcaugaaagaaguuguauugcaguacaacccucugaauuuauucaaugugguaaagccuuugcauaucauagucuuagacaaaggcaugaaagaacacauaauggggagaaagacuauuacuguaaccaaugugguaaagccuuuguaauaagcagucaucuccgaauacauaaacgaagaaauacaggagagaaacccuaugaauguaaccaaagucuacauucuugaguucuuuauauauauuggauauuaguccccuaucugauuuaggauugguaaagauucuuuuccaaucuguuguuggccuuuuugucuuauugacagugucuuuugccuuacagaagcuuugcaauuuuaugaggucccauuugccaauucucaaccuuacagcacaagccauggcuguucuauucaggaacuuuucuccauaucuucaaggcuuuuccccacuuucuccuagauaaguuucagugucucucguuuuauguggaguuccuugguccacuuagguuugaccuuagaacaaggagaugagaaugaaucaauucgcgcucuucuacaugauaacugccaauugugccaacaccauuugaugaaaaugcugucucuuuuccacugaaugguuuuagcucccuugucaaagaucaaguuacuauagguguguggguucauuucugaaucuucaauucuauuccauuggucuacuugacugucgcuauuccaguaccaugcaguuuucaucacaauuacucuguaguacagcuuuaggucaggcauggugauuccaccagagauucuuuuaucauugagaagaauuuuuccuauccuaggucuuuuguuaauacagaugaauuugcaaauugcccuuucgaauucgaugaagaauugaguuggaauuuugauggggauugcauuggaucuguagauugcuuuuggcaagauagcuaauuucacuauauugauccugccaacccaugugcaucagagaucguuccaucuucggaaauuuucuuugauuucuuucuucagagacuugagguucuuaucauacagaucuuucacuuccuuagugucacaccaagguauuuuauauuuuuugugacuauugugaaggguacucuuucccuaauuucuuucucagucuguuuauccuuuguguagagaaaggccaaugauuuguuugaguuaauuuuauacgcagcuaguucacugaagcuguuuaucagguuuaggaauucucugguggaauuuuuagggucacuuauauauacuaucauaucaucugcaaauagugauauuuugacuucuuccuuuccaauuuguaucccauugaccuccuuuuguugucuaauuguucuggcuaggacuuugaguacuauauugaauagaaagggagaaagugggcagccuuguguagucccugauuuuagugggauugcuuccagcuucucuccauuuacuugguuguuggcuacugguuugauguagauugauuuuauuauguuuagauaugggccuugaauuccugcucuuuccaagacuuuuaucaugaaugaguguuagauuuugucaacugcuuucugagcaucuaacaagaugaucaugugaguuuugucuuugaguuuguuuauauaguggauuauguugauggauuuccguauauuaaaccaucccugcuucccugggaugaagcccucuuggucaugauggauuauccuuuugauguguucuuguauucaguuagcaagaauuuuauugaguauuuuugcauugauauucaugagguaaauugguuugaaguucucuauuuuuuuuuuauuacguauuuucuucaauuacauuuccaaugcuaucccaaaagugcccccccaacucccccuacccacccauucccauuuuuuggcccuggcauuccccuguacuggggcauauaauguuugccugaccaaugggccucucuuuccagugauggccgacuaggucaucuuuugauacauaugcagcuagauucaagagcucugggguacugguuaguucauaauguuguuccaccgauaggguugcagaucucuuuagcuccuuggauacuuucucuagcuccuccauugggggcccugugauccauccaauaguugacugugagcauccacuucuguguuugcuaggccccggccuagucucacaagggacagcuauaucacuguccuuuuaacaaaggcuugcuaguguaugcaauggugucaucgcuuggaggcuaauuaugggauggaucccuggauauggcagucucuagauggaccauccuuuugucucagcuccaaacuuauaaauaaggcuucuaugaacauaguggagcauguguccuucuuaccaguuggaacaucuucuggauauaugcccaggagagguauugggggauccuccaguaauacuauguccaauuuucggaggaaccgccagacugauuuccagagugguuguacaaguuugcaaucccaccaacaauggaggaguguuccucuuucuccacauccucgccagcaucugcugucaccugaauuuuugaucuuagccauucugacuggugugagauggaaucucaggguugcuuugauuugcauuucucugaugauuaaggauguugaacauuuuuucagguguuucucagccuuucgguauuccucgggugagaauucuuuguucagcucugagccccaucuuuuaagggggcuauuugauuuucuggaguccacccucuugaguucuuuauauauauuggauauuaguccccuaucugauuuaagauagguaaagauccuuucccaaucuguugguggucuuuuugucuuauugacggugucuuuugccuugcauaagcuuugcaguuucaugaggucccauuagucaauccucgaucuuaaagcacaagccauugcuguucuauucaggaauuuuuucccugugcccauaucuuugagacuuuuccacacuuucuccucuauaaguuucagugucucugguuuuauguggaguuccuugauccacuuagauuugaccuuaguacaaggagagaggaaugggucaauucgcauucuucuacaugauaacaaccaguugugccagcaccauuuguugaaaaugcugucuuuuuucuacuggaugguuuuagcucccuugucgaagaucaagugaccauggguguguggguucauuucugggucuucaauucuauuccauuggucuacuugucugucacuauaccaguaccaugcaguuuuuaucacaauugcucuguaguaaagcuuuaggucaggcauggugauuccaccagagguacuuuuauccuuuaguagagcuuuugcuauccuagguguuuuguuauuccagaugaauuugcaaauugcucuuccuaauucguugaagaauugaguuggaauuuugauggggauugcauugaaucuguagauugcuuuuggaaagauagccauuuuuacaauguugauccugccaauccaugagcaugggagaucuuuccaucuucugagaucuucuuuaauuucuuucuucagggacuugaaguuuuuaucauacagaucuuucacuuccuuaguuagagucacgccaagauauuuuauauuauuugugacuauugagaagggugugguuucccuaauuucuuucucagccuguuuauucuuuguguagagaaaggccauugacuuguuugaguuaauuuuagauccagcuacuucaccgaagcuguuuaucagcuuuaggaguucucugguggaauuuuuagggucacuuauauauacuaucauaucaucugcaaaaagugauauuuugacuuccucuuuuccaauuuguauccccuugaucucuuuuuguugucuaauugcucuggcuaggacuucaaguacuauguugaagagguagggagaaagugggcagccuugucuagucccugauuuuagugggauugcuuccagcuucucaccauuuacuuugauguuggcuacugguuugcuguagauugcuuuuaucauguuuagguaugggccuugaauuccugaucuuuccaagacuuuuaucaugaauggguguuggaucuugucgaaugcuuuuuccgcaucuaacgagaugaucaugugauuuuugucuuugaguuuguuuauauaauggauuacauugauggauuuucguauacuaaaccaucccugcaucccuggaauauaaccuacuugguuaggauggaugauugcuuuaauguguucuuggauucggguagcaagaauuuuauugaggauuuuugcaucgauauucauaagggaaauuggucugaaauucucuaucuuuguuggauuuuucugugguuuagguaucagaguaauuguggcuucauagaaugaguuggguagaguucccucuacuucuauuuuguggaauaguuugugcagaacugggauuagaucuucuuugaaggucugguagaacucugcacuaaacccaucugguucugggcuuuuuuugguugggagacuauuaaugacuccuucuauuuccuuaggggauaugggacuauuuagauccuuaacuugauccugauuuaacuuugguaccugguaucugucaagaaauuuguccauuucauccagguuuuccaguuuuguugaguauagccuuuuguagaaggaucugaugguguuuuggauuucuccaggaucuguuguuaugucucccuuuucauuucugauuuucuuaauuaggauguugucccugugcccucuagugagucuagcuaaggguuuaucuaucuuguugauuuucucaaagaaccaacuccucguuugguuaauucuuugaauaguucuucuuguuuccacuugguugauuucaccccugaguuugauuauuuccugccaucuacuccucuugggugaauuugcuuccuuuuuuucuagagcuuuuagauguguugucaagcugcuaguaugugcucucucccguuucuucuuggaggcacucagagcuaugaguuucccucuuagaaaugcuuucauugugucccauagguuuggguauguuguggcuucauuuucauuaaacucuaaaaagucuuuaauuucuuucuuuauuccuuccuugaccaagguaucauugagaagaguguuguucaguuuccacgugaauguuggcuuuccauuauuuauguuguuauugaagaucagccuuaggccaugguggucugauaggaugcaugggacaauuucaauauuuuuguaucuguugaggccuguuuuguggccaauuauauggucaguuuuggagaaggucccgugaggugcugagaagaagguauauccuuuuguuuuaggauaaaauguucuguagaugucuaucagauccauuuguuucauaacuucuguuaguuucacugugucacuguuuaguuucuguuuccacgaucuguccauugaugaaagugguguguugaagucucccacuauuauugugugaggugcaaugugugcuuugagcuuuacuaaagugucuuuaaugaauguggcugcccuugcauuuggagcguauauauucagaauugagaguuccucuuggaggauuuuaccuuugaugaguaugaagugucccuccuugucuuuuuugauaacuuuggguuggaagucgauuuuauccgauauuagaauggcuacuccagcuuguuucuucagaccauucgcuuggaaaauuguuuuccagccuuucacucugagguagugucugucuuuuucccugaugaaguucucuaucuuuguugggucuuuuugugguuuagguaucagaguaauugugacuucauagaaugaauuggauaagguaucuucuguuucuauuuuguggaauaguuugaaaagaacuguaguuaggucuucuuugaagaucugauagaacucugcacuaaacccaucugguacuggucuuuucuuuuuuuucuuuuuucuuuuuuugguugggagacuauuaaugacugcuuccuuuucuuuaggagauauaggacuguuuagguuauuauucugauccugauuaaacuuugguaccuuguaucugucuagaauuuguucauuccauccagguuuccaguuuuguaguacgaucugaugguguuuuuuauuuccucaggauuguuguuaugucucccuuuucauuucugauuuuguuaauuaggauacuguccuuguucccucuaaugaguuugacuaaggcuucaucuaucuugaugauuuccucaaagaaccagcucuuugauggguugauucuuuguauaguucucuucauuuccacuugguugauuucagcagugaguuugauuacuuccugccaucuacuccucaugggugauuuuacuuccuuuuguucuggagguuuuaguugugcuucaagcugcuagugugugcucucucugcuuucuuuuuggaggcacucagagcuuugaguuuuccucuuaggacugcuuucauugugucuccuaaguuuggguauguugugguuucauuuucauuaaacucuaaaaagucuuuaauuucuuucuuuauuucuuccuugaccaagguaucauuggggagagcguuguucaguucccaggugaauguuggcuuucuauuauuuauguuguuauugaagaucagccuuauaguccauagugaucugauaggaugcaugggacaauuucaauauuuuuguaucuguugaggccuguuuuguggccaauuacauggucgauuuuggagaagguaccaugaggugcugagauguauuauccuuuuguuuuagguuaaaauguucuguagauaucuguuaaauccauuuguuucauaacuucuguuaguuucacugggucccuguuuaguuucuguuuccacgaucugcucauagaugaaagugggguguugaagucucccacuauuauugugugaggugcaauaugugcuuugagcuuaacuaaaguuucuuuaaugaauguggcuucccuugcauuuggagcauagauauucaaaauugagaguuccucuugaaagauuuuaccuuugaugacuauaaaguaccccucgucuuuuuugauaacuuuggguuggaagucgauuuuauucgauauucgaauggcuaauccagcuuguuucuucggacaguuugcuuggaaaauuguuuuccugccuuucacucugggguaguaucuuuuucccugagguggguuuccuguaagcagcaaaauauuggguccuguuuguguagccagucuguuagucuaugucuuuuuauuggggaauugaauccauugauauuaagagauauuaaggaaaaguaauuguugcuuccuauuauuuuuguugauagaguuggcauucucuucuuguggcugucuucuuuuagguuuguuguaagguuacuuucuugcuuuuucuagggcauagauuccguccuuguauugguuuucuucuguuauuauccuuugcagugcuggauuagugcaaauauauuuugugaaucugguuuuguuauggaauacguugguuucuccaucuaugguaagugagaguuuggcugguuauaguaacccgggguggcaguugucuucucuuagugucuauauaacauauguccaggaucuucuagcuuucauagucucuggugaaaagugugcaguaauucuaaugggccugccuuuauaugguacuugaucuuuuuccauugcugcuuuuaauauuuugucuuuauuuagugcauuuguuauuuugauuauuaugugucaggaggaauuucuuuucugguccagucuauuuggaguucuguaggcuucuuguauguucaugggcaucucuuuuuuagguauggaaaguuuucuucuauaauuuuguugaagauauuugcucgccuuuaaguucaaaaucuucauucucaucuacuccuauuauccauagguuuggucuucucauuguauccuggauauccuagauguuuugaguuaggaucuuuuugcauuuugcauuuccuuuguuguugugaccauguucccuaaggaaucuucugcaacugagauucucucuuccauauccuguauucuguuguucuacgguuccugcuuucuuuccuaggguuucuaucuccagaguugucucccuuuagguuuucuuuuuguuucuauuaccuuuuuagauccuggaugguuuuguucaauuccaucuccuguuugguauuauuuucuuguaacucucuaaggcauuuuuguguuuccuccuuaaggguuucuagcuguuuaccuguguuuuccuguauuuccuaauuaaaguccuccaucaucaucauaagaagugacuuuagauccaugucuugcuuuucuggugugaugguguauccaggacuugcuauggugggagaguuugguuccaaugaugccaaguaaccuugguuucuguugcuucuguucuuaagcuugcguccugccaucugaucaucucaaguauuugcugcccucaauauaucugauuggagccugucguuccuacaaucccaguugauucagaacuuauaagaguccagcuuucucugugauccuuugcuugugggcuccugugaaucugagauucugggugugucagaguuuuuggcagucaagcuuccucugagacccugaaauacuggugugaacaagcucuuuuuauccuaggauccuguugucaaagauccugggcauguuacagugccuggaggugguguuuucuuugaggaguguggagcugucuggucagugguccuaaguuaguguggacaguccucuagggaccauggguguguccgccaacucugcacacagggugaccaaguacuggcgccaacaggaagggacuuguaacucuggucaggcagguuuucugcgucccuaaugcugucucagguuccgugugcgagaggauuggaacagaaguuguguuccacuaaccaaugguccuaaguacacgagaagaguccucuagggaccuuagggauguccgccgacucugagcccaaagugacccugugcuggcaccgacuggaagggaccaucugguguaauucuaauagcccugccucuauauguuacuugaccuuugucccuuacugcuuucaauauuguaucuuuauuuaguucauuuguuguucugauuauuaugugucaggagauacuuuucugguccuguuuauuuggaguucuauaggucccuuguauguucaugggcaucucuuuuugguuggggaaauuuacuucuauaauuuuguugaagauauuuacuggugcuuugaguugaaauucuccauucucauuuauaccuauuaucuguagguuuggucuucucuuugagucccggauuuccugcauguuuuugguuaggaucauuuugcauuuucuuugauuguuguauccauguucucuauggaaucuucugcaccugggucucucccguccaucucuuguauuguugcugaugcuuguaucucugguuucuuauuucuuucccaguguuucuaucuacagaguugucucccuuugggguuucuuuaccauuucuacuuccauuuuaagaucuuggauggauuuguucaauucugucaccucuuugguuguauuuucuuguaauucuuuaugggauuuuugucuuuccucuuuaaggucuucuaccuguguagcagugauuugcuauaauuccuugagggauucuuugugcuuccuauuuaagugcuucuaccuauuuagccguguucuccugaauuucuuuaagugaguuauuaaugcacuucugaacauccuauaccaacaucaugagauaagauuuuagauucgaaucuugcuuuucagguguguugguguauuugagacucguuguggugggcgaacuggguucugaugaugcccaguggucuugguuucuguuaggaagauucuuucauuugccuuucgccaucugguagucuuugguguuagauguucuagcugucucugguugaagcuuguuccuccuguguucuuuaaccccugucagcacuccugggagacuaauucucuccugugucccaguggucagaacacucucugcaggcaagcucucuucuugcagagaaggugcacagaagucuggagcucagauccaccuccugauuucugaggucagagcccuccccagaggccaauucugcucuggcaguaaagguguccaggagucuggguuccagcucugucuucuggcugagaauguaggccuguagggacccuguccaagaagcuugguugcuucugcugcccauguacucuucuacauaaacugguuucagugaucccaaaauucugggugugcuagggccugccuauguccuuugacccuguuuuugcuagcacaagacccucuggauuuuuuggaacugauguuguguuccacucaccagugaucucaaggaacugggugugcuaaugugccagccuuguggggaguccucuggggaccuuagggcccuccacagagaccgccucaaacacucuuaaacaauuacuucugucucauuuaucccuaaaagcaauuaaacaaaucucauagauuucuauucuuuuuucugauuauagcucugggcagcuucuacugucaaccucugucucuucuuucugagcuaccugucugucuguacugcaccuccaagcucaaacuauuugagacagacagaaaucuuugagaagggcccaugguaaauccagaccaacaaggauguccggaucaacauggaggauuuuggugauucccagcacauuccaugaacccaagaauuaugcaaaccaauucagcucaacuuuuguuuuaguugugaacuugcacaacuuggugaggaacuagauggcucagcaaaaccagcaacuccacuaagaauccaauuuuccccaucccuuaauuucacaucuuagcauugguuuuucauucgagaaucuccaguaaguuuugaauacugcguuucagccuauaggugugaugccuucuguagacucaguuguuacucugcucuacuauaggaugccaccuguguaaguuccuagcucagcuugcaaaugcuuuggagucugaaaugaaagacaaacagcuuuauuuaauaugccaaaucagcucauuagaugggacacucccaaucauccacauugcuaauggcuccucuauggcacuccugaauuacuaaaaucuauagcccaucucugcuuccccagaaccaaucagaagagggaacacugggacuacucuuccacagcucuuauguggcugguauucugucuuucccaucucucaagccagcauccaauuccuuuacuggcauggagauccucuuuguuccccuugucaugaauccaaaaauccugccugugucuccucccuagccauuggcugcuggcacuuuaguuucccaguuauaaucagccuggggcagggaaucucagugucucaaaugcaagauuaucaugaaauuugggaacaauuuaacaugaguagcaugagaaccaauaaacaauugggaauaaacaauaaaacacggcaaauccaagcaccaggcccuaaguauugccuuuugguuauuacccuccauuuacucauauggugaaacuacguucaaguuuccaggcaucagguauuguggagguccaaccuaacuuuacucauauuuuguucuugaaaacauaaugacugucucuaauaaagcuuucugcuuuucauagugugcuucucaaaacauaacaccuguucuuuaccaccaaagaacaaauccaaaugauuguuuaaacuauaauaccuauauucuauaacaguugauacaguaaacuacauaagccccuguccuuaaauccugauuggugugaaaaugaagcugaaagaaagaugaaauuucaagaccuguaagucauauaaaguacucagaaauugcugguuguuuguaagcuuagaggcuccuggggcugagaacaaagaaaaacaaacccgggcauuccugggaacagcuugaccaaaaagauaaagagcaauaugaggacauaacagggcuaucugaacugagucaacaacucacagaacccugaccugcacguauucuuuugcugauguuugaauaagccaauagugugucacgaugcugaguuccccaccccuaagcccuuuaccccauaaaaaccccuagcuuucgagccucggggucgaauccagugucuccugugugagauucguuuuugacauggagcucugucauuaaccuaccucauguguuuacaguaaggaggacucuuguguuucuuugggugcacucucucuccccagacuagagcagcagucccugaaagggggucuuacaaagcuauaauuuugaaggaauguuucugccugucccucccuuuuuuuuaaauauauauaaauguuucuuucuuuuauuguuuacucuuuuuuuuuauacaauccacaccuucuaccccuuaucuuauucaaaguuucuauuccugcacaaacaucaugaccaagaaacaaguuggggaggaaagaauuuauucagcuuacacuuucauacugcuguucaucacaauggaagucaggacaggaacucaagcaggucaggaagcaggagcuuaaguagaggccauggagggauguuucuuuacuggcuugcuuccccuggcuugcucagccuccucucuuauagaacccaagucuaccagcccagagauggucccacccacaagcagccuuucccccuugaucacuaauugagaaaauggcuguccuccaaaaaaggaaagagccuggugugggggcacacaccuuuaaucccagcacucaggaagcagaggcagguggauuucugaguuugagguaagccuggacuacaaagugaguuccaggauagccagggcuacacagagaaacccugucucaaaaaaacaaagggggggggggcggagagagaaaaugccuuacagcuggaucacauggaagcauuuccccaacugaagcuccuuucuuuugauaacuccaacuugugucaaguugacaccaaacuugucaguacaauugaccccuugucaacuugacacacaaauacaucacuaguaagccucaacccuuaguuucuuauucauccccaagaucuaaacaacuuuaaaugucccugucuuaguuaggguuuuacuccuguuaacagauaccaugaccaaggcaagucuuauaaaaaacauuuaauuggggcuggcuuacagguucagagguucaguccauuuucaaggugggagcauggcaguauccaggcaggcauggcacaggaggagcugagaguucuaugccuucauccaaagacugcuaguggaagacugacauccaggcaacuagggugaggaucuuauacccacacccacagugacacacccauuccaaccaggucacaccuauugcaccaaggccacaccuucagauggugccacucccugguccaaggauauacaaaccaucacaaucccauagucuuuacauauuaaaaguucaauccuuuuaaaauauucaauauccuuuaaauuccaaacuguuuuacaaacucuuaacuguggaauccacuaaaauauuuuuuuuccuucaaagggaaaaaauaugagggcacagucacaaucaaaagaaaaauuaaauuccaacuguccaacgucugggauccaacucaugaucuucugggcuccuccaagggcuugggucacuucuccagcccuguccuuuguagcacacagcuuguccacuaggauccagauggcuguacuuuacugcugcugcuguucuuggucauucaugguccuggcuucuccaaacacuacaugaccccugggucauuaauugcaucugaggcugcaccuucaccaauggccuuccauggccucucuuagugcugagccucagcugcucugcccgaucccuucaugccagcaaaaccaguaccaccuggguaccucuuacacguuaccaaguccagccauagcacaaggcaaaccuuggcuaucucuggaacacagccucugugcucucagaaaacacuuccgagaauaugucaccccaaugaugcuggucucuucuuaauuacugcuaaguuuuuagcuacagcuaaccagcaucaauagucccaguaaugccaaguuuucacucuaguaguucugguaucuuguuaaucacagcugauucuucagcccuagcuagucagaaccacagaaucuucacaaucuaaaauagcaauggcccugaaaagagucuuuaauuuucccucugaaauuucacaagccaggccuccaucuucugcacugaucucaacauuaucuuccaagcuccuacacaacaucccacagaguucuuaaaacugaauguguccuuuggcccaaaguuccaaaguccuuccacaguccucccaaaacauggucaggcugucacaggaauaccccaguucucauaccaauuugucuuagucaggguuucuauuccuucacaaacaugaugagcaagaaagcagaggggaggaaaggguuucuucagcuuacacuuuccaaauugcuguugaucaccaaaggaugucaggacuguaacucaagcaauacaguaagaaacaccccuguauccucuugaauccuuuguaugauuauuuucaugaugaugaagaauuagaaauguuuaaaggcuuccccauauuuaaugcauuuauaggguuucucuuucauaaugaugaagauuugagaaucugaaaagguuucaccauauuauauuccuaaauuucuuggcaguauggauuguuucacugugaagacucuagaaauauucaaaaagcuucaccauauuaacuacucucacaggauuuugucuacauuaugauuucuuuugugucuuugaauaugauugacaagugaaggcaauaccacauggcuuccagacauaggguuucucaccucuaugucuucuuuuauguauuugaagauuuuaauguacaaggcuuuguaccuuuaauaacuuucauaggguuucucucaagugugucuuccuuuauuuacuuagagaauacugugacuuauaaaacauuuaccacauugcuuauauucauggguuucuauccaguguguauacuuuuguguuaggagaugacucuuuauaacugcuuuaccuaauuagugauauucagaggauuuuucuccacuacauguucuuuauggauuugaagaugauugugauguagaaggguuucaggacauugccgauauucauaggguuucucuccaguacaaacacguacuuauauauuuugaggccacuguuuugugaaaaaagguguaaaagcacauugguaacauucaaaaaucucucuccuauacguguuguuuuacgauuuuguugaugacugcuuuuugaaaaaguuuaaccacauugguuaaagucaaagcauuucucucaaguauauauucuuuuauguauguaaagacuauugguuuuugaaaaagcuuuaccauguugguuacauuuaaaagguuccucucugguauguguucauuuauauacguggagaucaaugcuugcugcaaagacuuuauaacauuagaugccuucauagacuuucucuucuguaugaucuuuugucuuuggaggucacuccuuccugcaaaggcuuuaccacauugguuaaauacauaggguuuuucagcuguauguauucgaugauauucaagaccacugcuuccugaaaaggguuuacuaccuugguuucauucaugaggaguuucgucuguauguguucuuuuaugacauuggagaccacugcuuccugcaaaggcuuaaccacacuaguuacauucauagggucucucuccuguacguguucgcuuauauaucuggagaguacugcuuucugcaaagcuuuaccacauuguuuacauucauaggauuuaucuccuguaugucuucgcuuauguauuugaaggucaacacuucuuauaaaaacuuuaccacauugcuuacauucacaggguuucucucauguaugucuucgcuuauguauuagaaggucaccacuucuuuuaaaagcuuuaccacauuguuuagauucuuaggguuucucuccuguauguguucgcuuauguauuuggagaguacugcuaugugcaaaggcuuuaccacauuguuuacauucacaggguuucucuccuguauguguucgcuuauggauuccgagaugacugcuucguguaaaggcuuuacaacauugguuacauucauaggguuucucuccuguauguauucguuuaugaauuuggaggucacuccuuuuugcaaaggcuuuaccacagugguuacauucauaggguuucucuccuguauguguucguuuaagucuuuggaggacacuccuuguuccaaagucuuuaccacauugguuacagucauaguguuucucuccauuguguauucuuacaugccuuugacuaugacugauaugcaaaggcuuuaccacauugaauaaacucagaguguugcucugcagaagaacuucuuucaugccugcaaauacaauuggcacacgugaaauuguucucgcauugauuauacugaugagucuuuuuaucuguaugaauucuuuuaaaaauuggcuucauucaaaagagcaaucuaauguuaauguaauaugccuuuguuugcauucaaagguguucuccucguuauggauuguuuuacaucuuugaggauacaugaaaugggaacaguauugauuaucuggcucacauuuauagcauacuuuuuguauaaaagguuauucacauauuugaaaaaaacaggaagaacucaaagucuuugcacacugauugcauucacaaauuuuguuaucaugagaguaauacuacauuuggaacaugaacaaaugcaaacagaauauaauuucuacuacccuaauucuaauuaugauuuucagcaguuugaguuggaaaauguccccaauaauguugggaaacuaaguacuuauaaacuuacagcacauuuagaaugucacucaaaguauguuauacugcauauccucuuguuguucugaaaaagugaaagguauguggcaucuuucaauaccccuaugcucacaagggcuguauccauaguaacguaugacaaccauauuaaaagagaauaacaaguguaaagguuccauauuacauucacacacgugacuuuuuuccucauagagauguaguauagcgauuaagguuuuuccaccaaaccauuuuugaaucuuaugaacuguccaucucacuaaauuuagcaaugauauuacaaguauaucauugagcucagauauacuauggauuauuugcuuauuacuagguuuuagacauauacuugucaccuaaucacuguguguuccuuuugcaauagcuaagcgauaugagacuaaagacacucgcacuuguacagcauggcucuacuaggcuugauuuaaacaguaacauaccuguuaagccauuauuucucugucuuugaacuaauagaaagucuugcaaacaauaauuacauaucugccauagacauauaugauuuuaugaaauucaauaaacauccauaacugaaagcagugcuuauuguacccuauugguuuucuuuacuacuuguagcacacguuaaacuuucuucauaggcauuuucuccucaguuugcagaguaaaauuaccuuccaugacuucuagaaguuuggaaauggucuucaauuguauguucuucccaacuguaaccuaaacacaguaccagagaaaguauguuacauuauugggaauuaggcaacauuuaaguuacuaacuccauugaacuuuaaaaccaugacugauuuauucaccauauucuuccucauucucaauuaaaauuacaaaacaaaaaacaauaacaaagaaacaguugugcauacauguuauaaaguaaaaaaaaaaaagaaaaguccaauauuaucuauagcugugagauuccuauaggucucuaccaucacaccuuuguagagacucuucugagaagcauccagcaaagcccacucuuccugagugaaguucacaugcacgucaucauaggugacuaaauccuguaggauuugauaagugugcacaaagcaauauauacagacaacaguguaaagguuuauuucaaaaugaauauucgcugacugcccugccuacccacauaguacuuuuuauccagucuuucacaguuggacaacaaaaacuuaaguaaauaaaugaucucugggaaccugaugccuuaguuuuaagauguucuguauggaaccauguagaaugcugguagacauuuuuguuauugagaucaaauaugcaagaguucccuuaaaacugcaguuuucucucaccuauccaugucacaaaagaccauuuccaucuccccuuaccuucuugucacauguccccuucccuucuuagcccccaaguauggacagacacccccuucucaaccauagccaauucucccaaagaccaagcagucugucuaaagaacaagcccacuaucuguuuuccuagacagaacagucucauaguaggccacagaacugccacacaauaucagggaaagcuuccucugcccauuuccacgugaccaauuuucaacuuuucuucaauaacuaaggcaacuacaccaggaacaaugugaacuugacuaauauuaccugugcuaguauguguauagaaauaaaauaaaaucauauuuccugacuccaauaaaaguaacucaaagucaccccuaaacuguuauaaaucugacccuacaguuacuacugaucugucuuccaaacagagaggccccaugcuccagaguucucucugucauuguagaugaucagaaaguugagcuauuguucuauagcuguucaugacccuuuguacuuucaggcuaaaccaggcccugggagcccauauacaaaacaaugcugaaugauaacuuaaugucugcuuccugccauaugcauuaugcuccaaucuguccuauccacccacccagcaccaucaacaccugagaaacuucugcaugucagaagcuccuuuuguaacaagaauugaaauucugugaaucaugccauuuugacaacagggaauagaaagauaaaaggaaucuaaucaaauauuucuggaggaugaucgcugacaacucuuuacuacuaccuucuaaacuauuuauaaaacuagucacacaaaacugaauacagaagggucaugaauucuagaaaucaaaccauuaguuuuccaauguuguccuauggcacaccaaaggcaaugccuguauaugcacacugcagagugacauuuaaguuccauaccuugccacucccagggcuaccgagccacccccaccccuguaaauccacacucagaaagagucaaaggacaagggccucuguuaugaucaccacauggaccaacagaaccacacucugacccacaguccauuuagaaccagaagaucggacucaaauagcucugcagacuugcuucuccuguaccgucaauggagauuacuauaauaaccaggggauggcuuguagucuuccaggcagcuuguaacacaugcaucugaggagaguccuguagagaaucugcaagcuaccuuccccuaguguuccugauuguuaguccugcccauaguuccucauuagcauggaaaagucagcugggccucagggcaacaacagcuccuuccacugugggaucacagagcaaaagauuuagacagcuaaaaccuuccaggcuaggcuguuacacccuacaugcagacauagcccuagucuggaaaauuuacauuuauaagaauguucuaguccuggagaccaaguaauuuccauuuaaauuccauuuaauucccaagguccuuucuuuauauauucaauuaugcaugcaauacccacuacagccaucucuacuucuuacuggggaaguccugcagccaaccugcaaucaaauucauacauugacaauaauuuaaaagugaaugugacuaugacuuuuaaaacuagaagcaguuauugggcgagaaaaaggaagaaaaagaagaaauaaaauguaaggacaucacugcuccuagguaugguggaggagaaaguauauuauacacaaaagagugaacauagccugacccaauuauaccugggauaguauagaguagacaugaccugggaccuuguggagagaggaaggagggcagaagcaagagccagaucaagaugguuaaugauagaugaaaagcccaguuccuaaaugauuggauugcauaaggaauggcagcugggagauuggcaguccuacugcugggguagauggcgagguaugccagcaauauggugucacaacgagggccugugaucucauuugacauugcccuaaucugaaaaaugcccgaagaugaccaguauggaauuuaacugauugugcaaaauugauuacuugacuccuuauggugaaugucaacuacugccaaagcagaaaggccucaccuaccuuauuccuccuccucuucugugcugcaaguagaccagcuucaaaguuggucagugaauucaaccuuauaccuguuccucuuuauuuguaacccccuaauuuguaacccuguaacccagggagguuagacaacacucauucccuggugucuuuugucucacugaucagucagaacccagcuugacaggaguuguaggacuguuuuccaagcccugggcagcagagggaggauuaggaguucaaagcaagucuuaacuacauggcauaaagaaaguaggagcuacaggagauguuucucuaaacagacagauaugaaaucucuuuaaaaacaggaaugaaauucuuaauuuuggggcaauauuggagaaaagaaacacuuaagagaucacccauggauagucaaaaugaaauuuaaaaucuaauaccaaaaaugaacuuuuuaaaaagaaaaaaauaaaugaaaaaauauauuacuguacugauuugaaaaagaucaugcccuuccugguagaaggaauggcaauaauaagauaguguuugaccuugccccuaugaucuuuguuaacuacugagaucuauaaugugacacacacagcuacagcuaauggcauguguuuauauuucugagaucacuuaaauaugucaccaagguuugcacauaucucauaauacagaucauaaaaugggaauucaucacucacuggcucaagcuaaccugcccaaaauaaacacccaccaaucuaguuuuacuaauaaccauucucuguuguaaacuucucucucaauuuaugauuugauuuuuugugugaacuuguaguguacucaguaacaugugaucagguauucugaaagauuuauaaguacagaggacaaggagauauggaaaagagaaaggagaaguuuuuuugcccuuccccacuuaggaucuuuucgcuuuuccucuuagauagcuuucauagguaacuuuugacaacuuaguaaaaacuccauaaccacuucuuugagugucccauuuucuuccugugauuucugaccugcaggcuaaaaguuagagaccagcaguuccuucugagauagagcaaaggccacacugcuuaauccucagcuguuaggcuacagguguuaaucaccgaagcccucagucuucuacccucagaaagagcaaggaagguuuuaggcucaggugcucaaagcaaggcuuaacuacauggcauaaggaaagccugagcuaccgauguugcuguaaacagaaagauauguaaucucuuuaaaaauaggaauuaaauuauugauuucugggaaauauuggagaauaggaagaaguaagaggucagagcaccuauacauaaagaaaauaaaaauuuaaaaaauaauaccaaauauuggcuuuuuaaaaagauaaauauaauugaaaaauaugucacuauacugauuugaaaaagaucaggccuaucuugguagaaggaaaggcauuuaugagauaguguuugaccuugucccuaagugcuuuguuaacuacuaaggucuauaaucuaacacacacagcuacagagaauggcauguguuuuacauuucugagcucaauuaaauaugucaacaaggauugcacaaaucuacauaauacagauccuaaaaugggaauucauuacccacuggcucgagcuaaccugaucaaauaaaacacccuucaaucuagguuuacuaaaauacauccauacauggauacagucuguaaaauuacaaaaucauuuucauucccugaaucagguccuucuccauaacagugaccccugcagcauacucccuuuuccuuuggucugugaccuagcucuugucagcacucuuuuaccugacaguguacacaguaagcuguuccucugguucucauccugccaaauauauuucuccacacacaagccccugacacaaagguuuugacaagaugcagucuuauaauaaaguuacucagaggccacagcugggaccaaaaggagagaguagguccacaaaggaccucacagauguucccaucugucuggcugaugcugacaauccagccucugggaagagauauuacacaaucauccuuugcuaagaugcuugcuccuccucuuugugggagaugacauugcacuuaccaugucugaaguucuaaguuugccugagcuaaccucacagcaaccagcaaaaauaauaagaaccgauuccacagaaacacugagaucagcugaguuacacagaggagcaugcaggcuuaguaccuggaagagucaccuccucuucugacuggcagcuccauguggaggcucuaauucgcuauugagucuugagugaagugaacaccaggcuuaggguuagagugugcuguagagaugcagcccagugguuccagucugggccaauccuuuuccagaucugcagauuugcaguucaguagcaccagugugucuccuccaauagucuguuccuucaccaagcucuugggagaggcuaagauuccugauccuugcugccuaagugccugccucuccccuuucugggcagugccccuggguucacugcuuugaaaguuuggaguuugccugagcucuaauuccagcacucaggaggcaauuccccuucuuccuccuggaaucaagguggauagcuuacauuuccccaucaaucagcugaaauuggaguuaccaaacuguccacagguggucagugcccaaauauuaguaacugaagagauuuuuaggacauaagauuuuguguuguggcuucaggcuggguucagguaaacggcaaguacuuuccacccaauggcuaugagacaaggcucagagcaauuaggacacaugucagacacuguggagcacucauguuagucagcucauuguccucaguggguugucaaaacaaacauaauaacaaaaaacccacaccuauauugguaaaauauaucacuguacugauuugaaaaauaucaggccuuucuugauugaaggaaugauauuaauaaaacaguguuugaccuugccauaugugcuuuguuaacuacugagaucuauaaugugacacacacagcuagagcuaauggcauguguuuuacauuucugauacauuauaucuauauaguacagauccuaaaacagaaauucauuaucauuggcucaagcuaacccuuacaaauuaaguacccaccaaucuaguuuuauuuaaucacaugcauuauuuaauacaugcuguuaaauuacaaaauuauuaaccuugccuaacucuuauccuucgcuagaauggugacaccuggagcagauucucuuaugguuuuaucuaugaucuaacuaucuccugcccuguuucaacugacagagauaacaguaaaccauugcuccuguucuuaucuaaagguggaagaaauuaacaguucauuauaugacucaaaugagcaauuauaaaacacuauuuugcuacauucuuuaacuuaagaauuuaggaauuuccaucaagaggaaagcaaggucacucuccuggggagcagcagaccagggucaaggcuuacugagucaacauagcuuguauuagaaacaucucuauauggggaagaagagacagcucucccagaauuaacaugucaucccagaaagaaaucucuccauauacaacuaaaauauuaauuaggaaaauuuucuuaauggcaucauggauucagcuguggcuaaugcucaaagaccaggcagccaaagacagguuuuggauuccacacaugcucucauccauaaguuucuuuccuguucagucaccagguuauuuucaacaauuuaaauauggacuggagauuacaaguccuacuuaagacuacuaggagauuuacacagcaaagacccccagaacacuuauuaagugccucagagcccugaaauagcaagucauuucucagugauagauuccugaguuggaggucccagaagaugagaaaaauagcaaaaguagaagguagaauuuacaauagcuguaguagugagagcuuacacaagcuaugucuuaugccaaguaaacuuuuuaagaguagcaucuugugccaggugugguggcucacgccuuuaauuccagcacucgggggggggggggaggcagaggcagguggauuucugaguucaagaccagccuggucuacuaagugaguuccaggacagccauggcuacacagagaaaccccgucucaaaaaacaaaaacaaaacaagaguagcaucuuguauccuucucacaggggauaaguggaaagaaauggagaccucuauaaagucuuuagaaacuugcauacccugggacaaacucagaagucuaacaaaacaauacugcacaagggaacugccaaguaucuaaaaaaucaugaccaaccaaacccccaguggacuugggacagagaaccauaucgccauauuguggagaaaguuggaaucucaggaucugaagcuucuccucccagaagcccuagccacagaacauugccaccucuccuaaugcuaauccuggcuuaagagaaagagcacuauuuuguauucaaugcaccagggccuuaggucaagcuccuaagccuuaaggcuccaggcucuuaaaggucuggaauuuaggauucagguaugcaauucuccacacauuaggaucaagcuuuauuugaguggaccagcccucaacacaguaguauuuuuccuuucaaagagcugucaccagcgguaguccugcccuugaggcaaaacuaugcuuuuuccaugaaggaaaagaaaauuauggaugagagcauauguggaauccaaaaucugucuuuggcuggcucgucuuugagcaauauucacagcugaauccaugcugucauuaagaaauuuuuccuggggcuggugagauggcucaguguguaagaguacccgacugcucuuccaaagguccggaguucaaaucccagcaaccacauggguggcucacaaccaucuguaacgagaucugacgcccucuucuggugugucugaagacagcuacaguguacuuacauauaauaaauaaauaaaucaaaaaaauuuuuaaaaaaagaaauuuuuccuaauuaauauuuuaguuguauauggagcgauuauuuucugggaugacaucuuaauucugggaaggaaaauagaucuuuauggcacaccaggccuuaagguugguugugacccuauaaugccauuuuguguagcuuguuaggggccuguucuuugauaucaccauaggucuaaugccugacuguauagcagauuugucccuuuuguuaagauuugaagacaaauuuccgauaaccgugguaaauaaacaugcauauggcuauacuagccuucaagagggcugcuuagcauacuacauaccugucagguguuuuacaggcagcccuaccucagcuacauccuacuuagugucacuuaauauuuccuaagcauugguaaauccguagcaucaucaacucuacucuuguacaucagagcuuaauauuggagugcuacccaacacauaauaugucuucuacagccugcaccuacauguuaacugcuaagggcagaauucauagaagauaauauagaaacaagggcugucaaguuugucauccugccaaguacauuucuccauuucuccagaguagccccuccugcaaauuuuuuuucuacuucuucuguuuuuuuggguuuuuugguuuuugguuuuuuucucucgauacaggguuucucugcccuggcuguccuggaacucaccuuguagaccaggcuggucuggaagucagaaaucugccugccucugacucccgaguucugggauuaaaggcgugugucaccaugcgcggcuuccugcaaauguuuugugcagaugcagcccaauaauaaauguauucagaggccaaagccggguccaagaggagacuaagcccacagguggccucaucuagcugccugcuacuuaccauccagcugaugggaaguccacuacacaugcauuuucuacuaagcugcuugcuccuccucucugugggagaugaucuugcacuuaucauguuuggaguucugagcuugcuaggucuucucacaucacucaguagaggcacacaaaacacaucacauagaaaugcaaaggucugcugaauuacauggagaaggaagucgcuggcuuggaaccuggaagggccgccuccucuucuaacugguagcuccaggucgagauucugauuggcuggagcguauugagugacauguuaacuacucuuagggugaugguguacugaaggaacucauuuccaaccugggccaauccuuuuccagaucuagagauucaugguucaguagcacuaaugccuccauuccaguaacuuacuuggguccuccugccaagccccugggaguaacuaagauuccagauccaugcugcuuaauugucuguuacuucccuuugugggcagugucucuguuuucacuguuuugcaaauuuggagcucaucugaacuccaaccacagcacuccaaaggcacaucuccuucuuccuccuagaaucaagcuggauagcuuauauagcucuugaaucagcuuacauuggaguuaccgaugugccccacaaguggacagaugccagaauauuagcaauuaaagaaagauuuuaagaaacaagauuuuggucugucuucuggcuggguuuaggucacugcaaguauguuccacaugaugguuauuugucaagcuucaaaacagacuaggaaacucaugaaagacauggugcacccacuuccuggcuuuccuggccuuugugaucaucagacaaugacaaaaacaaaaauacagaggcaaaacaaccauacaaauaaaauaauagcuuaauuucuuagagagagagagagagggagagaaagagagagagagagagagagagagagagagagagagacauuuaaagacagcacugaagaauugggacaauacaauaacucuuaaagucauuucagauguuuagagucagugccuuacaaucauuuucaaaaugaauauugccaagcaugccaguaugugcuaucaauugcaguaguguggagacaaauucauauucaugaauuugaggccacacuccucuacauagucucuuccauaauauaaaccaucucaaauaggcuuaguuucuuuaaauggcagauacaguuacacugucaagaaccaggaagcaacgaccuaaaugauaugaaguaaaaauuuguucuauuuccaggccaaucucacagucuccucugaauucagagagauaaucagcugugaguaaaaacagagaaacuuuuuggagucaaacucaaggcuaagaugaauaguaacuauuacaaaacuggaauugccuugcaguuaguaauacaauuaaaauccgcaauucauaaaaccuaccaugccgggcuugauggugcaugcuuuuagucccaggacacgggaggcagaggaaggcagauuucccaguugaaggccagccuggucuaccgagugaguccaggauagccagggcuacagagaaacccugucucgcaaaaaaacaaacaaacaaauaaauaaauaaacaaauaaauaaauaaaacaucccaugaacagaggaacacuguaaacaauuuauacuauguaaaucuuaagauuauagaggaaaaacuagucaaaaugacaauuuguccauuaacuugggacauuagagacaacauccauaguuaauauagaauuacucauauuuuauuuuuaggauuaauuuggaacaggaaauaaaaaauagcccuuaaguugcccuuaacaaauaaaauugugauuguuuaucuguguuguuguuauuucucagacacagccuuauuuagaauaucagagucacuaaauaaacgcuaauaaaaacaauuaaaucaaaauuaauuuaucucuguucuuugauuaucugcucauuggaggccagcagccuguauugucuuccucucuuugccuuacucugggcagccuauuugaagagcagugacucccagcaccucuaagucuaaacucuuuggauaguccagaacucugggaagaaaucuccacauggcuuaggcaaaaucuguaccuugcuaaaaagccaauccuccccuccaucuaaucuuauaucaugguguguguauuccaucccagaaucucuaaauaacuuuuaauaguacuuuccccauauugccaucuauagaggugaauuguuaauuugcuuaagcucccaucagguggcgcauguacuacacccgcccaagaguucuggauucgugaauaaaagacacacaugucaguuuaauccuuaauaugccuaaguagcucaauuucugugcacuucuaaucuucccaauggcuagcacauacuucucuccaauucuuuguuuuguuuuguuguuguuguuuguuuuguuuuguuuuuucgagacaggguuucucuguguagcccuggcuguccuggaacucacucuguagaccaggcuggccuugaacuaagaaaucauccugccucugccucccgagugcugggauuaaaggagugcaccaccaugcccggcuuuuuuuuguuuguuuguuuuuugagacaggguuucucuguauagcccuggcuguccuggaacucacucuguagaccaggcuggccuugaacuaagaaaucugccugccucugccuccccagugcugggauuaaaggugugugcuuccaucccuggcucucucccuauucuuaaguuaucguuuucuaaauauacuuagguuauuugcuuucccugacucaagugggggaucagccccugggccuucuucccuggguaauucuauguugaccugccuuuacuucugauaucucugcucccuucauagugauucuuucuuugucccccuuauucccuugcuugugcaaucuaaaaguccugcuugcauuucccugugcagccauugccugaacggcaaucauuuauuaucaaucaaagccagcuggaggcagggcuacugagccucucagagcaagcauuucgggaggaaaauuaagacauagcauaauauucaaccugcaauacaugcacauaaccagggacuuugaaacuucagauggguuaacauugaaagagcacagcuggcaucaggcugacaauccgcuauaaaaaugcccagucuuuccagauaccuucuaauuaaugaugcccuaaucaaacuuuggguuuguuuguuuucauaaaaaauaauuccuaaggaauauaauguugaaaaugaaaauguaauuauuaagaugaaaugcugaucugacucuacuguuuuguagauuuuuucuuuuuuauaauguguuuauuuuuauguuauauauauggguguuuugccugcaugcaugaggguguaaaauuggcugaaacagaaguuacagacaguugugagcugccauguuguuucugggaauuaaacgugggacuucugcaagaguagccaguacucucaaccauugagccauuucuccagucccuagaguuuuuguguuaaaugucagaauucuaaauguauauacuaugaaauauaauuauauaucccucgucccccucuacagcccacagauccauccaaaucaaccaucuccucacuaugaacucuccuccuccucugccuucuccugaucccuacuaaguccauuuagcaaugccugcaugggucugacugugaggcccguuauuggacaaugggcagccuuccagucaccucauccucaauaaagaaugacccugaucucucagcugcaaauagcccuucaguugaggguacaacuaugagaaacguuuggcuauucuacauagccaauuuuggcuuaacccucucacccacccuuugauuguccucauuucagcugauuaaaccuuccauuuucuaauaaagaaaaaauuauuuuauuauucuacguguaugaguguuuugccuuuuuguauguuuaccacaugcauuccugauucccucauaggacagaaguggacaaugaaucuuuuguacuggaguuuuauacaguucugagccaauguguagacacagagaauacagguucucugcaaaaguagucuuuuuauuuuaaauauauuuuuauuagauauuuucuucauuuacauuucaaaugcuacccccuuuccuaguuuccacucuggaaauccccuauaaccuccguccucacccugcuccccaauccacucacuccuuccucccgaccuuggcuuuccccuauucuggggcauagaaucuuugcaagacuaagggccucuccucacauugaugguuuacuaggccauaagacaggaguaccaccauguauuuucuuugauauuauuuucuuugauuauuauauuuucuggccucgaacucagaaaucugccugcuucugccucuggagugcugggauuaaacacaugcgccaccacgccugguuucauuuucauuaaacccuaaaacgucuuuaauuucuuucuuuauuucuuccuugaccaaguuaucauugaguaguguguuguucagguucaacgugaauguuggcuuucuauuauuuauauuguuacugaagaucagccuucaucugugguguucugauaggaugcaugggauuauuucaguauuuuuguaucuguugaggccuguuuugugaccgauuauauggucaguuuuggagaagguauaaugaguugcugaaaagaagguaaaaccuuuuguuuuagcaugaaauguucuacagacaucuguuaaauccauuuguuucauaacuucuguuaguuucacuguuucucuguuaagaaaauauucaaagauuccacaauaccuagucuuugaggauaauaaggaaucccaguaauaugacugauauuaaauuguuaacaaaacaucucaaaugucugacuguaauggccaguaacuccauguccuuuugaacauccaguauagaaaaacauguaggcaaugacuaguuucauauuuaguugcuucucuuguuaaagcauuuccaaauugauagccugagaagguaucaauagucauacuugcuaugaaucggguccagugggcgcuccucaauccuugggaaucaggaguuccagcagaugggcauagaguuggcgggaauugacagacagacacagauaugagagagugugcugaaucugaauguaauuuguuaacucgagcaucaaacuuuuuauacagaagaaaauaggaaaguucagugacacucaggcaaguacaaugauguuacugaauucuuacacaaaacagaggaaugcaaacacagaaggacugaccagaggaaccaacugggauaaaauucaguguuaacaacugggaucaaaaacagcuccaccuaagguccacuuaaucuuagaagccaggggcaagggcuucaugcccuuggcauaguuccuacucuagucuauuguauaaucaacuuuuccccuaggacauuguaaacacuuguguauggguguaacucagcaaucuauaguucuaaguaucuacucugguuccuccucuggucacaaacuuccuucuuccuaaauaaugguaaauuccugcauagggcagugauucagcuauccaugcccagggucggaucaaggacugccuagaaucuaacuuagguauaugucaaaaaaaaucaauccuuaggagcacuuauuuuguuuauaauuaugugauuuaaagauuuguuuauuuauuauguuuaaguacacuauagcugucuucagauacaccagaagagggcaucagaugucauaaugggugguugugagccacaaugugguugcugggcuuugaacucaggaccuucagaacagcagucaaugcucuuaaccacugagccaucucuccagcccccuuaggagaacuuauaauaaagcaauauuaagggaaagcccauagauccguuuaccaacuaaagcaaggacacuggagcauucuuuauacaugauggcaagauuccaggagacuaaguucugugaacuucuugccucaggacagcacacaguuuuucggggccugucgcgcuucucacuacuggauuggauguagcacauauguacauuguuuaacauuuuuaaaaauuuagauauauaaguaaugucuauuugccauaacugaguagguaccaguccuagaggauuaacaccuagaggauuaacaccuuugugugauacaggaagaaacugaggacacugaugaaugucuuuacaauuugacaugcacauucucaagaaauaccaaauuguugucucaaccuauugcuuuuuaaugauguaaagaaugagaguguuuggcuaaacuguuccugaguaaugccuauacucugccuaauaugcaaaccugcugaggcauugcccucauuaaggggucugggcaauccacuaugagcuuucaaauauccuauaacuuaaggaagaguacuugcucuuaaauuaaguugcauuugcauaaauaauuccaaaauuugaguacuagcugcaacuaaaaauggaacaaagucaagcaauuguaagccaugacguauauacuggccaucaguauauaaacucaaagcuugauuuugucaacguuucaaaaaacaguggcuauaguacauuauucaaauauuugugaagcaggggggaaacucaagagaauaaacaugauccaaguacauaugcuaccuucccuuuagaugagcugucuauaaacauaauaaaugcauucucuaugagcugccuguguaaauuuacaggaaauacaaauguaugcauaaaggcaaauucuaacaacuugccuuuuggauaacaauuaucagauuuacguaaaauguuugcacguucaauagacuaaauauaagcauucuucaguaaccaauuucaaagcugaaauaagaaauaaacauuucaucacauucuuuuccaaaauaguuuugugauucuauccuacaauuguguaucaacauagcuacaguuucauaguagggugugcaaacuuuacuuggagaugaagaaagaugaauacacauuaauugucccuuuggcuaaaagacugcugugaacuagucaacaauuuaucuuaguauauauauauauaucuguuguuggcuaauagcuuccuauacauuuagcaaaacuuuucauuccucgucaguuaauuuuccaggggaauuaggauuugcauuucccuugagaaauaacaaacagacauuuaaguucuucuguggcaagcuuaaggugaggucuuagccaacuaacauuuccuaacagcuuuugaaaguaauuuaaaguaaguaaacuaucuuuucuuauuugaauuuucuggucaacaauuucuuuaggauauaacugauggcccaaaucuugaaaaggauauugucuuugaaucuuuucuuucccaaaaauuuaaagcuuuuuauaucauaacaaaggccuauagaaauacucuuucagaggaagaaucuaauaaaauauccauaucaugaucaauacacacaguaggauucaaagucuggacaacccacuuacaguaaaauaagagaauacuguacagaagguauuagaguuacaagggccagcuuugaggaaagcuacaagcaggaaauggaauuuacugaaaagaugcuaugugugcugcaggugacagagcuggagaagugagaguauggaaaaccauguggcuaaggcaaugucaucauaaucucaagaugcugacaagaagcuauaaguuuuguuguuuucacugauaaauuuuggucucuuuggucaguucauuuuuccagaugauuugauuauuucugcuaaggauuguuucuuuugugacauuggaugugcaaaagagaacaaucucucuuaagcauaugguacaguguggacagauaaaaaguaguuuucauuuuugaaaaaacaugugguaguuaaaugauaauggcucccauagacuuauauguuugaauacuuuuuuaaaaaaaaagauuuaauuaauuauuauauguaaguacacuguagcuaucuucagacacuccauaagggcgagucaaaucucaguacagaugguugugagucgucauaugguugcaaggauuugaacucaggaccuucaggagagcagucagugcucuuaaccacuaggccaccuuuccauucuccauauguucgaacacuuauuuuuuuguuuaucggacugauuaugacggauguaacaucuucugaccaugcccauuuugcuagcuaccucuugucuagguucaaaauaugagcucucagcucuaccugaugccauguguuuauccugccaguauugacucuaaggcuuuggaacaguaagcccaaaaugagccuucaguuauaauucccuuugucuaugguguuuuucaugagaucgauagaaaagaaauauucagaagaguuccauggaaaaucagaaaucagaauaucaucccuuccaacuauagaaaccaaggaggaauauuuuucaaacuaucucuaggucaguaugaucugucccauaccuuugaaauuaggaguaaucgcaagauugacaauuaucuacuucccuuaaagcaauccuuuuaagaacauucugcuuuacuuauaacccaaccaauuccaaauaacauuucugcuccaucuuguauugaagacucguguaaugaauggaggccgaaaagcacaggauuaccuaaugguaaaauaugauaaauucuauauuguuaaauaucgauguuuucucuaaugucccaaguuaaaggacaacuugucauuuugacuuauuuuuccucuauagucuugagauuuacauaguauaacuuguuuccacuguuccacuguucaugguauguuuuauuuauuuauuugguuauauucgagacaggguuucucuguguagcccuggcuauccuggacucacucaguagaccaggcuggccuucaauugggaaaucugccugccuaugccucccaagugcugggacuaaaagcucaaaccaucauugcccggcaugguagguuuuaugcacugcugauuuuaauuguauuaccaacuggaaggcaaauccaguuuuguaauaguuacuauucaucuuagccuugaguuugacuccaaaaaguuucucuguuuuuacuuacagcucauuaucucucugaauucagagaagacugcgagauuggccuggaaauagaacaaauuuuuacuucauaucauuuaggucauugcuuccuaguucuugacaguguaaauguaucuacccuuuaaaaaacuaagccuauuugauuugguuuauauuauggaagagacuauguagacaaguguggccucaaauucaggaauaagaauuugccuccacacuucugaaauugauagcacauauuaucaugcuuggcaauaucauuuugaaaaugauuguaaggcacugauucuaaacaccugaaaugacuuuaagaguuauuguauugucccaauucuucaaugcucucuuuaaauguuauucucucucucucucucucucucucucucucucucucucucucucucucucucucucucucucuccaucucucucagaaauuaaccuguuauuuuauuuguaugguugguuugccucuguuuguuuuguuucuguccgugccugauggccacaaaggccaggaaagccaggaaggcuaccaugucuuucauguguuuccugcucuguucugaagcuugucucauaaccaucauguggacuugcaggugaccuaaacccagccugaagacagacgaaaaucuuguucccuaaaaugucucuuuaauugcuaacauucuugucaccuguccacuugugggcacauugguaacuucaauguaaguugauucaugggcuauguaagcuuuccagcuugauucuaggaggaaguaggaggcaugcagagggagugcugugguuggaguucagauugaucuccaaauuugcaaaacagugaacauagagacacugcccacaaagggaagacaauugagcagcauggaucuggaaucuuaguuacucccuggggcuuuuaggaggaugcacagguacucuauuggagcaaaggcaugagugcuacugaucugcaaaucucuagaucuggaaaacaauuggcacagguuggaacuguguccuucagcacacccuaacccuaaggguaguucacaugucacucaagacucuugagccaaccagaaucucuacacagcuggcagucagaaaaggaggcagcucuuccugguuccaagccugcaacuuccucccuguaauucaucugaucuuugcauuucuguggaauguguuuugagcgccucuacugagugaugugaggggauguccuaagcucagaacuccagacaugguaagugcaaagucaucugccacagagaggaggagcaagcagcuuagcaagaaaugcacuuguaguuccacuucccagcaccuggaugguaagaagcaggcagcuagaugaggccaccugugaggagcuuugugggccuagucuccucuuggacccggcuguggccucugaauaacuuuguuauugggcugcaucugcacaaaucauuuccaggaggggcuacucuggagaaauguacuuggcagaaugacaaacuuaacagcccuuguuucuauauuaucuucucuauguucugcccuuagcaguuaacauguaggugcaagauccauuuggaguuguuuuuguggagguuguagaagacauuuuaugugcuggguagcacuccaauauuaggcucugauguacaagaguagaguugaugauguuauggauucaucaaugcuuagguaauauuaagugacauuaaguagaauguagcugagguaggacugccuguaaaacaccugacagguauguaguaugcuaaccagucugguuaaagguuauuauagccauaugcauguuuauuuaccaggguuaucagaaauuugucuccaaaccauaccaaaagggacaaaucugcuauacagucaggcauuagaccuaugcuuuuaucaaagaauaggccccuaacaagcuacucacaauggcauuauaggcucacaaccaaccuuaaggccuggugugccauaaacauauauuuuccuucauggaaaaagcauaguuuuuccucuagggcaggacuacagcuggugacagcucuuugaaagguaaaauacuauuguguugagggcugguccacucaaauaaugcuuuauccuaauguguggagaauugcauaucucaauccuaaauuccagaccuuuaagagccuggagccuuaaggcuuaggagcuugaccuaaggcccuuguguauugaguccaaaauauugcucuuucccuuaaggcaggauuagcauuaggagagguggcaauggucugugacuagggcuuuugaggaagacaauguucagaucccgagauuccaacuuucuccacaauguggcaauaugguucucagucccaaguccacugggagcuuggucagucauacuuuuugauacuuggcaguuccguuuuacagugcuguuuuauuagacuucugaguuugucccaguguaugcuaguuucugcagacuucauagaggucuccauuucuuuacacuuauuccuguaaguaggauacaagaugcuacucuuaaaaaguuuacuuggcauaagacauagcuuguguaagcucuccccacugcagcuguuacaaauucuaccuucuccuuuugcuauuuuucucaucucuugggaccuccaacucaggaccccaucacugaaaaauggcuugccauuucagggcucugaggcacuuaauaaaugauucugggggucuuugguuuguauaucuccuagcugucuuaaguaggacuuguaaucuccaguccauauuuaaauuguucaaaauaaccaggggacugaacuguaaagaagcuuauggaugagagcauauguggaauccaaaaaaccuguuuuuggcuggcuggucuuugagcauuagccagugcugaauccaugcugucauuaagaauuuuuacuaauuaauauuuaguuguauaugcagugauuccuuucugggauggcauguuaguucugggagagcugucucuucuuccccuuaaagagauguucuaagacaagcuauguugacucagguagccuugauccuggucugcugcuccccagggcaaucaccuugcuuuccucuugauauaaauuccuaaauacuugaguuaaagaauguagcaaaguaguguuuuauaauagcucauuugagucauauaaugaacuguucauuucuuccaccuucaguagagaacaggaguaaugguuuacuguuaucucugucaggugaaguagggcaggagauggcuagauuauagaugaaagcuuaagggaaucugcucuaggugucaccauucuagagaaugauaagugucaggcagguugaauacuuuuguaauuucaugaaauguauuaaauaaugcaugugauuaaauaaaacuagauugguggaugcuuaauuugugcagguuagcuugagccagugauaaugaauuucuguuuuaggaucuguacuauauagauauaauguaucagaaauguaaaacacaugccauuagcuggagcugugugugucagauuauagaucucaguaguuaacaaagcacauggggcaaggucaaacacuaucuuauuaauaucauuccuucaacuaagaaaggccugaucuuuuucaaaucaguaguuauauauuuucccaauauagguguggguuuguuauuauguuuguuuuagcaaaccacugaggacaaugagcugauuaacaaaagugcuccacagugucugacauguguccugcuuuucucugagccuuugcucauagccauuagguggaaagugcuugcacuuuaccuuaacccagccugaagccacaacacaaaaucuuauguccuaaaaucucucuucaguuacuaauauucuggcacugacccccuguggacaguuugguaacuccagugucagcugauugauggggaauguaagcuauccagcuugauuccaggaggaagaaggggaagugcuggauuuggagcucaagcaagcuccaaacuuucaaagcagugaacccaggggcacugcccagaaaggggagaggcaggcacuuaggcagcaaggaucaggaaucuuagccucucccaagagcuuggugaaggaacagacuguuggaggagacacucuguugcuacugaacugcaaaucugcagauuuggaaaaggauuggcccaggcuggaaccacucugcugugucccuucagcacacucuaacccuaaggguggugcucaugucaauaagacucaauagccaucagaaccuccacaacgaauugccagucagaagaggcagugacuuuuccagguacuaagucagcaugguucucuguuuaacucaacugauaucaguguuucuaugugaccuguucuuaguguuuucgcuggaugcugugagguuaacucaagcaagcucauaacuucagauguacuaagugcaaugucaucucccacaaagaagaggagcuagcaucuuagaaaaggaugcuuguauaauaggucuucccagaggcagaaugguaugcaucagccagacaaauggggccaccugugagguauuuuguggaccuaaucuccuuuuggacgagacuguggccucugaguaacuuuauuauaagccugcaucuggacaaacauuuguagcuggggcuuguauguggaaauauacuugguaggaugagaacaagggaaagaguuuccuguguacacugucagguaaugcagugcagacaagagcuaggucacagacuaaaggaaagggaguaugcugcauuagucauuguuauggagaaggacaugauacaggcagugagaaugauuuuguaauuucacagauuguauaaaagacuggauaaaaaguacuaugugggugggcagggcagucagcgaauauucauuuugaaauacaccuuuacacuguugucuguaucauauuuuguuuuguacacacuuaucaaaucuuacaggauuuagucaccuaugaugacgugcaugucaacuucacucaggaagaaugggcuuugcuggauccuucucagaagagucucuacaaaggugugaugcuagagaccuauaggaaucucacagcuauagguaauauugugauuuuuuaaauuuacuuuauaacauguauguacaacuguuucuuuguuauucucauuuguuuuuguaauuucaauugagaaugaggaauaauauggugaauaaaucacucauguuuuuaaaguucaguggaguuaauaacuuaaauacuguuuaauugccaauaauguaacauacuuucucugguucuggguuuagguuacauuugggaagaacauacaauugaagaccauuuccaaacuucuagaagucauggaagguaauuuuccucugcaagcugaugagaaaaugccuaugaagaaaguuuaacgugggcuacaaguaguaaagaaaaccaauaggguacaauaagcauuucuuucagucauggauauuuacugaauuucauaaaaucauauaugucuauggcagauauguaauuuuuguuugcaagacauuccauuaguucaaaggcagagaaauaauggguuaacacauauguuacuguuuaaaucaagccuaguagagccaugcuguacaagugcuagugucuucagucucauaucgcuuagcuguugcaaaaggaacacacagugauuaggugacaauuauaugucuaaaaccuaauaaugagcaaauaauccauaguauaucugagcucaaugauauacuuauaauaacauugcuaaauuuagugagaugaacaguucauaagauucaaaaaugguuuuguggaaaaaccuuaaucucuguagcacaucucugugacgaaaaaaagucagcugugaauguaauguggaauuuucacuuguuauucuucuuuugauauggaugucauagguuaugauggauauaagccuugugagcauuggggcauugaaagaagccacauaccuuucacuuuuccagaaugauuagaggauaugcaguauaacauauuuugagcaacauucuuuuuuuuuuuuaaauguuagcauuuaauuaaccucccguguggcuuuuaagccaccagaacacaggcaccuccaacacccuuaaucuucucuucagcucuucugcugaagaauuuggccuucacgaugacagguuguuuagggagcuuucccuugcccaaaacuuuguaguagccugaucgaacaacaucagugaugggagcagcuccagucuuguuuuuugcugcauugacccgcgucugcucgcugaccaacauccacaguuuauccagguugacuguugggcauucgcucugguuccucuucaagugguaaugccgcauaccaacuuucccaaaguaaccugggugauaugugucaaaguugacccugugguggugccugccuccagaguucccgcucccgccugggugcuugcagugcuuaccgaugcggccguggcuguagcucacguggccccggaguuuccgggucuuccucagucuggauggcauggcgguggcagaaagggaugcaacauucuaaaugugcuauauaaguuuauaaauaauuuguuuccgaacauuccuggggacauuaaccaacucaaaaugguaaaaauaguaaugagaauuaaggcaguagaauuuuuuuucuuuugcauuuguucauauuccaaauguaguauuacucucaugaugacaaaauuugugaaugcaaucauugugcaaacacugugaguucuuccuguuuuuguuuucaaauacgugagugaucuuuuauagaaaaaguauguuauaaaugugagccagauaaucaguacuguucccauuucauauauccucgaagauguaaaacaauucauaauuuaguaaaacuccuuugaauauaaacaaaguaauauuauguuaacauuaaauuguucuuuucaaugaaaccaaaauuuaaaacaauucauacagauaaaaagccucgucaguauaauaaaaguaagaaagauuucacgugugcaaauuuucuuugcaggcgugaaagaaguuguacugcagagcaacccucugaguuuauucaaugugguaaagccuuugcauaugagaguuguagucaaaggcaucaaauuaaacauaauggagagaaacaccaugacuguaaccaaugugguaaagcuuuuaaaagaaggagugaccuccaaauacauaagcgaacacauacaggagagaaacccuaugaauguaaccaauguggaaaagccuuugcaagaagugaugaccuccaaaaacauaaacgaacacauacaggagagaaacccuaugaauguaaacaaugugguaaagccuuugcaggaagcaguggucuccaaugucauaaaagaucacauacaggagagacaccauauuaauguaaccaaggugguaaucccuuugcaggaaacagucgucuugaauaucauaaucaaacacauacagcugaaaaacccaggaauguaaccaaugugguaaagccuuugcaggaaggauugaccuuuaaagagaaaagaccauacaggagagaaacucuaugaagguaucuaauguuauaaagccuuugcagcaagcauugaucuccaaguacauaaaugaacacauaccagagaggaaccuuuuaaauguaaccaaugugguaaagcuuuuucgaaaaacaauagucuuuacacacauaaaagcacauauaguugagagaaaugcuuugauuuuaaccaaugugguuaaacauuuucaaaaagcagucaucaacaaaaucauaaaagaacacguauaggagagagauuuuugaaugcucgcaauggugcuuuuacaccuuuuucaugaagcaguggccuccaaauauauaaaggaacacauacaagggagaaacccuaugaauauuggcaauguuuuaaagcacuucuacaucacaaucaucuucaaauccauaaagagcaugagguggagagaaauccucugaacaacacuaauuagguaaagcaauuguacaaaagagucaucucccaacacaaacguauacacacaggauagaaacccuaugaauauaagcagugugguaaacauuuuauaagucacaguagucccuagguaaauaaaaggaaacacaguugagagaaacccuaugaaaguuaucaaaugaacaaagccuugugcauuaaaaucuucaaauacauaaaagaagacauagaggugagaaacccuaugucugcaagccaugugguauugcuuucacuugucagucauauucaaagacacaaaagaaaauauaauguagacaaaaugcugaguguauuuaauauggugaagauuuuugaauacuucuagagucuucacaaugaaacaaucuauacugcaaagaaauuuaggaauauaauauggugaaaccuuuucagauuucccaaauuucaucauuaugaacgagaaacccaugaaugcauucaauauggggaagccucuaaacauuuuaaauucuucaucaucaugaaauuaaucauacaaaggagaauaaggggauacaaggcauguuucuuauugucuugauugagugacaguccugacauccuuuggugauaaauauaaauguagaaagugugagcuggauuaaacccuuuccuccccaacugcuucuuggucaugauguuuaugcaggaauagaaacccugacuaagacaaauugguaucaggggugggguauuuuugugacaaccugaccauguuuugggaggacugucaaaggacuuuggaacuuugggccagaagauccauucgguguuaagaacucugugggauguuguguaggagcuuggaagaaaauguugagagcagugcagaagauuaaauccuggcuuguaaaauuucacagggaaaauuaaagacuuuugagggccauugcuauuuuggauugugaagaucugugguucuggauagcuagggcugaagaaucagcugugaugaacaagauaacagaacuacuagagugaaaacuuuguauuacugggacuauugaugcuguuuaguuggagcuaagaaauuagcagugauuaaaaagaaaccagcaucauugagauggcacuauaugggaaguguuuucugagagcacagaggcacuguuauaaagauagucaagguuguaucuugugcuguggcuggacuugguaacguguaagagguacccagaugguacugguuuugaaagcauaaaaggaucaugcagagcagcugaagcccagcacugugagagaccauggaaggccauuggugaaggugcagccucaggugcaauugauggcccagugcugaagagaucaugcaguguuuuggaguuuucacguccaugaaugaccaagaacagcagcaacaguaaaguacaggcaucuggagccuagaggacaagcugugugccacaaaggacagggcuggagaagugacccaagcccuuggaggagcccaaaggaucgugaguuggaucccauacuuuggauaguuggaguuuaauuuuggauuuugauugugacugugcgcuaauguuuuucccucuugaagggagaauauacuuuaguggauuccacaguuaagagacuuuuaauuguaaaaggcuuuggauuuuaaaggcuauuagauauuuuuaagggauugaacuuuuaauauguaaagacugugggacuuucaaaguuguguauaucuuggggaugaauaagaaacuaagguuugaggauuacuagugauguguuugugugucaaguugacaaggugucaauuguacuggcuaguuuugugucaacuugacacaagcugaaguuauacagagaaaggagcuucaguuggggaaauacccccaugagaucuagcugucagacauuuucucaauuugugaucaagggaauaggccccuugugggugggaccaucucucugugcugguagucuuggguucuauaagagagcagucugagcaagccaggggaagcaagccaauaaagaaacaucccuccauguccucugcaucagcuccugccacuugaccugcuugaguuccaguacugacuuccuuggugacgaacagcaagcaguaugaaaggauaagcugaauaaacccuuuccuccccaacuugcuucuuggucaugauguuugugcaggaauagaaacccugaauaagacaacggguauaaggucuggauuguaaaaaaagacaucagacaauaaagaaaugaagaaauaaaauuauggccuggugagauggcucaguggguaagagcacccuacugcucuuccgaaggucuggaguucaaauuccagcaacuacaugguugcucacaaccauccguaucgagaucugacucccucuucuggagugucugaagacagcuacaguguacuuacacauaauaaauaagcaaauaaaucuuuauaaaaaagggaaaaaaagaaauaaaauuauuuuuaaaaaaaggauggacagacagaaacauaccuuccaaauuauagcuucauuuucacaccaaucaggauuuagggauaggggcuuaugaaguuuacagugucaucuguuauauauuauggguguuauaguuuaaccaaucauauggauuuguucuuuggugguaaaguacaggucuuauguuuugaggagcacaaugaaaagcagaaagcauuauuagagacagucauuauguuuucaagaagagaauauguguaaagugagguuggaucuccacaagaccucaugccuggaaacuugaacuuagagucaccauaugaguaaaugcaggguaauaacaaaaaaggcaauacuuagggccugguguuuguuuuguuuugguuuuucugcuuauucccaauuguguauugguucucaugcuacuccuguuaaauuguucaaauugauaagcccauauugggacacugagauucccugccccaagcugauuguaaauggguaacaaaagugccaacagccaauggcuaggcaggagacaaaggcaggaugucugggucagcuagggggauuuugcuacaucccagcuaaugacauguaaccaagaauuaugcauaccaguucaacucacuuuuuguucuaguugugaaccugcacaacuuggugacauaccucaugucuccagcaaaccagcaucucugcuaagaauccaauuuuccacaucuuuuuaucucacaucaugacaugguuuuccacuugagaaucuacaauuaauuuuuaauauuaaguucaagccuacaggugaggugcauucugcagaguugguugguuacucugaucuacuauaggaugcuuccugugcaaguuccucacugagcaugcaaaugcuuuagauccucaaauaaagauacacagcuuuauuuacuaucuuaaaucagcuaauugguugggacacucccaaucuuccacauuccuaauucuucucugugauacuccugaauuauuacuuacuaaagucucuaugccaucuuugcuaccccagaaucaaucacaggaggggccacuggggccucucuucccuggcucuuacauggcugguauucugccauucccagcucucaagccugcauccacuucauuuacuagcauggcaauccucuuugguucucuugccaaugaauacaaaagucuugccucagucuugcugccuagccauuggcuucuggcaauuuuauuuaccaauuagaaccaucuuggggcagagaaucucagugucccaaaugcaggauucucaugaaauuugggaaccaauuuaacacaaguagcaugagaaccaauaaagaacaauugggaauuaccagaagcaagaaaaaacaugccccaaguauugccuuuuuguuaucaccuacauuuaaucauauggugaaauuaaguucaauuucccaggccugggguauuguggagauccaaccucacuuuacucauauuuuguucuugaaaaccuaaugacugucucuaacaaugccuucugaauccauauugugcuccucaaaacauaacaccuguucuuuaccaccaaagaacaauucaaugauugguuaaacuguaacacccacauucauucauucauucauucucucucuuucuucuucuucuucuucuucuucuucuucuucuucuuuuucuucuucuacuucucucucucucucucucucucucucucucucucucucucucucucucucucucucucucucugguuuuucaagacaguguuucucuguauggcccuggcuguccuggaacuuacucuguugaccaggcuggccucaaacucagaaaucugccugccucuaccucccaagugcuggauucaaauggcauguuacaccacugcccagcaacacccacauucuauaucaguugacacuguaaacuacauaauccucuguuccuaaauccuguuuggugggaaaauguagcuguaacagcacagauauuucuguuuguauuuuuuuaauauccuuuaauccauuguucaaucuuuuuuuuuuuuuacaaucuuaacguucuaccauuccaaguccacccuucaacuuguccaaaugccacaccuccuaccaaaguuuccaagaagaugucuccaaaaauccccaccccacccauucuccccacuaccuggggccucaagucuuucgaggguuuuguacaucuucugacugaguccagaacuggcagcuuucugcuguauaucaagagcuuuaugcuaggugguuguuagcucagugucugaaagaucaaguggguccauguuaguucagacugcuggucuuccuauagagucacccuccucaccuuccagguuuucccuaauucagucacaagggucacaagccucuguccauugcuuggguggaauugugugcaucugacuguuuaagcugcuuacuggacuuuucacagggccgccaggauaggcuccuguuuguaagcauaccauagcaucaguaacagugucagaucuuggugccacccacucagcuggaucuuaauuugagaaugucacaggaccuucuuuuccucagacucuucuccauuuuuauucuugcaguucuuucagacaggaaguauucuggguaagaguuuuugacugugggauggcagcucuauaacauucuggcucacagugggaaagugugugugcugugaguuacacauuagguucugaguaugcucucucaugauucaucagcagcuuuauuacaauaaacuccugccauuuguguuaccugaguuugaguugugugggaucagagaggaccucauacaagaaaggcucuaccacucuguuuacauucauagacuuucuuugcauaugauuaauuucuuucuuucuuucuuucuuuuuuuuuuuuuuuuuuuuuuuuuuuuuugguuuuucgagacaggguuucucuguuuagcccuggcuguccugaaacacacucuguagaccaggcugaccuugaacucagaaauccaccugcuacugccucgcaugugcugggauuaaaggagugugccaccacggcacaccacggcacacaacgggcgcagcuuuauaugauuacuuucaugaugaugaaaacugugcaaaaagugacauuuugacuucuuccuuuccaauuuguauccccuugaucuccuuuuauuguugaauugcucuugcuaggacuucaaguacaguguuuaauagguagggagaaagugggcagccuugucuagucccugauuuuagugggauugcuuccagcuucucacuauuuucuuuguuguuggcuacugguuugcuguagauugcuuuuaucauguuuagguauggaccuugaauuccugaucuuuccaagacuuuuaucaugaauggguguuggauuuugucaaaugcuuucuaagcaucuaaugagaugaucaugugguuuuugucuuugaguuuguuuauauacuggauuauguugauggauuucugugacuugaaccaucccugcaucccuggaauaaaaccuacuuggucaggauggauaaucguuuugauguguucuuggauucgguuagggagaacuuuauugaggauuuuugcaucgauauucauaagggaaauuggucugaaaaucucuaucuuuguugagucuuuuugugguuuagguaucagaguaauuguggcuucauagaaugaguuggguagaguaccuucuguuucuauauuguggaauaguuugugaagaacugggauuagaucuucuuugaaggucugauagaacucugcacuaaacccaucugguccuggacauuuuuuuuguuguuguuguugggagaccauuaaugacuucuucuauuucuuuaggguauauaugacuguuuagaucauuaaccugaucuugauuuaacuuugguaccugguaucugucuagaaacuuguccauuucauccagguucuccaguauuguugacuauagacuuuuguagaagguucugaugguguuuuggauuucuucaggaucuguuguuaugucucccuuuucauuucugauuuuguuaauuaggaugcuuuuccuuugcccucuagugagucuggcuaaggguuuaucuaucuuguugauuuacucaaagaaccagcuccucgagccucagcagcagcggucgccaucuuguuccgggaaccaccgaacuuaggaaauuagucaggacaggugagagggugcaccagagaaccggacagcuucugggacaggcggaagcacagagccgcugaggcagcacccuuugcgggccguagacagccggccacccuccggaccggaggacagguguccgccuggcuugggaggcggccucagccucagcagcagcggucgccaucuucuuccaggacccgccgaacuuaggaaauuagucugaacaggugcgagggugcgccaaagaaccagacagcuucuggaacgggcggaagcacagagccgcuaagacagcacccuuugcgggccguagacagccggccaugguccagaccagaggacagguguccgccuggcuugggagguggucucagccucagcagcagcggucgccaucuucuuccgggacccgccgaacuuaggaaauuggucugaacaggugagagggugcgccagagagccggacagcuucugggacaggcagaagcacagagccgcugaggcagcacccuuugcgggccguagacagccggccacccuccggaccggaggacagguguccgccuggcuugggaggcggccuuagccucagcagcagcggucgccaucuuguuccggaaccgccaaacuuaggaaauuagucugaacaggugagagggugugccagagaaccggacagcuucuggaacaggcggaagcacagagccgcuaagauagcacccuuugcgggccguagacagccggccacgguccggacuggaggacagguguccgccuggcuugggaggcggccucagccucagcagcagcggucgccaucuucuuccgggacccgccgaacuuaggaaauuagucugaacaggugagagggugcgccagagaaccggacagcuucugggacaggcggaagcacagagacgcugaggcagcacccuuugcgggccguagacagccggccacccuccggaccggaggaaagguguccgccuggcuugggaggcggccucagccucagcagcagcggucgccaucuuguuccgggacccgcggaacuuaggaaauuagucugaacaggugagagggugcaccagagaaccggacagcuucugggacaggcggaagcacagagccgcugaggcagcacccuuugcgggccgcagacagccggccaccguccggaccagaggacaggugucugccuggcuaaggaggcggccucagccucaggagcagcggucgccaucuugguuccgggacuccaaggaacuuaggaauuuagucugcacaggugagaaucugcaccacagaagcuaacagcuucugggaacugccaaagcaacacagcuucugagaaagguccuguuuugggccuucuucuucggccaggaggagguccaaauacaagauaucugcgcaccuucccuguaagagagcuugccagcagagagugcucugagcacugaaacucagaggagagaaucugucucccaggucugcugauagacgguaacagaaucaccagaagaacaaucucuaaacagagucaacuauaacuacuaacuccagagauuaccagauggcgaaagguaaacguaggaaucuuacuaacaggaaccaagacuacucaccaucaucagaacccagcacucccacuucgcccaguccagggcaccccaacacacccgaaaaccuagaccuagauuuaaaagcauaucucaugaugaugguagaagacaucaagaaggacuuuaauaaaucacuuaaagaaauacaggagaacacugcuaaagaguuacaaguccuuaaagaaaaacaggaaaacacaaucaaacagguagaaguccuuacagaaaaagaggaaaaaacauacaaacaggugauggaaaugaacaaaaucauacuagaccuaaaaggggaaguaggcacaauaaagaaaacucaaagugaggcaacacuggagauagaaacccuaggaaagaaaucuggaaccauagauuugagcaucagcaacagaauacaagagauggaagagagaaucucaggugcagaagauuccauagagaacaucggcacaacaaucaaagaaaauggaaaaugcaaaaagauccuaacucaaaauauccaggaaauccaggacacaauaagaagaccaaaccuacggauaauaggaguggaugagaaugaagaauuucaacucaaagguccagcaaacaacuucaacaaaauuauugaagaaaacuucccaaaccuaaagaaugagaugccuaugaacauacaagaagccuacagaacuccaaauagacuggaccagaaaagaaauuccucccgacauauaauaaucagaacaacaaaugcacuaaauaaagauagaauacuaaaagcaguaagggaaaaaaggucaaguaacauauaaaggcaagccuaucaaaauuacaccagauuuuucaccagagacuaugaaagccagaagagccuggacagauguuauacagacacuaagagaacacaaauuccagcccaggcuaguauaccuagccaaacucucaauuaccauagauggagauaccaaaguauuccacgacaaaaccaaauucacacauuaucucuccacgaauccagcccuucaaaggauaauaacagaaaaaaaaacaauacaagaacgggaacaacgcccuagaaaaaacaagaagguaaucccucaacaaaccuaaaagaagacagccacaagaauagaaugccaacuuuaacaacaaaaauaacaggaagcaacaauuacuuuuccuuaauaucucuuaacaucaauggucucaacuccccaauaaaaagacauagacuaacaaacuggcuacacaaacaagacccaacauuuugcugcuuacaggaaacucaucucagagaaaaagauagacacuaccucagaaugaaaggcuagaaaacaauuuuccaagcaaaugguaugaagaaacaagcuggaguagccauccuaauaucugauaagauugacuuccaacccaaagucaucaaaaaagacaaggagggacacuucauucucaucaaagguaaaauccuccaagaggaacucucaauucugaauaucuaugcuccaaauacaagggcagccacaaucacuaaagaaacuuuaguaaagcucaaagcacacauugcaccucacacaauaauagugggagacuucaacacaccacuuucaccaauggacagaucauggaaacagaaacuaaacagggacacacugaaacuaacagaagugaugaaacaaauggaucugacagauaucuacagaacauuuaauccuaaaacaaaaggauauaccuucuucucagcaccucaugguaccuucuccaaaauugaccacauaauaggucacaaaucaggccucaacagauucaaaaauauugaaauugucccauguauccuaucagaucaccaugcacuaaggcugaucuucaauaacaaaauaaauaacagaaagccaacauucacguggaaacugaacaacacccuucucaaugauaccuuggucaaggaaggaauaaagaaagaaauuaaagacuuuuuagaguuuaaugaaaaugaagccacaacguacccaaaccuuugggacacaaugaaagcauuucuaagagggaaacucacagcucugagugccuccaagaagaaacgggagagagcacauacuagcagcuugacaacacaucuaaaagcucuagaaaaaaaggaagcaaauucacccaagacgaguagacggcaggaaauaaucaaacucaggggugaaaucaaucaaguggaaacaaaaagaacuauucaaagaauuaaccaaacgaggaguugguucuuugagaaaaucaacaagauagauaaacccuuagcuagacucacuagagggcacagggacaaaauccuaauuaacaaaaucagaaaugaaaagggagacauaacaacagauccugaagaaauccaaaacaccaucagauccuucuacaaaaggcuauacucaacaaaacuggaaaaccuggacgaaauggacaaauuucuggacagauaacagguaccaaaguugaaucaggaucaaguugaccuucuaaacagucccauauccccuaaagaaauagaagcaguuauuaauagucucccagccaaaaaaagcccaggaccagacggguuuagugcagaguucuaucagaccuucaaagaagauauaauuccaguucugcacaaacuuuuucacaagauagaaguagaagguacucuacccaacucauuuuaugcagccacuauuacucugauaccuaaaccacagaaagauccaacaaagauagagaacuucagaccaauuucucuuaugaauaucgaugcaaaaauccuuaauaaaauucucgcuaaccgaauccaagaacacauuaaagcaaucauccauccugaccaaguagguuuuauuccagggaugcagggaugguuuaauauacgguuuaauaugguuuaauauccaucaauguaauccauuauauaaacgaacucaaagacaaaaaccacaugaucaucuuguuagaugcagaaaaagcauuugacaaaauccaacauccauucaugauaaaaguucuggaaagaucaggaauucaaggccaauaccuaaacaugauaaaagcaaucuacagcaaaccaguagccaacaucaaaguaaauggagagaagcuggaagcaaucccacaaaaucagggacuagacaaggcugcccacuuucucccuaccuuuucaacauaguacuugaaguauuagccagagcaauucgacaacaaaaggagaucaaggggauacaaauuggaaaagaggaagucaaaauaucacuuuuugcagaugauaugauaguauauauaagugacccuaaaaauuccaccagagaacuccuaaaccugagaaacagcuucggugaaguagcuggauauaaaauuaacucaaacaagucaauggucuuucucuacacaaagaauaaacaggcugagaaagaaauuagggaaacaacacccuucucaauagucacaaauaauauaacauaucuuggcgugacucuaacgaaggaagugaaagaucuguaugauaaaaacuucaagucccugaagaaagaaaugaaagaagaucucagaagauggaaagaucucccaugcucauggauuggcaggaucaacauuguaaaaauggcuaucuugccaaaagcaaucuacagauucaaugcaauccccaucaaaauuccaacucaauucuucaacgaauuagaaggagcaauuugcaaauucaucuggaauaacaaaaaaccgaggauagcaaaaacucuucucaaggauaaaagaaccucugguggaaucaccaugccugaccuaaagcuuuacuacagagcaauugugauaaaaacugcaugguacugguauagagacagacaaguggaccaauggaauagaauugaagacccagaaaugaacccacacaccuauggucacuugaucuucgacaagggagccaaaaccauccaguggaagaaagacagcauuuucaacaauuggugcuggcacaacugguuguuaucauguagaagaaugcgaaucgauccauacuuaucuccuuguacuaaggucaaaucuaaguggaucaaggaacuucacauaaaaccagagacacugaaacuuauagaggagaaaguggggaaaagccuugaagauaugggcacagggggaaaauuccugaacagaagagcaauggcuugugcuguaagaucgagaauugacaaaugggaccuaaugaaacuccaaaguuucugcaaggcaaaagacaccgucaauaagacacaaagaacaccaacagauugggaaaggaucuuuaccuauccuaaaucagauaggggacuaauauccaacauauauaaaaaacucaagaagguggacuucagaaaaucaaauaaccccauuaaaaaauggggcucagaacugaacaaagaauucucaccugaggaauaccgaauggcagagaagcaccugaaaaaauguucaacauccuuaaucaucagggaaaugcaaaucaaaacaacccugagauuccaccucacaccagugaaaauggcuaagaucaaaaauucaggugacagcagaugcuggcguggauguggagaaagaggaacacuccuccauuguuagugggauugcaggcuuguacaaccacucuggaaaucagucuggcgguuccucagaaaauuggacauaguacuaccggaggauccagcaauaccucuccugggcauauauccagaagaagccccaacugguaagaaggacacaugcuccacuauguucauagcagccuuauuuauaauagccagaaacuggaaagaacccagaugccccucaacagaggaauggauacagaaaaugugguacaucuacacaauggaguacuacucagcuuuuaaaaagaaugaauuuaugaaauuccuagccaaauggauggaccuggagggcaucauccugagugagguaacacauucacaaaggaacucacacaauauguacucacugauaaguggauauuagcccaaaaccuaggauacccaagauauaagauacaauuuccuaaacacaugaaacucaagaaaaaugaagacugaaguguggacacuaugcccccccuuagaagugggaacaaaacacccauggaaggaguuacagagacaaaguuuggagcugagaugaaagaauggaccauguagagacugccauauccagggauccaccccauaaucagcuuccaaacgcugacaccauugcauacacuagcaagauuuugcugaaaggacccagauauagcugucucaugugagacuaugcuggggccuagcaaacacagaaguggaugcucacacauggauggaucacugggcucccaauggcggagcuagagaaaguacccaaggagcuaaagggaucugcaacccuauagguggaacaacauuaugaacuaaccaguaccccggagcucuugacuccagcugcauauguaucaaaagauggccuagucggccaucacuggcaagagaggcccauuggacaugcaaacuuuauaugccccaguacaggggaaugccagggccaaaaauggggaguggguggguaggggaguggggguggguggguauggggaacuuuugguauagcauuggaaauguaaaugagcuaaauaccuaauaaaaaaaaaaaagaaccagcuccucguuugcuugauuuuuugaauaguucuucuuguuuccacuugguugauuucgccccugagguugauuauuuccugccaucuacuccucuugggugaauuugcuuccuuuuguucuaaaguccuucauuuuuuucuuuauuccuuccuugaccaagguaucauugagaagauuguugugcaguuuccacgugaauguuggguuucuauuauuuuuuuguuguuguuauugaagaucagccuaguccauagugaucugauacgaugcauugaacaauuucaauauuuucguaucaguugaggcuuguuuagugaccaauuauguggucaauuuuuggagaagguaccauaagguguugagaagaagguauauccuuuuguuuuaggauaaaauguucuauaguuaucuguuagauccauuuguuucauaauuucuguuaguuucacugugucccuguuuaguuucuguauccaugaucuguccauuggugaaagugguguguugaagucucccacuauuauugugugaggugcaaugugugcuuugagcuuuacuaaaguuucuuuaaugaauguggcugcccuuuuauuuggagcauacauauucagaauugagaguuccucuuguaagauuuuacauuucuugaguaugaagugcuccuccuugucuuucuugauaacuuuggguuggaagucgauuuuauuagauauuagaauggcuacuccagcuuguuucuucagaccauuugcuuggaaaauuguuuuccagccuuucauucugagguagugucuaucuuuuucccugagauggguuuccuguaagcaguaaaauguuggguccuguuuguguagccugucuguuagucuaugucuuuuuauuggggaguuguguccauugauauuaagagauauuaaggaaaaguaauuguugcuuccuauuauuuuuguuguuaacguugacauucuguucuuguggcugucuucuuuuagguuuguugagggauuacuuucuuguuuuucuagggcgugguauccguccuuguauuuuuuuuuucuguuauuauccuuugaaaggcagguuucguggaaagauaaugugugaauuugguucugucguggaauacuuuuguuucuccaucuaagguaauggaaaguuuggcuggguacaguagccuguguuagcauuuguguucucuuagugucuguauaacauccaucaggcucuucuggcugucauagucucuggugaaaaaucugguguaauucugauaggcuugccuuuauauguuaccugaucuuuuucccuuacugcuuuuaauauucuaucuuuauuuagagcauuuguuguuaugauuauuauauauugggaggaauuucuuuucagguccagucuauuuggaguucuguaggcuucuuguauguucaugggcaugucauucuuuagguuugggaaguuuucuucuauaauuuuguugaagauauuugcugguccuuuaaguugaaaaucuucauucucaucuacuccuauuauccacagguuuggucuucucauuguguccuggauuuccuggauguuuugaguuaggaucuuuuuugcguuuuccauuuucuuugauuguugugccgauguucucuauggaaucuucugcaccugagauucucucuuccaucucuuguauucuguugcugaugcucgcaucuaugguuccagauuaauuuccuaggguuucuaucuccaguguugccucacuuuggguuuucuuuauugugucuacuucccuuuuuuaugucuuggaugguuuuauucaauuucaucaccuguuuggucguguuuuccugcaauucuuuaagggauuuuugugcuuccucuuuaaggucuucuaccuguuuagcaguguucuccuguacuucuuugagugaguuauuaaaguccuucuugauguccucuaccaucaucaugagauaugcuuuuaaaucugggucuagcuuuccggguguguuggggugcccuggacugggcgaggugggagugcuggguucugaugaugguuaguggucuugguuucuguuaguaagauucuuacguuuaccuuucaccaucugguaauauaaucucuggaguuaguugauuuaguugucucugauuagagauuguuccuccagugauucuguuagccucuaucagcagaccuguguugggagccgcccccacauuugccgucacaagauggcgcugacauccuguguucuaagugguaaacaaauaaucugcgcaugugccaaggguauuuuacgacuacuuguacucugccuuucccgugaacgucagcucggccaugggcugcagccaaucagggagugaugcguccuaggcgaaauauaacucuccuaaauagggaagggguuucgguuucguuauugagggggcuuucguuuuuggggcugggcgcugggcgcuugcccuccuggcuccaaaagauguaagcaauaaaguuuugccgcagaagauuuugguuuguuguguucuuccucgucgggcgcgcgaacgcuauuaagaauuggugcugaaauccgggacgagaaauuccgggacgagaaaaaauccgggacgagaaaauacaagaaaacucgggaccggcgcaagggagaucccucauuccagaaccagaacugcgggucgcgguaauaaagguucccguaaagcagacuguuaagaaggauucaacugcaugaauucagaacuuuucagcuggggaacgagaguaccagugaguacagcuuuacgagguaagccuggccuugaacuuucuaacgaaauucaagacagucuaucagaaguaaaguggaaaauagcuuuauaagauauguuuggccuugaacuuucucuaguguuagaagcccuuuuguuccuuuucacauguuaucaagugguuaaggcagggcggauucuggaugaaauucaggacaaucuaucagaaguaaagcggggagagagaguaggagcaaagagaaaauaugguacacaaaauaaguauacaggccuuuccaagggucuugaacccgaggaaaaguuuaggucagguaagaauaccuggggagagauuagaaggaaggaaaagaaaaaagaaaagaaaaaagaucgauuagcggaggucucuaggagauacucgucacuagaugagcucaggaagccagcucuuaguagcucugaagcagaugaagaauucuccucugaggaaacagacugagaggaagaagcagcccauuaccagccagcuaauuggucaagaaaaaagccaaaagcggcuggcgaaagccagcguacuguucaaccucccggcagucgguuucaagguccgcccuaugcggagcccccgcccugcguagugcgucagcaaugcgcagagagaugcgcagagaggcaaugcgcagagagaugcgcagagaggcaaugcgcagagagaugcgcagagaggcaaugcgcagagagaugcgcagagaggcagugcgcagagaggcagugcgcagagaggcagugcgcagacucauucauucccagagaggaacaaaggaaaauacaacaggcauuuccagucuuugaaggagccgagggugggcguguccacgcuccgguagaauacuuacaaauuaaagaacuugccgagucgguccguaaauacggaaccaaugcuaauuuuaccuuggugcaguuagacaggcucgccggcauggcacuaacuccugcugacuggcaaacgauuguaaaagccgcucucccuaguaugggcaaauauauggaauggagagcgcuuuggcacgaagcugcacaagcgcaggcccgagcaaacgcagcugcuuugacuccagagcagagagauuggacuuuugacuuguuaacgggucagggagcuuacaacuagauguauuaugacaaauaacucagcugggguguaaacaaaaguuuccgagauuguguguuacuuccauucaguaugagaaauuuacuaggacagcuaauuugucaaaaagucuuuuucaguauauguuacagaauuggacggcugaauuugaacagauccuucgggaauugagacuucaggucaacuccacgcgcuuggaccugucccugaccaaaggauuacccaauuggaucuccucagcauuuuccuucuuuaaagaaugggugggauugauauuauuuggagauacacuuugcuguggauuaguguugcuucuuugauuggucuguaagcuuaaggcccaaacuaggagagacaaggugguuauugcccaggcgcuugcaggacuagaacauggagcucccccugauauaugguuaucuaugcuuaggcaauaggucgcuggccacucagcucuugcaucucacgaggcuagacucauugcacgagauagagugagugugcuucagcagcccgagagaguugcacggcuaagcacugcaguagaaaggcucugcggcauaaaaugagccuauucuagggagacaugucaucuuucaagaagguugaguguucaaguguccuucccccaggaaaaacaacacgggaccagaccaggaccccucugggugaugagccugggaggagguuauguguacggcuccuuuaccuacacacuggggauuugaccucuaucuccacucucauuaauauggguggccuauuugcucuuauuaaaagaaaagggggagauguugggagccgcccccacauuugccgucacaagauggcgcugacauccuguguucuaagugguaaacaaauaaucugcgcaugugccaaggguauuuuacgacuacuuguacucugccuuucccgugaacgucagcucggccaugggcugcagccaaucagggagugaugcguccuaggcgaaauauaacucuccuaaauagggaagggguuucgguuucguuauugaaggggcuuuucgcuuuuggggcuggggguuugcgcuccuagcuccugaagauguaagcaauaaaguuuugccgcagaagauucuggucuguuguguucuuccuggccgggcgugagaacgcuauuaagagaccugggagacuagcucucuccucugaguuucaguggucagagcacucucugcaggcaagcucuccucuuacagggaaggugcacagauaucuggcguucggaccucccuccuggccaaagaugaaggccccaaacaggacgugucccagaagcuguguugcuucgcccugugacagaagcuuuuagcuucuguaguccacacucucacaugugcagaauacucucgguggaguccuagaaccaagaugucugccgcugaugcucaggcaaagcccucccgggcugggcggacaccuauccucuggcugggaagguguccagaugucuggggccugaaaagggggcugccucagaagcucuguggcuccugccugucccagaagcuguuagcuucuguaguccauacuuucaccuaugcagacuacuuucggcagauacaaauuggaaaggaagaagucaaaauaucacuuuuugcagaugauaugauaguauauauaagugacccgaaauauuccaccagagaacuccuaagccugauaaacagcuucaaugaaguagcuggauauaaaauuaacucaaacaaguuaauggcauuucuguacacaaaggauaaacaggcugagaaagaaauuagggaaacaacacccuucucaauagucacaaaggauauaaaauacuuuggcgugacucuaacuaaggaauugaaagaucuguaugauaagaacuucaagucucugaagaaagaaauuaaagaagaucucagaagauggaaagaucucccaugcucauggauuggcggaucaauauaguaaaaauagcuaucuugucaaaagcaaucuacugauccaauacaauccccaucaaaauuccaacucaauucuuccacgaauuagaaagggcaaggcuuuaccguaucaaauauauucauacaguuucucuccaguauggauuuuucaugaugaugaagacuuuagaaaugugggaaaccuucaccauauuaaacacauccacaggauuucucuacauuaugguuuauuucuugccuuugaauaugaccgacaugcgaaugcuuuaccacacugcuuacagucuuaggguuucucaccuguauggcuucuuguauguauuugaagaugauugcaacauacaaagccuuuacccauugaugacauuaauaguguuucuguggaauauguuuucuuuuauuuccuuggagaguacugcaacuugcaaaaaguuuaccauauuucuuauauucauagguuucuaccagaguguguaaagaugacuguuuuguacaaagacuuuaccauguuaguuacauucagaggauuucucuccaguacauguucuuuuauguauuugaagauaauuauaaaguagaaugucuucagaacuuugccgauauucauaggguuucucuccuguauguguuccuuuauauauuuggaggucacagcuuuguggaaaaggauuaaaaccacauugcuaacauuuuaaaauuccucuccucuauguauucuuuuaugauuuuggugaccacugcuuugugaaaaaccuguaucacacugguuacagucaaaugguuucucugaacuauguguuauuuuauguaugugaagacuacugauuuuugaaaaagcuuugccacacagauuauauuuaaaagguuucuuuauuauguguguuuauuuauguauuuggagaucacugcuuccugcaaaggcuuuaccaaauugguugacuucauaguguuucucuccuauaugaguccauuuaugauauccaagaguacuucuuuugggaaaggcuuuacuacauugguuaaacucauaggguuucucuccuguauguguuccuuuauguaucugcagaugucuguuuuguacaaaggcuuuaccacauugguuacauucauauguuuucucuccuguauguguuuguuuauauauuuggaggucacuccuuccugcaaagccuuuaccacauugguuacauucauaggguuucucuccuguauguguucucuuauguauuuggagaugauugcuuuguacaaagccuuuaccacauugaucacauucauaggguuucucuccuuuaugaauucguucaugauguuggagagcacugcuguagccaaaggcuuuaccacauugguuacauucauacaauuucucuccuguuuguguucuuucaugccuuugacuauaacuaugauaugcaaagacuuuacggcacugaauaaaaucagaggguuguucuccaguacaacuucuuucaugccugcaaauacaauuggcacacaugaaauauuucucacauuguuuacacugaugagucuuuuuauguguaugaauucuuucagaauuuaguuucauugaaaauagcaaucuaauauuacuguaauaugacuuuguuuucauucaaagguguucuccuucauuauggauuguuuuacaccuuugaggauacaugaaaugggaacaguacugauuaucuggcucacauuuauagcauagcuuuuccauaacagauuauucacauauuugaaaaaaaacaggaagaacucagagcuuuugcacaccgcauucacaaauuuuguuaucgugacaguaauacuaaauuuggaaggugaacaaaugcaaacagaauaaaauuucuaguacccuaauucucauuaggauauucagcaguuuaagucguaauuguccccaauaauguuggcaaacuaauuauguacaaacuuauagcacauuuagaaugucuacucaaaauguaguauacuacauauccucuaauaguuuuggaaaagagaaagauaagugguuucuuucaaugucccuauauucacauggcucauauccauuguaauauccauaucaaaacaagaauaacaagugaaaagguuccacauuacaaucacagcugacuuuuuuccucacagagaugugguacagggauuaaaguuuuuccacaaaaccauucuugaaucuuaugaaccguccaucucacuaaauuuagcaaugcuauuacaaguauaucauugagcucagauuuacuauggauuauuugcuuauuacuagguuuuagauauauacuugucaccuaaucacuguguguuccuguugcaauaguuaagcuauaugagacugaagagacucgcacuuguacagcauggcuguacuaggcugauuuaaacaguaacauaccuguuaacccauauuucucugucuuugaacuaauagaaugcuuuacaaacaauaauuacauaccuguuauagacauauaucauuuuaugaaauucaguaaacauccauaacuguaagcagugcuuauuguaccauauugguuuucuuuacaacuugcagcacauauuaaauuuucuucacaggcauuuucucaucaacuugaauaggaaaauuaccuuccaugacuuuuagaaaauuaaaaaucgucuucaauuguauguucuucccaaauguacccuaaaacacaguaccgaagaaaguauguuacauuauuggaaauuaggcaauauucaaguuacuaacucccuugaacuuuagaaccauaggugauuuauucaccuuauucuuccucauucucaauugaaauuacaaaaacaaauaacaaucauaaagaaacuguucugcauacauguuacaaaguauauaaaaauaucacuguauuaccuauagcugugagauuccuauaggucucuagcaucaaaccuuuguagagacucuucuaggaaucauccagcaaagcccacucacgagugaaguucacaugcacaucaucauagguagacuaaauccuaaaagaucugauacaaguguccauaaaaaaauaugauacagacaacaguguaaagacugcccugcccacccacauagugcuuuuuauccagucuuucacauuuggacaacaaaaaaacuuaaguaaauaaaugaucugugguaaccugaugccuuaguauugagauguuggguagggaaccaugcagaauguugcuagaccuuccucauuuuuacucccugagacacaauaugcaagagugggcuuaagacuaguuuccucucaccuguccauuacauauguagauuaaaaagaccauuacauucuccccuucccuuccugccacaugucugggucuuacaacccaaacaagggcagacacacccuucucaaccauagucaguauuccugaagacuaagcagucucucuaaagaucaagcccucuaucuguuacccuagacacaauucucauaguugccuauagcacugcaauacaguaucaggucccauuaccaugugaccaauuuucaauuuuucuucagaauaacuaagacaauuacaccaagaacaaugugaacuuaaccaauguuaccugugcuaguguguguauagaaauaaaauaaaaucauauuuccugacuccaauaaaaauaacucaaagugacccuuaaacuguuauaaaucugacccaacaguuacuacugaccugucuuccaaacagugaggccccauuuucuagagcucucucugucauuguagaugaucagaaaguugagcuauuguucuauagcuguucaugacccuuagugauuucaggcuaaaccagccccacaggagcccauauacaaaacaauucugaaugauuauuuaaugucugcuuccugccauaugcauuauguuccagucuauccuauccacccaaccagcaccaucaacaccugagaaacuuaugcauugugucuaggguaacagauagagggcuugaucuuuagagagacugcuuagucuucaggaauacugacuaugguugagaagggugugucugcccuuguuuggguuguaagacucagaagcuccuuuuguaaccaagaauugaauuucugugaaucaugccauuuugacaauagggaauagaaagguaaaagggaucuaaucaaauauuucugaaggaugaucauuaucagcucuuuacuacuaccuuccaaacuauucauaaaauuagucacaaaaaacugaauacagaacagucacaaauucuagaaaucaaaucguugcuuuuccaauguuguccuacuacacaccaaaggcaauguuuguauauacacaaugcauagugacauuuaaguuccucaccuugccacucccagggccaaccccaccccuguaaauacacacucaggaacgaucaaaggacaagggccucuguuaugaucaccacauggaccaacaguaccacacucugacccacaguccaucuuaguaccaggagauuggucgcaaauagcucugcagacuugcuccuccuguacugucaauggagauuaccauaaugaccagggaauggcuuguggucuuccaggcagcuuaaaacacgugcaucugaggagaauccuguaaagaacuugcaugcuaccuuccacuaguguuccugauuguuagacgugcccauaguccuacuuuagcuuggaaaacccaagccgggccucaagacaacagcaccuccuuaacuguaggcucacagagcaaaugacucacacaacugaaaccuuccaagcucugcaguuccauccuacaugcaggcaaagcccaagucuuuaacauuuacauuuaaaagaauuuucuagucccacagacuaaguauuuuccauuuuaaaggcccacggucuuucuuuguauauucaauuaugcauacaauacccagggcagccaucuguacuucauacaggggaaguccugaggccaaacugcaaucaaauucauacauuaacaauaauuuaaaaguaaaaguggcuaugacuuuuaaagcuagaaucaguuaaugggagagaaaagggaagaaaaagaagaaauaaaaaguaaaggccaucacugcuccuaggucugguggaguagaaaguauauuauacacaaaagugagaacauagccagaccuaguuauacuugggauaauauaaguagacaugaccuugaaccuuguggagagaggaaggagggcagaagcaagagccagaccaggagaucaggaugauuaaugauagaugaaaaggccaguucccaaaugauuggauuccauaaagaaucgcagcugggagauuggcagcccuacuccugggguagauggugagguaugccagcaauaugcuguaacagagagggacuauggucucauuagucauugcccuaaucugggaaaugccccaagauguccaguauggaauucuauugauuauguaaaauugauuacuugauuccucacggugaaugucaccuacugcuagaguagaccuuauuccuccuccuuuucugugcugcaaguauaccagcuucaaaguuggucagugaacucaaccuuauaccugucccucuuuauuuguaacccccuaauuuguaacccuguaacccagggagguuagacaacacucauucccuggugucuuuugucucacugaucagucagaacccagcuugaaaggaguuguaauacuguauuccuccuccucucuaugggagaugaccuugcacuuaccaugucuggaguucugaguuugcgagguccccucacaucacucaguagaggcacucaaaacacauuccacagaaacgcaaaggucagcuaaauuacagggaggaaguugcuggcuuggaaccuggaagagccugccuccucuucugacuggaagcuccguguggagauucugauuggcuugagagucuugagugacauuaucaccaucuuaggguuauggugaacugaagaaauucaguuccaaccugggcuaaugcuuucccagaucuagagauucacaguucaguagcacuagugccucugcuccaguugaguaccuuugugucauccuaccaaaccccuggguguaacuaagauuccugauccaugcugcucaauugucuguuacuucccuuugugggcugugucucuguguucauuguuuugcaaauuuggagcucaucugaacuccaaccacagcacucaggaaguaugucuucuuccuucaagaaucaagcuggauagcuuacauagccuaugaaucagguuacauggaugggugcccagaauauuagcaauuaaagagagauuucaggaaacaagauuuuguucugugguucugacuggguuuaggucaucugcaaguguuuuccacauaaugguuaugagagaagcuucagaacagaguaggaaacacgcgagagacauaguggccuucuuggauuuccucauggacagaaacaagaauacagaggcaaaacacccauacaaauaaaauaacagcuuaauuucugagagagagagagaaugagagagagaggagcaaaauugauaacagguaaagagagcaccgaagaacugggacaauaggauaacucuuaaagucauuucagguguucagaaucagugccuuacaauugaaagaaccuaguggggaaccacacacacacacacacacacacacacucaauucccgaaucagcgcgcacccaaggaauccugagagaccuugaugcaaacauacacaugcuguaguuuaaugacggagcucugggccaacacguaucucacgcaggagacagcgguuuuugaccaugaggcucgaaaguuagggguuuuuauagaaaagagucuggggcugggggaggaauuggcaugguuucacaugauugguucauuuaaauaucagcagaaugauuacacaucagaauaagaguacguguaagucagggugucaggaaugcugagggucuggugcuuaucuaagucagcagagcaucugguuaacauuuaacccagguuagaagggagggacauagggaguugccgggccagucuggacauucuuuuaugucuucccuaucuuuauggcuagccaguuccugagaugacuuuacagccuuuguucuuugcucuaggcccaaaaagcccuccuaucuagcaaaccgcaugagucuugaccuugaauuuuacuuuucuuucacuaucaucuucaaaaugaauauugccaagcaugauauuaugugcuaucaaucccagaaguuuggaggcaaauucagauucauggauuucaggccacacuuaucuacauagucacuuccauaauauaagccgucucaaauaugcuuaguuucuuuaaaggguagauacaguuacacugucaagauccagaaagaaacgaccuaaaucauaugaauuaaaaauuuauuuuauuuccagaccaaucucgcagucucagaauucagagagauaaucagcugugaguaaaaacagugaaacauuuuggagucaaauucaaugcuaagaugaauaguaacuauuacaaaacuggaauuguuuguaguuggugauacaauuaaaaucuguaguuaauaaaaccuacaaugccaggcauugauaguucaugcuuuuaaucccaacacaggggaggcagagcaaggcagauuucugaauuccaggccaggcuggucugaagcugagugaguucaggacagccaaugcugcauagacaaaccaucucuugggagaaaaaaacaaauaaauaaauaaguaaauaagcaaacaaacaaacaaaacauaccaugaacaguggaaacaauuuauacuauguauaucucaagauuauagaguaaaaaaccagucaaaauaacaagguguccuuuaacuugggacaugauuagagaaaacaccauaguuaacaauauagaauuaaucauauuuuaucuuuaggauuaauuuggaacaggaaauaaacaauagcccuuaacuggcccuuaacaaauauaauaugauuguuuaucuuuguuguuauuucucagacaggcccuuauuuagaauaccagcugaacuagagucacuaaauaaacgauaauuuacaacauuuauugaaucuguauaaagaguaguaugauaccccaguguaagggaaugccaggguggggacacaggagugagugacugggaacacccuaauagaagaagggggagggagaggaaauaggagacugggggaagggaacuaggaaaggagauaacauuugaaauguagauaaaaaaaauacucuauaaaaacacucugugugcugucaaaaaagggaggguaguauauauuuaaucuugugcuuuuggaccuccauuccuuacaugauacaagauggagcugaaauguuuuuuggaauugguuggguuauaaguaaaggaaaauguucuuuaaaggauugcuuuuuaagggaagucuauaauugagaaucuugggaucacuccuaauuucaaagguaugggacagaucauacugcccuagagauaguuugaaaaauaucccucccugguuucuauaguuggaagggaucauuuucuguacucugauuuuccaugggacaauucuuuauacuuucuuuuccauugauauugugaaacacaccauagacaaaggaaauuauaauugagggcaucauuuuggacuuacaguuccaaagcauuagagucaauaacgacaguauaaacacauggcaucagguagagcugugagcucauauuuugaaccucuaacaagagguagcuagcaaagugggcaugguuagaagauguuaaagccuuagcaaacaguucaacaaacuaaaauaauaaguauucaaacauaaggggcaaacauaaggggcuggaaauauggcucaguaguaaagaguacugacugcucuccugaguccaaauccuagcaaccauaugguggcucaaaaccauccauauuuacucccucuuauggagugucugaagacagcuacaguguacuuauauauaauaauuaaauaaaucuuuuuuuaaaguauuugaacauauaagucuaugggagccauuaucauuuaacuaccacauguuuuuucaaaaaugaaaacuacuuuuuaucuguccacacuguaccuuaugcuuaagagagauuguuaucuuuugcacauccaaugucacaaaagaaacaauccuuagcagaaauaaacaaaucauauggaaaaaugaacugaccaaagagaccaaaauuuaacagugaaaacaacaaaacuuauagcuucuuguucagcaucuugagauuaugaugacauugccuuagccacaugguuuucuauacucucacuucuccaucucugucaccugcagcacauauagcuucuuuucaguaaauuccauuuccugcuuguagcuuuccucaaagcugguccguguaugucuaguaccuuuuguacaguauucucuuauuuuauugaaaguggguuuuccggagucauaaugggacaagcuaacaucuagcaggugaaauggcgugcuucggauuauuauaauaucugagacagcuuugcccucauuaagcaagccuguaauggauacauuuuaggaaauauuccugcuauuaauaugcuuuuccuguuauuauugaacauauauaacaaucacuaaauaguaccacaccccuuuagagcaaaacucuacaggucuacgaagauguagugaugcuacauagacgaauagaugacuuaagucuuaaugaugaucugauaagaauuccuaaaauuaugucagugauuauuaagcucuuuuauagugggacaaacugcaaugagaagucugccagccucccaagcaucaccaauuaauugcucuuaguaaccagacuuucuccuacucagagcacauuccaagagaauguaaaacaauuuaccaaaggucauaaaaaggaaacuaacaauuuauuauagguccuaggcuagaagauaaaauauugacuguguuuaucuaugcaaaacuuuacuaauaacuuuguuaugguuuuaaaucuucaguaaaccuguggauuugauacaggcaauggauaguuagccauuaguaauuacuccuaaugguaugcauguaaacauucucuguuguaaacuucuuucucaacuuaugauuugauuuuuugugugaauuuguaguguucucugcaauaugugaucagguauucugaaagagguauaaguacagaggacaaagagauaaggaaaagagaaaggggaacuuuuugcccuuccccacuuaggaucuuuucacuuuuccucuuagauagcuuucauaggaaacuuuugacaacuuaguaauaaacucuaacaacuucucuaagugucccauuuucuuccugugacuucugacuugcaggcuacaaguuagugcccaacaauuccuucugagauagagcaaaggccacauuccuucauccucagcuguuaggcuacagguguuaaucaccuaagccaucagucuuuuuacccucagaaagagcaagaaaguuuuuaggaguuuuuagauguuaucaucaguauuucaguacaguuagagagcuagauagccccgagacccucagacuuugaagccaucaccaguguccuauucuaugacuccaccauuacccugcccugggccagaagguuucgagcagugggugaauaggcauggagagaucauucaguuguuaagagcacuguucaaacucauuacuuuuucuagcucucacauggcugaucaacaugugcuguaauuacacuuccguaagaaccauaaaucaaaauaguuggguauaagcuaguaccugggauugcuuuggauguuaacguaaauaaggcaauuccuauaaguccuuauauagauuuaaaaaguaguguuauaaagauauaccucuguugccaaguuccaauccugggcuagaaggaguguucugagagaaggggugucugagagcauugaaaauaaaggauaggcaguugaaucaucacuacaagguuacacccuuuucucugcuggaaacaguuuucuauucugaauucauucuguucugugcucauuuaacugaucaguguucucuggagaucuucaagcagcucccaugacaguucuacaagcaauucucucuuacuauucuaaaaaauucucugguuaggucaucuccuggagaucaaguccagucauuuauuuuacacaucaauccagucauuuacuccaaguuuccuuuucauuaucuuaagaaggagcaucccucuccauaggcccgaguccauugauauugagugauauuauugaccagugauugucaauuccuguugcuuuaaugugauugugaugguucucauauacacuacccaggcaguggcacuauuagaagguguugcccuguuggaguagguauagcuguuuuggaauauguauauaacuaugggguuggccauaagacucuuauccuuccuaccugaaagccaguauucugcuaauagcuuucagaccaagacauagaacuuucuuuuuuuuuuuuucuuacaucgugccugccuggaugcugcgauguuucugccuuaaugaaaauggacugaaacucuaaaccuguaagcuagccccaauuauauguuguaauauaggaguugucuuggucauguugucuauucacagcagugaaacccuaauuaagagagugguauguguguauguggguguuuguguauauguguuagguguguuuguuuuuuuuuguuuguuuguuuguaugugcuucccauguuuuugcuguuauggaauuauuuauuauuauuauuauuuauuuauuauuauauuuauuuauuuauuauuauuacuacuuauuuauuauuuauuugcugugucuucugugauguaguuauccuccuugaguuggagguuugcuucuaguauuuucuuuaggggcagauuuguggauauauauuguuugaauugaauuuucuuguaauauccuguuuacaccuucaaugguacuugagaguuuugccagcuauugguugucacuccugauuuucagcaguugcaagacaucuguccaggcccuucuaccuuuuagaaucucuguugagaagucugguauaauugugauaggucugccuuugcauguuuccucgcuuauuucccuugcuucuuuuaauauuuuucuuugaucuauagaucuuguguuuuauuuaucaaauuguaggaggauuuucuuuucuuguccacucaaaguggcuuucuauacucuccuuguguguguauacucaucuuuuuuucuuuuuuugaaaguuugaugcuuuuuuuuuuuuuuuuuugguuuuguuuugauuuuugagacaggguuucucuguauagcccuggcuguccuggaacucacuuugcagaccaggcuggccucgaacucagaaauccgccugccucugccucccgagugcugggauuagaggcgugugccaccacgcccugcucagaaaguuugauccuuuaauuucauugagaauauuuuuugggccuuggagguggggcucuuuaccuucuuucccuauuauucuuauguuaggucuuuucauaguaccacaaauuuccuggauguucugugucaaaaaguuuuuagauguaacauugucuuuuuuuuuuccauuuuuuauuagguauuuagcucauuugauuuaacauugucuuaacugauguaucaaugcuugugguuuucuuuuccacaccugucuucuguugguggcacuuguaucacucuaguguuacuauucucugccauaagcuuuccaucuccaggaauucaucacuuuguguuucuucauuguuucuauuucugcuugcagguccugaacaguuuuauuuauuuccaccaccuaguuaauuguauaucuuucagcguuuuuuuuuuuuuuccgucuuuaaagaccucuaccucucugauuguaaucuguauuucuuuacaggauuuauuccuuucccauacaaaggccuuuaucaucuucauaagauuagauuuaaggucauuuucuugugcuucaguuguguuagaguauucaggguuugcuguauuagggcagcugugcucugaauuugucauauugcccuaauguuuguugaucauguucuuucugagggccuuuagccaucuggauggcuuugguaccuggauguucccauuguacuggguauugggagcaguuuaccucaauggccuuggugugucaggcuucugaucgguauccuugggcuccaugauaccacaucuucuguucucuauggcucaggagccacaggucugauuaaggugagcagaaauaucaccugggcuagcaggcugcucaggacagcuugacuuuuuucaagggacauagcaugcagggaagacgggugggagaaugguaucuuacauggaugguucagcaucccaggucugaugaucaugggcagagauguuguagaaguaucagaacauuucuuuugaaccuuuccagaugggcugaagaugucuccauuugggcucuuaacaggagcaggucauuaggucagcaagcuccaaacccagagcuggagcuugggcauaggauugacuacacagcguauauauuuuuucccuuuuuguuuaauuuuuaucaagaagucacaugauuuaaccaaaaggaauuccaucauccucugagaccuggcuacacauugaggacaagggcaaaaauauuagguauccccuuuuuguccucucuuucugguguaggcuuccacucuuucucugcaaacugguuucaugauguuaauuucaaaguuuccaacccuucugugguggaagcucaguucuucccaugccccucuuguucuuauuggaggugccauguacuucccccuuaguagucccugugugcuucacugugaucuuuguuacuaagauucacagaucaaagugucugucugcaucuugaggcuacugagcuguauccuccuuguaucccagagugggacugggagggcauuugaaugagaaggauguggugaugaugucuugacacuuugcuuauggaugaaauguguaaacagcaacaauaaugaaaacaguuucucaacugaaagaagacccugcagcuaacaaggagacccugcugcugaggcaggguuaagauugucuacucaagauuuucaacucuuaugcccagauucuggcaguuagacaauugccagccuucuuuuggagcuuuuaaagcagguucaagucuaccaaaggagccauuuuuuuuuaaucacugugagaagggagaaaucauuauuuguggagucuaucagcauaccacagcauaugcaggccuccagacucacuaucagcuguuacauauuuaagaaucccugcugguguccugguucuucuuucccagucccuuagaacaacucucuccucuccaaggcuccucauucccuuugaaaucugcuguuuugccuuugcacucuccuggccccucucucuugaugcacucugucuucaucucccccaucccucauggccaaguccagccugcugccacauucaauccaauucuuucucucucugcucuggaaacuuccagaggauuuuuguccauucucucuugccacacaaccuccaguaagaucugugugacaaguuccacagacugagaucauuuaccuccaaagggcaaggccugcuagaaccgguuguggaacucuucgcuggaaaaaaaauauugaccaauaguucucauggaaaucuaucuguuuuguuuucucuuauuccuuuucuuacuuacauauuccugguagccuaguccaagaucuuaagagagaauaaugaguaagaaaccauccuuaagagaugggggucacuaacaagaucuuauccccggggaaacuaacacuuuacuuuuuuuuuuaauuagguauuuuccucguuuacauuuucaaugcuaucccaaaagucccccauacccaccccccccaauccccuaccgacccacucccccuuuuuggcccuggcguuccccuguacuagggcauauaaaguuugcaaguccaaugggccucucuuuccagugauggccgacuaggccaucuuuugauacauaugcagcuagagacacgagcuccgggguacugguuaguucauauuguuguuccaccuauaggguugcaggucccuuuagcuccuuggguacuuucucuaguuccuccauugggggccaugugacccaucuaauagcugacugugaucauccacuucuguguuugcuaggccccggcauagucucacaagagacagcucugucuggguccuuucagcaaaaucuugcuaguguaugcaauggugucagcguuuggaagcugauuaugggauggaucccugcauauggcaaucacuagaugguccauccuuuugucacagcuccaaauuuugucucuguaacuccuuccauggguguuuuguucccauuucuaagaaggggcaaaguguccacacuugaucuucuugaauuucaugcauuuagcaaauuguaucuuauaucuuggguauccuaaguuucugggcuaauauccacuuaucagugaguacauauugugcgaguuccuuuaugauuggguuaccucacucaggaugaugaccuccagguccauccauuugccuaggaauuucauaaauucauuuuuacgcuuuacuuuuuaaaucguuuauaaaacuauuaugauagauaaaaacuuucccaacaauaaaauuuaauaugccuacauguuugucaucggauguggguuuugguauaugguaaagaaagccuuaauuagauagaauuaaaauaguuuaaauuuaaauauugaagauuuauaaauaucaggcacuagauguuaaauaauaauugaccauggggcuggagaguuaguucagugguuaagagcacugaacauuaaagauuuauuaaucugcuccuagaaauaugccacuggccuuggacaacagcccucacugaauacauccuuuuagaauuguuacauuuugaugauuuauaaugauguuaccuguucuguuugugauucacugaacacauaguuucaggguuguaaugcuuggaugacuuuuaugcuuuauuguaccaaaugauuuuuguugguauuugugauuguuucauuggacauaguuucuaagagauguaauguuugguuuuuuaauguauaaaauccccugcuugguuccugcaaaauacacucauauucagacugccucuguguuuguguuuguuuguaaccaccaaauccuuacucaccuagcuucaagaucccucauucuagggaccuccuuauccgacugggguguuccguggcacucucuuauaucuauaguaaaaaccuuguuuuguauaccauggaaugagcauguccaugguuuacauaucaaccugucaaccucaguguguccuggggacuugagaauuuguuuccuugaaagugaauuugaccuggaaggaaguagguggcucucuaacuugugaucauuucagguuacaaccaaaugguucccuaaaacagaacuuuugggcuugagacagguuuuuguagucucagccagacaugguggcagacaccuuuaauaucaacaccagagaaagagucgcaggcagaucuuugugcagugauggccagccugcucuauauagugaguuucaggucaaccagcauugauacccucucccccagaaaagaaagaaaaagagaaagagagagagagagagagagagagagagagagagagagagagagagagagagaauaaagggucgaaaauguauuuuguuuaguguaggcugcaucauuuccaauguauaaaucauaacauaaauuagcaaucuacaggaauagauuauugugagauguauuaucagaccccuaauuggugugauuggcaagugguaugacuguaaaacaugacucuauuccagcaaguuuacuccuagguguuugcuggaaacuuguauccacaggcaugagcacagacugcacaugggcuugcuugguuuagcagcauucauaguugcuccaauaagaaccaagucaaaucuccagcaaucagagaauaagcaauacuuccuggcaacuaugaaaaaaguaugucugaagccaauggagaugggccuggagaaacacacacaaacaccauauaaacaaacacacacacacauaugcacacaauacucauacacacauaacauauacaugugugugcacucucacacagaccauauacacccccauuacauacaagugaacacaaauacuaaauauucacacaugguuauucacacacacacacacaccauacucacacaccccuuauucacacauacacauauauaccaccugcauacucauaggaaaaguauguuauaaaugugagccagauaaucagaacuguucccauuucacguauccucgaggauguaaaucaauucauaauuuaguagaacuccuuugaauauaaacaaaguaauauuauguuaacauuagauugcucuguucaaugaaaccaaaauuuaaaacaauucauacagauaaaaagacucaucaguauaaucaauguaagaaagauuucacgugugcaaauuuuauuugcaggcaugaaagaaguuguucugcagagcaacccucugaguuc

SEQ ID NO: 1325 - RNA, 48747 nt, Mus musculus
cuuagccacaaugucuuaggaauucccacucuucuagcucugucaccugaagcacacacagcuuuguuuccucaaagucaccaucuucuuucagcuuuccucaaagcugguguuuguaucucaaaucuguaauguauaguacugucucuuauauuauugaaaguagguuagugggcuaagggaucauucaguuguuguuaagagcacugcucaaacccauuucacuuccuagcacucaaauggcaguucacuagucuguagcuacacuucuaugaaaauacuugaguauaagcugguaccuggcauugacuuggaugguuacauaagugauacauuugcucuaaguccugacaucuagauuuaagauuaaugauaucaaaguguacuucuguugccaaggaccaagccugggcuuggaggguaguagagggagaagggguaucugggagcaugaaaacaaagacugguccucaaauccuguguucaagcuuuggcuccucaauucgggacccugugauccauccaauagcugacugugagcauccacuuuuguucccaauucuaagaaggggcaaaguguccacacuuuggucuuuguucuucuugaguuucauguauuucgaaaauuguaucuuauaucuuggguauucuaaguuucugggauauuaucuacuuaucagugaguacauaucaugugaguucuuuugugauugaguuaccucacucaggaugaugcccuccagcuucauccauuugccuaggaacuucuccacauccucuccagcaucugccgucaucugaauuuuugaucuuagccauucugacuggugugagguggaaucucaggguuuuuuugauuugcauuucccugaugauuaaggauauugaacauuuuuucaguugcuucucaaccauucgguauuccuuaggugagaauucuuuguuuagcucugagccccauuuuuuaaugggguuauuggauuuuucuggaguccaccuucuugaguucuuuauauauauacuggauauuauuccccucucugauuuaguaaagguaaagauccuuucccaaucuguugguggccuuuuugucuuauugacaguaucuuuugccuugcaggagcuuugcaauuuagugaggucccauuugucaauucucgaucuuauagcacaagccauuguuguucuauuuaggaauuuuuccccuguacccauacauucgaggguuuuuuccuacuuucucgucuauaaguuucagugucucugguuuuauguggaguuccuuaauccacuuagauuugaccuuaguacaaggagacaggaaaggaucaauucgcauucuucuacauuauaaaggccaguugugccaacaccauuuguugaaaaugcugucuuuuuuccacuggauguuuuuugcucccuugucaaagaucaagugaccauaggugugugaguucauuucugaaucccuuuuuuguuuuguuuuuuuuuuuuuuguuuuuuuuuuuuuugagacaggauuucuauguauaccccugacuguccuggaacucacucuguagaccaggcugaccucaaacucagaaaucugccugccucugccucccaagugcugggauuaaaggcauguaccaccaugccccauuucugggucuucaauucuauuccauuggucuacuugucugucgcuauaccaguaccaugcaguuuuuuaucacaauugcucuguaguacagcuuuaggucaggcauggugauucuaccagagguucuuuuauccuugagaagaguguuugcuuaccuagguuuuuuguuauuccagaugaauuugcagauugaccuuucuaauuuguucaagaauugaguuggaauuuugauggagauugcauugaauuuguagauugcuuuuggcaagauagccauuuuuacaauguugauccugccaauccaugagcaugggagaucuuucaggcaaggauguggagaaagaggaacacucauccauuguugguaggauugcaagcuuguacaaccacucuggaaaucaguccagcgguuccucagaaaauuggacauaguacuaccagaggauccugcaauaccacuccugggcauauauccagaagauguuccaaccgguaagaagaccacaugcuccacuauguucauagcagccuuauuuauaauagccagaagguggaaagaacccagaugccccucaacagaggaauggauacagaaaaaugugguacauuuacacaauggaguacuacucagcuauuaaaaagaaugauuuuaugaaauuccuaggcaaauggauggaccuggaaagcaucauccugaaugagguaacccaaucacaaaagaacucacacaauauguagucacugauaaguggauauuagccuagaaauuuagacuacccaagauauaagauacaauuugcuaaacgcaugaaacucaagaagaacaaagaccaaaguguggacacuuugccucuucuuagaauugugaaccaaacacccauggaaagaguuacagagacaaaguuuggagcugagacgaaaggauggaccaucuagagacugccauauccgggaauccauccaauaaucagccuccaaacgcugacaccaauacauauacuagcaagauuuugcugaaaggacccagauauggcugucucuugugagacuaugccggggccuggcaaacacagaaguugaugcucacagucagcuauuggaugggcccaauggaggagcuagagaaaguacccaaggagcuaaagggaucugcaacccuauauguggaacaacaauaugaacuaaccaguagcccccccggagcucgugugucuagcugcauaugaaucagaagauggccuagucagccaucaguggaaagagaggcccauuggucgugcaaacuuuauaugccucaauacaggggaaccccaggaccaagaagugggauuggguggguaggggaguggguggggggagcgugugggggacuuuugggauagcguuggaaauguaaaugaaauaaauacccaauaaaaaaaaaaucugcaguucauaaaaccuacuaugccgggcaaugauggugcaugcuuuuagucccagcacucgggggcagaggaagguagguuucccaacggaagaacugucuguucuaccaagugaauccaggauagccagggcuacacagagaaacccugucucgaaaauaacaaaauaaauaaauaaaacauaccaucaacaguggaaagaauucauacuagguaaaucucaagauuauagaggaaaaacaagucaaaaugacaagcuguccuuuaacuugggccauuagagaaaaccaccauaguuaacaauauugaauuaaucauauuuuaucuuuaggauuaauuuggagcuggaaauaaaaaauagucuuuaaauggcccuuaacaaauauaauugugauuguuuaucuuuguuguuauuuuucagacagggccuuauuuagaauaccagcugaacuagagacacuaaauaaaugauaauuaacaacauuuauugaauauguaauacagaguagugugaugccccaguguaaggguauggcaggguguggaugcaggagugaauggcuggggaacacccucauagaagagggaagggaggcaauaggagacugggggaagggaacugggaaaggggauagcauuugaaauguaauugaaauguaaauaaaauauucaauaaaaaaaagugagcugucaaaaaaaaaggggggguaguacauauuuaauccugugcuuuugggccuccauuccuuacaugagucuucaauagaagauggaggugaaauguuauuugguauugauuggguuauaaguaaaggagaauguucuaaaaaggauugcuuuuaaacggaaguugauaauugucaaucuucagaucacuccuaauuucaaagguaugggacagaucauacugaccuagagauaguuucaaagauauuucucccuguuuucuauaguuggaagggaugauauucuguguucugauuuuccauggaacuguuuucuuguaauguuauauaaacaaauagaugacuuaaguauuaaugacagugugguaagaauuccuaaaauuauaucagugauuauuaaacucuuuuaugaucggacggcuguuagguaaauuucugauauucaaaagugcaaagagaacuccgccagucucccaagugucaccaauuaauugcucuuagauaguaaucaggcuuucuccuacucagagcacauuccaagagguuguaaaacaauuuaccaaaggucauaaaaaggaaacuaaugauuuauuauaggugcuaggcuagaagaugaaauaugggcuguguuuaucugugcaaaacuuuacuaauaacuuaguuaugguuuuaaaccuucggugaaucugugaaucugaaucaggcgauggauagcuagccauuaguaauuacuccuaaugguaugcauguaaccauucucuguuguaaacuucuuucucaauuuuuuuuuuuuagucuucucagcuuuugaaaggauucuucuuuuuuugucccucuauagaguuuuuuuuuauuacguauuuucuucaauuacauuuccaaugcuaucucaaaaguccccccccccccaacucaccuacccacccauucccauuuuuuuugugugugaacuuguagugaacucuguaacaugugaucagguauucugaaagauguauaaguacagaggacaaagagauaaggaaaagagaaagaaguuuuuugcccuuccccacuuaggaucuuuuugcuuuuccucuuagauagcuuucauagguaacuuuugacaacuuaguaguaaacuccauaaccacuucuuugagugucccauuuacuuccugugacuucugacuugcaggcuaacacuuagagcccagcaguuccuucugagauagagcaaaggccacacugcuuaauccucugcuguuaggcuacaggugauaaucacagaagccaucaguguucuacccucagaaagagcaaggaaguuuuuaggcucagaugcucaaagcaaguauuaacuacauggcguaaggaaagccugagcuacacauguugcucuaaacugacagauauauaaucucuuuagaaaugggaguguaauuauugacuucugggaaacacuggagaauagaaagaagagaucagagcaccuaugcauagagaaaaugaaauuuaaaaaguaauaccaaaaaguggcuuguuaaaaagauaaauauaauugaaaaaauauaucacuguacugauuugaaaaaggucaggcccuuccugguacaaggaauggcauuaaugagauaguguuugaccuugccccuaagugcuuuguuaacuacugagaucuauaaucugacacacacagcuacagcuaauggcguguguuuuacauuucugagcucaauuaaauaugucaacaaggauugcacauauuuacauaauacagauccaaaaaugggaauucauuacccacuggcucaagcuaaccugcccaaauaaaacacccuccaaucuagguuuacuaaauuacauccauacauggauacagucugugaaauuacaaaaucauucucacucccugaaucagguccuucuccauaacagugaccccugcacacacucccuuucccuuuggucugugaccuagcucuugucagcacugcuuuaccugacaguguacacaguaagcuguuccucugguucucauccugccaaguauguuuccacacacaagccccugccacaaagguuuagucuagaugcugccagauaaaguuauuuagaggcuacagccggguccaaggagagacuagguccacaaaggagcacacagguggccccauaugccuggcugaugcuuaccauccaugcgcuggaaagaccuacuacgcaggcauccuuugcuaagaagcuugcuccccaucuuuacaggagaugacuuugcacuuaccaugucugaaauucugaccuugucugagcuaccucgcagcacucaaugaagacaguaagaacacaacacauagaaacacucaggucaccugaguuacagagaggaacucgagggcauaguaccaggaauagccaccuccucuucugacuggcagcuccguguggguguuaugauggcuacugagucuugagugacaugagcaccacccuuaggguuagaguguguugaaaggacacagcuuagugguuccagccugggccaauccuuuuucagaucugcagcuuuguaggacaguagcaguagugagucuccuccaauagcugaucugucuguucucccgccaauuccuugggaggggcuaagauuccagaucaaugcugcuuaucugccugcuucuccccuuugugggcagugcccuuuguucacugcugugcaaauuuugaucuugccugaacucaaagcacugcacucaggaggcacuucuucuuccuccuagaaucaagcugaaucaagcccaucaaucaacuuacauuggagucuccaaugugucccacaaguggacuguugcccagaauauuagcaauuaaagaaauuaaagagagauuuuaggaaacaaggauuuuuucuguggcuucugacuggguucagguccacugcauguauguuccacgugaugguuaugagcuagcuucagaacagagcaggaagcacauaacagauaugguggcuuugcggacuuuccuggccuucgugggcauaaggcauggauggagaaccaaaauacagaggcugaauaaacauacaaauaaauuucuuugagagagagagagagagagagagagagagagagagagagagaguuaguugagggagggaggugguagggagagaacauauugagacacucagcaaagcauuacuucaaacccacuacuuagaacacagaggcugggagauuacugaguuuuaggauagccagugcugcaaaaucaacaugcacacacauauacugacagaggagagagggggagggagagggaggggggagaguggaggggagaggggggagagaaagagaaagagagagggaggggaaaggaagaaggagaaggagaauaaagagagaguagagguaagagagaugauagagaggaaaagaaaaacaaaaugaauaacuaagauaaugaaagcacugaagaauugggacaauacaauaauucuuacagucauuucaguuguuuagaauuaguaccuuacaaucaucuucaaaaugaauauugccaagcaugguaguaugugcuaucaauuccagaaguuuggaggcaaauucguauuccugaauuccggccacacuggucuccauaguaacuuucauaauacaacccauuucaaaaaggccuaguuuuuaaaaggguagauauguuuacacugucaagaaccaggaagaaaugaccaaaaugaugugaaguaaaaauguauuuuauuuccaggucaaucuugcauucuccucugaauuaggagagauauucagcccaaaguacagaguaacuuuuuguagucaaauucaaggguaagaugcaugcuaauuaucacaaacuggaauugcuuugcaguuaguaauacaauuaaaaucugcaguuuaaaaacauaccaugaacagucgaagcaauuuauacuguguaaaucucaagauuauagaggaaaaacaagucaaaaugauaaguuggccuuuaacuugggacaugauuagagaaaacaccauuauuaacaauauagaauuaaucaaauuuuaucuuuaggauuaauuuggaacagaaaauaaaaaauaguucuucacaggcccuuaaauauauaacugugauguuuaucguugauguuguucuugagagagugccuuauuuagaaugucaucccaacuugauucacuaaauauaccauaauuuacaacauuuauuguauguauaauaaagaguaguauaaugccccaguguaagugagugccagggcaaggaggcaggagugagugguuggcggaacacccucaaagaaacagggguagagguagggaauagugaauugggaggagagaacugagagaggggauaacauuugaaauguaaauaaagaaaauauucaauaaaaaauaaggagcugucaaugaaagaaggaguaguauguguguaauccuaugcuuuugggccucaauucuucacaugaaucuucaacacaagauggaguugaaccuuuauuugguauugguugggauauaaguaaaggagaauguucuuaaaaugguugcuuuuucagagaaauauauaauugucaaucuuggaaucacugauaauuucaacggcauggaacauaucauagugcucuagagauaguuggaauaguguuccucccuguuuucuuuaguuagaaguggugguuuuucuguguucugauuuuccaugcaacucuuuuguauauuuauuuucuauugauaucauaaaacacaccauagacaaaagaaauuauaauugaaggcaucauuuugggcuuacaguuccaaagcauuagagucaauaguggcaguguaaacacaugacauccaguaaagcugagagcucauauuuugaaccugagacaagagguagcuagcaaagugagcauggucagaagauauuaaaaccugaauaugcacccauaugacacaucuuuccaaaaggccacaccugugcuccuuugaaaacagucugaccaacuaaaaaaauaaguauugaaacauauaagucuaugggagucauucucauuuaacugucacguuuuuucaaaagucaaaacuacuuuuuaucuguccacacuguaccauaugcuuaagagagauuguuauauuucauaaauccaaugucacaaaagaaacaauccuuagcagaaauaaucagaacauaggaaaaaaugaacugaccaaaugagaccaaaauuuaacagugaaaacaacaaaacuuauaacuuccaguucagcaccuugggauuaugguuuaauugccuuaaccacaagguuuuagguacucccacuucuccagcuaugucacuugcagcaaacauagcuucuuuucagcaagcuccauuaaccauuuguagcuuuccucgaaguucguacuugaauaucuaauaucuccuuuacaguauuuuauuuuauuuuauuuuauuuuauugaaaguggguuaguuggcaugcagggaucauucagugguuaagagcacuguucaaacccauuacuuuuccuaggucucacauggcugaucaacauguucuguaaguacacuuccauaagaaccauaaaucaaaauaguuggguauaagcuaguauuggcauugcuuuggauguuaacauaaaugagaccuuuccuauaaguccugauauagauuaaaaacuuaguggcauaaaaauauuccucuguugccaaguuccaguccugggcuagaaggaguguucugagagaagggguaucugggagcaucaaaaauaaagggaaggcaguuuauucaucacuacaagguaacaaccuaugcucugcuggaaacaguuuucuacccugcguucauucuguucugugcucauuuuaucugaucugccucucuggagaucuucaagcagcaauccaugagaaucuucuacaagaaauucucucuugcuauucuaaaaaauucucuggguaggucaucucuuggagaucagaguccagucuuuuauuuuacauaacaauccagucauuuacuccaaguuuccauuugauuaucuuaagaaugugcaucccugagcacacaccugauucuuagcagaaagcaaguacacauuuucuuauaaaauugcagaagaauuuagaggucuaccugccucuguuaagcacagauacuaaacuagcugagugcaacccaguccugaaauuccauuuccaaaacaccuggguuaaccuugaucuguuccaggcugauauuuaacucaggaaucucuuuggcuuuguaaauauagauaacagcuauaacaacaaaaauuuaucuggguuaaaucucuugugaucaccacucucuaagucucauuaucuucuauauccuuccuuaguaucugucugauaaguuggcucacagcacaccuacuuucuuuccuuuagauuugugaagccccucauaguucaauuugcauuauuguuuuuugaggaauuacauauuuggaaccuaagaucuuagaggucuuuuccacagccuuaagggcuguccugaaguuugcagcauuuaccauuuuacugagacauuagccaccccuuugccuccuggucuuguagccaaaauggagucauuaauauuaacagggaagacauucuuuaaagcaauauuguaaugguuuguauauucuuggaccacggaguggcaccauuuggagguguggccuuguuggaauagguaugaccuguuuggaguaugugugucaguugggugugggcuuaauacucucacgcuaugugccuggaaggcagucuuccacuagcagcuguuggaugaagacauagaacucucagcucugccugcaccaugacugccuggaugccaccaugcucccaccuugaugauaauggacuaaaccucugaacccauaauccagcccuaauuaaauggguuuuuuuuuuuuuguuuuuuuauaagacuuccuuggucauguugucuguucauagcauuaaaacccugacuaagacaucuuguguucuccugaagggaaguauuuacagagacaaaguuuggagcagaggcugaaaagaugaccauccaagacugcccaaucuagggaugcaucccauaaacaaccaccaaaaccagacacugcuguagaugccaacaagaguuugcugacaggauccuucagucuuugcuccaaacuuugucucuguaaauccuuccacgauuauuuuguucucccuucuaagaacaauugaaguauccacacuuuggucuuccuucuucuugaguuuuaaguguuuugcaaauaguaucuuagguacucugagauucugggcuaauauccacuuaucagugaguguauaucauguguguuauuuugugauuggguuaccucacucagggugauauccuccagauccauccauuugccuaagaauuucauaaagucacuguuuuuaauagcugaguaguacucaguuguguaaauguaccacauuuucuguauccauuccucuguugaggggcaucuggguucuuuccagcuuuggcuauuauaaauaaggcugcuaugaacauaguggaguauguguccuuauuacaaauuggaacaucuucuggguauaugcccaggaguaguauuauuggauauucugguaguacuauaaccacuuuuauggggaaccaccaaacugauuuccagagugguuguaaaagcuugauagcccaccagcaauggaggaguguuccucuuucccaacauccucaccagcauaugcuaucuccugaauuuuugaucuuagccauucugaccggugugaguggaaucucagaguuguuuugauuuacauuucccugaugauuaaggaauagaacauuuuuucaugugcuuaucauauauucuguauuccucaguugagaauucuuuguuuagcuuuguaccccauuuuuuaauaggguuauuuaauuuucuggaguccaccuucuugaguucuuuaaauauauuggauauuaguccccuaucugauuuaauauugguaaauaucuuuucccaaucuguugucagacuuucugucuuauugacaguguccuuugccuuacagaagcuuugcaauuuuaugaggucccauuuguugauucucaaucuuacagcacaagccauugcugaucuguucaggaaauuuugccuuaugcccauaucuuugaggcucuugcacauguuccuuucuauaagugucagugucucugguuuuauguggaguuccuugauccacuuacaccugaguuuuguacaaggagaugagaauggauaauuuugcauucuucuacauucuacccaccacucgagguagcaccauuuguugaaaauguuuuccuuuuuccacuggauaguuuuugcuccuuugucaaagaucaagugacuuccuccuuuccaguaugaauccccuuaauuuccuuuuauugccuaauugcucuagcuaggauuucagguacuauguugaauagauagggagagagugcgcagccuugucuagucccugauuucagugagauugcuucaaguuucucuccauuuaguuugauguuggcuacugguuugcaguauauugcuuuuauuaugucuaaguaugggccuugaauucuugaucuuuccaagacuuuuaucaugaauggauguuggauuuugucaaaugccuucucagcaucuaaugagaugaucaugugguuuuugucuuugaguuuguuuauauaguguauuuuguugauggauuuccauauauuaaaccaucccugugucucugguaugaagucuacuugaucaugagggaugaucauguugauauucuuggauucuggcuaaggguuuaucuauauugaugauuuccucaaagaaccagcuccugguuugguugauucuuuuuauaguucucuucauuuccacuugguugauuucagcccugaguuugauuauuuccugccaucuacuccucuugggugaauuuguuuccuuuuguucuagagcuuuuagaugugccgucaaacagcuggggugugcucucucuaguuucuuuuuguuggcacucagagcuaugaguuuuccucuuaggacugcuuucauugugccucauaaguuuggguauguuguggcuucauuuucauuaaacucuaaaacgucuuuaauuucuuuaauucuuccuugaccaaguuauugaguagaguguuguucagguuccacaugaauguuagcuuucuauuauuuauguuguuacugaagaucagccuucaucugugguguucugauaggaugcauggaauuauuucaauauuuuuguucuguugaggccuguuuugugacgaggccagucaguuuucuucaguuuauggacaguuuuggagaagguaccaugaggugcugagaagaagauaaauccuuuuguuuuaggaugaaauguucuagagacaauuguuaaaauugguucauaacuucuguuaguuucacuguuucucuguuuaguuuccauuuccaggaucuguucauugaugagaguaggguaugaaagucccccacuauuauugugugaggugggaugugugcuuugaguuuuagcaaaguuucuuuaaugaauguggauguuccugcauuuggagcauagauguucagaauugagaguucaucuugguaaauuuuaccuuugaugaguaagaagugucccuccuuaucauuuuugagaacuauagguuaaaagucaauuuuauucaaauggucccagcuuguuucuugggaccauuugcuuggaaaauuguuuuccagccuuuuacucuaagguagugucugucuuuguccuggagguggguuucuguaugcaccaauauguuggguccugcuuauguaaccugucuguuagauauuaagagauauuaagaaaaguaauuguuguuuccuguuauuuuuauuguuagaauugguauucuguccucguggcuauguucuuuuagguuuguugaaggacuacuuucuugcuuuuucuaggguguaguuuccauccuuguguuggaguuuuaucuuuauuauccuuugaagggcugaauuuguggagagauauugugugaauuugguuuugucauggaauacuuugauuucuccaucuaugguaauugagaguuuugcuggguauaguagccugggcuggcacauguuuucucuuauggucuguauaacaucuguccaggaucuuguugcuuucauagucucuggugagaacucugguguaauucuaauagguccgucuuuauguuacuugacccuuuucccuuacugcuuuuaauauucuaucguuauuuagugcauuuguucugauuauuucguguaggggaggaauuucuuuuccgguccaguguauuaugaguucuguaggauucauguauguuccugggcaucucuuucuuuagguuagggauguuuucuucuauaauuuuguugaagauauuuacuggcccauuaaguugaaaaucuucauucgcaucuauaacuauuauccuuagguuuggucuucucauuguguccuggauuuccuggauguuuuggguuaggaucuuuuugcauuuuacacauccuuuuauuuuuguguccauguuuucuaaggaaucuucuacaccugagauucucucuuccaucacuuguuuucuguuggugaugcucaaaucuaugacucaugauuucuuuccuaggauuucuaucuccauagcugucucccuuuggguuuuauuguuucuacuuccauuuuuaggucuuggaugguuuuguuuaauuccuucaccuguuuauuugcguuuuccuguauuuccuuaagggauuuuuguguuuccuauuuaaugacuucuagcgguuuaacuguguuguccuguuuuucuuuaagggaauuauuaauguccuucuuaaaauccuuuaccagcaucacgagauaugguuuguuggguuauccaggguuugcuguggugggauuacagguuucugaugaugccaaguguuuuugguuucuguugguaagauucuuauguuugccuuuugccaucugguaaucucugguguuagauguucuagcugucucugauuggagcuuguuccuucugugugucuguuagccucugucaguacuccugggagacaagcucuguccugaguuccugggucagagcacucccuacaggccaacucuccucugucaggaaaggugcacagaggacugaggaucagcuccaccuccuggcugaggaugaaggacugaagggauccuguccaagaaccucuuuuccuucugcagcccacgugcucuccuguguggaccugccucaaagacacccuggauagaaaaucagcaauagcauuucuacaaaccaggagaagccugguaaaaagagagccccaaaaucaauccaggcauauauagucaacaaaauuuuguccccaaaguacucuuugagucaucucuuuaaccacucagggcccguuuuuucauuuauuuuuaaagguucuuaaugguuagacuuucuuuuuaguucuuuguacauucuaucuaugauucucuuucagaugagcaucuggcagagaggccucuccugucuuguaagccucuccucuucacucaccugacacuucaguguucagcugcauaugguccccuuugucaguaauugcucucauccucugcugcacaagggucuuguuuagaaauuccucuccuguacuucuguguugaugcagagucguugauauuucuggugcagccuuggaguacaaaguccuguguugauguccuugauccaauuggaauuaaguucugugcaggaagaaaagauuggcuucuuuuucgugaauauugauuuucagauguaugggugcauguaggaauguuaaugacugugaggauguguuuuugcauguguguggagauguaugugauccuguuuguauuugagcauguuuaaagggugcauguguaugugugagcacaggguuugcacaugcauaugcaugugugugugugugugugugugugugugugugugugugugugcauguaugugugucaucugguguuugugcaugugagugugagcaaaugugcuuggguuacuugugugaauguguguaugagaauaugggggagugcaugugugaaugucugucugugaaguuguugcaggggugcauuuguguuugugugagcaugugagggaaagaguuucuuguguguauguguuuguauguguguggaagggagcaugugugcaagucagggucagguauguggugugcauuuuuguuuuagcauguuuaugugcauguauguaugcauaugugggugugagcuugugacugagaaugggacaugcauguguguauguuucugcaugugacaguugaauaagcaugugcauguaugucugugugagagcaugugagugggguucauguaugaaugugugugugucuguguguguguguauguguguguaugugugugugugugugugugugugugugugugugugugucuuugucagagauaaugugaccuuaugcgguuauaucuggaucuucuauuccagugguucaauccgugucugguuaugugucaguaccauucugauuuuuauuacuucagcuuuauagcauaauuugaaaucaaguauggugaugaccugcaauauguccgaacacagggguauuuugaacaaauaaaaucacugguagauuuucuaauuaauaaguuaaaugaauuauuucaaaacacagaaaccuuuaaaauaguuuuauuucacaccuuguuucuagcugguaccaccugcaugaggcaaccaaaaauauugagcaauauuugaggucgccacaagagggccaccgaaaccuuccugacuugugggauucucagggauugggagaguggggggugaggggggaauggcaagcucgcuuuuugagaagccccugcuuuguuuuucuuuggacaaauucugucacuuuugcccuuguccuuccugcauccacuuuucaucuuagacaggcacauccuugaagucuguacauuagcaccagcucugaugucucaacacugaggugggauccuggcuccauggcagugacaguucacaagaugucacaggagcuucucaugugucaacuacccaaggcagugacccuggacaaugauuacagcaaguuuuuaaugggguguuuguuguuaaauguauccuggggagaugggaaggaacuucuuuuccuuccugauagagcauguugagagauaggagauggcuccacccaaguacugcuuuggagcaucaguggguuuucuuguugcugcgaauaaauacccaacaaaaauauuuuaggauuaugggaaggaaagguuuaucuuggcccaugauuuucggaaguccaucauggugagaaaggcaguguuggaagugggagacaggauggggaggacagugagauagcugggaggagggggggcaagugauuaagaagggaacuagugggaagagggaggcaggaggggagagggagcuagguaggaguggaaugcaugauuuggaguugaaaguauccugucacauuucaucuuuuguccugacauagggagauuaaaaaguguuccucucauuuuucaccuuagcugggccaagauuuggagccauuucauucugggugcuuugaucuuuuuuuuuuuuagcuucucucaaacuccccaaaacaaccaaaacuuugucucugaagugauuucaagcccagugaaugggagagaaauuauuauugagcuuuucagauuaugguugacauagucagcuagcugaguuacuaacaaagcaacccaauaugggggaugacuuggaggaguugaaucccuggaguuugcuauacugcuugcaggcagugcuaccagggagucaucucucccuuagaaacugguucuugcuuauacaaccccacugguaacacugugagucccauaaccuccuuugaguuaguuucagauuggagguaguauacaguuguaggucaagccaggguuagcauaguaggaaucugcuguuuccuggcugcagaaaugaaugaugccugacagagagugagacugagggaagcuguccaucaagagauagacuagugagaugugugcacuuggcauucuuuggacaauaccuuucauguaauauauacuuuauguuucauuuuuuaaaauccucaaaagagaaacaaaauguuuaaauuuauugguacgucucaaugcuauucuuacaauaaaauacccuaggaaaagcaaaugggaaagaaagggucaucuuagcucauagguccgugguaugguccaugaugguauaauguuguggugucaagagccugcgacaagagugcacaccugggcuggugagauggcucaguggguaagagcacccgacugcucuucagaagguccgaauuucaaaucccagcaaccacaugguggcucacaaccauccguaaugagaucugacuccgucuucuggagugucugaagacagcuacaguguacuuaaauauaauaaaucuuaaaaaaaaaagaaaaaaaaaagagugcacaccuaucaacagucaagagcagagagugcucagagcauuuuugcuagugcacaguuugcuuucuccauucuuuuacaaccugccuaggaaauggagcaaaucucagugguaauucucuucaucuuaauuaauauaacuaugacaguaucccacagcuauugugaaaggcuaaccugauucagaugaugccuccuugagacuuuccuaccagaugauugaagauugugcuaaauugagaauuguuuuaaaguuccaugggcaugcuccacugccgcagacccucugggucccugugucugcguggaacggggucucucgacgcgggugggaaaagcguggaugaaugacagacagaugcacacaggaaagguuguguguagaaucugaauguaauuuacaauucgagcuucagacuuuuauacagaagacaauaaaaaaguugggugacauacccgcaagguacaaaugagguaaccggaugcuuaaugauucuuacacagaacagaggaaugaaaacgcaaagaucggaaggaacugggcaauaaaauaauugagacaaagucagcccuaucuaaggucagcuauagucuuagaagccaggugugagaacuuuucacuccuagggcaagggcuuucacauccaagucaugguucuaacuagggaguuccguucuagcuaaccaucucaugaauaaugcaauacucuaaaaccacagcccgaucugcuuccuaaaccauaguaaauuccuguaaaucgguguaacucagcuauaauucuaagcaucuauucugguuuccacuacggucagaaacuucuuucuuccuaggugaugguagauuccugugaagggcagugaccuaacuuuuacucaaagagauaguguaauaccaggggcaguacugaauuccaaacccaaggucuugauaaggacgaacuaggacuguuggaacacuggcggacggcuuuagcuaugucagaauucaaucuuaaaaggcacuuaugauaggaaaauauugaaagagagcacguggauccauacacuagacuaacucaggaauggaacucgggaaugaaaaauuacuguauggguagggaacccuagacuccaggaggagagcuuccuugaagcucuuuugccucaugagugacuuuuaagccuuucggccuguccaguugacucgaccggagaguguagcacuccacaauaccuauucuucgagaauaauaaggaaucccaauaauaugacaaauauuaaauuguuaacaaaacaucacaaaugccugacuguaauggucaguaacuuuaucugucuucaugucauuuugaacauccaguauauaaaaacaauguaggcaaugacuaguuucauauuuaguugcuuauccuguuaaagcaguugcagauagaaagccuaaaaagguaucaauagucauauauacauuguuuaacauuuuuuaaauucagauacauaaguaacauccauuugccauacuugauuagguauguguucuuaaggauuaacaccauuaugugguacaggaagaaauugaggacacugaagacaaguuuuuauaaauugacaugcacauuuucuagaaauaccaaauuguugucucaaccuauuaguauuuuaaugauguauagaaugagaguguuuggcugaacuguuccuguguaaugccuauucucugccugauaugcaaaccugcuguggcauugcccucauuaaagggucuggaacacccaguaugagcuuuuaaaugucguauaaccuaaggaacaguacaagcucuuaaauuaaguugcauuugcauaaauaauuccaaaauuugaguacuagcaguaacuaaaaauggaacaaagucacgcaauuguaagccaugagguauauacuggccaucaguauauaaacucaaagcuuguuuuuucaacguuucaaaaacaguggcuauaguacauuauucaaauauuugugaagcauuggggaaacucaagagaauaaacauaugauccaauaacgcaugcuaccuucccuuuagaugagcugucuguaaacacaauaaaugcauucucuaucagcugcaugaguaaauuuacaggaaauucaaaaguaugccuagaggcaaauucuaacaacuugccuuuuggauaauaacuaucaaauuugccuaaaauguuugcacauucaauagacuaaauauaagcauucuucaguaaccaauuuaaaugcuguuugaaauacggaauaaauauuucaucagguucuuuuccaaaauacuuuugugauucuauccuacaauucuuuuucaacauagcaacaguuucauaguagagugugcaaacuuuacuuggagaugaagaaugaugaauacacauuaauggucccuuuugcuaaaggacugcugugaaauagucaacaauugaucuuagucuauauaucuguuguuggcuaauagcuuccucuacuuucagcaaagcuuuucauuccucaucaguuauuuuuccaggggaauuaggauuugcauuucccuugagaaauaacaaacagacauuuaaguucuucuguggcaagcuuaaggugaggucuuagccaacuaacauucccuaacagcuuuugaaaaucauuuaaaguaaguaaacuaucuuuucuuauuugaauuuucugggcaacaauuucuuuaguguauaacagaugccccaaaucuugaaaaggauauugucuuuaaaucuuuucuucuccaagauuuuaaagcuuuuuguaucauaacaaaggccuguaguaaaacucuuucagagggaucgucuaauaaaauauccauaucaugaucaauacacaaaguaggauucaaaguccuaacuucuuguauugaagcagaaacaaauuuuugacaugauguagggcgacugacccuuccuugagaaauuccauugaagggagucaaaugauaucacuucguggcuuauuuaaaauuacaagcagacacuucaaaugcaaaccuuuuacaacccucaagaugcaaaggaauacuauaaaaaugaucuuuuaagucaauaauaaucuuacaccuauuuuugaaaugucagcuaaaguagguaagacaguuuugaauguccucuuaagucccagguucauuauccuuucauacaucuuaaguuuugaaauuuauuuucuuauacuuuugguugugagccuagccuuuaacggcugagccaucucuccagcccugaacuuuauuuucggucauuggaauaaccaguccuuuggaggugagggaguacaucagcuccagugccuauuaauccuuccaaacaguuuccuucaauuaguaauuuaagguuaggucucuuaauagcaacagauuggacccaguacacauaggugaaaccaaagcuaccuuguccucucacacauuuagcagauacaagggaacuaaauuaaguugaacaauucuuuuguuagcagguacacauauaauggggcagccauaauucuaauuucaccugcauaaucauugucuauaaugugugaauagaucugcaguauuuuuauaauagugcugcuucaguccagaaauuaucucuggucccuggagucaaugggccaaaaacuccuguaggcagaguuuagacccccauuucugaggccaguacaggugauccuaaaacucaguaaucucccugccucugugcucugauuugguucucuguccauaccugauggccacaaaggccaggaaagccagcaaggccacaauaucugucuuguguuuccugcucugugcuguaguuugcucauaaccaucauguggaacauacuugcaguugaccugaacacagucagaagucacagaacgaacucuuguuuucucaaaucucuacuuucuuuaauugcuaagauccuggccaaccgcccacuugugggacaaauuggugacuccaauguaagcugauugaugggcuaugcaagcucuucagcuugauucuaggaggaagaagaagugcuuccugagugcagugcuuagacaucaggcaaguuuuuugcacagcagugaacaaagggcacugcccacaaaggagagaagaaggcagauaagcagcuuugaucuggaaucuuagccccucccaagggccuggcuggagaacagacagaucagcuauuggaggagacucacuacugcuacuauccuacaaagccacagaucuggaaaaggauuggcccaggcuggaaccacuaagcuguguccuuucaacacacucuaacccuaaggguggugcucaugucacucaagacucaguagccaaucagaacccccacacggagcugccagucagaagaggagguggcucuuccugguaccaagcccucaaguuucucucuguaacucaggugaccugaguguuucuauguguucuguucuuacugucuucagugagugcugcgaggguagcucaggcaagcucagaacuucagacaugauaagugcaaagucaucucccauaaaaaagagggacgggggggggagcaagcuucuuagcaaaggaugccugcguaguaggucuuuccagcgcauggaugguaagcaucagccaggcauauggggccaccugugugcuccuuuguugaccuagucucuccauggacccggcuuuagccucugaauaacuuuauugucuggcagcaucuggacaaaaucuuuguggcaggggcuuguguguggaaauauacuuggggggaugagaaccagaggaacagcuuacuguguacacugucaggcaaaacaguacagacaagagcuaggucacagaccaaagaaaaagggagugugcugcaggggucacuguuauggagaaggaccugauucagggagugagaaugauuuuguaguuuuacagacuguauucauuuauggauguaauuuaguaaaacuagauugguggguguuuuauuuggacagguuagcuugagccaguggguaaugaauucccauuuuaggauauguauuauguagauuugugcaauccuuguugacauauuuaauugagcucagaaauguaaagcacaugccauuagcugucucugugugagucagauuauagaucucaguaguuaacaaagcacuuaagggaaaggucaaacacuaucucaugaaugacauuccuucuaccaagaaaggccugaucuuuuucuaaucaguacagugacauauuuuuaauuuuuuuucuuuuuuaaagauuuacuuauuuauuauauguaaauacacuguagcugucuucagacacuccagaagagggcaucagaucgcauuacggguggaugugagccaccaugugguugcugggauuugacucaggaccuucagaugagcaguugguguucuuaaccacugagucaucucuccagcccuugguauuacuuuuuaaauuccauuuucuuuaugcauaggugcccugaucucuuacuuguuucuauucuccaauguuucccagaaaucaauaguuuuauuccuauuuguaaagauuuuacauaucugucuguuuacagcaacaucuguaguucaggcuuuccuuaugccauguaguuaauacuugcuuugugcaucugagccuaaaaacuuucuugcucuuucugaggguaaaagacugagggcuuccgugauuaucaccuguagccuaacagcugaggauuaagcaguguggccuuugcucuaucucagaaggaacugcuggacucuaacuuuuagccugcaagucagaagucacaggaagaaaaugggaugcucaaagaagugguuauggaguuuauuacuaaguuguaacaaguuaccuaugaaagcuaucuaagaggaaaagcgaaaagauccuaaguggggaagggcaaaaaacuucuccuuucucuuuucuuuaucucuuuguccucauuacuuauacauccuucaguauacaugaucacauguuaccaaguucaucacaaguucucacaaaaaaucaaaucauacacugaaauagaaguuuacaacagagaauguuuacauguauauccauuacgaguaauuacuaauggcuaaguauccaucgccuguaucagauccucagguucccugaagguuuaaaaccauaacuaaguuauuaguagaguuuugcagagauaaacacaguccauauuucaucuucuagccuagcaccuauaauaaaucguuaguuuccuuuuuaugaccuuugguaaauuguuuuacaaccucuuggaaugugcucugaguaggagaaagucugauuacuaucuaagagcaauuaauuuaugaugcuugggagacugguggaguuuucuuugcaguuuugaguaucagaaauuuaccuaauagccgucugaauauaaacaguuuaauuaucacugaaaccauuuuaggaauauuuauuggauugccauuaagacuuaagucaucuguuugucuauauaacaucacuagaaaacaguacaucuucauagaucuguagaguucugcucuaaaggggugugcuucuacauagugauuguuauauaucuuuaauaauaacaggaaaagcauauucaucucaggaauauuucauacaaggaauccauuacaggcuugcuuaauaagggcacagauguugcagauuauauaauaauuguuugaacauauggaggauggaaagguugcucagugguuaaaaucacugacuguucuccugaagguccugaguucaauuccuagcaaccauauggcggcucacaaccaucuguauugagauuuaacucccucuuaugaugugucugaagacagcuacaguguacuuacauauaauaauuaaauaaaucuuuuauuuaaaaaguauuugaacauuucuggaugaucacuugcuagauauuagcuuguccuauuauggcucuggacaacccacuuucaacaaaauaagagaauacuguacagaagguauuagaguuacaagggccagcuuugaggaaagcuacaagcaggacauggaauuuacugaaaagaagcuauguguguugcaggugacagagcuggagaagugagaguauggaaaaccauguggcuaaggcaaugucaucauaaucucaagaugcugaacaagaagcuauaaguuuuguugucuucacuguuaaauuuuggugucuuuggucaguucaauuuuuucagaugauuugauuauuucugcuaaggauuguuucuuuugugaccuuggauguacaaaagauaacaaucucucuuaagcauaugguacaguguggacagauaaaaaguaguuuucauuuuugaaaaaacaugugguaguuaaaugauaauggcucccauagauuuauauauucgaauacuuuuuuuuuaaaaaaagauuuauuuaauuauuauauguaaguacucuguagcugucuucagacacuccauaagggggagucaaaucucagcacagaugguugugagccaucauaugguugcaaggauuugaacucaggaccuuaaggagagcagucagugcuuuuaaccacugagccaccuuuccguccuccauauguucgaauacuuauucuuuuaguauaucggacuaauuaugaagguuuuaacaucuucugaccaagcccacuuugcuagcuaccucuugucuaguuucaaaguaugagcucucagcucuaccugaugccauguguuuauauugccaguauugacucuaaggcuuuggaacaguaagcccaaaaugagccuucaauuauaauuuccuuugucuaugguguuuuucaugagaucaauagaaaagaaauauacagaggaguuccauggaaaucagaaaucagaauaucaucccuuacaacuauagaaaccaaggaggaauauuuuucaacuuaucucuaggucaguaugaucugucccauaccuuucaaauuaggaguaaucccaagauugacaauuaucuacuucccuuaaaaagcaauccuuuuaagaauauucuccuuuaauuauaacccaaccaguuccaaauaacauuucugcuccaacuuguauugaagacucguguaaagaacggaggcccaaaagcacaggauuaaauauauacuacuacuuuuuuuuuuaacagcucacuuauuuuuuauugaauauuuucuuuauuuccauuucaaauacuauccccuuucucaguucccuuccccaagucucccugucugagaaauaacaacaaccaagauaaagaaucacaauuauauuuguuaagggccaguuaagggcuauuguuuauuuccuguuccaaauuaauccuaaagguaaaauaugauuaauucuguauuguuaauuaugguuguuuucucuaaugucccaaguuaaaggacaacuugacauuuugacuuguguuucaucuauagucuugagauuuacaaaguauaacuuguuuccacuguuccacuguucaugguauguuuuauuuauuuauuuuauuauuuucgggacaggguuucucuguguagcccuggcuauccuggacucacucaguagaccuggcuggccuucaauugggaaaucugccugccuaugccucccaagugcugggacuaaaagcuugcaccaucauugcccggcaucguagguuuuaugaacugaagauuuuaauuguauuaccaacugcaaggcaaauccagguuuguaauaguuacuauucaucuuauccuugaguuugacuccaaaaaguuuuucuguuuuuacuuacagcucauuaucacucucaauucagaggagacuggaagauaggccuggaaauagaauaaauuuuuacuucauaucauuuaggucauugcuuccuaguucuugacaguguaacuguaucuacccuuuaaaaaacuaagccuauuugauaugguuuauauuauggaagagacuauguagacaaguguggccucaaauucaaaaauaagaauuugccuccacacuucugggauugauagcacauauuaucaugcuuggcaauaucauuuugaaaaugauuguaaggcacugaugcuaaacaccugaaaugacuuuaagaguuauugcauuguuccaauucuucagugcucucuuuaaauuuuauucucuuucucuccccuccgucccccgcccccucucucucucucagaaauuaaccuguuauuuuauuuguaugguuauuuugccucuguauuuuuguuucuaucugugccugauggccacaaaggccaggaaagccaggaaggccaccaugucugucauauguuuccugcuuuguucugaagcuugucucauaaccaucaaguggacuugcaggugaccuaaacccagccugaagacagaccaaaaucuuguucccuaaaaucucucuuuaauugcuaacauucuugucaccuguccacuugugggcacauugguaacucccauguaagcugauuuaugggcuauguaagauauccagcuugauucuaggaggaagaaggaggcaugcagagggagugcugugguuggaguucaaaugagcuccaaauuugcaaaacagugaacacagagacacugcccacaaagggaaguaacagacaauugagcagcauggaucugcaaucuuaguuacuccaagaggcuuuuaggaggaugcacagguaaucuauuggagcaaaggcacuagugcaacugaacugcaaaucucuagaucuggaaaaugauuggcccagguuggaacugugucccuucaacacacccuaacccuaaggguaguuaacaugucacucaagacucuugagccaaccagaaucucuacacagcugccagucaaaaaaggaggcagcucuuccugguuccaagccagcaacuuccucccuguaauucaucugaucauugcguuucuguggaauguguuuugagcgccucuacuaauugauguaaggggaccucacaaacucaaaacuccagacaugguaagugcaaagucaucugccacagagaggaggagcaagcagcuuagcaagaaaugcacuuguaguaccacuucccagcaccuggaugguaagaagcaggcagcuagaugaggccaccugugagguccuuugugggccuagucuccucuuggaccuggcuguggccucuaaauaacuuuauuauugggcugcaucugcacaaaacauuugcaggaggggcuucucuggagaaauguacuuggcaggaugacaaacuugacagccuuuguuucuauguuauuuucucuaaguucugcccuuagcaguuaacauguaggugcaagauccauuuggaguuguuuuuguggagguuguagaagacauuuuaugugcuggguagcacuccaauauuaagcccugauguacaaggguagaguugaugauguuauggauucaucaaugcuuagguaauauuaagugacacuaaguagaauguagcugagguagggcugccuguaaaacaccugacagguauguaguaugcuaagcaguccuguuaaagauuauuauggccauaugcauguuuauuuuccaggguuaucugaaauuugucuccaaaccauaacaaaagggacaaaucugcuauacagucaggcauuagaccuaugcugauaucaaagaacagcccccgaacaagcuacucacaauggcauuauagggucacaaccaaccuuaaggccugguaugccauaaagauauauuuuccuucauggaaaaagcauaguuuugccucaagggcaggacuacagcuggugacagcucuuugaaaggaaaaauacuauuguguugagggcugguccacucaaguaaagcuugauccuaauguguggagaauugcauaucuauccuaaauuccagaccuuuaagauccuggagccuuaagccuuaggagcuugaccuaaggccguuguguauugaauacaaaacagugcucauucucuuuuuuuuuuuuuuuuuuuuuuuuuaauuuuuuuuuuccauuuuuuauuagguauuuagcucauuuacauuuccaaugcuauaccaaaagucccccauacccacccacccccacuccccuaccugcccacucccccuuuuuggcccuggcguuccccuguucuggggcauauaaaguuuguguguccaaugggccucucuuuccagugauggccgacuaggccaucuuuugauacauaugcagcuagagucaagagcuccgggguacugguuaguucauaauguugauccaccuauaggguugcagaucccuuuagcuccuuggguacuuucucuagcuccuccauugggagcccugugauccauccauuagcugacugugggcauccacuucuguguuugcuaggccccggcauagucucacaagagacagcuacaucuggguccuuucgauaaaaucuugcuaagcucauucucuuaaaccaggauuagcauuaggagagguggcaauggucuguggcuagggcuucugggagaagguucagauccugagauuccaacuuucuccacaauguggcgauaugguucucagucccaaguucacggggcuuggucagucaugguuuuuugauacuugguaguuauguuuugcagugcuguuuuauuagacuucugaguuugucccaguguaugcuaguuucugcagacuucauagaggucuccauuucuuuccacuuaucccuguaaguagaauacaacaugcuacucuuaaguuuacuuggcauaagacauagcuuguguaaacucuccccacugcagcuguugcaaauucuaccuucuccuuuugcuauuuuucucaucucuugggaccuccaacucaggaacccaucacugaaaaauggcuugcuauuucagggcucugaggcacuuaauaaaugauucugggggucuuugcuuuguauuucuccuagcugucuuaaguaggacuuguaaucucuaguccauauuuaaauuguucaaaauaaccuggggacugaacuggaaagaaacuuauggaugagagcauauguggaauccaaaaaaccuauuuuuggcuagcaggucuuugagcauuagccgcagcugaauucaugaugccauuaagaauuuuuacuaauuaauauuuuuguuguguaugcagugauuacuuucugggaugacauguuaauucugggagagcugucucuucuuccccuuauagagauguuucuaagacaagcuauguugacucagguagccuugauccuggucugcugcuccccagggcaaugaccuugcuuuccucuugauauaaauuucuaaauucuugaguuaaagaauguagcaaaguaguguuuuauaauugcucauuugaguuauauaaugaacuguucauuucuuccaccuucaguagagaacaggagcaaugguuuacugugaucucugucaggugaaguagggcaggagacggcuagaucauagacgaaagcuuaagggaaucugcuccaggugucacuauucuagagauacgagucaggcagggugaauacuuuuguaauuucacuaaauguauuaaauaaugcauguuauuaaauaaaacuagauuggugugugcuuaauuugugcaaguuagcuugagccaaugauaaugaauuucuguuuuaggaucuguacuauauagauauuauguaucagaaauguaaaacacaugccauuagcuguagcuguguguaucacauuauagaucucaguaguuaacaaagcacauaggggcaaggucaaacacuaucuuauuaaugccauuuguucuaccagaaagggcaugaucuuuuccaaaucaguacgguaauauauuuuuucaauuauuuuuaucuuuuuaaaaaguuauuuuucgguuuuacuuuuuaaauuucauuuucaguauccauaggugaccucuuauguguuucuauucuccaauauuacccgaaaauuaagaauuccauuccuuuuuuuuuuuuuuuuuuuuuucgagacaggguuucucuguguaguccuggcuguccuggaacucacucuguagaccaggcuggccucgaacucagaaauccgccugccucugccucccaagugcugggauuaaaggccucacgccugccucacgcccggcuccauuccuauuuuuaaaaagauaacuuauacuucugucauugucacuuucacuuuuaaauuauuguuaauguaugaauuucauugcagguuuuuuucaggacuuccccaguaagaaguagagauggcuguaguggguauugcaugcauaauugaauguacaaagaaaggaugcugggccuuuaaaauggaaaauacuuggucuacaggacuagaauauucuuuuaaauguacauuuuccagacuugggcuuugucugcuuguaggguguaacagaugaguuuggaagguuucagcugucugagucauuugcucugugaucacacagugaaggagcugcuguugcccugaggcccagcuggguuuuccaugcuaaugagggacucugggcaggccuaaccaucaggaacacuaggagaauuuagguagcuugcugguucuuuaaaggauucuccucagaugcauguguuacaagcugccuggaagaccacaagccauccccugguuauuauaguaauguccauugagaguacaggaggagcaagucugcagagcuauuugagucugaucugcuggugcuaaauggacugugggucagagugugguucuguugguccauguggugaucauaacagaggcccuuguccuuugacucuuccugaguguggauuuacagggguggggguggcucgcuaggccugggagugggaagguauggaauuuaaaugucacuaugcagggccuauauacaggcauggccuuuagugugccguaggacaacauuggaaaaguaacgguuugcuuucuagaauuccugacccucuguauucaguuuugugugacuaauuuuauaaaauaguuuagaaguuaguuguaaagaucgacagcggucauccuucagaaauacuugauuagauuccuuuuaccuuucuauucccuauugucaaaauggcaugauucacagaacuucaauucuugguuacaaaaggagcuucugacaugcagaaguuucccagguguugcuggugcuggguggguggauaggacugauuggagcauaaugcauauggcaggaagcagacauuaaauuaucauucagcauuguuuuguauaugggcuccugugggucugguuuagccugaaaucacuaagggucaugaacagcuauagaacaauagcucaacuuucugaucaucuacaaugacagagagggcucugaagcauggggccucucuguucagaagacagaucaguaguaacuagggucaaauuuauaacaguuuaggggugacuuugaguuaucuuuauuggagucaugaaauaugauuuuauuuuauuucuauacacacacuagcacagguaacauuggucaaguucacauuguuccugguguaguugccuuaguaauugaagaaaaguugaaaauuggucacauggaaaugggcagaggaagcuuucccugauauuguguugcauuucugugggcuacuaugaaaacugugucuaggauaacggauagagggcuuguucuuuagacagacugcuuggucuuggggaaaacugucuaugguugagaagagggugucugcccauacuugggggcuaauaagagaaggggacauguggcaagaagguaaggggagauggaaauagucuuuuguaucuacaggugacaugggcaggugagaggaaacugcagucuuaagagaacuauuacauauuuggucucaaggaacaauaauguggaaggucuaccagcauucuacaugguuccauacacaacaucuuaauacuaaggcaucagguucccagagaucauuuauuuacuuaaguuuuuguuguccaacugugaaagacuggauaaaaaguacuaugugggugggcagggcagucagcaaauauucauuuugaaguacaccuuuacacuuuugucuguaucauauuuuuauuuuuuauguacacacguuugggaucuuuuagaauuuaaucaccuaugaugacgugcaugugaacuucacucaggaagagugggcuuugcuggauccuucucauaaaaaucucuacaaagaugugaugguagagaccuauaggaaucucacagcuauagguaauauugugauuuuuuuauuugcuuuguaaaaugucuauguuauuguaauuaguucuuauaauuucaauugagagugaggaagaauaugguguauaaaucacucaugguuuuaaaguucaauggcguuaguaacuuaaauguugccuaauuuccaauaauguaacauacuuucucugguacuggguuuagguuacauuugggaagaacauacaagugaagaccauuuucaaacuucuagaagucauggaagguaauuuuccucuguaagcugaugagaaaaugccuaugaagaaaguuuaacgugugcuacaaguaguaaagaaaaccaaaaggguacaauaagcacugcuuucagugauggauguuuacugacuuucauaaaaucauauaugucuaugucaaauauguaauuauuguuugcaaggcauucuauuaguucaaagguagagaaagaauggcuuaacagauauguuacuguuuaaaucaagccuaguagagccaugcuguacaagugcgagugucuucagucucauaucgcuuagcuauugcaacaggaacuaacagugauuaggugacaaguauaugucuaaaaccuaguaauaauccauagaauaucugagcuuaaugauauacuuguaauaacauugcuaaauuuagcgagaugaacaguucauaagauuaaaaaaugguuuguggaaaaaccuuaaacucuguaccacaucucuguuacgaaagaaagucagcugugaauguaacauggaauuuucacuuguuauucuucuuuugauguggaugucauagguuaggauggauacaagccuugugaacauugaggcauugaaagaagccacauaccuuucucuuuuccagaacaauuagaggauaugcaguauaacauacuuugagcaacauucuuaaugugcuauaaguuuauaaauaauuuguuuccgaacauugcuggggacauuuacaaacgaaaacugcugaaaauaguaaugagaaucaaggcaguagaauuuuuuucuuuugcauuuguucauauuccaaauguaguauuacucucaugauaacaaaauuugugaaugcaaucacugugcaaacacugugaguucuuccuguuuuuuucaaauaugugaguaaccuuuuaugggaaaauuauguuauaaaugugagccagauaaucaguacuguucccauuucauguauacucaaagauguaaaacaauccauaauucaauagaacuccuuugaauguaaacaaaguaauauuauguuaauauuaauuugcucuuuucaaugaaaucaaauuuuaaaagaauucauacagauaaaaagacucaucaguauaaucaguguaagaaagauuucacgugugccaauuuuauuugcaggcaugaaagaaguuguucugcagagcaacccucugaguuuauucacugugguaaagccuuugcaaaugagagugguagucaaaggcaucaaauaaaacauacuggagagaaacagcaugacuguaaccaaugugguaaagcuuuuaaaagaaggagugaccuccaaauacauaagcgaacacauacaggagagaaacccuaugaauguaaacaaugugguaaagccuuuucacaaagcagucaucuccgaauacauaagcgaacacauacaggagagaaacccuaugaauguaaacaaugugguaaagccuuugcacaaagcagucaucuccaaauccauaagcgaacacauacaggagagaaacccuaugaauguaaacaaugugguaaagccuuugcacauagcagucaucuccacauacaugagcgaacacauacaggagagaaacccuaugaauguaaacaaugugguaaaggcuuugcacgaaguggugaccuccaaaaacauaaacaaacacauacaggagagaaaccauaugaauguaaacaaugugguaaagccuuuucaagaaagaguguccuccaaauacauaaacgaacacauacaggagagaaacccuaugaauguaaacaaugugguaaagccuuugcacaaagcagucaucuccgaauacauaagcgagcacauacaggauugaaacccuaugaauguaaacaaugugguaaagccuuugcaggaagcaguggucuccaaugccauaaaagaucacauacaggagagacaccauaugaauguaaccaaggugguaaacccuuugaaggaagcaguggucuugaauauaauaaucgaacacaaacagcugaaaaacccuaugaauguaaccuaugugcuaaaguuuugcaggaaggagugaccuuuaaagagaaaagaccauacaggagagagacucuaugaaggcaucugauguuauaaagccuuugcagcaagcauugaucuccaaguacauaaaugaacacauaccagagaggaaccuuuuaaauguaaccaaagugguaaagcuuuuuugaaggguaaaaggcuggaaaacaauuuuccaagcaaauggucugaagaaacaagcuggaguagccauucuaauaucaaauaauaucaacuuccaaccuaaaguuaucaaaaaagacaaggaggggcacuucauacacaccaaagguaaaaucuucaaagaugaacucucaauucugaauaucuaugcuccaaaugcaagagcauccacaucuaugaaagaaacuacaguaaaggucaaagcacauauugcaccucacacaauaauagugggagacuucaacacacagcucucaucaaggaacagauccuggaugaaacuaaacagagacacauugaaacuaacagaaguuaugaaaaaaaugaauuuaacagaugucuacagaacauuuuauccuaaaacaaaaggauauaccuucucagcaccucaugguaccuucuccaaaaucgaccaagagaaccaaagaggauugccaugcuaguaaaugaaguggaugcaggcuugagagcugggaauggcagaauaccagccauguaagagccagggaagagagccccaguggccccuccugugauugauucugggguagcaaaaauggcauagagacuuuaguaaguaauaauucaggauuaucacagaaaagaauuagcaauguggaaguuugagagugucccaaccaauuagcugauuuaaaauaguaaauaaagcuguguaucuuuauuugaggaucuaaagcauuugcaugcucagugaggaacuugcacaggaagcauccuauaguagaucagaguaaccaaccaacucugcagaauguaccucaccuguaggcuugaacucaauauuaaaaauuaauuguagauucucaaguggaaaaccaugucaugaugugagauaaagagauguggaaaauuggauucuuagcagagaugcugguuuacuggagacaugaggugugucaccaagcugugcagguucacaacuagaacaaaaggugagcugaacugguaugcauaauucuugguuccaugucauaagcugggauguagcaaaaucccccuagcugauccagacauccugccuuugucuccugccuagccauuggcuguuggcacuuuuuuuacccauuuacaaucagcuuggggcagggaaucucagugucccaauaugggcuuaucaugcaauuugaacaauuuaacaggaguagcaugagaaccaauacacaauugggaauaagcagaaaaaccaaaccaaaacaaacaccaggcccuaaguauugccuuuuuuuuguuauuacccugcauuuacucauauggugacucuaaguucaaguuuccaggcauggggucuuguggaaauccaaccucacuuuacucauauucucuucuugaaaacauaaugacugucacuaauaauacuuucugcuuuucauugugcuccucaaaacauaagaccuguacuuuaccaccaaagaacaaauccauaugauugguuaaacuauaacacccauaauauauaacagaugacacucuaaacuacauaagccccuaucccuaaauucugauuggugugaaaaugaagcuauaauuuggaagguauguuucugucuguccauccuuuuuuaaaaaauaauuuuauuucuuuuuuuuuccuuuuuuuuuaaagauuuauuugcuuauauauuauguguaaguacacuguagcugucuucagacacuccagaagagggagucagaucuccauacggaugguugugagccaccaugugguugcuggaauuugaacuccagaccuucggaagagcaguagggugcuccuacccacugagccaucuaaccagcccauaaguuuauuucuucauuucuuuauugucugaugacuuuuuuuuuuuacaauccacaccuuauaccccuugucuucuucaggguuucuauuccugcacaaacaucaugaccaagaagcaaguuggggaggaaaggguuuauucggcuuauacuuucauacugcuugcucuucgucaccaaggaagucaggacuggaacucaagcaggucaaguggcaggagcugaugcagaggccauggagggauguuucuuuauuggcuugcuucccuggcuugcucagacugcucucuuauagaacccaagacuaccagugcagagagauggucccacccacaaggggcuuuuccccuugaucacaaacugagaaaaugucugacagcuggaucucauggaggcauuuccccaacugaagcuccuuucucugugauaacuucagcuugugucaaguugacacaaaacuugccaguacaauugacaccuugucaacuugacacacaaacacaucacuaguaauccucaaaccuuaguuucuuauucauccccuagauauacacaacuuugaaagucccacagucuuuacauauuaaaaguuaaauccuuuaaaaauaucuaauagccuuuaaaauccaaagccuuuuacaauuaaaagucucuuaacuguggaauccacuaaaguauauucucccuucaagagggaaaaauauuagcgcacagucacaaucaaaauccaaaauuaaacuccaacuauccaaaguaugggauccaacucacgauccuuugggcuccuccaagggcuugggucacuucuccagcccuguccuuuguagcacacagcuuguccucuaggcuccagaugccuguacuuuacuguugcugcuguucuuggucauucauggacgugaaaacuccaaaacacugcaugaucucuucagcacugggccaucaauugcaccugaggcugcaccuucaccaauggccuuccauggucucucacagugcugggcuucagcugcucugcaugaucccuuuaugccuucaaaaccaguaccaccuggguaccucuuacacauuaccaaguccagccagagcacaagauacaaccuugacuaucucuagaacacugccucugugcucucagaaaacacuucccauaugaugccaccucaaugaugcugguuucuuuuuaaucacugcuaauuucuuagcuccaacuaaacagcaucaguagucccaguaauacaaaguuuucacucuaguaguucugguaucuuguucaucacagcugauucuucagcccuagcuauccagaaccacagaucuucacaauccaaaauagaaauggcccucaaaagucuuuaauuuucccugugaaaauuuacaagccaggauuuaaucuucugcacugcucucaacauuaucuuucaagcuccuacacaacaucccacagaguucuuaacaccgaauggaucuucuggcccaaaguuccaacuuaauuuaagagcaaguacucuuccuuagguuauaggauauuugaaagcucauaguggauugcccagaccccuuaaugagggcaaugccucagcagguuugcauauuaggcagaguauaggcauuacucaggaacaguuuagccaaacacucucauucuuuacaucauuaaaaagcaauagguugagacaacaauuugguauuucuagagaaugugcaugucaaauuguaaagacuuucaucaguguccucaguuucuuccuguaucacacaaagguguuaauccucuaggaguuaauccucuaggacugguaccuacucaguuauggcaaauagacguuacuuauauaucugaauuuuaaaaaauguuaaacaauguacauaugugcuacauccaauccaguagugagaagcgcaacaggccccgaaaaacuguauaaguucuccuaagggggcuggagagauggcucaguggucaagagcauugacugcuguucugaagguccugaguucaaagcccagcaaccacauuguggcucacaaucacccauuaugacaucugaugcccucuucugguguaucugaagacagcuauaguguacuuaaacauaauaaauaaacaaaucuuuaaaucacauaauuauaaacaaaauaagugcuccuaagaauugauuuuuuuuugacauauaccuaaguuagauucuagacaguccuugauccgacccugggcauggauagcuaagucacugcccuaugcaggaauuuaccauuaucuaggaagaaggaaguuugugaccagaggaggaaccagaguaaauacuuagaacuauagauugcugaguuacacccauauacaaguguuuacaauggccuagggggaauauggacuauauaauagacuacaauaggaacuaugccaagggcaugaagcccuugcccuuggcuucuaagauuaaguggaccuuagguggagcuguuuuugaucccaguuguuaacacugaauuuuaucccaguugguuccucuggucaguccuucuguguuugcauuccucuguuuuguguaagaauucaguaacaucauuguaccuugcuggagugucacugaacuuuccuauuuucuucuguauaaaaaguuugaugcucgauuuaacaaauuacauucagauucagcacacucucucauaucugugucugucugucauucccgccuacucgaugcccaucugcuggaacuccugauucccaaggauugaggagcgcccacuggacccgauucauagcaaguaugacuauugauaccuucucagguuaucuauuuggaaaugcuuuaacaagagaagcaacuaaauaugaaacuagucauugccuacauguuuuucuauacuggauguucaaaaugacauggaguuacuggcuauuacagucagacauuugagauguuuuguuaacaauuuaauaucagucauauuacugggauuccuuauuauccucaaagacuagguauuguggaaucuuagaauauuuucuuaacagagaaacagugaaacuaacagaaguuaugaaacaaauggauuuaacagaugucuguagaacauuucauccuaaaacaaaaggauuuaccuucuuuucagcaacucauuauaccuuuuccaaaacugaccauauaauuggucacaaaacaggccacaacagauacaaaaauacugaaauaauccccugcauccuaucagaacaccacagaugaaggcugaucuucacuaacaacauaaauaauagaaagccaacauucacguugaaccugaacaacacucuacucaaugauaacuuggucaaggaagaaauaaagaaagaaauuaaagacguuuuaggguuuaaugaaaaugaagccaggcguggugguauacguguuuaaucccagcacuccagaggcagaagcaggcagauuucugaguuugaggccagaaaauauaauaaucaaagaaaauaauaucaaagaaaauacauggugguacuccugucuuauggccuaguaagccaucaaugugaggagaggcccuuggucuugcaaagauucuaugccccaguauaggggaaagccaaggucaggaggaaggagugaguggauuggggagcagggugaggacggagguuauaggggauuuucggaguggaaacuaggaaaggggguagcauuugaaauguaaaugaagaaaauaucuaauaaaaauauauuuaaaauaaaaagacuacuuuugcagagaaccuguauucucuguaucuacacauaggcucagaacuguauaaaacuccaguacaaaagauucauuguccacuucuguccuaugagggaaucaggaaugcaugugauaaacauacaaaaaggcaaaacacucaugcacguagaauaauaaaauaauuuuuucuuuauuacaaaauggaagguuuaaucagcugaaaugaggacaaucaaagggugggugagagggucaagccaaaauuggcuauguagaauagccaaggauaucucauaguuguacccucaacugaagggcuauuugcagcugagagaucagggucauucuuuauugaggaugaggugaguggaaggcugcccauuguccaauaacgggcccacagucagacccaugcaggcauugcuaaauggacuuaguagggaucggaaggagagggcagaggaggaggagauuucauagugaggagaugguugauuuggauggaucugugggcuguagagggggacgagggauauauaauuaaauuucauaguauauacauuuauaauucugacaauuaaaaaaaaaacucuagggacuggagaaauggcucaaugguugagaguacuggcuacucuugcagaagucccacguuuaauucccagaaacaacauggcagcucacaacugucuguaacuucuguuucagccaauuuuacacccucauacauucaggcaaaacacccauauauauaacauaaaaauaaacacauuauaaaaaagaaaaaaaucuacaaaacaguagaguuagaucaguauuucaucuuaauaauuacauuuucauuuucaacauuauauuccuuaggaauuauuuuuuaugaaaacaaacaaacccaaaguuugauuagggcaucauuaauuagaagguaucuggaaagacugugcauuuuuauagcagauugucagccugaugccagcugugcucuuucaauguuaacccaucugaauuuucaaagucccugguuaugugcauguauugcagguugaauauuaugcuaugucuuaauuuuccucccgaaaugcuugcucagagaggcucaguagcccugccuccagcuggcuuugauugauaauaaaugauugccguucaggcaauggcugcacagggaaaugcaagcaggacuuuuagauugcacaagcaagggaauaagggggacaaagaaagaaucgcuaugaagggagcagagauaucagaaguaaaggcaagucaacauagaauuacccagggaagcaggcccaggagcugcuccccgacuuggguuagggaaagcaaauaaccuaaguauauuuagaaaacgauaacuuaagaauagggagagagccagggauggaggcacacgccuuuaaucccagcacuggggaggcagaggcaggcagauuucugaguucaaggccacaaggccagccugaucuauagagugaguuccaggacagucagaguuauacagagaaacccugucucaaaaaaccaaaaaaaaaaaaaaaaaaaaaaaagccgggcaugguggugcacgccuuuaaucccagcacucgggaggcagaggcaggcagauuucuuaguucaaggccagccuggucuacagagagaguuccaggacagcuagggcuacacagagaaacccugucucgaaaaaacaaaacaaaacaaaaaagaauuggagagaaauaugugcuagccauugggaagauuagaagugcacacagaagggcuggugagauggcucaguggguuagagcaccugacuguucuuccgaagguccagaguucaaaucccagcaaccacaugguggcucacaaccauccguaaggagaucugacucccucuucuggagugcuugaagacagcuacaauguacuuacauauaauaaauaaauaaaucuuuaaaaaaagaagugcacagaaauugagcuacuuagucauauuaaagauuaaacugacauguaugucuuuuauucaggaauccagaacucuuggguggguguaguacaugcgccaccugaugggagguuaagcaaauuaacaauucaccgcuacagauggcaacauggggaaaguacuauuaaaaguuauuuagagauucugggauggaauacacacaccaugauauaagauuagacggaggggaggauuggcuuuuuagcaaggcacagauuuugccuacgccauguggagauuucuucccagaguucuggacuauccaaagaguuuagacuuagaggugcugggagucacugcuguucaaauaggcugcccagaguaaggcaaagagaggaagacaauacaggcugcuggccuccaaugagcagauaaucaaagaacagagauaaauuaauuuugauuuaauuguuuuuauuuguguuuauuuagugacucugauauucuaaauaaggcugugucugagaaauaacaacaacacagauaaacaaucacaauuuuacuuguuaagggcaacuuaagggcuauuuuuuauuuccuguuccaaauuaauccuaaagauaaaauaugaugaaagacccucgaggggagacccucacucagacacucaagucccgggacagccgcguacccaagaagacacugagaccauacauaaaauguagaaggcaagauuuaauaaagcagcgacaugaaagcacacagaccagagcucuggggucgaaauaaagcagcaacauggaagcacacagaccagagcucuggggucgaaauaaagcagcaacauggaagcacacagagcucuggggucgaaacucauacaccuuagcacaggguagaggagucucgacggucagccaaaauuuuucacaggcuuauauaguaaaacucaaagggggagaacugggcagggaaaguacaaguuuacaucacuagggaguucuugccaaaggaaucuacguaacuaaggagucauguccuaucaaggaaucuauguaacuaaggagucauguccuaucauuuggcaauguacccgguucauuuugagguuguuucaggaggccuuuaucucaaaaauguucuuggucgaacuuuagggugaggaguuuuggggugaaaaguuuaggaguguuccgagaacaaccucuagaugggagggggugggcuccgagguaaaaaguucauguucucacaagaggccaguaauuuuucauucuucauuccccacuucuucuuguaaguaauucuaaucuuagaauuucagaagucuauaucucuauguggagaauacugcauuuacucuaucuuuaacaugggaacagaaacagaauaaggcagauuaguaaacagaacuaggcagggacccuuuuagugaggcuugagggucucagcaugacgcagguguacguagaucagaucucuggcuggaacugguaagauguccuugggguacccagcucguucacuguagccaguugugaccagacuuuuuucugcaccaccugcaagccuuuuaacuuaacauauagaucauuauuauaacaacauagguuuaaacacaucauuuaagacagugaugggcacaggagccccauaaaggaucucaaaaagaguaaaaccgaaucaagagggaguauucucaguucuaaauagggcaaggggaaggaguaccaaguaagccugugccagucuccaggauuaauuuugucaaagucuguuuagaguuuuauuuauucuuucuaucuguccugaguucugaggucuguacacauaauacaauuuuuauuugaccucuaaauacuuggccacacccugacuuaccugggcaacaaaggcaggaccauuaucugacacuauugcuuuuggcacuccgaaccuuggaaaauuuuuaauaaucuucuugaugacuaucugaguagucucaguuuuauaaggaaaagcuuuuauccaucuugagaacguuuacaaaaaccagaagguauucauacacauauuuuuucaguaaagucuauuuuucaguagaugucuucucaugagaggacuaguuuucuuucuucaguuuuuacuauuuuauacaggguuucuuuuaccagucuuaauuugucuauaacuugauagucuucagacugucaggaucauugcucuuuaggaugccugggcgguuagauuugccaucugauuuuuuuuuuagccacagcaucuuaggucuuucucugcagaugucaacagcucucuuugucuguauauauagagcuuguauuaaagccacaaguuuagcuuucugggcugaagucucuuuagggaggcugcuggccuagaucacuugcuuucuguccaucacugcacugcuguccccgccuuccgcuuaccuuuaaccuccaggcuacugccauccguguaccaguucaaacucucaggccaaggcugaucugauccuucagaucaucucgaguaugaguuccuucugccagaaugucagcacaaugaugaguaggugaagucucaggcaguagugagaucgaggauagcagggggagcgaaggucacucguucagucaaagcucugacaauguguccaucggucaggggaacaguuggauaaugcuuucaagagcguuagucagccaucggucaugggggcugaaccacacuuucuaggacaugugccaaguuuugucucagagucaauuuaucugcguccuugaccagaagccacuaugugcagacaagcaggccaucuuacagccaccaggucuaauuucuuacaaguaugccacaggucuuuuucagggucccaaucucugaguaagaacuucuuuggcaauaccuuuguucucagucacaucuaggagucccauagcuggggauaacauuagggcagucucaagagcaucuaaggccaucuaagauuguuccuuuuuuuuuuuucuuuauacgaagggcuguuuaucucuuuaacucagcaaaaccuggaauccacaaucugcaaaagcccgcagugcccaggaacuuuuuagcuuguuuugcacuggucgguggaggaguaugaaacacagucucuuuuuuuuagcugcuucaacagguagaccaccggacucuuuuaaggacucagcuucuguauuagcaccccuuuuguuaucucuuuacuuuuagccacgaacaggugaaggguuuggucaugaggggggcuccucuucuuuuuguuggggcagucucucacccagugcucauuuucuuuacaguauacacguugaucuuuagccaaaagcuuucuuuuguugccagguacuaucuaaguuuucuaauuuuccugacuuuuguggccagcauuuuauuuuucuuaucuuucugucucacagcacagcucugauucugacucuggucucugucuuugucagccucauguuucuuuaacucuuuuucuugucugacucuuauuaccuugguuagauuguugggacuuucuagucccacagagacgagacccccaucagagucuggcaguuagacucacaggugcuccuuaccuuggacagaagccccaagugggcggaugccucccucacuggagcuuagaacagacucacugccagcagcucaggguggugccaccuucugagaagagggaacuuuagagcagagacgggagugcagcucucacagcuggcugcaaccggcacuuaucuuaaagugaaagcaguuuuucuguuaacaagagaugggaugggagggacaggggaaugagaagcugccugggaaccugcagcgcucuuggccggcuacucgaacagccuccucuucuuuuuuucuucagcagccacaacauccagggccacugacuucucagggaccacuccucauuugcuccggauuuccgagcucauuuuucccuaggcuccagguccaugggcgggaccacugugacccgcuggcugcucucuggaguuggaguaggaggcagggcagcugaggaucugaaaggaaguggucagcauagggaucugacaggauuuuuaggcuuauuucagaaggcauaacuuaaaaacagucgucagucaucaguccaaguccgaacacaaagagacaaaaaagacacacacagaaaccguuuuucaggcaaccacuauagaaucacaguaccacagaaaugacaaacacaagcaagaccaauacagggcaucuuacaugcgauuuccagagaagcuuacugucacuaugaccaacccaaauggaccugucuccaugggaaggccccagaaccugagaccggccuaaaaccaaaccaagauaaucagucaacuccuugggaccaaaaccagaccugaaaccagacaaaucaaaaacaaaacagaaucagaaggugguccaauggaggacacacaagugaacaagacacacagacacacagacauacagacagggagggaucucacuuuaccucugacguacagugucugugucucaugacaaaaaccacaaacaaaaacaagauagcaacagagaaaaagaagacaccaguaucucuaagcacacucguccacgccuggacuuguacaaccagccaagccaaacgcuauuuccugacgggggcagauuccacaucgacucccuuccuccugaaaaacaauuugccugacggcggcgauuagugacaagucaaaagcacccuuagguggccagccuacuccaaacguuggccacucggaggcgcaaaaggucugccacugacccuuucugaccuccaccgacugguugugggcucugacccgcaccuccuuccaaugcuccagagucagagaaaggggagugaacacagauugucccauuuuuagaaaaacaguagucacaacaagagcggacacgagacuaagacaaaaaagaaaccagaagaaucagauggccucucuaaggccggccgauugagacccucugcacgaggugggacucgaacccacgaucccgugaccagacgcgaggugggacucgaacccacggucucgcaacaaggugcgaggugggacucaaacccacgaucucgcaacaaaaugcgaggugggacucgaacccacgaucucgcaacugggcacgaggugggacucuaacccacgaucucccaaccccaaauggucucuuggccuucaaagggguccaccaggcgucccugauccuccc

SEQ ID NO: 1326 - RNA, 1864 nt, Mus musculus
ggggggggauuccucagcugcaucccagaccucucugccugggguguuuucuucagugugcagaccuuccuugguugcugcuucacagacagugguuguuuauuaaggacuguaguuaguagcuucauccuuuguucuaggcauggugauucuaguguuuuuuggguuuuuuuuguuuguuuguuuuuuguuuuuucaccuuugagacaaagaacaaagguuacauguugcaguuggaaauaacaauggcuuccacagggccccuggugucugugacugagaugaguuuaguuaaaaccagcugcuaagguuaaauguccaauuaucgcgcugaacaacacgugaauuuuuuuucagcccuuuuucuuuaggacuuuauuuucauauucuuuuugcacuguccccccagagaaaaccuguuauuuauuaaaugcaggucuugugccuuuucaugugaccaaaauccguuuauguugaaggcaguccacagaugcaauguccacauuugccggaguaugcaccuuguguugggagaacgauaccacccugcucccucuucccaccugagggaggcccuggguccacuucccuucuccuuggagcacagacuauuugcagcaugacuggaacuucccuuauucuuucucuagguuuuuaugcggauccuuuggaagcuucagggccaguaaauguaagcaugacaucauauacacguaauaccagcucuagugcucacuagaguagcaugcucacuagagcagcacugacaggguuucuuuucuguuacacaccuguguggguccuuuagacccugacaggcaagggugaaauuccuuuucccuugcuggaugugagucugagcuaaaacugucacaacuaaggaaugcaaagacagugacucaugcauucguucccagcacacuuaaccgaacuugguuccugaucuagggacuagaauucauguucuguguuuagacagcccuagaagcccaaagcacgacuuuguuuaccucuuugcccagguugauuguccgaguugagcaguguuauuggaucugggugcuauugagcagcacaguuuguuacagucacguugaguguaguuauuugagcacagccuuuuccacgaucccuaaaaacauaccccacguaggcaaguagacaacauugggcacugaacuguaaacucaauaaguucaaggccaaaccagaguauccagccucagugacagagggugcccuucugggaaguucuucucacucagggaugguuaaaaggcccucccguuuaaaccagucaaacccaggagaaauauaaggaaaacaguauuucagacuuaauaacaucaaugaguggagaaaaaaaaaaucacaaaagguucuaaguauucacugauggcuuuggucauuuuccaaaucucaaaggggcugaagguuuguaaccaacuugaaggucauagaguauguggccugucacagcccuuuggaggagaagacagacgccauggucuucacgcaaaaggaaggccccugaaccugugagcuguugggcuuauguucuagaagaccuaaggauaacuucuuagguggcuuauaccuucuuuaucuuucuuuccguucauuuccuuaaacaaguagaaauaggcacuccuggagguacuguguucgagguaacagcaguauuuauuguuuuauuuguguacguguagacggcuguaguaaagugaccuauaaacacauucagcauguucauuugcuguuguacugcuguguguuugguuuuauacguagaaaaacaagucacguaagcuuuugugaacuuggacuguuccuuccuggagacaaauuaaacaaacguuaccug

SEQ ID NO: 1327 - RNA, 3508 nt, Mus musculus
ugcuuaaaccaccaacauuuaucuucucacagcucugucugcucagguaacauuaccuacggaggcagcgaguuuggguuuggagagggcccuucuuucagacuuccagaugaccaccuuccuagugugucuucacaugucuuucuucucugugagcugcuggaaagcgagaucuccaccgugcuaagcucacuuagccucaucacuuccugaucuagcuucacucuguguuagagcagcaagaacaaagugggcauauauuuauuuauucacuuccgggucacaguccaucauugaggggaguuaggggacaaacuuaagcagaaaccacaaaggaagguugccccuggguuucacagacucaugcuugguuagcuuucuugaacaacuaagaaccaccuaucuagggauguuacuacccauggugagcugggcccuucccugccaaugaauaauuaagacagccucucacagacacgacacaccacaagcuguucugaucuaagguuuccuucagccaagaaucuucugucagaugccuaagguugacacuaaggcaccuccucaagccguguguccaaaugcaaucccacagggguuagaagaacagagcuucugcauaugaacggggcagcaugugagccugcgcagcuuccuggaggggugagggcuggcagcaggaggggucguuacuaggaacuuagaggaaaaugcagagcaaggaagaggagucgcaggggccuggagagacaacacaguucacgaacuguuugccacauggacaugaagacccgauugguuccuggaacccauauaaacagccuauguaguguccgccgcuugugaucagggguugggaaggcagagucaugaggaucccucagcuugcuaaccaaccaucucagccugauaggagaggacuaggccaaugaggaacccuguauccggaaaacaagguggauagcucgggaagaaugaggggcaggcacagauacacaggugcacacagagacacagagaggagccacaggccacgggcaagcaggugggggagauaaaugagucaugguaagcaccauucaagguucuaauuuagaccuguugcaucagagacuccugcgauguuacaauaggcagaucaucucagcggugcaacaaaaaaaaccuugaaaaugcaguaauaauucaaaucacuuguucucugccaaagcgcagucaucggaggcauuggagauaaauuucuguggcucgcucuggcugccccgccuggaucguugccuuggcugguguaagacaagcuguggugggggugaggaauggguuggcaagccggagccagggagcuuccgguguuccugggagaacaacacagaggcggccagcggaagauguucccuaagcuugucagagggagcuggugcaugguuucuguagacaacaccauuagucaaaacaaauucuuccagccugagaagcccgaagccuugcaggaacacagcucuccuggaguguccccgguggcccaucaugcacugccaacugccacuguuaccaucagaguuucauuaaguucaaacaucugaaaugggccucuauuucucucugaaacgccugggucccuagcagccccguuccacugccucagacuuuccucugcccgaggccguugaagcccaucuacugagccuucuuccccgcacacccugcaccugacucuggggagggugaaguccaggaaccagagagggcucaggaaggcuugcuccucuuucccugugucucuguguguuuucuguauccgaucuuuucuccguccucugaggcagcaccagggauguuaugcugucucccauauaaacagaacccuuccgauuuaauugcuuuauuccucucaaccaaacaaaacauguauaagucuuaacgggcugagagaggccuccgggcacaguuuuuaacaaccugccugugauuuggagcuugcaagcauuacagaggacacacucucugaaaagacuguuauagauccugggggcagggcugccucagggggaagagccguggggaaaaaaaucuuuaggagugucuugaaaaauguaucuuaaucccaauauauugcaaagacgcaucaauuuuuuuaauguauuugugucgaaguguuuuaauagagcguguugucugagaccuuacuuguacggcucucagaagacgaagccuaagggcuagaaggagaucauuugcagaauaugaaaaugucagggguucagucaaguaaugguuccaauaaauaacucagcaggaagugacuccucuggccuccugugaucuuugccccuuaguguuauuucccaggaagcuuuauugugaauuaauucuguuuccuuugccagcccuggcaaggcacugaagugcacauaguaacuucuggaagaaaauugccucuccucuucaguuggaaaauacuucaaaugaggcccaaagcuaucuucugaaagaguggguaggugaugugcuagcaaacaugcaaaguggucuuugcucuugacuugcaaagagaguucaaauccagcuugucaaguguaagcgguuuggaggucucccaccaaagcuccaacaguaagaaggaaaugcuaaagcccaugccuuuccucagccugugaaugaucugggcucacugcccuucaucaucucaguccuuguacuauaugcaggcgcuggguaccaugucaccacaaugaagcuagaagcgggcaguuuuccacccauaaaaacgugauaguagaguccaaucacucagagacccccucugccccucuacaguaaucuugaaaugacccacauguccagucucuguuuucuuuagcccuuucagugaaccccgugucucugcucagauugggauaaccauuguacguggagcuguuccagccuaaacugcaagccaagucacuguuuacucgagucuucugccauggugucgccuguucacagggugagucauuguccuggauucuggagagagaguggaaucuggguugucacagcccagcauuacugaucuauaccaaagcauagcaaccaacaugccacacaugucccaagauaaaggacaaagaccuuugaaaacgaugguggggggaggggaacucuacacauacuggcagacuagcuaggacgagacccaugugcuguucucagcaaacccaaaagaggaucauugguaaaagucccuguagguuggcugugccagcuacaccuugguagccaacuuggucagaaagcacacguaccaguucccagcagcacacaucagacacagguaaguguccaauaccuggaagcuguugucauuuuggcucugugcagugguucucagucugugcuccugucaguaucagagacgccuagguauuguaugcugucauaaaauaccugggguagaaagucccuguagguugguugugccccucauguugucauacaaugccuggaugaagcuacuugagacuca

SEQ ID NO: 1328 - RNA, 1690 nt, Mus musculus
uuucuuucuuuuuuuuuuuuuuuuuucaaggcacauuuaauuuaauaucaggaauucgauagauacaaaaggcccaauacaaugaaggaacacauucccccauuucacaccaacgacaaugcuguuuaacaugugccugcugaaugagaugaggguuuacugaauaaugggagucucaucacagccaaauaccauauacaaucuaguugugaaaugaaugcuuauaaugcuucaaacacuuuaaaccugaagugugagaccacaccuucacguuuguacaguccuugguuaagguuaucuacaguuuccacaaccauucaaaagacaaaccauugauaaaaaccacauagauuuaaggcuccauuauauaauauagagcucagagcuaaauggauaaauauuugcucuacuuguacugguagcuaugacgugauugucucacggcuauuaguugguucuuagcaaguaaguccuuuaaaggcaaauucaccucauuugaguuuugacccaguaguucaacaaucaugaaguccacagucuuauuggcauaacuguuguacagugucucuaagucacuaugcucauggcuaagagcgaugcauauuccauuuuuacauuuuacuggaauuuuacauguucaauucaugauuuaaaaccucuaggauuucaauccucgaaacugucugaagacacagugugccacagacuuaagacuucuguuuuucccucuauuuucuucaaacagaaacacuucucaaagugucuacauguccuagaaggggaauuuuucggaguuggccucuucuucggaauaguccgacggcaucaggccucugaagcaagggggaggggaagagaaaagcugaaacacaagguucaucugcuaaguuuuacauuaaccauuacaagcuggacaguauaagaauguggcuuuuuuggcucaaaaagucugagucuugguguggaaacgaguacuuggcugucccaccacagcuuucucgaggugggacugucagggaagucuugacuggggaguaugauuuguuuaccuaucaggcguaaacuuccaggcacucaguucauuuugggcuuguuccaguuugucuuuagucuguuccaguucaccuuucauuuuuaggaaaaacaaguugaucgcugggucuaccauuguugaucucaguugggccacacucggcugcugaacuugcuugagguacuggauuugaguagugcacucuugcaucuccugcuccuugguugcuagccgcaugacaagaauguucucccugcgugcagacuccugcuguugcugcuuuaguuuuucuucagauucccuuaaaccagucacaucguuugaauuaagaucuguguacuuucccuccaaagcuugaacauaugcuucauauuguuuccaucuuagaauuaacucaucccgugccauaacuuugaagucuguuucacucagucggaccuuuuuaggaagagguucuucguuggucaucuugcaccccgagacgcgccucucgggcgccuccucggucaccgcgccgggcgccucuggagagaaggggcgaggggcggccggcucggccccgcucgggaccucggggcgcggagaggcagcggcacuacgccgccgccgcacggagacaguccgcggaagcccgcaccggccccgucggggcucuag

SEQ ID NO: 1329 - RNA, 15331 nt, Mus musculus
ugcgcggccagagcccgacccggaaccagucgagcgagcggaggugggagcugucgggagcgggugggugcgggcggcauugcacgggugugcguucuccggcggcaggcggcgggcgggaugacugggcgggaucucucucugugugcgguggcucuaaugaggagagcccguccggccugaucgccguaaaguugguuucugaaagacucgcucucgccuuagcuugagcgugauggcgcacgcuuguaagcgcagcuucccagaugagacagguggauuucuaggaguucgaggcccgccuaggccacauagugagaccaugaacagaaaacaauggcagaaacguccccuugcccagcucuuuuggaaagccuuuauggaugcgcuacuaggguagaggcucaccuguuaagaugcaggcgccgcagugugucgccuaacuaugggcaguugagucuuccugaguccccgccuccgcggcuuuguagaggcauucuuuuaaagaugagguaaagaagcauucugcacacuaaggaucgguagagaugcgccuggggugcgagcaaauggccuuguuccuacucagaaaucuaaaggaccagcauggaacaguuucggagcugucgggagguuucccugccugcaugugaaccagucugggaccuugagugcugggucggggauugggugggagguggcagcugucccuccagucagucugucccacaaggccccauagggcaggcacccagacagcagcguuguugaacgcgugcuuuauuuuguuuuugagacaggcucucccuugcuggccuggcacccagaugccugucuggcuuccggagugcaucugccaccgcacacagcaggaacacuuacccccacccccgugaauggcauauaauuaaguaaaaaccauguaaugugaguugucaggugacaaaaugauacuccaguuucuaaauguuuuccacaugaagaacgaaguagaucacaaacauauguaaugaaguguaaaaguauguagcagaaacaguaaugcccgcgugggauuuaauauccgguagcaaagugaaaauggaaugcuuagaauuaaguuaguuaacugugaauacuguuaaccaauugugcuuagccuauaaaagaauaacacugaagaaaugaaaacauuccucaagaaugcuuuuuuuuuucccccuuucucuuuuuuuaagacagguuugcaugugucuggcucccuggcuggccuugaacuugcuaaguaguagaagaugaccuugaacuucugaccuuccuaccuccaccuccugaguaagugguggcaugccuggauuaugugauuccaggggucaaccccagggcuuugugcaugcuaggucgguaggcauucuaccaacugagcuacaccccucuuccacagugcuuucuucuuucucauugaagacaucuuggcacaugucucuagugccagcuacacaaucagaucaaucgguucacugugaaacuagugcggaagguuccuggacacaccucuuguggacaguagccgggagcuuagcauccuguauagcagcaguggcccucucacacgguagcaccguggaauuccccauacaugaaagccuugcuguacagccuuaaagcaucuuggcucucaggcuccaggcucugacucucuucauuggcccagcaaaggcacaguuagacagaaagugaggaugcccuccuaggcucccucuacagugugcuguggguagacccuacccacuaggacuuucugugauggcaguauccuagucuguauuuccugguuuagcccugaguggccuguagcacugaagaacuagguacuugggcuuuauuuacucuggugagugugcaugcccaugcaugugagugugcagaugcacacacgugcacauguacagguaagagggcauuagguguccucuagcacucuuucucauucccuugaggccagguuucucccugagucuggaucuugccaucucagccuccguguagugugcacgguugcagguuacaccacaagcauucuugcccaccgagucaucuccucagcuggauuuuaauucauuuuaacuuuaucagucccggguggcuguagacacuagaugggacagugcagagauugcguuagguaagcaaugagagagaacagcgacgacgggaaagagguuucguuugcucccuggcagggagccgcccaucucaaagagcagacacacaaacugaaaguggggugaggagcagacuguggcagcguacaccuuuggucuccacacuuagagguggaagcaagcaguuuuccaugaccugccaaggcuauauggugagaccuuguuguccucaaaccaacccccccaccgccaccaaaagaaaaaaaaaaaaaaaaacccacaggaaacacagaaagaaggaaaggagccaaagcagacccaagucugugucaggacgccagguggcugugcagcuguuccuaaccuuuccguuuggcuccaccagugccaaaccagcugacagugacagccugugccuuacaggucuagccgccggugugccagcaggugcccagagcagagccacccaccacguuccuacaacacucuuuccuccaugcagcaguucaaguccuuggugaguucugauccuguucuuugcuucagcgucuuccauugucaaaugggaauaauggaagaguuugcuuuguggaacauuuguauaggcagaaugguggguucaucacuggaacccacuuuagcagggauagaauucugcagguugcacacuagggcuggaacauuugcuacugguugcuugguuugguuugacugguuggucgggguuuuuuguuguuguuuuuagguuuacuuauuuuauauauguaaggacacugucauugucuucagacacaccagaagagggcaucggaucccauuauagguuuugagccaccaugucgcugcugggaaugaacucaggaccucugaaagagcagucaaugcucuuaaccacugagccaucucuccagccccaguugaauuuuuuuuuuuuuuugaggcagggucucacauaacucaggcuggccucacacaguguagcugaggcuggucuugaacuugcugagguuaaauguguacaccagcugccucguguguuuagauaaagucucccucugcagccgagagccuggaaaucauaacagcuuagacugaccucagccaaggggauccagcuccccugagcuccacuguaaggguugcagauaugagcuuccauaucugacucaguguucauuauuaauuaauuacagagugguacagagaggugacuuggugguuagaaacacuuguuacucuuacagaggacccagauucaguuucccaaacacacauagguucucagcaauccauaacuccacuuccaggggaucuguugcccucuucugaccuccaugggcacuggguauucacguagugugcauacauacaugugggcaaaacacucauaaaauaaaugcgaaacaauguauuuuuaauuuauguucaagugcuuuucauaugugcacuggauaaagaagguuguguucuuuuuuucuuuuguuuguuguugcugcuauuguuuuguuuuguuuuguuuuguuuuguuuuuugagacaggauuucucuauguaacccugacugucauagaacuuacucuguagaccauucuggccucaaacuuagagagauucaucugccucugccuccucagcucugagacugaagguguacaccacuauaccuggcaaaaggcuugcuuucuuaacuuuaauuucuaauugauugauaugcuuggcccaggaaguggcacuguuaggaggugugaccuuguuggaaaaagugugucacuguggggauagaccuucaggucaagguauagaacuuagcuccuccugcaccaugcuugccuggaagcuauucuccuaccuugaugauaauggacuaaaccucugaaccuauaagccagccccaguuaaauguuguccuuauaagaguugccuuggucauggugucugcucacagcaauauaaacccuaagacaguauaauuaugugugauacuguaaaugauuuuccugggguuuucuaugcauucauuauucucucaccucuucuuuauaagauucuuagaaauuauaugucugucugucugccugccugugggugugugcgcaaagagcagauuucuuuggagccaguacaagguguuagaguuccuacaaauaguuaaauugccugaugugggugcuaggaacugaauuugggucgugugcaagagcaguuuacauuguaaucacugggccaucauuucuagcccacagcuuccucccucccucccucccucccucccucccuccuucccucccucuuucuuucuuucuuucuuucuuucuuucuuucuuucuuucuuucucuuucucucuuucucccuugcgcucuuucuuccuuuccuucuuucucucucuuucuuucuuucuuucuuucuuucuuucuuucuuucuuucuuucuuucuuucuuucuaacugccuuagcaucugaaagcacauggcuuacaggagugaaugugggcaucccugucuugcauaggucuccagggaaccacucaugccuuuccuuagaaaguguggcaucagucuuggccuggccacuugucaugugcuaggugacauuccuuucccauucugcuugcuaagauguugguuucccuacuggaugucaagaaggucccagccaugugcccuagcaugccagccaggacccaacugcagagguggccuugugcuuucucaacagacccugcuagguacuagccuggaauccucagaguagcauauuguuuugagggguacuagccucuaacuuugcuuuguguggaaucuaggccguggucuggagcuacacugaacucuagaacagauugaauaguaugcuaauguaugugaguuugggguuauuuuuugauagcauuuaccaggaacuuaaccaccagggcugaaauuugggaauauuuuuuucuagaaaacaugauuucuugaggugauguggggcuguuuguucuuguauuuguuugaaucuuuaaugauaugcccaugugguugccagguaggagugggcauggcuuuagauaacagcaccugagaggcagaaacaggcagauugagcucaagccuaguccacggagugaacucuaggacagacggggccacacagaaaacccuguugggaaaaacaauuaaaaagaaggaaagaagggaaggaaggaaggaaggaaggaaggaaggaaaguuauauccauuugacaugagugagucucagagcaccacaugugaagaguggaggaauucucuguaaaucuagucacuccagagcaaucugcuuuaaaaagauaacuuucauaguuagggcuggaguuguagcucugugguagggcauuuauuuauuuauuuauuuauuuauguguaugcauuuuuuaucugcauguauaccugcaugcaucagauuacaugugguugcugggacuugaacucaggaccucuagaagagcagacgauacucuuuaaccacgagccauuuguccagagccacugagccaucuaucccucuaggcacuguagaaauuaaaacaagcuucagagggcucagugguuaacaguguggcugcuuuuacaaaagacuaggguucuauucccaggacccaccuggaagcucacaacugucuguaacuccaguucccagggaucugacauccacagacacuagguagauauguacacacaugcauguauugcacauacauuugacagaacacccauauuuauaaaauaaaguaauaaaguauucaaaguugaaaaagaaaagaaaaaacaguugggcaugguggcauaugccuuuaaucccagcacuugggaggcagaggcaggcggauuucagaguuugaggccagccugaucuacagaaugaguuccaggacagccagagcuacacagagaaacccugucuugaaaaaaaaaaaagaagaaagaaaaaaaaaacuuagggcuagcaggaggagggugaccccugaaugucugugugucuuaguuaggguuucuauugcugugaagagacaccauggucacaacaacucuuauaaaggaaagcauuuuuuuuuaugauuuauuuauuucauuuauaaaaguacacuguagcuaucuucagacacaucaguagaggucaugggaucccauuacagaugguugugagccaccauguuguugcugggaauugaauucaggaccucuggaagagcagucagugcucuuaacugcugagccaucucaccagcccagcauuuuuuaaaaaagauuuauuuauuucauuuauaagaguacacuauagcuaucuucagacauauaacaagagagcaucugaucucauuacagauagaugguugugagccaccaugugguugcugggaauugaacucaggaccucuggaagagcaaacagccagugcucuuaaccgcugagccaucucuccagcccaaaggaaagcauuaguuggggcugcucaucgaccauuaucgucauggugggaagcauaguggcauucagacagacauggugcuggagaggaagcugagaguucuacaucugcaucagcaggcagcagaaagcuugagugagccacugggucuggcuugagcuucugaaaccucaaggcccacccagccccagggacacacuuccuccaacacagccacaccuccuuaauuuaagccuguuuucauucaaaccaccacaguaugugaacaucagugucacacaucaucuagauaugggucccaugauuccugguuccuggagaugaggcuaucuguggggcugugcuuaggagaacauggcugggggcacagaaagguguuaagacccauagcacaaacugggaggauccaaaacuccuagguagacuucugcuggccacaccaggaacaauuggagacucagacugaauacugccaagagcuuguguacugaccaaggaagacgcaugcauagaaucauaagcuugugguguguggaggagcaggaucuagggggccucauuagaccccuguggagcagaguguggcccagccuacugugugcuuagcagcgcagcucuccccuggccucaggguuuugugggugugcucucagggaagcauaccuuuaccuccuagcuguuguuccugcugcagggugugugguggcuuuucaagcuucagugccgucuggcauugcuuuguggaggcagguccccacccugaagcagcaggagggcaggucaccucauuagagcacaagccacugaggcucagaggcccccaucacucucaucucucaggaaauuagaaggaugggagcugcgugaggaacagagugcugagaccacacagacacugcucauuguguucacagaaggacagacgccacggugcacccgugugggcuggccuggccuugcccggccuuuccacuuucaggugaggagaaugaggcagcaguugcaaaggugaccugugucugguugugugggugccgucagucaguguucuccuguaccaggcuaaugguuuucagcuacccgagagacacucuucaguaacaauuuagcaaauggcuguuuuuacuuuggagaaauucugacuugagauuuaaauucccuuuuaauaaucucaccaagcagaucccucauauucuccuuggagauucacucaccauugcaaagauuuaauuaccuaaagcugugugcccagccccuggccugagugcacaugggcugucagacacagaauccauccccaugcauugugggguccaacagaucacuuccuccggucacuuguuuucucugacacaauucuggauucugccaugugccagaguuugcucuagcucuagucugaaguucacguuuaacccaagggccuuacuggauccuucugacuuuuuuuauuaggaccaugguaucuaccagacuugucuuggcaaggacuugcacuguguuugaggguguuuugaaaugggcuccauccacacgugcuguccucaggccuagccaccuucuucuacaagcaucaugcagauugcucucugugggcaucguagaccacgcuaagcaccgggagccuucugggaagaagguucugucagagaagaaacugguaagccacugcuuagggaggaugccuuugagccugccccagcccagccccagugccugugcgugugugugcguguguguguguguguguguguguguguguguguguguguacucauggaagucaggguaaaagguagggucccuuggaguuacagacaccugaaguagguacuucagguacuuggguucccuggaauugcaacaagaguuccucacugccccguugucucuagcagcagcuaugcauucugguuugcaugacacacacugagggcaacauggagaucuugaagaacaaacagacugugugccagaagcuuguggccacacaaggccagguggagcuagggccugacuugauugauugauugguugauugauuuagaguauuggggauggaacccagggcuuuugccugagugcugaagugcuccaagagcugaagcccugccuuaagagcuuauucuacuguuuagagacagggacccaggccauccaggugccuuuaacucccgcggagcugaagaugaccuuaaucccugauccucugucuccagcucccgccucacucagcuuuccuaaaaguauuuuuugugcauuuacuuauuuauuugcauuuaaguguuuuugaauauucaaguucuguuuugacccuggggauuggguauaucuuuaguuuugcuuguucauuuguuuaaugcgugcaggggccuguguguaugcagguaccuguguaaaugugcaagaagacaaucucugucauccucagagcacuauccguuuccuuuaauggagucucucauugacuaccauagcagcucuuucuuuauaugggcucuggggacuaaacccaggaccaaacacuugaggcuguuauaagagguuuuucuucugauuacaagaaccuuucaggaguucuuuuuuuuuuuuuuaagauuuauuuauuauuauaucuaaguacacuguccugucuucagacacacuagaagagggcgucagaucccauuacggaugguugugagccaccaugugguuugcugagauuugaacucaugaccuucgggagagcagucagugcuuuuaaccgcugagccaucucuccggcccccuuucaugaauucuugcuguuaucuucuugcuccuuuucuguccucuugccucuuccccccucucuuuccacaugcucaugaccggccucuacuucucaacucugucucucucucuguuucugucugucucuggcucugcucuguucugcucugcuuuguuuuucaagacaggguuucucuguguaaauagccuuggcucugcuggagcucacucuagaccaggcuguccuguaacucacagaaauccuccugucucugccuccagaaugcugggaauaaaaaugugugcugccgggggcuggacagguggcucaacaguuaagagcacagacugcccuuccagagguccugaguucaauucccagcaaccacaugguggcuuacaaccaucuguaauggggucugacgcccucuucuggugugucugaagagagcaauguuguacucauauacauaaaauaaaauaaaauaauuuuuuaaaaaugugugcugccaaggcuggugagauggcucaguggguaagagcacccgacugcucuucugaagguccagaguucaaaucccagcaaccacaugguggcucacaaccaucccuaacaagaucugacucccucuucuggugugucugaagacagcuacaguguacuuacauauaauaaauaaauaaaucuuuaaaaaaaaaaaaugugugcugcaacuggccacaggcuguccuuugaugaucuuugacuaaagaacugacucauuaggacucaccucgcucucaccuuuggaaagagcuucaguugagcaccgaggcuuccucaggcguccccugcugccaguucaugcuugagcgggauccuuccugauggucucaaccuuguuuuuuccugugagguggauucugguuuuguuggcucagugcaaauuuacauucuuuuugaaguagcagcuugugguuuucuuugggguguggccaaggaauccuaggcuauuugguuuggggaccuuuuguuuauuuuugugguaugcggcaucagaucuggguccuuacacugugcacgcgaugacuuagugcuguacugcugagcucuaccccaggcuggacaguuuuugucuuagaaacaguuccuuccaggagacuggguagagccgcaguggcugagagcacuuguuauucuugcagaggauuuggcuuugguucccagcacccucagaauagcucacgacuaccugaaauuccagcucuaggagaucuggcacaaguuuucacacauaauggaacauauacauauucucagguacauacacuuauacacauaaaauaaauaacuauuuuaaaaaucagaugcuagggauggaagaggaaacuguagcugaaggaugagcugaauguaugaggguuuugccagcgaguauuuaaaugggccacauguguaccuugugcagaagagggagggcuucagauguccugggguuagaguuacagauguuugugaaccauagauguuugcugagaauagaacccagguucucugcaacaauagcaagagcucuuaacugccgaaccaucuucccagcccaguugguuaauucuuuuucuuugacuguguucugcauuaagggccuaaagaaagccuuucugagaagggucaugccugccucccugcuucucacacauaagcccuccgguggcgccuugggaaguagacucugcacagcaaaagugugggcauuccccagggaccccaccuucucccacagcagcuauagcuuuccacuaguaaagacagggcugcaguuuuagcaauacaguucuguuugaaagaagcuagagggacacuuuguucagggaacauuuccuaaacaagcugugcucucuagaauugcugaguucccuuuugaaguguguacaccacaccagccgcccgcugugucugcagugguucaccucagcccucgggugcgggugaccuguaagagccgggccuuaccuguggcuucugaagagcucugcaaucauauuagcaugcuuaaccucuaauguugguagagaggcauguaucaaguggaugguaauggguaugaguguuuugcuugcaugcauguuugucuccuggaaggguugcaggggugcuaacauccucuggugccuuuuacucucuguagaaaaggcauuucguggaucaccggagagugcugguccguggaggaagcgggggcucuggcaugagcugcuuccacagugagccccgcaaggaguuuggaggcccugaugguggagauggaggaaaugguggacacaucauccugagaggcacguccccuggggcagcuggggagggacagccugcacacgggguggagguccugcuguccuaucuuggcacguaucugcacucaaacuugguguguacacagcauuuuuaugaauugugucugugcucagcaccaguguaccaaggcaagagacuuuggaugucauuuuuguuuuuuaaucucagaaacacaaguuguuucccaucaggagccucaugacagcccaugucacagggucagacagugcagcagagcccuuggcuguacugagcaaaugccuggcaugaauauucagcaagcugggugcaagcaucuucauagcauaaugaaguuagcugcugguuauuguauguguacgggugcuaggccugagugcuugucuguguauguaccacauguaugcccugcagaggccaucugaccuagaauugcagacagcugugagcugccauuagacgcugggcaccaaccugcauccucugcgugagccgccaugcuccuaacagugcccagcucuuuagcuccguaggugaauuuuuuuguguuuuuaauugaugauagucauauucaccuuauauggugaugccuuccugcugcaaguuugaaaaaauuucaggccagucagggcuacaauucuacacagugaaaacuugucaaaaaagaaagaaagaaagaaagaaagaaagaaaggagggagggagggagggagggagggagggagggagggagggagggagggaaggaaggaaggaaggaaggaaagaaagaaaggaaagaaagcaagcaaacaaaccagccagccagccuauggugguaguggugaugguaguggcacaugccuuuaaucccagcucucaggagaggcaggcagaggcaaguggaucucugugaguucgaggacagccagggcuaaacagagaaacucugucucggggaagaaaaaaaaggucauauucuauuucgguuaggauaaugaagagugugggcggccagccguacacccaagccaggggaggaggaggguggcagauguaaggcccuguuccccgcucagcagcugcgucggcugucuuaacacaaaggaacaugagguuuugcucuugcucuaguugaccagcaagucaaguccuuguccucagucuuaucccaguaucagggcuucaguggagaagacgguggcaguaaaaacugcucuggacgagguggugccacccucuacauucagguaagcuggggagcuggagcaggagucguccccugcguccuagucacugaguccaugggugacuaaagcacccagcugggaacagaagcggacagugguguguuuuaggggucacauuccccacacaaucaccuuugcacuggugugguacuguguugcuucugacccaagagagucuaaaggaaugaccuugaagagggagccaagcacauacuuucccaugucuagacaggggcagcaugcccacuccaggguuccacacucccaugccgguucccuacugcuugguuguucagguccuauagaaacacuucagaaaagccccauacagaaauggguuucugguguuaugacagggccucacugugggacccaggcugcccuugaacuuguaaucccccugccucagcugccuaagcgcuagaaggcaagucuuaccaugacaccuuauggggcaucugacuagccccauaaaaucucuucggagcagagauuuguuuguucugauaccugaagagagcgguuaccagcgccccaccccuccucuuccuggcuggugauagaacaccugaugacagugaugggggugggggugcuuuucaggucccuguggguaccuuggugaaagaaggagacaagaucguggcugaccucucuaaccugggagacgaguacguggcugcucucgggggugcaggaggaaaaggcaaucguuucuuccuggccaacgacaaccgugccccuguaacuugcaccccuggacaaccgggucaggagcggguccucuacuuggaacucaagacaauggcucacgcugggaugguaugccccugacagugccacacccugagggugagcacacucuacccaggagagaaugcuggcuuucauucaucgccccugcccagugcucugucugucugugccagcugcugguggcauugacaguguccuccaugagaccacaggacacuuuuacuuuguuucuagguuggcuucccaaaugcugggaaauccucucuccuucgagccauuucaaaugcaaaaccugcuguagcuuccuacccguucaccaccuugaacccucacguggggaucguucacuaugaaggccaccaacagguagcagguagagccucuaaaacccugccagaggaugaguuuaaauggcccagugauucaggagagcaauuauguaaccccgaguuucucuucccacuuaaaaaaugagacauuguuuucccugauugaaacaauuuuaaugagucuguucucugucaaagucagccccuccccucccagccaagaaauccgaucccuucuguugggaauuguacucuugaguugggagccugaggagaggacugccucuugccuuccucauucucuccuguggaacugggcgguaucagucaugcagacagcaugugguuuaaaaagccuuuccuguagcauuuuaagaggaaaacuuuuuuccagaagauaauguacccauuaaaaauagcaagccugcuggugagguuauuugugcagcacuuuauaucugcaaagugcacgauagugauugguauccauaaucaaauuauccauagaaugcagggagccagcucccuuuuaugaacuguguuugaagccugggagacaggaauguguuaaaucuuccucauuagauuaauccaccaugccugucacccaaauauuucagagcauuuuacagaccugagagcugaggugccucggugucgcuuggccugcugagucaccugggggcggaugaguggcuuugauucccaguguuccuugaaaguuguagaacaugagaucugggccagaaagggucucccugaggggagucuccugaccgcaauugggaggccgagaacaggacccugaccugacauaacucuuacuucuuucaguggcagacaucccaggcaucauccgaggugcacaccagaacaagggccugggccucagcuuccucaggcacaucgagcguugucgcuucuuccuguuugugguagaucuuaccuugccugagccguggacucagguugaugauuuaaaauaugaacuagagaaguuugaagaaggccugucagagaggucccacgugaucauugcaaauaagaucgaucucccgcaagccagagcccgccugccucagcugcaggcccgccucggacaggaggccauaggccugucggcgcugacuggggagaaccuggagcagcugcuucugcaccugaaggagcugcaugaugcccacauagaggccgagcuggagcagggccgccagccucucaggugguagugggcacagggccgugugccccagggccagcguggaacgggggugggccaucaaucacaggaagcaaaagcaaccuuuuguaaacugcgggcccuuugaacucccgagacuaaguacuugcaaauauau

SEQ ID NO: 1330 - RNA, 18625 nt, Mus musculus
cauugguggcgguggugaggccacuacccccaucccugcgggagcggcuugggcgaugaaugaagcgggagugggcugcgcgcguaguccagagcgcagggcgcagcgcggcagccggguucgugggaaggugagugcucugggaucuggacugcuuugaggucucggaccaggauggggacagggucuggcuccguacuagaugccuccuagguaugccagacuccgaccugcugacgucaggagcgcggcagguguuugcggaggcuggacuaaagcgcggcggagccccgggugcguugucugaagacacaucccggggaaccaaugcggggacagagugggcucaagggagccggaugcagaauucaccccuucucacugcacaugagggaagcugcaagucugcaguggggugggggaaggcagagccgcugcgcuagagcgagagggaagaugggaguggacuuggggcgcaggaaagcgugagggggggggggggaccgcuagagcugucggcccagguuaaagguuugcuaguauacgcaggugcgagccucugcgggucuguucagcgacagauccaguggcuguggugguuguugcuaagaccgagggaaacguggagcacggaaguugcucacuaguggcgggcuuugucccuacgaggagcgcggaugcccgggucccugaggcccgguaccuucacgcagcucuccgaugcccccggacgcguguguacgccaacgagaguucgggucgcuuugcugccugauuggcacgcuuagcuccaaacccgggaacucaaggcaggguaccuccuucacaggagaggugagcaucuguaggaaaaaugagauagagacacauagucgcaccuuauagcuuggggccccaggcgcaguggcuugaguuuagcgugaugaggauugcuggccucccccagacauggccuugggguguuucugucccaagguguugaaacugcccauuugugauggaacuaucccaacuucagggcaguguuuuuuguuuguuuguuuguuuuguuuuguuuuguuuuguaguuuaguaaaccaagguagcugucuagucagcuguuguuaaagcagcuuggggcagguggacggcagggaagagaacaccugguguuuagccgaauuauuuauaaaucuuagcugugguaauggggacagcaggcgcuguuugcugagccuggcauuugcuggcuuggagagggcuuuggauaagagcagucccaggcagcauuuuaaaguccccuugcacagaggagcagccuggggcaccgggauguuuggcuugccuagaaaugacacaggggagaccggagguuuguaucauuugccagccauucucucuucaagaagagaggaaagccaggucagagaaccagcaguuaccaggacaggacuaugcugguggccaaagguaccuaccuguuggcugugaugaggugcaagacuugccuugccugcccacuaggaaagaccaacagguacuaccuggauaaauucuuccuggaugaucuaauuguagcucauugggugugguccccaaagcagaugcuggacaagccccaaccagaaccuuccccaauacugcagaggggccaggcaggcaagacggaggcuugugacugggugaagagaggggcagggccugggccaggaccagcagcauaaagacuuguaaaugggcccagcaggagagcuaccgaguaacuguuuugcagcaguuuggacucugucuaugccuugcuuccagacacucagauuuucucaguucacugacauauggggccuguuguugugaguccucuuucuguuacagaagucuucugacuuaaccugcuucccaggugggugcuguuguguuuuaugaauucauaccauugugaucuccuaaaguggaacaggucgaguucccagccugaagguccucugcaggacggagcauuugagacauagaaaggucacugcccacucuggugcuccuggacaccccugcuuccucuugaguuauacucagugcucccuuccugauccccguggucacugagagagcucaugggcuaauccuuggaaccucaccacagaccuuguucugagacucuggagaaacucugaccuuagcguggucuugaugaacaagagggacagggagguucaacucuagcucucagccacugggaguaacugaacaggcccucagggauugugucccauguauccaguggccaggguucugccugaccaguagagccuggaagccuugcugguggagauggaggaaauguaccagcaugcagugccuggguuguauccuguugugggucacugcagaggcagcggcugaucugggcgcauccuccaaaccugcugcucucaggugagggucucugguuuuccccagcacccuuuucccaaucauggacagcuaucaugaccucauucuuguuuucauuacaaagaauuauaaucagcugggguggugcugcaugccuuuaaucccagcauucagaaggcagaggcagucagagcuccgagaguucaaggccagccuggucuacauggugaguuccaggacagccagagcuacauagcaagaccccccuccccccaucuugagaauacaaaagcaaacaaacaaauuagaauucugggcauuucuauagauaagggugguucuucucaaacuacuggccuuuuaaaaagcugcuuguucguggcuuagaaaccagagaccauggguagguaaggugaggcuugcagccauugucugggcuucccuuggcacaagaugcccauaacuccgggaucugagggagcuccaauaugcuguuucuucuccucccgagagcuaccaagcuccccuuccauauguccaggccuugccuuugccuuguaauuuuuaaaccugcaagcuuuggggccugccucagacacugcuccucagacccaaccaagccacagagaacacuuaggacuaucugagcaugguccucuccacccauaccuacugcugguauuuucgcacccuggcuaugccagucaggucucuuaucuagcuagagcugccuccuccugaaccuaagaggacccugagaaucaugaagguugucugucaccagaauccuucaccguccccuagacuguagaagagcuguugcaagaaccaucacaccaacagucagcgaugagcagggacaaagcaagcuacuuuuguccccagcuaucagaugagcugagggacaucaaaugagguauggggaccuuuuugaaguccaggagcgccaugcuacagagguugaaguuacccaguacugcaggucuguuucccaugagacguaaguggcagcugggcugaguccaguaccucaugacacacugcaggagggaaacugaaggucagagaggccugugaccugccuccugccuggcucggaggcagccucuaccagccccucugcuucuaaaauccaccuugacuagcaaggcuuccauuccccuccaaagcauggugcauggcagaaccuucucugugucccuggaucuccagauccccagauccagacaggauaggagcaaaccuggcuggcugagacagcagaccucuguuggacacguccuucuggugccagcccuggcgucccuuauucaggucccaaguccauggcagcuccugagcaaagccccagguuuccuauacuuucagcagagcauggcuaccaggugugcaaacuggguugcacuaggugcuuugguggcuggccaauacaccgugccccuugucugagccucauccugaagaagggaacacacuccucuugucuguaagaggggauaccugggagaaauuaggagccagagaagaguccuaagguccugggguugcugcugacuaguguguaugucaguagggguuucaggagagaagugggcuuaguuuguuggugaccccagagcaguugggugcagagaacaauuucuuuugccuccuuuuucuggcugaagcugagagguguugggguuggaaguggggagaagagagaugggaagagaaaugacucugugguuugcuagcucaaagucugaggaaguuauaggauuugggccucaaagugucuccaaacgaggacagaauucuacuagacaucccaccuuuaggacuuuacaauguccugggaacauccuacagagauccagguagcagagaucuggggcagaggacuacucugaaauucuuccuuucaaauugcagcaugagcugagaggccuuagggacugcuccagcugggagucaguaaauggauggauaaggaaauaagggagcaaggaagagagugcagccaugcgaaggccagagaccuuuucucacagauuaggugguagcaagcugccucuggccacugaccuuucugggaggcucugaggaggcagccagagcugucuggauucuuccagaacuaaaagacaucaucaacuaaaggcugcaauugcagcccugaagacagugcaggggacuuguaagggaaucuuggucaccugugaccuccuaaaauaacgcacaugcauuacccacgccuaugcacacgccugcccuucccacagugcucagguguggccauugucagcugccagaggccccagggcuucaucaucccgggcuaaucagcuuggccuaaucccacaggggcaggcugcugggcugucuggguggagccugccugguaggcugagacacagaacagggaagguuggcuauguaaaagagucauaacccugcuguuccccaccugcucggacugagaaaacuccuccaaaucuggugccaacuucuccuggucucaaauauuuguuuucccuacuacacagcugcuagaaguggacguagaugcaggagccgggacuggcacacaggcaggcuccacggcaguaaguaguccccaugaaaaagccguuuaguggugaagguagggguaagucacauggcuggaaucccagugggaaaaaggucucuguccuuggauacugucaggaguacagggccgaggugaguaaaguaauggaccugccuuccuauaaaucgaaucaguugggcauauguguccaguagauccaggcagcccccauuuggucaugcucacaaagauauuggauguccugugaaaggcucuccccuugucagcuguggaugagcuagucccagcuccauguguuuugcccccuggagccuguauugugcugaacagcagccacacauggcugucaaggaccucucaaggacugcucagguguaguggcugugggauccagguaaugauuucuguauccugggggcgggucccugaacccugguaccuaacagagguucccaacuauggcagagcaguaucagugucaaaggaauaggaugaccucagagaaggaagccaaugagaaaucuacagggauuuacuaucaggaacugacucaugagauuaugaaaguggaaaugucccaggauccugaggacgguaagcugguaggccaguaucccuuccaugcagccaagccuuccagacguagugccuguagacucaaugacgucuuauucagaaaccccucagugacaugcgcauggugacaugugacaaaugcaccuauggucuaacauuagggucugcuccagccauuccagaaccaacuuaccagaaccuaggaagaaacuugagagcuagugaucuggccauaccuuagcagcacaguccugcugaaaccagaauggcggcugugguugugggcccagagacccagaaauugcuguuugugucauuagguuguuuuauugguggugauggugaggcguauguuccuguuacugcucacgugugugcuggugcacaugcuaagcauguaugugaaagucggaggacacccucagcuguugcaagcaccaccucaucucaguuuuuguuuguuuguuuuguuuuuuugagguagggucucuuauuaacucggcaaguagacgaagcuggccugccagugagcguuaguaauaagccuggcuccaccuccucagggcuggaauuguaagcgugaaccgugaaauccaacuuuagaaaaacaaaaucaacaacaagaaagccauguguuccagggcacagaauucaggcauuacuccuugcaaggcaaacacuuuuaccagcugagcuccggugucgcucucaaacauuuauguuuuauuuauguggcugaguggaguuuaugccuucuaugugugggugcccacagaggacagaaaagggcauuugaucuccuggagcugaaguuauagguaguuguaagacaccuucgggugcugggaacagaacucgaguccucugggagauaccgccuuaacugcugagucaucacuacagccuuaccggccccuuuuuuuuuucuuuugagucagaaucuccagcuuagauuggucuugaacuuguaauccuucuaucucaguguccccacaugcugguauuaccgguaugugccacaggccuaaucagcuuugccacccuaccauggaaagacagcaaacaucaggaagucacguggcuaauauuuacaguaggauuucaaauugcucauucaguguguuucaaauauuugucauugcucuuagcucgggugaaaccagggugaacuugcuguggggcacccauaccuagaauucuuaggugguggcuuucguuuucagggaagaaauccuguuuccuuuuguguggugcugaucacaaaacugcggucuguugcaguauacccgaucugccuguguaguccuguguggucccuagcaguugucgugggauagggaggagagagcacaguggacgggaggcaaacccgaguuuaaaggcaaacgcaaacagcacucuggugaccuugaaucuuuuccuuuugauucucccugugcccaaagagucugcugucagcuucuaccccaaguucuaaggcuggugcacaguauggccauucucaccccucuaucuggcccuacccuguuccucuuugucucucuucuguccuguuccacugcaguuugagaaaguggacuaaaugucucggccgccucuacugcaccucaccugcugugcugccaaagccuuccccaugaggcuggagaugccccagccugggaugggggacacacuugcuuugggaccagggagaugacuuaggcagggaaaaguuugagaaccugagcuggaccccacucucuauguaagaggacauucauggggauacgugccuguaaucucagaauaagggaagcaagcaagcaaagaucucuaggacuugcuuagacaucacugagcuccaggucuuguuagagacccugugauuaaaacaauaagguggagguggcuaugagccccuccgugucuuagcucuguucagugcuuggugguuccauccaguaacucugacuucagugucuucagguguggccacaccuucagagucggcuggaauccagucccugggaccaggcuguaugugacccaguagcugcagggcuguggcugggagcaaggugugagggaugggccaacagccacucuggcuccaggaaggcugaucccagugggaucugaauguucacgcagauaggggagcagguaaaaguuuacuaaugagaaacucuguucacagauagacccagugacaagacagucucucggccaccucuacugcaccucggcugcugugcugccaaagccuuccccacgaggcuggacaugccccagcacgcgaugggggacacacauuuccucucccucccgaagcaccucuuuacuagcacguccucagccacggacagcgggugugacacuccgcccagcagcagagcauccccagccucccugcgcucugcccacggcacccugggcuccuccagccaaccccuguuugagccccaggcugagaagcggaguagccagacagcccgugaggugcaguauguguccucggggccacagaacucacugugcggcuggcaagccuucacgcccaagugcuugcaggucuucaacacccccaagggcuuccucuucuuccugugugcggccuccuuccuucagggcaugacagugaauggcuucaucaauacugucaucaccuccaucgaacgccgcuucgaucugcacagcuaccagagcgggcucaucgccagcuccuaugacaucgcugccugccuaugccuuaccuucgucagcuacuuugggggcaaugggcacaaaccgcgauggcugggcuggggugugcugguccugggaaucggcucccugguauuugcacugccccauuucacugccggccgcuaugagguagagauggaugaggggcuggggacugggacgugccugacuaaucagagucauguggaguguaaagacagugccucaggccuguccaacuaccggcugaucuucaugcugggccagcuccugcacggugugggugccacgccgcucuacacacugggcgucacguaccuggaugagaacgucaagucaaguuacucacccaucuauaucggugaguaggauuugccaaggaaucaggguggguaggcagaagggaucagcaggugacaugaaaugaagguggugcauucugggggccuggcuaggugagcuuaugucccucccucggccauaugauccaagugucccuaagcuaccacuuacaaccaucagggcuuuuuaccaaaagauaggagaguggaugucaacuuuccuaaggagccccauaaugguucagaccagagaucucagcacagcccuauacuaggugggcccgcucacguggcucaggggcuccaaguccuugggcagagcuaaggaaggguuagcuggcaaccauccucucuguaguuuggaaagaauccugugcaaagauaaguggggggaauagaggcaggcuccuucugugcccuguguguaccuagccugggcuugcuagcugggaaguaaauaaaaguuaggaaugcugacuuccaggcaaagccacacaacagcucacggcuucuauaucguggccuaugaccuucgagacaacugcaugccaugcagcugagugcaaagucuacccaggcggccuccgauuccauauccucucagcucaggcucaugccucaggaugggcaguagggagccagucccaguugcaggcuacacagaggcacacuugucuacaguggucuacuauggggcuacagguacaagaacaugguggagguaucucuuaggaggagggccccacugaguggccugugacggcugcacacuauuuuugcuuuucuagccaucuucuacacggcagccauccuuggaccugcagcaggcuaccugauuggaggagccaugcuaaacguuuacacagaagugggccaacggugaguaauuagauguccccaccugccugccucaguaccugggaugcugugggccccaaagaguaguucagauauacagcaugaagauagagcagggaaaaucugggcuagucuuggauacaggacuggggguaugcagagagacuuggggucugugaguggcuuccagggcagacccagagucaggcucgagauggguggagggguguggauucaagaucacgugauucugaagcccuggccaugugucuucaaagcucuccucuugaagugacaggcaacgagucuguaucuuuagugugugguacuaauauuuguaaauguaauugggagagcggggaguaggagggaugggaggagacaaagcugggguggccuuugcuggguacugcccagcaaggcugugugguggccuugcccuaccauguccuuccauggaaggguagcucucauuugaguuuuccugguggcugugcuggguuuggggcaccauuccaccuuaggacucucucugcagauggcgccggcgagguuucuagcgcucugcccucucacuugccgccucuagcccuggguugauacuauggggucaagggugcguguucuaugcagagccugagguaggucaaggcuccugucuuugcaucuggauguguugugguccuugggcucuggguucugaguuaauaugcacacgggugggagcaugaucuagacccuggggcagcuuccuacuguuucagaacagaggguguacaagcucugcucuccuggcauugccaucuaaaguccuuccuccauucuucuuccugacccuugucccgccaucccaccaucccccaccccuugcucccuccgcacccucuucuucccaaguaugaaauccuauuggccagucgcuaccuucccaugacuucuccuguucugagagcccccucucucccgugcagauggcaguccgacgccuaauggucccugugugaguagcucagugaacuccagcugagccuucuguccccugagcucuguggcccugaggaugacagcugguguggggagggauaccagcuguuacuugaagcuccuguccccaaugggccuugcccccaaggucucagucugaggcccaguugcagcuucccggugucuggcagucagggucugagugaggagcugcucuuuuagggaauggccacauuagaaggcuucuccagucugaagaagaagugaacauagaguugugaccccaagagucucuguugcccucugugaagagguccuaggggaaugagcaggcuaacccauacagguacuggaaaagacacaggggcacugaucaguaauccgaggaccauugcuucuuccaacaggacggagcugaccacugacagcccacuguggguuggugccugguggaucggcuuccuaggaaccgggauugcugcauuccucaucgccauccccauccuuggcuauccccggcagcuaccagguggguuccuggcccuggcacagagguccuaucuaggaggcagaagauaccccucccugucauguucccuucucucuguccuuucaacuaacgaggcguggaggcuuugucaagcagccugcuauccccuucugugucucuacuugaaaugaccccuccaccuccaugccuacuggauccauaugggccuugcucucaugucugcaguucugucacaugacaacuccaccuuuucuggccacacccucaggccuuagacuguaauaccgcaugagcgucugcauacacuguccccagguccugaagaguggaggaguuggggucagggcaaccuccauggugacauccucuggaagccuuagcugucuacugauucugucccuccaggcucccagcgcuacguuguuaugagagcggcugaaacacagcagcugaaagaccacagccgcggagcagugagcaauccagcuuuuggcaagacugucagagaccugccccuguaaggaguguguguuguguuguauguguguugaguuguguguguuuuguguguguauguguuguuaguauaaguguuguguuguaugugaauuguguuuguguggguguuguguguuguguaugugaugugugucuuaugguguguguuauguguguuuucuuguguauguguuguguguuguguuguaugugugugguauguguaugcaugcgaccagugcacucuccauaccauccacagcccuuuaacccucuucuugacccaccaagcacugugagacaugggcagcagaagcuccuggcugaaggcacgggccugguugagaccagaaccacugugugaagccccauagagcagaugucuucccagugguaugccucccuguguaccugcaggccuugaggcccuccucagagagccccucagaugguauagaccaccauuguccuuucuuggguaucuugcuauuagaagcuccaaggagaugcgauucuggacuccucccccacaggacagagaaccacaguugcagaggccucuuccagcuuuuggcucucccacugaccuucguccccccucugcccugggguagucuuuuuccaugcuuaauguuuucacuccaucaccucuuuucugugugucuguccgagcucugcuauccuuacagaucaagaaacagucucugagcuaguggggucuugggggacaguguagauucugggaguuccugguaucuaccuacugucucuuccuuacacaauugacauuucaaaagaccuacaugaggcaaccuuaggauggguugcaaccccauugcuuggccugaucuuaugaauggcggcaacuaacugaccacuugggaaggcucuuguagguggggcugaguuccacagucuguccuuaacacagagaaggaaggguagcccccagggaucccagaauaaagcuaggcaaacauggagaugcaaguucuuacaggcuuuguauuucauuacuguucagcucacccaggacagccuaccuaagagggcugagccccaggcaugacugaauuggcugagggccuacaagccaugguccaaaaguuugucuuaaaguuggucucucuucaccccaacaacagagcgucugcuguuaaaccauuuggggcagcauagcauggcacgggggcuuugcucagcuggggagccugggccuccuacugugcuuuauacaguaagagguucaugcccagcauuagugucugaagcuaggcgccguuacugaacaagcccacaaaugcguuccuuccuuaagaucaugaaggucaugacaguucucagugcaaacucaagaaucucagccuucacugggguuagguaauauguggaacguguccacacggcgaagcuacccuuguccucaaccaccacagccugaagcuaagcaagccuaggcaaucccuugggagugaaccagccuguaccugguuaucccaugccagacauaggcacagaaccagcaggggaggcgcucugacaggccagcauccugagccuggaggucccuguugggggucacgguuccuucacacccacuuuccccagucagaacacaauugacuggaaagacuuuucaacccucaggucaagaaguaaaauuuaaaagaauugaguguacccuaccucagaagggauccugugugucucucacuaggacuggucugaccgcucagugacccugguucauugucuaggaagcgguagguucuugccagucugcacgcugucauggacccugcugaugguggggcucugacuaauccuggcuucucuucagagcaugguauauuuuggcccauauccucccuaugcagagcuggaguguggagcugugugcugcugccuccacugguacucagaacuaucgugcccuagaucuuagauuuggugaagagaaugagucuuauggggguaaggauguggaguggccacucacaggaggcaggagcaggcaccauaagccuugacacacccaccccuaagacccaauccuccucccaggcuucuggaaaugcuuuagugugcagaagccagcauaguuacugcaccaugagcugacuucaagggaugaaugcccuggccccgugugaccugcgacuugggauagaugaccguaggggacaaugauccgcugugaccuccaggcuuaagguggcagcuguccaagaaggacuaaguucaggcucugcucccaagagcucuaauagcucaugaucagccucacaguuggcacacaguccucacucaccccaggaaaccuggagcccgacucccagccagcagggaagcugcagccugacuccaggccagcaggaggcagagccuucagaaucgcccgccugucagaugggugugcugucacacccuggucacucugccuugcggaaggcacuucagucaccaccucaccguguggcugaugucuuugacauuccagacagaguggcaaauggagggaaagagcccugcgugggaacccagcucugacagugcugggaccuuggauucuuaggacuccaggccagagucacugugggauuaacagacuguaucugaccaccaagccuauuaccacuccuacagccaccauccccuaaguacaagccaagagaaagggagcaagccagaccgacucaggacuccuugaagguggccccuguuuccaaacccagaagaugccugccucuucucucuauagcuugugcuuggcaaccuguaccucucuuggugacuccuacccagucuaggucccuauaccuuggugaccucuuaccccuuggugaccccugccccuugguggcccaucuuuuggugagccccaucccauuagagaccucagccccuuggugaguccuaccuccuagagaccccauucuuuugauggccuagcuccugggugaguaugagucuuaugggggccuacccccccagucccuuaguagcacccuuccuagcccuguccagcccugaacuugguggucaccaucucucuaccccuuacucagacacuucugcuauuuugucccgucccagugccuaccagaugcaauuacuaucuucauccauucauggucuauccauguccgcacacugaaacuggaaaucggccacagcagugacauagucuguguaauugguuuuaauagcuuuguggacaggguaccaaagguuuacaguggggccauuaauucacuaccugccaagcccagcuucucacccacucugggugucucugggcuagauggggguaccacuucacugcccucucaaacccagugccuuuccuguguggguggccucaggaacggcagguuccuugcaugcagucuggcgcaugcugacccuucucccuuuuucuggucucucuucccuuuaccccagcuccaucuggcuccuucuaagaaaccccacguucauccugcucugccuggcaggggccacugaagccacacucauugccggcauguccacauucggucccaaguucuucgaggcccaguucagcuugagugccuccgaggcugccacccuguucgguaaggagacccugagcauuggagcgcucuucagggacagguggagcuccugcaaguacuaaccucagccuucaaacuccaaguggacagugcuccaagacggaagggaaggccaacuccugcaugcaagccacuuuaccuaccacuccuuacagaaaggguuugggccaggcuguccccaugggccaugcaguuggugccccagagucuuagggaucuaaguuugagucaccguaccugccugacagagcucugugccaggcuggcuugcagggaccaucuagaguccuuacucuacagaucauggcuucccuaagcugagggcaggguacauccuugaugagagagguacaccucugccuggagaugcccccaugcccucaguggucagugcugagaucagccuagggcacugaccaguauggauagaagccaucagaugcagcccaccuugcaggucuugucuggguagugagaggguaucauauuggugacuccacucucuccagacacauccuuaucuggcccagaugcccacaccugauagcucccuuccauucuuugcacuuuccuaugcugacacccucaccccauguacacccacccuaugccuuuuucacugggcucugggcuuccagguccacugcacagagagaacccacccuacuccuacagcuaucccugagcagagaugggcagggaugauucuuuccauuccucaguguccgcacuaaugcagcagaaaugacaggaucaggggguuuuuggcccucacuaagugaguuucuucuucaggauaccugguggugccagcaggcgguggugguacacuccuagguggcuuccugguaaacaaguucaagcuccguggcucugggaucaucagguucugucuauucugcaccuugaccagccuacuagccuucuuugucuuccucaugcacugccccaaugugcacauggcaggugugaccaccggcuacguugggaggugagccuaguagagacccuacacgugggggcccugcguuccugaggagggcuggcaccguuggggagggggugaaggucacuguaacauguguagggaagucuaccaggaagccugaacaccugcuaacauaccgccugaugccgguucuguagccuccugccuaaaggacagcuggaccuaaaggcagcuugcaacgccaucuacuguugccagccgaagcacuacagcccccuguguggcucagauggcaccauguacuacucucccugcuacgcaggcugcccugcugaugccgagacagaccuggguggccagaaggugaguguggccacgcccacaucccccucucuggccgggacccggaaacuucugccuuugugugaucagcacuguuguugggcuccccagguauaccgaggcuguagcuguauccuugagaaggcuuccucuggcuggggcaaugcuaccgcagggaagugcgcuuccaccugucagagcaagcccuuccuucugguucucguguucguuguaauuaucuuuacauuccucagcagcauuccagcgcuaacugcuacucuacgguaagaagcucucucaccgcauuuucuuuugcaguaccagcagguggcgcucuacagaugcugcugggcccucggguagcugcaggcccuggaaaugggccucauucuaguggcaucggaguugacugucucugguccccaaagaggugcuuggcaccuagggagguggugauguggccuugaacuugcccaggacucuugcugguguaugggguaugaggugcacagccaagcuuccaugggcucugauagcgcaauuuuuauugcaggugugucagugaucggcaaagauccuuugcccuggggauccaguggaucgucguaagaacacuagguacugcgugggggugaggaagccguguacacuugugcagugcuucaggcauaaggaaccaagcaugaggcuaugggccacacugagaagggcuuuuucccuaacugcccacuagagggacacauuguccuucuauauacccuguagguuucuuagccucaacauaaaaaggcccuccugagaaaccauggugcgccuacccaaugccaguucugcaaaaagggaguuaagucuccccuuugccccuggaaccacaaauggacaaaguggccuugcaagggucuuccccgaugaccuauccuuucuucacccacuaggauauuaagugaacucucuccuuuggcaggcaguauuccggggcccauugccuuuggcugggugauugacaaggccugccugcuguggcaagaccaguguggucaucagggcuccugcuucguguaugagaaugaagccaugagccgguacaugcucaucgcagggcucacuuucaaggugagauggcuccucuggcgucugccuccaccucugcccucccccccccccccgccuccccaccaugcuccuaccuugccuuauauaaaggcucggccacgggguuagggccacccugaauccaggagacuucaucuugagguccuuccucagcccuacagagacuguguuguuagcgguuucuaaggacaagggugguacaugccuuuuaggggacccugucuaguccguaccaggucuuuccaccuucccuuggcuccuacuuuuaaccaaaggugguucucauucuuuaagugaagcacuggugucucaugcggggcugaucauacagaaaggcgugucuuuguuccagaaagaguaaggcagaguauuacaccggcacucacagcugggcagaauccccaggcuggccaggaccaacgucuccuccugucuccccagguguugggcuuccucuucuucgucgccgccuacuuucucuacaaguccccuuccguguccucagauggucuagaggccucccugcccagccaguccucggccucugacagucccacagaacagcuccagagcaacgugugacagcgcuggccucuccacauuuccugaggacucuuccuggaaacccugacccacccccacagggcgguaacacugaggaccuugcaaaaccucacacuguguucuggggucucgcacugccccacacugugacugagcagccucugaggcguuaaggaggaagucacgugugucauaggggucacauaugaaccagacacauuccccaagcccuggagucugaaagggggucacuacauuucauagaccaucaccugauccugauuuccugugucuacugagaagccccaugcagggcagcagugcccugggaaugauccuguggagccagcuauuggguaauuugcuugaaucugcuuacugccuguccuggaagcccgguggccuccaugcggggcagcagcgacuugaaucguuauguccagacguauauuuugcacugaaugguguuuauggaaucaguuuuguacuugaucaugugacucauguccaagcaaacugcacugaggauuugaucccaucugaggugccacgcagcuuguguggacaguguguuucuauguuuuugguuagaguguguacauaauauauuuuaauauuuaaaccaaugauccuugugugaug

SEQ ID NO: 1331 - RNA, 5090 nt, Mus musculus
agcugaagccuggccacagacugcugucuggcucugagcucugagcugucccagacaaugagacaggucagagccagcacccuccaugguucccugcugugagcauugucugguuacaggccugaaugaggggcaaguggagugucaggacuggauucaaggcuuguggcagccagcaagugauccuuaucaagacccaagaguucagagcuacaguggccccauagcacaaaggagaacaaagguucucaacaucuuagucugagaggcaucagucagaaaagggauucugaugccuggcaauggcugaggaauggguaaguaaugaaaccuggauggguggcaggguaggacccauggcacagcugacuggggugacucaggcccagaagcaaccauguucuuaaggcugcugugcccagcccuuggcccuauccaaucccauguagagcuacuaacaccugccugaaauucugacagucugaguuaaucauccaaccacuucuggaguggauccacuguagggacagaauggagguacagguagguagcaaggccgacaggaccuggauuucugucuucugaugccaaggaagcacuuaauucugggacugucgugcacucaggucagggcuacugaaagauauacagagcuucacuccuacaaaaugugauuguugggcuuuaaauuuuuaaauuauuuauggugugugugugcaagugugcauauaccauggaauacauauagagguuagaauacaacuuuuuuuuuuuuuuuuacuuauuuuauuuauaugacuaugcuguagcuaucuucagacacaccagaagagggcaucagaacccauuacagaugauugugagccaccaugugguugcugggaauugaacucaggacuucugguagagcagucagugcucuuaaccgcugagccaugucuccagcucuagaguacaacuccuaagaauugcuccucuccugccagcucuaggauccagggguggaguuccaguuaugggcugugcacaaggaucucuauuagaugggccaucucacuagcccaugggauguuguuguuguuauuguuguugcugcuguuguuguuuaaacuauuuuucuuaaacaguuuuagugagauguaauuuacauauuguacaauuuaucucuggcaaggagagacacaccuucacuucuagcugaguucuuuuccaaauuaccuaaccaggugaagcccagauuuuugggccgugugugucaugcuaugcagacuuggcugacucagaacuccugccucucucucccgagagcuagaauuacaggagugugucaccacgcccaucuggugcauuuuuaaagcauaagguuuguucccucgccuucuccggacagagccguaggcaguaaaagguucaaccaccaggagucgcugcugcaccggaagccagucuucgcugcgccugcgcggacgcgggcacgcggcguucuccagcccggcgagugcgcgcccuccacaccaagugcgccugcgcggagccuguaguauuuucccccuucucgcgccgggcgcucgucaaucgccggcggccaugggggaggccgaggugggcggcacgggcgccccaggcgacaagggcccaggcgaggcagccccgagcccugcugaggagacggugguguggagcccugagguggaagugugccucuuccacgccaugcugggccacaagccugucggugagcgccgcgccgcgcaccggcguggggguggggcgggauaaaccgucgggcgggcuggcggagccugcgaccucccacgggacguggccucccacucuggggugcccuacuagucuaagagccuaugacuuuccugcccgagaagcccucucccuggggacacuccugacuucccugcccuugagacacuccuaccccagggaacgccuccauucccccccacccccccaccucugcagcccccuguccuuggacccgccuacuauacacacccuagccccuggaacacccaccugccuuguggcaccucucuuccccuuugacaugugacuccugcaacacuugcaccugcggguuugcccacuccugccccuccuucuucacccauguccuacgcacagaggugcuguccuaacccucaacccacuguccuaccucucaggggugaaucggcacuuccacaugauuuguauccgagacaaguucagccagaauauugggcgccagguuccauccaaggugaucugggaccaucugagcacuauguacgacaugcaggcacuggugaguuggauccuggccugcccauuuacgggcugaccguggagucaagucccagauccugucagcugugguacaggacagaacccucuucucacuugggguuugguaugcagagcagaggugaucucaaaggaugaggcuccuuccucagaaaagcuuaaguccuguugugaaaagcacagacuagcgaugaucucugacuacuuuuucagggcaccuaccuacuuuagauuggguggcacaaaaaucgucgaggugauaguugaggucugagaugacaaagaagccuucagccaccguaaaaagcaguaaugguacagcgucaguauaggaggguccagagucguuugagagucuguauacugugggagccagacuccuccucuucagagagccuagagauagcugugucuugauggguagcuagguaacugguuuggagagcuggcaguggcugaugguucugcagguaacuaguaaccuugcuagucagguuugucugucuugucugguaggcagugagaccaggugaccaggauggguagagcuguaggugccuuugguuguucaugguaccccuggauacauuggccuggugggaguguuacaguggugagccgggucagguccuugugugcacaucagcagagcugcugugucuccagggcucacucagcggcaugguccucuccucuaguuuuguuuggcuggugcuagccugguccucucuaaucaucugaaaagcccagcugagguggacucugcaagcuggagcaaggaccccaccagcucgcagccuccagccugcuucuccuguacaucuuagugagcugagauccuauuuucuguuucuugaaaauacaaaaaugcuuugugccggcagcacgagucugagauucuuccauucccaaauccagagaggaacuuuguccuuccagaugagaucauucaggaaguccgagaaggugagacucggccaccaccagggcugggaauaaaaaaagccucaccaggccaaagguggggcggucuggggccuccagggagguguaaggauccugcucagaccauaccuccaguggcaccugggagguuuugggagccaagggcuggggagagcggugcucaaaggcagucuccugauggaugccgucucgugauggacgccgaggccugugugggcagcgagaaucggaagcagucauggccagaccgucccccagcgcuggccaccaccguggguuuccagugaacggcagcugucuccuccacaggaaaaguggucauugaagaagaaaugaaggaggagaugaaggaggauguggacccccacaguggggcugaugauggugagugugaacugcccuuuggagcaaacaugucucccccccagucuccucaccgcaggccagccucaggcagagugaggucagguagccauggagucaagagugaauggucacuuaaagaugaacucagugcaggucaucuuaggcaggauggccccugggggccaugaaggaaggaaccaagggccaaggaugggggccucugagggccaagaaggaaggggccaaggccgggagcaucaggugggcucagacaggagacccccugggacuccagguuucucuucaagcccagcuguucagggcacuuacccaggggaacauaacuggguacaaagagccugauguaccucugauuucucuagcugaacaggaaaaugagaugagugucuguauauucuauuucagccaaaugauuuuguuucucaguuuuuucaucuucagggagcuuggggaaagcauuagaaaaauccagcaaagacaaagagaagaacuccucagacuuggggugcaaagaaggggcagacaagcggaagcgcagccgggucacugacaagguccugacugccaacagcaaucccuccagccccagugcugccaagaggcgccgcacauagacaccucauccucagguggccacagagaugcuccaacugccugucuccaggucccugggugaauguggccauccagcagagaugcuaguggggcuuccgcugugucaucagaccuccagagcaccugauuggcccaaaagaccagcaagacccuugucuacucugcagauggugaagccuuugaggcagccucuugcuuucuccugugggucccuugugcccacaguguguagagaagagcaggugcauggggccaggggaccaagagucagcaagcaauaagacgccacccucacuguccucaggagccaggcauccucccugggugcccacucuuugcaucugcuuuuccuguaagacuccacugugcacuggcauccagagaaggugucuuuggaguucacacagcacacacugugcacagaaggccuccccaucugggaaauagaacuggauauuuugccucauucacuuguacuguaauaguguauauaacuuaguugguauuucacuauuuaauuuuuaagaagccuauuuuacuaguguuuuguaugaagaaaaauacugcagaaguuaaaccugugauguguuuuuuugagcuguuuuguuuuaagguaacuacugaaauaagucuggcuguuuuuauaugccagauacagagaauuuuuagcgguuauuuuuguaauuuuaguaacuuggaaaagaccaaaaaagggaguggaacaaaggaaccgccauuagacugaaaaaacaauggccugaugguugaaguacauuuucauuugcagaauauuaaagcacuaaaaaaaaaaaaaaccuauc

SEQ ID NO: 1332 - RNA, 6595 nt, Mus musculus
uagaggcaggaaucccggugcacgcgccuccaggguuguccuucugggcggggggcggggggcacugccuucuccaggacaccgcuucccgccuagcuccgagcguagcagccccugcugggggacuccgcgcaagggcggaaacugagcggugggcgggaccuggcgccgccccgcccccgcgcuuccuccucuuucacuuuccuuuccgcggaaagcggguccagccugucgaguauggacgacccggaaugcgauuccaccugggaggacgagagcgaggaggacggcgaggauggccaggcggaugauacgaccgaugaggacacgggcgacgaugacggcgacgcggaggaggcacggccaagccuguuccaggugcggugcgggaggaccggagggcgacaggacaacgccaggccgugaucgccgggcccaggccgcuguccccuagggggacgccgggcccaggccuuggcggaccgagcgcuggugacgucaaggaagcgacugaugggggucguccgugggugacgucagagcgcgccccagggccucauccugcguggguggccuuuccucagguugcccucccuccaccccacacucagccccuaccccacuucagacagccuccacuggcucagaagugaccccggccuaggacgccgggagcaggggucugucuaucugcccuuagcucugguaacuuuuguugccacccggagcauguuccguuauacuuuuguaucaagccgcauguaaaccucaguggcguucuguaagacgcacuggccugcuuauagcugugauuccgggugugauggagaaccuagaaaaacgagagugaggauuaugaccccaaaauccauucuccccaucgcuucgaucucuaguugucugcucuguaugggaaagcagccccgaaucuggagaagcucucaggcaggccagagcuagccucugccugaccacauugggaugaagcugaggcuggguagucagguuuguagugcaggcucaggccccuccugugggugguaaggccucccaaaagcucugauagaacugcuguuucuccacaaaaggucuuagauccuaccugaaacaguagucacuuaagagccuaucccaggccugguggcacagugucuuugucacacugggccagggagaagcagggguuuacaaagaugaggcuucauucacccauccaucagacccauccagaggcaucuagguuuuuuucuugaggcuguggcuggcaaaguagcuccccuuggggauacagcccagugacuauucacagaaucauaggacgagaaauacuacaguacucagagacuaggguuggagugggggcacauaaagaucuuggaccaaaaugagguugaccagcagaccaaggaggagaugcagcugggacuuaaagacagaagagcauuagccacacaccugggcagcuugcaggcuagauuaggccaaggcucccuacagaggaaaauugaguacugagaggugcagaggugguuguugaggcuauucuagugccacuguuuguguucaaaaugaaggauguucuucuaggguccagaucugucuucucagaacccuggguggggaccagaagaaaaaacagaagcacccauuccucuuacauagagcucagugaugguuggcccaaaccgugcugccuucauccuggacacuuuccaguaccucauccuuguauuuucuccccagucuaggaugacaagguaccgaaacuggcgugcuaugcaggacaugcaaagauaccggcacaacuacccgguagguacauguggcuccuaccgaaagucacagcccucuccccaaauagaacauccccuggucugcugaaaaaccagcuuuggguucuuggguguguuccuuauugucuggaagacaaacccaucgucauuucagauccauacccuucuaguuauagagugguagagcauguugcccgaccugagccucagagccuagcuuuaaaaugagggucuagcuucagccuccugacagaacauguggcucagugcuucucacagggcucccuggcugguacgugggaucauuuucagaccaucuccucuguauccaugaguuaguugcuagcagucccugugguauuuuggagguacagaaagggagcuaccaucuguggccucuguugguggggagaugaagguugaguuguccuccaaaccuacccuugcucacagaaaggaucccaggcugagcuuugggaucuuggacagcuauccccacuccugacugcaugaaucugaggggcucucagagagagcuguuucuccugaguccucagccagccuuucucuggcccuucaggauuugacagaucaagacugcaacggagacaugugcaaccugagcuucuacaaaaaugagaucugcuuccagccaaaugguaccugcccucgcagccccagcaccuucugcccuuggccgguugucuaaucuauuagcacucugcuucaggcugccuguuguccucaauccaauaacaugccuacagaccaccgaggggauuggagcuuagaucuuaggauauuagauugaagggccagagaauaagcuuucgagguuuuaaaugguggucuuucuguguaucccaggcuggccucaaacucaggaucuuccaucucagccuuccagguacugaaauuguaggcaggucugagcuacuauauauguuucaugacauaaacauuugaaacuaaacaguaaguagaguucuauuggugcuuguuacacccauccacacauguaguuacuuuuugauauagccuggagaaggccaugugucuacacagccaagauguuugcugucuggcccuucaaagacaucuucccuagaccaugcuccauacuuagucucuauggggauuucucuugagcacagagcuuccugccugagaagauauaugucccagagaggaauuauugcaccccuuaccuacagaaguagccuaguuaccuaaaacuagugugugcuuauaucagaugaguuauggacagcucugcugaguccugagaauccuaaaggaauugagggcuaggcagugauuuugauagaucuguccucugagcuaugucaagguggccacuguagcugacuucucuccaugggguguccaggcuuucucauugaggacauucuucagaacuggaaagacaacuaugaccuccuggaagagaaucacuccuacauccaguggugaguggauugagccuuagggaaguggggcuggacacugaggugggaguucucaugucauguccagguucagaugagggcuauugugcucaggucugugggcaggcuuuuauguccugggaggaguuggagcuggacuacaucggacuugauuuuuagcaggaugugaaugagauaccacaaagcagacucagaaacgaugccauuuccuggcaagaacaacauuccuuggcuugaggacaacccacugaucugcucccaguauccucuugucacggaguacguugugggaauaauucugcaggguuaaugacaagaaagaacaaacugaaucccuaggaaagauagcucugccccucagcuggugaaaggcacacuggucuccgccauuuugacuuucuaccacccagcccacugagcacauaggcugggguucuaagaagcugucuuaccugcuuucggccgacugccauccuuacccacuuccuuggguaagaaaggccaguuagcuccucccagagaugaaagagaggcacugaguucaaaaaacgaguugcugccuggcacucaagucccuguguccucaucaucuucucaggcuguuuccccugagggaaccaggagugaacuggcaugccaagccccucacacugaaggagguugagguaagaauuccaccuaugccagaaugggggagggaggagagauaccccugccugcagucacccugagacagugcuguccugucuuaggccaaaagagccccaugaucccacuuuuggggaccucagagaaaggaggccagcucuaaaagacuaaguaguagagauaagggccaggaggucccuggacaacagcaaggaacaccuuguggcagguggcucaggauagaggugaccccagccucucggagaagaaagcuggagguguguuuugucuuacccucaggcugaaucagggucuaagggaaaaaucacccuaccugguacccaggggcccacccaguguuccuugggaacagugaugagugagggccaccugagucccaggggauuguuuucuaggcauuuaaaagcuccaaggaagucagagagcgucuuguccgggccuaugagcucaugcugggcuucuaugggauccaacuugaggaccggaacacaggcgccguaugccgugcacagaacuuccagccacgcuuccacaaucucaacagguaaggacaagaccugcugucacccucccgucccuguugcuucccuuuaguaucuggggcuggguuuuaagcagagaggucaaaugcaggcucugaugcuugcuucgcccagaguguagugcucucuguggcagguggcucaggauagagguguuguagaaauuguggggugauggacaaagcaguuccuuggcuugggaguguuuaaucccuuccauccacccagaaagcuaggcaagggaggccuccagauggcauagucacucugggucagcccuuccuagcuuucagcaauguuucccagacaggaguccauggacugggccaucucccaggacuugcagauccuguccacaggucaaggguacccaggucauuucccuagguggggaccugagaagacucuagaacuuugagauggacuugacuggggaugccuuggccagauagggcaggguccacccuaccucuugucaccuaccuucacagccacagccacaacaaucugcguauuacacgcauccucaagucgcugggcgagcugggcuuagagcacuaccaggcaccgcuggugcgcuucuuccuggaggagacccuaguacagcacaaacugcccagcguucgccagagugcccuggacuacuuccuguuugccgugcgcugccggcaccagcgccgggagcucgugcacuuugcuugggagcacuucaagccucgccgagaguuugucugggggccccgugacaagcugcggagguucaggccccagacuauaucccggccacugaugggacuagggcaggcagauaaagaugagggccccggggaccccucccaagaggcuggcacccagggucggaccuguggaucuggaagggaccugaguggggacaguggaacagcugaggaucucucacuguugagcgcaaaaccccaggaugugggaaccuuggauggggaccaaaggcaugaggcuaaguccccgagucccaaagaaagcaagaagaggaaguuggaggggaacaggcaggagcaggucccaggggagccagauccucagggugucucugagguagagaaaauugcccucaaccuugaggggugugcccucagcccuaccagccaggagcccagggaggcugaacagcccugucuuguggcuaggguggcuaaugagguaagaaaacggaggaagguggaggaaggagcugagggugauggaguagccaguaacacucaagugcaggccagugcccugucuccuaccccuucagaguguccugagucccaaaaggaugggaaugggccagaggaccccaaaagccagguggggccagaagaccccaaaagccagguggggccagaggaccccaaaagccagguggggccagaggaccccaaaagccagguggggccagaggacccaaaaggccagguggagccagaggacccaaaaggccagguggggccagaagacccaaaaggccagguggggccagaggacccaaaaggccagguggggccagaggaccccaaaagccagguggggccagaggaccccaaaagccagguggagccagaggaccccaaaagccagguggagccagaggaccccaaaagccagguggagccagaggaccccaaaagccagguggggccagaggacccccaaagccagguggggccagagcaagcugccucuaagagccugggggaggauccugacucugacacuacaggaaccucaaugagugagucagaggaguuggcaaggauugaggccucuguugaacccccaaagccuuagagguaccccucaguccuaauuagcccacugcaggggguuucugucccagagcucuguuguuggcucuucuuggugccccacagugcuggccucucccuaguggucacugaaguggccaccagagggacugaggcccugcccucagggaaggccaaggccuucagaagccuccuuaccucacuguguccuccacugcccucugagcccuguguugugaacagacccuaagggucuaaggggaugggccucuuuucuucgucuggugccaagugaggccuuuucugaauaaacucuuuaggcuuugucuuuuggu

SEQ ID NO: 1333 - RNA, 8619 nt, Mus musculus
ugugguuauucuggaaguaaaaggaaaucuuuauuuucaaauaaaguuaccuacaagagauuauucauugauccacuaugaaugagucucucaucacauacagcaccaaaaauauauuuuaaaaaauaaaaaccaccacaaccucaccucucucacacacauccccucccaaaagccacacagcccacaccaagacaaaaaaccgauccaaacucaauacccacacaaaaguuaucuuugaauuaagauuuacaaauuuauacauuuuuuuccuaugaaggaacaaaaugaggaagaaaaagaaaagaagggguaaggaaaaccaugaaagucugugagacccaggaagauaaccccugccugccugcacauagcaggucggaaaagcacaucaguaauguucaugucugucugccugucuugggugaggccuucagcugagaugacacucccuagccgugcagcacacaguggcaaauuacaucuucuggaaccagcaaucuggaagcagugugugcagcucucgggauacagggcauggcagagguggugucuuccaucaugggcuugacaggguuuaaaaaggccauuuuccccuuuuaaacaauggggccaaagaaaaguacaggggaaagguucucuacuguggugacaaucugccagucacagccggaggagggagaguccugugccuauugacagugcuggguccaugcacaggcucuacuugggcuccucaaucacaccuuugcugaggucugucauuuugggauauuuuacuuucuucuggucuagcucauucugagcccaaaguagcaguuucaguaauuuugccagcuuggguguggacucucgauucucauaauccagaacagccugguuaacuucacuccauaccuagaaaagaaacacaucuaauagagaugccccccccccccccacauacauacacuaucagcaagccugacaauaugcuuaagacaucuuuuuuucccccagugcuagggcgagaccccagguucuuaagcagguuaggcaagcacucuaucucuaagcuauauaguccaguccaucuagauacuguucucauccaagaugcuuguuagucacuuaaaaacaaaugaaacaaguaacuaaaagccacuccaagggcacuaaaugacuuaggguggcuaaguacccugacuccccucaacaguucugugaggacucugacagagaggagcuucacaaugcuuauaugagacccugcagacaagcuuuaaagagacaccucaacaagauuuucaacggauccaacauagggggaaaggaagacaugggucuuaggaagcagugaacuaucaugcuuguagcauguggaaggaaaaagaaaacauuucaggagacuauacugauuuuacucugaaaauacuucagauaccugucucuaaacugauaggaaaaagguuaagagaagaaaaaguggcaaaggguuuuagacacuaacagucacaauggcgcugcucuuccucucacaagguaaaaggggacagaucaguggagcugccaguguucuacuggaguauccuggcccagagccaugugcuucaccccaacacaagcgcagcacaguaccaucuuuucacaaguccucugagugucuaagcacucuguucuuccuuuacuggcccuuuaccuuuugccucugcaucaugugaaggaggucuccaaaaggcgacuccucagggcuaucgaaggccagcaaggccagugugcgcuccaucucugugaggcauucucggcuuuccucacccugcucugccaguugugucugggcaaacuccaaugcugcuucugucucacgcugacggauaagcucaaucaaguguuguugcuagucaaaacaaagacaaacaagauuagccagccuguacacccaguagguggaacccaguauggucaacagcaaagacaaccaaguuuggcuggcauacacuuagaugaauaaccaucaacacuuggcuccaaucaaaaguauaucuuauguguggauugagugucuaacuaauaguguuaaaguacuuguuuagcaucuaggcaaugccugggcuccaccccaucacccuaaaagaaaauaagaaaggcaucuuaaaagaaacuuucuuagcaucuccaagaugcauuuccauuuuuuuuuccccugagacaggguuucucuguguagcccuggcugaccucgaacucagaaauccaccugccucugccucccgagugcugggauuaaaggugugcgccaucacgccuggcacauuuccauuuuaaaagcaaaaggagagauuggugagacugccacagugaaagugcucguugugcaaguaugcccagagcccauguaagggcagaaagaauggacucccaaggaaugccucuuauuuccauauguacacuauucauucauacucucucucucucucucucucucucucacacacacacacacagacacauacaccccuuuaauuuuuuccuugauaaaaguauaguuuuuauuauccauuuauuuauugauugauuguuagauauuuucuuuauauacauuucaaaugcuauccugaaaguucccuauacccucccccccacccugccccccuacccacccacuccugcuucuuggcccuggcauuccccuguacuggggcauauaaaguuugcaauaccaaggggccucucuucccagugauggccgacuaggccaucuucugcuacauaugcagcuagagauacaagcucuggggguacugguuaguucauauuguuccaccuauaggguugcagaccccuuuuagcucuuugggugcuuucucuagcuucuccauugggggccccguguuccaucuuauagaugacugugggcauccacuucuguauuugccaagcacuggcauagccucauacagcuauaacagggucccuucagcaaaaucuugcuggcauaugcaauagugucuggguuugguggcugauuaugggauggaucccuggguggggcagucucuggauaguccauccuuucuucuuagcuccaaacuuugucucuguaacucauuucauggguauuuuguucccuguucuaaggaggaaugaaguaucggcccauuggucuucccucuucuugauuuucuuguguuuugcaaauuguaucuuggggguucuauguuucugggcaaauauccacuuaucagugaaugcauaucuuuuuuuuuuuuuuuuuuuuaaagauuuauuuauuauuauauguaaguacacuguagcugucuucagauauaccagaagagggcaucagaucucguuacggaugguuaugagccaccaugugguugcugggauuugaacucuggaccuucggaagagcagucgggugcucuuacccacugagccaucucaccagcccccagugaaugcauaucuaaugacuucuuuugugauuggguuaccucacuaaggaugauauccuccagauacauccauuuguccaaaaauuucauaaauucauuguuuuuaauagcugaauaguacuccauuguguaaauguaccacauuuucugaauccauucuucuguugagggacaucuggguucuuuccagcuucuggcuauuauaaauaaggcugcuaugaacaugguggaacauguguucuuauuaccaguacacaccccccuuuaaaaaguaacuaguugcaauaguacauaaagcagcagcuagcucaaagccugucuccuuacacacaauggccgauuucuuucugagccacugcaaacaagcuuaauuugucugucuagcagccauaucagacugcugaaacucaccugaagguggaaguaaagauaccgguuugugucuaggagcucuggguggaggcuguugaucaaggcaauggccuccuggaucugacccuucagaaucaucucccgaaucuugauucgcucaucaaguguuucuagguccacacuugguucgaucccagacuccauccgaaauuucucugcugcuuccuuaaagcccucugaaaagaaaacuaucuucacugauaggaaagauaacuaggaauuaaggcuuuguacuucuaaagagcccaaccaucauuaaaugauccuacauauaaaccacaguuucuuaggaacuugguuuuuacuauuuuugugauuaauagucaaggcugucauuucuuugcagcuauacaaaaggcuuagccuaucaaccugaaggucacagacugcuagcccauugugugcugugacaucaucaaggcagggauuacaggucaggaugccagagcaacagaggcaauugcaggugaggcagacaccuugcugcaucuucacaggggugcuugcucuggcgccaccucauccacaggagucugguaaaaccacaggccaagauuccugcauccacuuucuaagaaauuuaguagaacauaacuggagaugugcaggaggauaaagugugaugggagacuuuucacugugugccuuuugagaaccggguaggagaacugauuccuucaccccagcaaucagugaaccuccuccuccagcaggagcaucacgugcuguuuucuucugcuuacucccagucauuuuccuuccuuuccauauuuucaguugugcaaucuagaaacaggccacaauauuuuuuccaaucuggccagaagauaucauuuauuuggacuuuaaauauacuccaaaacauucuuuuuuaaaaguuuugagacagacaggcuggccuagaauucauaaaaaccugcucuguccucugaguaagaacaccauuaaugaucaugaagguuuaacuguaaaauugucaaagccaaaaauagauguuguuuaggucucaaagaccuggaacaauuauuuuauugauaggaaaaauauguauauuuuuuaggggcuagggaaguugaggaaaagucucacauuacuggucuugaaucacaauccugccuuagcuucucaagugcuaggauuaugaguguggccuacaucacuuuggguuagaaaaggccauccugggcuggugagauggcucaguggguaagagcacccgacagcucuuccgaagguccggaguucaaaucccagcaaccacaugguggcucacaaccauccauaaagaaaucugacucccucuucuggagugucugaagacagcgacaguguacuuacacauaauaaauaaauaaauaaauacauaaauaaaaucuuaaaaaaaaaggccauccuuaacaugucaguuugauuuacaaauaucauaguguuuuuaugaauuuucaguacaaccuauuuuauccuuacgcuccagggguaaagggccacuagugugaaaagggagagcuaugcucaauuggugccccccuuacagccagccuuuaccugugacuagguaguucaugaugagucgguucaugucugcucguugaacaugcaaguuauugagcuuuuccauccauucaucuuugguuauuucauccggcuuuucugcauaacucauuaugauuuauuucuacaggaaaacgauacaaugguuagggaaaaauucuauguccaauuuaaucauuucaaaaaguaaacacagcaauauaguaaguuuaagaguaggaggggccggacagugguggcacaugccuuuaaucucaguacuuaggaggcagaggcaggcggauuucugaguucgaggccagccuggucuacagagugaguuugaggccagccagagcuauacagagaagcccugucuccaaaaaccaaaaaguaggaggaugcuuucaaucuucaaacggacaagcaaaaaaggccugagacaguuacacaucuggguagcaucaaggucaaaggugggauguaugguuagugaaauagaaucagaaguccuagaaugaagagaccaagacaucacacuaugaaggaggggauuagguuugaagcuaaaaguauuaaggggaaucacuauagaguuauacacuagacauuauguuaggguguuaaaaaggacacagcaaucaaaaggaagucaaguguuagucaaggguggagucuucaacuccucugugggaaaacugauaagauggcacaagccuccuuccucccuacuccuacaaccuagacaguuccagcuggcaccaaagaaagugcaguucacugaugagccugcauaagauggcaaaauguggacaccacucccuaagaaguucacucaacaagagccugaauaaaggagcucgauauacagaugccacauucaaacccuuggguaugaguguucugaagauaaggcuguaguuuuucacacagaucauauggcacaaguucuggcuugauagccucucuagagacagaugaugguaaaagcaagcauaugauaagcgugcauaucaaacaugcauauucacacucgguguaaaggaagcuaaaacauguuaucaagucaacaaauggguucaaaaagacuguucuggcuggauguguuggccaugacuuuaaucccagcacuugugaggcagaagcaaguugauccacagacagaacucuggcccagucagagugauauggugagacucuaccucagaaauaaauaaaaauaaagaacguuuuacauucaaaguaucuacgcuuuagaagggaauauggcugcacaucacuuuaauaaaacaacacuggaugggaaaaauaguacaaauuaaaagagaaguacaagugacaugaguuuuguaaaaucagauaugaaacaacuacauggcauguuuuuagcacaaaauauugugaucuuaagcaaagacaaggauucauacagagacucuuuuuuuuuuccugugacaggguuucucuguguagacuugaacucacucuguagagcaggcuggccucgaacucagaaauucaccugccucugccucccaagugcugggauuaaagccuugugccaccacacccgaccuucacacagggauucuuuuaugagggaguaaggcaggacccuaggugguccacagggcgugucagcagggguggggguggggggcaauuaggguagcucuaggagcaugggcuggaucauuuucacucggucaguaacauacacuucacagauauuaguuugugcacugcaaaggaccagcuaauuuguuuuacuaugucauaaaauugaaagguggcucugguuucugguuugacaauggaaugcauacuggauggaaagagcuuagcaguccaacaaagagauauccuacugcugguauaguggacaucagaagagaagccaagaucaagcuuugaccuccaaauuaacuaauggcagcuguugcuggacugaauaugaagggacaagagaaaagaaagaagcacggacagacugccaugucaagugucaggccuuagaaaugagagcauggcaacgugggagagaugcaaguaaaacagguuggaggagcagggcaagucuggugcagaggacucuggcaguuaggugugguaggccucuggauuacaggucauggggacccacgcuaaaaacaguaauuugggaaacacgcauauacacauacugugggaaagauauuuaaacaagagucuuuuaaaaagauauuaaguuuaaaaaaacauuacgauuccaaagcccauuuguggagaguuugcgcagugaaugcuauagagacuucgaauuuggggcaugccaggauuucuaguucuggcggacuugaagaucccagcagcccaaaagguaguaguaguauggaggaggcgggaagugaaacuaaaccggguugaugccgcuccaugccacaggaugacagcagaauucaccgauucgacuuuuauucagaaguaagguaaagaucaguguuggaaaaauguuccccaagaagguccuugccucucgauuuccacucggcgccgggaaagguuaucaagcaaggcuaaggacagagacgggggcaguguuucuguaggacucagaggucccaaaauucagcgguuacacagucgccggggaugcagccuaagccccgaggaugacuuuuagcgcaguagcugcgucuucaccuuuccgcuguccccuucaccgcgccuuuaauggcagagacgugcgaacauuugcaguaacuauucgggucccggcagcacccggacuaacagcgcggccuccaguccucccgcuccggggcccggccguggagggcagaacugaccgccccgauccccgcucuugccuugggcuucggauacccugggcagggcagccugucgggcacagacccccgaccucugaccuccgcgccucgguccaccccggagccccgcggagacgcucggcacggccgucagggcccgcugcggccaucuuaccgugcggaucccgccucccgugcgacagugucuggguggcggcuccgcggccgcucccggggccggggaggggcggcagagacugcggagauagaggaggcggaggcggcggcggcggcgggggcgggggcggggcgcggagcggagguagcuacaccggcgucggccccucagacaccucucgcgagaucguaagauuucgagaugcgaacuggcaaccaauggaauccucucg

SEQ ID NO: 1334 - RNA, 3654 nt, Mus musculus
cugaaagacuaauugccaugugccuagggaaugcccugcguaauaaauagcaaagcagccugguguugaugggaugacuggcuggcauuacccagcuggauguucaugcuagccagauugaacuuaagucauuucuuaucucuuccuucagugucagcagugcuguguguccugcuucucaucagccauuuuuuaccugcucaguggaaggcagaaaagacauuaccuguaggguaugguaugcacauguaggucggugcucugagugaugaguguauacauguauugugccugacaccgguguguuugauuuuuggcagugguccaggccugauggugucagugcuaaaggcuggggugggggugcacaaaccugcaaagcccucagacaguuauccauggauguggauggugaagaugauguggguacuguccuuugguggaaguuccugccugucugacacuagagccaggaguucugguacuggccauuaagaaacacuguucuuaguaauuacugaauugggauuguuucccuuguucuuuuuuuuuuuuuuuuuuuuuuuuuuuuugguuuucugagacaggguuucucuauauagcccuggcuguccuggaacucacucuguagacuaggcuggacucgaacucagaaaucugccugccucugccuccugagugcuaggauuaaaguugugcgccaccacgcccgguuguuucguuguucuugagcaauauugacuagcuaggucagacuacauuuauucaaaaguuuucuggcaccugagcugcucagauaacacagcugaccagcugucucuaucuuguucccuacuucaguauuguucauugguaucuguuuuuuacccacaggauucuguucuuguugggauggaaugaagugucuuccagcucucugcuucuacugcagagggcagguacuuuggcaguauuugccuuaggaucacauuagugacagacucaaggaugaaguuguugcugucauuaugacccugcacugcucuucuggucugugaguaaggagugagcagagcuuuccuuaccuccuggacagguggcuuuuuaacaucauugugagauguaaccucccaucugggguaaggauaagaauaagguagaggaguuucaggagagacgugccuuugguuaagaagacaugacaaauaaucaugaagaccagaguccggcacccagaaaagucaggcaucccccaaauuccugucacuucaguuccaaggaaucugauguccucuuuggccuccacauacacauaggcaggcaggcacaagaacacacacacacauacacacacgucuuuuuuuaaggcagaggaaaaggaaguuuuaauuuucagguagcuaauagauuaaaugaaacagaaguugggaaggaguaucgaagauuaaguguuuguuuuuaaagcaccauauaaagccaggcaugguggcuccugccugcaauuacagcauuuacaaggcugaggaaggguuuuuccaguccagccaaggcuauauuauacauaagaucuuuucuuauaugaaaaaguaccagauagcuagcauauuuguaucuuuuguuaauauauauauaugauuacuuauauagcuaaucacuuugacguguucuuaaaauuagagggcaugagauguauaguaauggagguucucucuguagggauuauccucaaauacacaggaggcuuguugcaugcauaaaauguucaguggcuguaagacaaggaguugacaauuuaccaacauuucagucaguagcuuagcugaugccacagauaccagugacucuggagaacgucaaauagaacugcuugcuuauccauggucuguuagugccuagaaacccccuccaaggauuuacauguagacuuuuccuguuagagcagaccaaguagcuuuauuucuauuugcaccuuuugauggaaagugccuugaaauaaacgagacaagaauauucugguacucuucuccaacgucauacguagagcugugcaaggaaaaaccaaguuugaaauuuucuaaagcgugguaaucuuugcacacuaaagaugagaauuuguuuugucucuugaauuaugauuuggguuuggcauuugagacccccuccucgcccccauaguguauguaguugaagacuuuguauagugacuuugagguggggccuguagaacugaggugggcaguaugucaucuuuauuuucuuuugugcuauuaguuuugaagaggagaaaccaggagaauccuuccagagggauucuuagauguuccaugauaaugacacugaugugaucaagagaaagaagugggauucccuuccagguuguugcucuccagucucagaacaaucaaaagaccaaauuccaaaugucagguuaacagaacagugugucuacaccccugcauuucaacaugcugaauugugugcaggggacaccaugcagggguauagacuguucaccagccuuugcuuacugcugcuuuguugacaugucucguucugacaccaugcauauuuuuuguuucacaaacauugcuuuuuucagauucuuaguaagccgccuugccagcaggagaugcagagucuguauaaaccucuagcucgcuggagcacucauguguauauguaauuguaauucuucauuggggguauuuguaucccugccacauaucaucugaguacaggucggguagcuucugggugccugcugugaauuuguuaguaaaaguucuuauguuuuucccagaaugguugucugaaagcucuuuucccgcuccuucccuaaagagguaccacaaaagagaauuacugaccagcuucucaguguauuagagcuggaagagugggaagguguaacugcguguuguugacuuugcucuguuuccacgccagcagugccacagcauagagccaguccacaccagcuggcagcugcagccguccugggccccaggaugugaugacuguggggacccugcgcaguaugcggcagcucccacacuggacgucuccauugccauuuucucaggucugaaggaaauacagugagacgaagccucccaggaagccaagcagcacacucugggagugucgcgcacuguguggugggucgugauugcacguagguagggccuugucaucccugagccuuguggcagugccaugacauggcauucuucaccaucacucacucuucccucacacuuccaguggguaaugcuaaacguccagugguagagaccucugcugugcucgagugugagcucuugcauguugagucugagaggcuugagguaccaucugccuaucauaaauggguucccucaauuuuggaaugccauccgacuugagacuuuuauauuuacaugaaagaaaaaaaaaugugauugccccauguuacuucccauugcagacucuaacacacgucuaugcacuggguaaugugcccugagauagucuguuccagaagccaagaauggcuauagugguauuaaggccuggacaguaaacccauugaugggguuacauaugaaucugguggacugguggggcaggaauguguggugucauggcagguaugacuauaguagucugcucugucugcagcucauucaugccccc

SEQ ID NO: 1335 - RNA, 3654 nt, Mus musculus
gggggcaugaaugagcugcagacagagcagacuacuauagucauaccugccaugacaccacacauuccugccccaccaguccaccagauucauauguaaccccaucaauggguuuacuguccaggccuuaauaccacuauagccauucuuggcuucuggaacagacuaucucagggcacauuacccagugcauagacguguguuagagucugcaaugggaaguaacauggggcaaucacauuuuuuuuucuuucauguaaauauaaaagucucaagucggauggcauuccaaaauugagggaacccauuuaugauaggcagaugguaccucaagccucucagacucaacaugcaagagcucacacucgagcacagcagaggucucuaccacuggacguuuagcauuacccacuggaagugugagggaagagugagugauggugaagaaugccaugucauggcacugccacaaggcucagggaugacaaggcccuaccuacgugcaaucacgacccaccacacagugcgcgacacucccagagugugcugcuuggcuuccugggaggcuucgucucacuguauuuccuucagaccugagaaaauggcaauggagacguccagugugggagcugccgcauacugcgcaggguccccacagucaucacauccuggggcccaggacggcugcagcugccagcugguguggacuggcucuaugcuguggcacugcuggcguggaaacagagcaaagucaacaacacgcaguuacaccuucccacucuuccagcucuaauacacugagaagcuggucaguaauucucuuuugugguaccucuuuagggaaggagcgggaaaagagcuuucagacaaccauucugggaaaaacauaagaacuuuuacuaacaaauucacagcaggcacccagaagcuacccgaccuguacucagaugauauguggcagggauacaaauacccccaaugaagaauuacaauuacauauacacaugagugcuccagcgagcuagagguuuauacagacucugcaucuccugcuggcaaggcggcuuacuaagaaucugaaaaaagcaauguuugugaaacaaaaaauaugcauggugucagaacgagacaugucaacaaagcagcaguaagcaaaggcuggugaacagucuauaccccugcaugguguccccugcacacaauucagcauguugaaaugcagggguguagacacacuguucuguuaaccugacauuuggaauuuggucuuuugauuguucugagacuggagagcaacaaccuggaagggaaucccacuucuuucucuugaucacaucagugucauuaucauggaacaucuaagaaucccucuggaaggauucuccugguuucuccucuucaaaacuaauagcacaaaagaaaauaaagaugacauacugcccaccucaguucuacaggccccaccucaaagucacuauacaaagucuucaacuacauacacuaugggggcgaggagggggucucaaaugccaaacccaaaucauaauucaagagacaaaacaaauucucaucuuuagugugcaaagauuaccacgcuuuagaaaauuucaaacuugguuuuuccuugcacagcucuacguaugacguuggagaagaguaccagaauauucuugucucguuuauuucaaggcacuuuccaucaaaaggugcaaauagaaauaaagcuacuuggucugcucuaacaggaaaagucuacauguaaauccuuggaggggguuucuaggcacuaacagaccauggauaagcaagcaguucuauuugacguucuccagagucacugguaucuguggcaucagcuaagcuacugacugaaauguugguaaauugucaacuccuugucuuacagccacugaacauuuuaugcaugcaacaagccuccuguguauuugaggauaaucccuacagagagaaccuccauuacuauacaucucaugcccucuaauuuuaagaacacgucaaagugauuagcuauauaaguaaucauauauauauauuaacaaaagauacaaauaugcuagcuaucugguacuuuuucauauaagaaaagaucuuauguauaauauagccuuggcuggacuggaaaaacccuuccucagccuuguaaaugcuguaauugcaggcaggagccaccaugccuggcuuuauauggugcuuuaaaaacaaacacuuaaucuucgauacuccuucccaacuucuguuucauuuaaucuauuagcuaccugaaaauuaaaacuuccuuuuccucugccuuaaaaaaagacguguguguauguguguguguguucuugugccugccugccuauguguauguggaggccaaagaggacaucagauuccuuggaacugaagugacaggaauuugggggaugccugacuuuucugggugccggacucuggucuucaugauuauuugucaugucuucuuaaccaaaggcacgucucuccugaaacuccucuaccuuauucuuauccuuaccccagaugggagguuacaucucacaaugauguuaaaaagccaccuguccaggagguaaggaaagcucugcucacuccuuacucacagaccagaagagcagugcagggucauaaugacagcaacaacuucauccuugagucugucacuaaugugauccuaaggcaaauacugccaaaguaccugcccucugcaguagaagcagagagcuggaagacacuucauuccaucccaacaagaacagaauccuguggguaaaaaacagauaccaaugaacaauacugaaguagggaacaagauagagacagcuggucagcuguguuaucugagcagcucaggugccagaaaacuuuugaauaaauguagucugaccuagcuagucaauauugcucaagaacaacgaaacaaccgggcgugguggcgcacaacuuuaauccuagcacucaggaggcagaggcaggcagauuucugaguucgaguccagccuagucuacagagugaguuccaggacagccagggcuauauagagaaacccugucucagaaaaccaaaaaaaaaaaaaaaaaaaaaaaaaaaaagaacaagggaaacaaucccaauucaguaauuacuaagaacaguguuucuuaauggccaguaccagaacuccuggcucuagugucagacaggcaggaacuuccaccaaaggacaguacccacaucaucuucaccauccacauccauggauaacugucugagggcuuugcagguuugugcacccccaccccagccuuuagcacugacaccaucaggccuggaccacugccaaaaaucaaacacaccggugucaggcacaauacauguauacacucaucacucagagcaccgaccuacaugugcauaccauacccuacagguaaugucuuuucugccuuccacugagcagguaaaaaauggcugaugagaagcaggacacacagcacugcugacacugaaggaagagauaagaaaugacuuaaguucaaucuggcuagcaugaacauccagcuggguaaugccagccagucaucccaucaacaccaggcugcuuugcuauuuauuacgcagggcauucccuaggcacauggcaauuagucuuucag

SEQ ID NO: 1336 - RNA, 17243 nt, Mus musculus
cuuacuuuaaauaguuuaauaguuuucacuuaaauaaggcucuggcaagacucaccacaucuauaaagaaaaucuaauaggcaucuuggagaauucauuaucagcucaugaaaccacaagcucuacaagaaauaagugcgggagguagaaaaacaaggccagaaaugggggggggggguuucaccuuguucuggggucugugaugucuggacugccaggcaccugccaacccaggacacaucaguagugcugagagauccacagggcgggaaccagggucugcaaggcaggugaggacccuggcccacugcacaccggcccagcuggaguggcaagccugacuccuggagagaagcagaaaccauggcuucucuaugguucugaacgguguuucuagugggccugucuuauggagacauggucuaaugucuauagacaucuuagguuauuguugcuggagagauggggguaggaaggugcccagaguagguugggggucagagccacuccugaacaucuaccagcacacaacacauccuuaacacaaaagucuugucaggaaacaacccucacuguggccggugagaccucccaucagcaacguggcuuccuuaacaguggcagucccacugaaccugagagagggcgggacuggcaagcggauuuggagccaugacccuccuccugacacaggccuguguguacucaggccuccccaggaaacuguggucuugcuguaugcucauacgucugggguggagauuccguuucacugacaggguuguuauccucaggcugcugacaucagguccugggugacuggaucgucagggaguuagagguccucaugaguggggaccagguccacccucugcgccuucccgaacaccaggaaggugcccagccccagguugcugaugauggcuaccagguggaacacacagguccaggaaccaguggucucgaucagguagccacucagacacacgccuaccacaccuggacaagagaggcagggacugacugaugguccggggaagcuggcccccucacaucagugagcucaggggcagagcagggcagacccagggauaaaauaugaacuaugagcuaugcgccacaggagacucagacucagggggucuuaggagacagaguccucaggggucacuccaaaucacauauugauggugucuccacuccaugucccacccaagggaaacaaagaacaagguacucaguggagggaccagaugguacucuaaacuacaggacugucacauggagucagucaugggagaacggcuugugagucccccaccaucaaccaggucaagugccaccucagcuggcauaucugagaucacccugggccaucuuggcccuugugcccucccuugacuuugagaccccauucagcagcagggggugagugagaugagaugacccccaucuaggcuauacgcuaaacucacuuacuagucaaccuaaaccaaaggacaagagagccucuaagccaggcuuggagccagcccuuaccugcuaaggccccugcaguguuggcuacaccuguaaacaggaaagugggaggagagacaucaggaggagacccauuguugccccgacagugccccgccccaccccagggauaacccauugucaaaggcaggggauaaagcagggauaaaccagugucucaccaaacaggaagccagcacaggauggggccagguccugaauguugacugaaauaccacugugagaaacaggaaggaaggcaggugaguggccacaggccuggcuaucucuacuuggccuguaggggcuacuggagcauaagagaugguuacaagucaccagaagacacccaagccagccccugccccuaucaccuaggugcugcugggccugcuggcaccuuauacuccccgucuucuuacugacacaacacuagaagcugcuccugagaaugugugcgaggccagaaaggcacgcaguaggguuuccccuuuguuaacuuggaagagcuuugaagugggcuccuaaugcaccccacaagaugcucacuugagguugcuauugcucaagaugagagaaaaggugcagaaagaaaggaacggaccacggagggacauuaagaccacagagagacauuaagcccggugcauauguucauucuuccucccggcacuccucccaguguuggggggaggggucuccuuguuuuccugaaugacccuugcuggguacccagaucugcucacugugacagaucauggggcgcuuucccugaacgagaauguacuaaaagcuagcaccccugugggaugagcucauggccucuuaccugugguugaaggucuggaagccaauggaagcugaugcaaagaucauagccuugaggaagcuugugguaugacccagacacagggcaaaaaugcuugacagaccaaggcccaugaccugcaggacagggcugguaaggggccaagggaccaugcuggcccauaugacucacccugacuuggaccccccaguguucugaguaagaucagauugguucuaccuaaaagcccuucucgggcuagggcuucuuugcccugccuguucuggcacagagaagagcagagagcaucuucagaacucggagaaaguucucaggucagccaauacuggccccagagcaucuuccaauggccacccacaacagccccuuccuggguccuauugcuauagauugaccucugaucugagcugacucugccaacccuaggagcagguacugguucuggggccaugagaccuggcuguaguuuucccaacccguaucuuuuauaucagccugguucuagaaaucaggggacuaaaguacacaacccucaggucucaggaggucagaacaaagaagggauguccauagagggauguggugguuugaauaagaauagucagggcuggagagauggcuuagugguuaagagcacugacuacucuuucaaagguccuuuuaaaaaaaaagucauucuugugccaaucuucauaccuuuaaaaaaaauaaaaacggcuggcgagaugacucaguggcuaugagcacagacugcucuacugaaggucuugaguucaaaucccagcaaccacauaguggcucacaaccagccauaaugagaucugacacccucuucuggugugucuuaagucaguuacaguguacuuauguauaauaauaaguaauuuuuuaaaagauuuauuuauuacauguaaguacacuguagcugucuucagacacaccagaagaggguaucagaucucguuacagaugguugugagccaccaugugguugcugggauuugaacucugaaccuucggaagagcaaucgggugcucuuacccacugagccacaucaccagcccaauaaaucuuaaaaauaaaaaaauaaaaagaauaguccccauaaguucauguuugaauauuugguuuccaguugguggggcuguuugggaaggguuaggagguguggccuuguuggaggaaguguaucagugggaguaggcuuugaaguuucaaaagaccacaccauccccauuguuucuuuaucugcuuugugguugugucucaagauguaagguuucagcuacuacuccaaggucauuccuguaugcccgccugcccaccugccugcugccauguuccccuuuaugauggucuuggacuccaucccuguagaacuggaagcucuaaacaaacucuuuuuucuagaaauaaguugcuuuucucacaguaccuuaucacagcaaaagggaaaaaaaaaugaacaagggauucaaaugauuuccuaccugcaugaacuuacgcaccgugaugacucuguaaccugagcagagagaaagacccaggaugaaucuccaacagcucauucagguccucaauagugucccgcccacagagucacagaagaguaaacggggugcccagggcagugcuccagggcagugcuccagggcucaagacaggagauucccuaucauaaacuguacccucuuguguacaguaugugugucagaggguuuucuguggugcagucuggguagaaauaugaaagggcagccccaugagcuauuacaaaagugccugcuauuggguaagcuuaguccaguuucuuuuaauuucuucaauuuuucugaucuugcauaaugaaugugugcuaauuucuguugaggaaaacacauaugcacauucuucuauaccugagucuguaaggacauugcuucaugggcugcaaguguggccccuggagcucuggaagauucaagagcaaaccuggguaccugugacaugugacaccgacaaacacuuuccuucccccaugggguccaguaucuucuugcuucccucaacucuacccacuaaaggggagaacgaggaagacacucugggcuccucagccccaggcugcauccauccguuccuugggcugacucuaaaagauggucugugugucauaggaugguggccuuuccccaagugacauaacuguacugccagaggggagugagauucuugagacugugguccacccaggacaauucaccccaacacucacccugacugauaaggcggucggagaugaacccacugaauagacuagcaggaauugccagcauccaggggacuacauugaagacccagcccugcagaaaaaggugcagccucaaagguggccagggugacaccuagccucuagaugacacccaggcaagaggaccacuccaauauuaucaccaugucaguugauuucuguccacccacugguugggccuaaaagcagaggguccucgaagaacaggcccuaaccaauccauuaccagcccccugggcaagaacugagcccacuaauggcuaacucuugaagccacauucuccacauguuccccuuauugugacaggguuagagccaagccagucugccucucucaggcagcaggcugagguagcuacaacucucauaguguacagccuugaauuaaugucuguucccaaauggauggucaucuccaggccugaagcccauagagggauggaguugccaagucaaagauacaaccacccacaaagggggccuuuacaacccaaggguagccccuauacccuguaagggcccagguaacaugacacccaccuuggaguuggggaaggucuccuugaagaaggugggcagccaggagaguagaaugaagaaggagcaagcagagcacaacugggagcagauugccgcccugugugggacaccaggaccagggcucuaagaggcugccagucucucagacacugacuccaugugggacccacuccuuccccccagggccaaggcccuacgcucugaaaccugggacauuugcuggagggucaggacuggguccuuccaaagcaacaguggcugccacaccucaugccccauccucacccacacucugccuggccucgcugacucuagcucaccagacagaggccuuccggaauaguugucuccagggcacuuuggagggcuuggucacagguaggccuugagcaaggaaucccagggccaggacaaggucuaggggaacaaacgauuucaaagugauagauagcuucaggaccagguacaucauguugucccuaacacagcaggcauuuaggagcugcuagggcagaggagucagggugcaucuuacuaaucccuugggaguaccuaucugguggcaaugccuaugagagccaaguucuaugucuaccccaugccugugccuggagucccuuagaggcccuuucuugcuaaagacucagcuucguccuaccaccugccuucuuuucaccugcuagacugacuucccaugucggcuucagccccaacggaacagaaugcagagcuggggcaggcgggaggguucucagagcuggugauaacucuuuaccaggcagcaaugacuacucagaauaauaccuucaguauggagucuaccucuccugaggccccagccccucucaccugugcuguuuuuaauuccucccccagccccauccacccagcucuccauguuuugggagguuaccugcagggaagucaccaccaucccugcgggguugagacuaagcuauauuugaguggaaucauuucuuuggucugcuguuggcacccugucuggggugaguagauuuuuguuuauuuucucuuuccagaaaaagcuuauacaauugauguuugaagcacagcugccaggggggagggacgggggaggcagacaggacuggccacauggcugcaguuaccuuucucauucagcagguaccuguacacauaguacgcccagagcaaggugaggccaccugagaaguagaagacacucugccagccacacugguccaggagcacggagccuacgcccccagucaccaggguccugggagacacagagaagugcuguagugaccuugguugcuauccuaaaaagagucaagcucccagagagaggccgcucgcucggaugcuccugccuggaggauuuugcucuucagggagacugggggugggacagcuagggcaaggggaaucugggggcagcugaggagacucagcauggaaacuacugcuggguuuuucauuucuuccuucuagaacuucaaacuggccuacaauuugccacguggacgcucucguggugguggugguggugguggugguggggugugugugugugugugugugugugugugugugugucgggggaggaaugauaaaaggguagcuuaggaaacacugaaauaaaaauaucccuuuuugcauuuuuguccuacauauaauacagagaacaguauucuaguagagcuucugaugugcaaaugcauagcugcagacaccaggccccacauuacauagcugcagacaccaggccccacaaccuuccccuugauucccggguacugugcccagacgugaugcaaagcaccucugccucacccuucaaccucccacccaccacucugugcacucauccaagcgaaagagagaacacugggcucuggugugaggcuuccugugcauucuguacccuaggcauggcacccagggcuggaccuacccuugccuggguacuuucucucccacucuuccuggccaugcauagaacccuaucugcuaugccagacacugaacccuuccauaggaccugagcccuauuguuucuuugacauccgcacuucacagugcaaacuguguuuucaggguuagaucaggccacccuaaccagaagagcuagccuugcauucugugggcgcucuuugcggcucccucucucuguccccagucugaacucagcaacuguagaccuaggccuggauguaucaggaagucccuuuaaccuuucaggagcccaccagugaguggaccuuccuccacacacagggaugucucacagaagguggggcagccucuggcuucccuaggacagauaaagggaaaagaugaagcaggugcucacccacccaguccacaugccagaacccuaucuuauagcaccccgaaaggcaaaaccaugcuggauguuagccuuuacugacagcuugagaagauucagaaucaccauggaaacacaccucuggguaugucuauaaagauuuuuccagaaagguuaaaccgaggagaaagagaaggaacuauccugaguguuagcagcaccaaccgugggcuggggucuugggcugaguaaaaggagaaagugagugugguacaaaccucuaauccaguacuuggcagaagggggcagggggcucugugaguuucugucucuuuuuuucuuuuucuuuuucuuuuucuuuuucuuuuuuuuuuuuuuucuucuucuucuucuucuucuucuucuucuucuucuucuucuucuucuucuucuucuucuucuucuucuucuucuucuccuccuccuccuccuccuccuccuccuccuccuccuucuucuucuucuucuuucuuccccuucuuccucuuccuccuccuucuccuccccuuucuucuuccucuucuuuuucuucuuccucuucccccucuuccuucuccuuccuccuccuccuccuucccuucuucugagacaggguuuuucuguauagcccuggcuauccuggaauucacucaccuggaaccagguuggcuucgaaaucacaaagauccaccugccucugccucccgagugcugagauucaaggugugcacuaucaucaccugacaaauccuuucuucuuaaucuguuucuugucauuguuuugucacagcagcaacagcagauaaaacacugucacaaacgcagcagguuugaggaacagcuuuggaaccuagcauuagucuacaucucuacucggaccaucacugcuggacuagaaggaugguccuugagagcucagggaaguuuccugaaugcaaaggggguggagccuuacccgaccugggagccagcacccacagugcuguagguaaaggcucucucgcucuccuguacuuucugggacagcagacuggucagggcuggaaaguagacaccuacaacaaucagagauuacugucacagaguacccagugacagcaagggagggcuaaggcuuggcuuccuuucugugaccucacugagcuuuaggggaucagcagggcugggcuuuuggcaauuuugggguaaugaaccaaacuaauuuagaaugagaguuauacagagcgauguaaaacauccccgggagagcuucugcuucaaggcaaaaugccucuaccccaagacauagcacccugcagccagaucgcugugcgugcacacauaaacacacacgccccacuuaagcucucuggaggcacuugacaacccucccacuagcacauuuauguguacacacacagaccacacaguaguuucucaggugugcucaggcacccugagacacucacaugugugagccguacaguucuguauguuugccauguacauacauggcacauguguacccuucggggaaaguuccucuaccuacucuuucuagacacauuuuccucccaggaguuccuuugguuccuaggcagcuugaaggcuuagaaacaucugggugcacaccuuuaauccuagcacuugggaggcagaggcaggcagaucucaggcagaguuugaagccagcuuggucuacauaaugaguuccaggccauccagggcuacacauagucucgucucaaaacacagacuugaguauccuuucccuucuagaggguucuaaaccucagucugaagagacucuugagaggucccucagagugugacaauaggaaccuacagccuccuuguuaccacucucagugggaaggcaggaaucaucagccugacucccuuguggaacuuucuaucaccaugucaaugaauguggcucuucagaaggcaguucuugcuucagaggcuuaagacccacugcccuaugaaggagagccaagggcuugggggacuucaucuuuuccucuuugaccacaaauaacacagauauggccaggcaccccuccccccaaacccccucccugagugaguugccauucaaauaucuuagauauauagaacagauuuuuaagcgaaccugugcguguugcucuguccacucuuccuggcggcagagucaaauggccacaccagagggagaaagaugaagacagcucuuaccuuggagcagaccggugaggauucgagagaaugucaggaaggccagguggccgcugccgaggugcgcaagcagugguguggugacaguaaugaagccccaggcggaggcugacagcaagaugaccuucucuccuccgaugcuggaggagacacagggagggacaggaugggguggcuguuugaggggggucugagggucaucacugugaaccaaugcacagagagcugugguagacacugcagugaccugcccuauagaagggcccagagcugagguaugguauacaggacugaguuuggccugucugcuguggcucagcacugccacacccgacuuccucuccccgaaggcuaagccucuccccaaauauuuguugaacuccuccccuauccaccccuccucuccugugugcaagggcgggacugaccacacugugucaggugaugguaaugaucccccucaggccugagcaguggggagaggggguugguuaccgauccccaagguggccgcccaccaccugagucaggcaguagccccagaagaagcugcugagcacgauaccagccuccuucuuguuccagccaaaguccuggcucauggcaacaguacagacgggcauggugacucgggcgcaguacagcaggcaggugcccaggagcaggauuccuguccaggccuggcauucaggccugugagacacagagagagggucaggaccuggggaggcccacacacagccuuaaucacuuagauaccuucccaagggcaggaaaacgcaaucaugaauacaguaagggaguuaagauaacuucuucgguggggauuucggcagguuaauaaaaccucgaaagcacugaaucugaugacuucuagaacauaaacacgggcuaagaauggcacaagggcccucaggauguggggcagguuaaacacauggcagaccauucacagggcuuagaaccugggcccaugccucuggcugccaggauuacaccaggaucccaaacacaagcacugagcauauucucauguuuccuguagaccauggagauacaggaaggcauccagaaguagcagacagcucauaaccugcggugccaugugcuaagcaggugaacccagcuccgggggagcagaagucucuccaagcaagcacagugaguacucaaagguccucaggggucgggcugggcaagguugcugggcagcuagaccccacacaggccugcaacagcugacaguggagaggcaaagagccucagaaggagcagacccuggcaaggcuuccaacuaagaaaggaagagugagguuccuggcccggggccagauucaugcuuccugagaagagcuuugaagauaacuuccugguauacucaagguuacaugguagacuggugggugggcuuagauggacggaaggguagcaagcaauguacucucucucuccacccacuccccaucuuucugugcagacuagacuagaauaauggagccuagggugaccucagacucaaagcaacccccuacccaagacuucugcaugcuaggacuauagauguaaacuauucuagcugccucuccuucuccuccuucuccuccuccucuucuuguuugagacagugccucucuauucuguccugguuguucuggagcucacuguguagaccaggauggccgcaaacucacaggaauucuccugccucuaccuccugagugcuggaauuaaaggcacagguugcaagcuucuuaaacauccaaguuuugcugggcgugguggcacacaucccagcacucgggaggcagaggcaggcggauuucugaguucgaggccagccuggggcuggugagauggcucaguggcuaagaacacugacugcucuuccaaaggucccaaguucaaaucucagcaaccacaugguggcucacaaccacccguaaugagaucugacgcccucuucuggugucugaagacagcuacaguguacuuauguauaacaauaaauaaacaucuaaaaaaaaaaaaaacuuaaaaaaaaaaaaaaaggccagccuggucuacagagugaguuccaggacaaccagggcuacacagagaaacccugucucaaaaaaacaacaacaaaaaaacaaaaaaacagccaggugugguggcgcacgccuuuaaucccagcacuugggaggcugaggcagguggauuucugaguucgaggccagccuggucuacaaagugaguuccaggacagccagggcuauacagagaaacccugucuugaaaaaaccaaaaaaacaacaaacaaacaaacaaacaaacaaaccccaaacauccaaguuuugaacugacauucaccuagagaguucugcugacagaaggggucggcagugaaacaggagaucuggugugcccuccagaaggaccagccucaucuguccuggcucuuccuuuccaaugaauuugggaaucagcaauuuuaggaaagacggugaugauggacaugaaggucuggauacuauuagugaguuugaucacauaugcuuagaccuaagguccauauuacuuccuucaccugagccuguaaagaucccagcccucuagggcaagagagguuucuucuuuucucuuuucuuuucuuuucuuuucuuuucuuuucuuuucuuuucuuuucuuuucuuuucuuuucuuuucuuuucuuuucuuuucucucucucucucucucucucucucucucucucucucucucucucucucucuuucuuucuuucuuucuuucuuucuuucuuucuuucuuucuuucuuucuuucuuucuuuccagugcugggaaucaaaccuaagcucucacucacucuugcuagggaaguacucagucagucauugcagucauugagucauaucccuagugguagguagauuucagguuugcucucuuggcucuguguauggucacuugaaaguagauucucuuuuguauuuucggguuuuuuuuuuuuuuuguguguguuuguuuuuuguuuuuguuuuuugacaagguuucucuguguagcccugccuguccuggaacucacuuaguagaccaagcuggccuugaacucagaaaucugccugccucugccuccaagcgcugggauuaaaggugugcaccaccacugccaggcuucucuuuuguaaaagcucauuguuugagugccuaaugucgugugugguaggcaguccuggccugauuuuugccacaguaggaugguagagaauggcucuuggcucaugagagccuucucgcagacaccccguacagcgaacaucaccauggacagauaucacacacagagagacuauggggugggggcuuagggauucugcauaaccauccucaugaagauuuuacaagaaaccuaccguucagauuuuuaauauaaaauggguuugaacacagucauauagguggggggcuucuggagaggcgaguguucaauauaagucucagccaggaggaggaggggaggucugagggaggauguccucucugggaggggacaggugauacuggccucccccucuacacaggcacagacugagcaagaaagaggcaaacuaguagauagcuagcugggguauaaggcuugggggacccaaggcuguagcugggcuggguccagaaucccacagagcuggacagagucacaggcaaauaaaugggagcagggucaaaggugagggccaggaggcagaaagaacagcuaauucaaagcaugguggcacagaagagacuuugagucacgaaccgggagcucaaauuggcuuccuguuuuuaacuucucuucuccagacggcuaacagggcugagcaaucacaggugcaccuagggaagaguggcaugcagggugggucccucuuggacacaguggcucucugcugcuuuagucacauaaaggaauaaaagcuccuuauugcagauaccuuuggaguguguggcguuuagugggugaguuagcgcugcuccuguacaccggcugugauucuuguaccucccagucugguaaaacaaggcggcugaacuguccucaccuagggguggaaucugcagguggggcagcucuucagggcagucaggguaccugggucuagcacaggaauaaagaggcacggaccuugaugggcaguggucagaauggaggaggguaauggugagacaagugaggugggcuccuggggagggggcauuacccuccccuuacccaaaagaugugugggguccugagggccagcagcagucuccagauuauggugccaagcaccuuccagucaggucaagggaggugggaaagcucugaggucugcucugguaauggccaaccugguuccacuguguggcaaggaacuucugaaccccaggagggacucucuugagugggucuaagaagggccgagcccucugacaccuaucuggggaccccaggcacuggggagggcagcaagcugcccucucccauucugccuuaauuucuugucaggguauuguccugagccaaccuugccauuggauuacugggaacacaggguggcugucaagcuuuccucaaggauauccugauugcccugaagugcugccccucccccaccugcagagcccaccccucggugaggacaguacagcugccauguuuuuguuuguuucgccuacaagggucacagcaggcccacuaaaagccacacaauccaaagguaauaaggaaccuuucauuccuuuaugugacuaaagcaguagagagccacgagagggacccacccuuggacccacccagcaggcaacucuuccguagaugcaccucugauugcucagcccaguuaacuggagaagagcaguuagaaacaggaagccagcuagacccacacccuccagaugagaguugucucuagcuucuugguagccaugggaagucaggaaaaaucuagguaaccaaugcccugacugaaggaggaggaaggggcuuggccaggugcuaucugagugaaaaugaggccaugucaacuccuagguauaguugaggaaacgggcuuuauuguaguuaugugagaguacagguagaguuaucuggaagaguccagacaacauggcuggcagaauagaaugggccuugagaggagucugcaaggagaaggaaagagagaggagacaagaaagagaagggaccuggagaaggagaagaaccaagagaacgcaugagaggauuuaaaggaaagagaagcugguugggggaggggaagcaaagcugggggacuggaggguucuggaguaagagagguggugagaagaagagccaggacucaguaagcuauagguacucagacacaguguggugaccagugucuucuuugauaugcuaacaggcaccuccauguccuuuugcuucaucccagcacccuggaggcaagaaaugggacuugucccucagcugggugggugguaccagccaggcugaugaaugugcauccucaguacuugcuggugacacaggacaugaccauccuccugaaggggcccugugggccugccugccugguuagaaccccagucuuuaguaucaggagcuuggaccaggacugccugaguagccccacuugcccacccagagccagagcucaggcuggaggucucagcaaucacacuuccucacagacuugugcagcucuggcuuccuguuagauggcugcgcagaguauccggggcugagcaaauaggugaucacguggcccuucguucagaagggaaaugugcuggcuacuuaacucagccuccaccaaccaccccacauucugagauuuguugaggagaacacugccuccccaacacgugguggugaguggugggccccuaaagucugguguucccugaacucaggguccuguuucuaguaacacuuauugcuguuacuauuacuccaguauggguugagaauggccuugacccugcaaaauuccccagaauucucagcuaccauuucugacaaaggcaacuggaggcacuacacaggagaaaguguaaagaugggagugaggguggggugacagguuggggagggggggacaggcagagccauuaaauuguaaccuacagcaaaauuggcagaacauuucauaguucuaagaaagcccuggguggugccuccaggggccaggugaagcauaggccuugggauaaacaugggguagggagggagguguuaagccagagagggaaggagagcuagugagggcaggcacauagugugccuccucuagcagagucugacacuacuguaacugucacuggcggugggggaggguggcgggggggggggcgcuaugaucugguucugugccucccugugaccugcugugcccucaucuggucuagguucagugaugguacuaucuuaagguccucuuuacacuuccugccaguagauccagggcucuugccccaggugacugggagguaccaaggcuugauccugagucuagcaccuccacgugaggacugcaggaaccagagcagggugugagcucuuuuaggcccccauuugaacccucacaguggucccauagccagaugccaccuuugccccugguuucuguggggauguuugccuggagagugcuggaaacagcgggaacggaauaugaaugaagauggguaacggcuguuuuccucccuaguuuagaagacucgugaagucaggaccugccucuaugacuuaagagcugcugcauagaucccuaugcugugagcaucuguccagcccagugcucccaccaagccuuacagacacuacccugccucccagaccacagaauuacugucagggaaaagggcaauggagccauuugccugauuuuggcauuugauuggagaugggaguggggugucucuuuacuggguccucccucuacuugggggcuagggcugcucagcgaggggcaugggagucccagggagagugaagguggcaggcugcagaauggcugguagacagccgcuagagucugguguucccugaacucagguccuaugaaguagcaccucagcucccuuucuaaacguaaaaguccuccuugccccgacuucagccacaccccaauucaccuggaccaccguguauccucugcugccgcagaaggggucuugcgggucuccucugggauuggcugcaucaggcuagagcgcugggauggcaugggcaccgcuguguaccgugcccucccaccucagaccuaggacaacccacagggcagcaccgcccaaguccacgugucagucccagugcuuccgucuaacucucccaggacguguugcccccggaauugaguccccgccccacugaugucccgggaggcagggccagggaccuucgagcaacuagaggcuuaccacugggacuuccugcuggggaagagaaaucccuggggguuuuguggcccgagacccgccagaaauaacuuucuugucaggaaagugagcaggugagcaguguguaugagucuccguugguucuaccc

SEQ ID NO: 1337 - RNA, 15838 nt, Mus musculus
cuugcaaagcgcgacguagccggaagcugcuggcggcugguggggggaucugagcgccuaguccagcuuggcaccucggccggacccgaccuccugggggcagcaggugaguuugcggccaggacaccgggcauccgcggacccucaguuccuugcccuuccggcucucagaucacccaguuccuggcccuguaauccucgauucugcagcccuaggccccuggucccccaauaccgugacuguccgacgcccccggucuucagcccugacuuacuccccggugccucccgcguaccucccauuucccagcuuccuggccccggguucuccaguccuucgacccgugacguuuuuguuccucggaccccaaacuccaggaucccagugugcggccguccagacccccccuccccugccucccggccugugagcuuuaccgcccuucagccuagcgguugcagggaccuacguggccccucagcgcucuggucccgagcagucuuggacgcagacugguucugcacugcccacuuugucgggaaagggccucagcccuucacuucgaaagaagauucuguccagaggugccgguaagccagguuuucuaaccucaguuuguuugauuuuucccuucuuggucucugaagugaguccucugcggaaggaggaaaaacaaaacaucucaacaacagacccccacaggaucaagcuucuaaacuuuuucucaauuguaccuggcaauagaauauacuguauuugcacucuuaaggcacccacaagucagaaguaauauacacuguuccauagcugugcaauguuuagagcauugaagcccuaacuauaguucuggacgaggugaugaucugauaucgucuguucuucagagugaagaagcauaacuuagacauggguucuuuguguucucugaacgguuuuuggucacccauacuguguagccuuagggccaagcuaugucccuagauguccccuuugaccucagauguacaucacgucccauuuaagaagcaaauguucucuagugugacauguagcucacuaaaguuugaaauccuuauuugcuucauuaucuacuagguaugucugccugaaggaagaguauuuuguuguuuuuuuuuucauuucagcuauuaagaauucuuaagggugggugauauggauaccagguaggggugcuugccacaaagccugacuaccugaguuugauccugguacucacuuggaggaaggagauacucagcucccaccuucuaggcuucuaggcaugcacuugugagcccacccaagaaagaaaucuuaaaaaaaaaaaaaaaaggauucuugaggccuucuuuaggcugguuaaacugagagauacuuauuuucauguuauuaagcaacauuuaagaugauuaauuugagcagggaaguaagugguggagcaugccuuuguuccccgcacuugggaggcagaggcaggcagauuucugaguucgaggcuagccuggucuacagagugaguuccaggacagccagggcuacacagaaaaacccugucuugaaaaaacaaaaaaccccagaccaaacccuaacuucucuccaauauccaaaguuuaccacacaggaagaguuucuuaaauccaaaccaagucaggcaugguggcaccaccuuugaucccagcacuugggaggcagaggcaggcagaucucugugaguuuugggccagccuggucugcacagugagcuauguguagagacccugucucaggcccguagcugagaauguccuucugcuugguuuuacucagagauccagaguugccuuaggagaugcuggcuucuugccuguguuugccuccauuugugguuguaagccucugagggcagccacagagcuuuggacacugggauccaguacagaaacgugcuguggucuuggugacguucacguagcagcuagaaaagaaugcagagagcuuuggaacucagcucuagcugugucuccccaaaugcucuugagcugucuggggcaguugugugcgugagugaaugccugggcuucuaacuuaugccugagugagucaugccaguaacggaguccuacaugcaaaaaucugcauuugugugcucacagucguaggaugccauucuaacaugugauuaaugcaguaaaaggaagguagaaugagcuggguguggugcugcaugccuuuuccuuuaauccgagcacucaggaggcgaggccagccuggucuacaaagugaguuccaggacugccagggcuauacagagaaacccugucugggggaaaaaaaaaaaaaaaaaaaggaagguggaauguacuaggauuuuguuucagacagcuacaguaaacaacuauuuccuaacaucagacagacgggggcgucacgcuaaaacacagagaguuuaagauguaggaggguugguggguugagagucaagaucuuuacugaacacuguguuucugcagacuuaaauuuaaaguuaaauacaggauauacggcggaggcguuuuguuuugacuuuuaugugaaccucacauuaauacucagccuaccucgugaauagagaauggucacuuucagucuaacagcgaguagcaagguaacuacccugaaaaccugcagcuucuggucacacggaguguuagucuguuguuuguauguguguugcccugugaaugagaggcaacagcaugaauccauugggauggaugaccacaccugacuggggggcuagaggcccagguccugcauccagaccccucagugcuggugugugccauaccacugggauuaguuuauguccaaccuugugguuggcacaguuuggguuuauuuuccuaguccugaauuaaaugacccaccaguuaguuaaaagucaaacauugcugaaacuggcagauacagagaaaugaauaggguuuagggagacaguucuguaggugagagcacuuucuguguucaaaucuuuaguaccuacauaaaagccaggcaugacugcacgugugucuauaaccucgacuuuggaagauggagauaagaagauccugcgagcuugcucccagccucaguaucccaagggaauagguuagaaaucuauagaagacaaucuguguccuccucuggacuccacacguguguacacaggcacacaugaaaagaaggaagggggagacauguacaggaaaugagauuuucauuuuagcugagccucauugcuguccucaccaauggcccuaggcagguggucugcauuuauuauuauguccuaugucugcauuacucacguuuaucuguccagauguccucauagaggacccauuuauaggcuaucuuaacaccauugccagggauacuuccuugccccuugcugcagucugagggcuuccuacuuccuaccccgacuuggagagcugggagagaggaagugcagaguauccucuucucaucagggcacugcucuuucgugugggggaaaagauugagcagccaaucuucauggguuuaauaaggcuacuccuugugaguuuuacuacaaaugacagcuuuuuaucaguuauucugcuugguggcacauaauggcuaaaccuguacucuguggcguuccucacuacuugacugcuaguugugcccuaagguguccuuccucauugagaagagccuccuugguaaauggcuccuguacugugcaaggccaccacuguuagaucuuaggaagaaaguauuacguaauguuauugcacugcuaguucauuuucuuccuugcagaguaacuugucguaagggcuuguuuuccuccuugcagcaccauggccagcccaagaaccaggaaaguucuuaaggaaguccgggcacaggaugagaauaaugugaguaugaccuuugggcugaugagcgucuuggugucacaugcagcuguggcugugucccuccuuggagagacugaucauggcacaggggagcagcuagcagcuaguaguuccuggugcucacuaguguggcuuggggagugggauuucuguugcaucgcucagguugugcuaaggaugcuuggucugcuuucuaaauacauuucucaucagagguucuguaucuucaugccaguuccugggcagcuacugccaccuccagaacagucugaacucacauccuuugaccaaccugaacagccuuauuaagcuuauggguacuagcccuuuaguuagucugugcacaugugguccaccgcucuucugcauucuuuuggggcaucucuuuuugucuucgggguccuaauccugcccugagcugcuuugugaguugugugugccacccuacccccuuugcagguuugcuuugaguguggugcguucaauccucagugggucagcgugacuuauggcaucuggaucugccuggaaugcucugggagacaccgugggcuuggggugcaccucaggucaguguugaaccacuuggcccugcacauccugcucuauccuacuugccacguugugggucugcugcccagaugcugucugauaggauguuaggggguguucuccaccauaaggugguccucgcuccacuaacacuggccacaagcaucagcugcgguccggcuugccuccgugaagcugcuucuggcuuuuaccuccauacaggaggcaucuguaucuagcucaggaugugaucuuggguugggaggcuaguugggucuccugggguuugguaaucagaucagacaucugguuucuagcuuugugcgcucuguuacaauggacaaauggaaggacauugagcuggagaagaugaaggcuggugggaaugcuaaguuccgagaguuccuggagacacaggacgacuaugagccuagcuggucacugcaggacaaguacagcagcagagccgcggcgcucuucagggauaagguaagggccugccuggcuggccacacagaugaacacugagcacacacgcugauaggggccagauggggcuucagugccuggcuggcuccacauagagagaugaacacaaagcacaccuugcugguggccagauggggcuucaguggcuuugggaggcagguuucucuucucacuuugaacaucuauggaggccaugcacuguccaagaacaggccaggacaaguggccccuacuaacccuguggcaggcucuuccugcccagagggaaugcaaauggucuacaauccaaggaggagaggaacagugaggaguagugccuuaaaaggauggcuuagcugcagacgcucuaaggauuuggcugucuuaacuuagagcccuucugggggucagauaaaugaguccuugugcauuugaaguuggagccguagcucaccaacacuuacuugucgucaugggagcccugguucauagcauggugguacuggcuuacaguguugaguagguggucuaucuccucauguccugucucaucuuguuagguggcuacuuuggcagaagguaaagaguggucucuggagucaucgccugcacagaacuggaccccaccucagcccaagacacugcaguucacugcccaccgguagcuccucuggccugcuggucagaccucagcuucacccucacguuagugguagcuuaggaacuccauagaaaccucauuuacuacacuugugggagcaguuucaguugugagcuauucccagaagucagagaaaaaaguagcuuuuuaacauuucugaaaggauguaaacuuguaguaaaaauuuaccccauaagaaguagcaucuugcccuauucugcagaagaguuccuuccccuucuuguagaugugucacacaacccuuuggacagugccuguggggaugugggcugugcuuuuaccucauguggucacucuucagugagcuguuggucacacuauaguguaggcaccaggauggcacgggaugacagcacgucuuccagguccuguagaacauaaccagaucauagcaccacugaugacauaacaccaguguauuucccaaauuugaacccugacugccauuccugguaugaccagaguuuacugucagcuguuagauugauacagagaaccacucgacuuuagcugugccugaguuucuuaugggucagagcugguaccucuuugaccccaacuaugauaugaaaaguccuugucacagacugugugguuucauuugguguguugaagccuuacugaccuuuaaccuucuaccucagagccucuggccagccacagagugcagccgccucuggggacaaggcuuuugaagauuggcugaaugaugaccuggguuccuaccagggguaaggcucuccggccgggcguagcggaaggcucuccagccuggguagcggaaggcaggugggagcauccuugacaggccacccugcgggguuuacuccguuagguuggacucuuuccuuagguuaagcugggcccacuccuucuguauguguccacaguaugugugaucugggguccacuuguggcaggccccaagauggccuagguuugaguggagguuuugaauguggagaaaaauccaguauuaaagaugauguauuuucuuccuggaaucaccuggccuguaagugaugcuugauguuuucaguaaccccacuuaccaggaguuauagaucuugcuguggaaccucagaucaugugguagaaaguaucuguauagcuccugugccccuuguccagaaugcaggguguccugugagagggaggggcaucucuccgagugaccauguucucacuguugaggaguggcaagguucauggcugugguugugaugucuguguuuaucuucagugcucaggagaaucgcuauguaggguuugggaacacagugccaccucagaagagagaagaugacuuccucaacaaugccaugucaucgcuguacucgguaagaaggccuaggaccugcagagugccugcugccccagacauagcuaaggggguuguccaauggcuagauauuggcaguguaggugguccugggcacaugacuuuucaucugauuaaaggccucuuuuuaccuccuuuuuuuuuuuuuuuuuuuuuuuuuuuuuaaaaaaaggccuuauauucauauuccaaagguauucagccacuucuggucauaacaugcacaucaaauuugccaagguagauuuccucaaagaacuaaagguuuucuauggagccugucuuccucuuaucuccaggguauauccugagcccagcagaaggcugacccagccuccuggccuguguuggguagacugacucagaaagugaggcccugagcagaggcugcucaaguuuuuuggcuuucuacugggguguggugugguguuuggguuugggggcaucugucugcuuucaaggcaacuuggaacuccgggucugaaguucaggguauggcauccuaggcuuguuuuucugagaaaaguaauguuuaagcuacuuuuguucauugugguguuguguucuguagcaaucauaaaugcacacacccuggaggccaagcaggggcugcacuaagugggcugaaugcugaaagugaaaagagagauugugggaugcaccauuagucccaacacucaggagucagaggcagugggaucucuuaaguucaagacuaaccuggucuacacagugaguuccaggauagccagggcuacacagagagacuuugucucuaaaaacagaacaacaaccaaccuaauaaaaaaagaggaaaggcuuuuugugcugaugauaccagaucuucaaaauacguauaacuaaguagggugugcaaggaauagaugagaugcugugagaggggaagacggcaagcaucugccuugcugcugcacaugcgcacugcagucuaaauggcacagauggaagacugacaacaaccuugucuuuuguauucugaguguuuauuccuuaaugagugaauauuuuuuaaccuuuuucuuuccuuuuuuuuuuuuuuuuuucuuaaugacaugucuaguuuguagcucugugaacuuauguguagaccaggcuggucuugaguuugcagugauucuccugcuucauccuccugcuuauugggauuccaagcaugaaccacugugccugguucaaacuguuuuaaaagugaaauugaauauuguaguguuuaccuguaccccuaggucuggagaagcugaagcaaguaggaaaacuaagugagccugaagccagccuggguuacccagugagaaccuaucugaaaaaccaaagauuugcuuacaggaccauggcagcuacagucccucuucugcuuucacacagguuauuuuuagggcagaaaagcaggauuuuaucguaaggccuauggcuguuguacaguucuuucuuguuuuuuugacagcucauuuuguagaccagacugucuucaaacucagagaccaaucugcaucugccuccuaagugcggggauuaaagaugugcuccaccauguuaggcccuguagaguuuuauuuaaagccccucaucauuuggcaucuguauucccugucuucugcugauagccuuuuuuuaaggaagaucccugaauauagaugucuccugaaggguagugguuccucugcacuaucucgagggcuaggggagaaggccagcuuugguuuaaaugggauguuucuauauugaagaagcuuuaauuuacguuggaagguauuggugaggagacaacugaaccuagaggaaaccugcaaccucugcccaccacggucugcuccucugggaggcaggagggaggcaggacagaugugagcacaagcucaccaacucccuuuuagggcugcuuaagaggccugguagccauccugugcugugguugguguuuugaguuccuccuuuugugcagaacugugcugugugcugcagcuggcaaggggaauguggauacuguagcacuugguggcuuuuggcuggucacaagagcuguggagguauuggaggugccuucuguggaaccguccugugcuaaaauguugagacuggcaugcacagggacuagaaaagccucaucauuuccuguuguuuuuucagggcuggagcaguuuuaccacuggggcgagcaaguuugcaucugcagcaaaggaggguguaaguaacugugaggugcaugucguccacuccaggccuguggcucugggagacagguccugggguccuucaggcagacaagcauggaccuucuccacugcaggauggccuaggagcccuuacuauaucgaaggugguugugugugugugugugugugucagagacaagcugcuuguagagguugacuugauuucuugugggugaauagcugaugagugcccaugccugaauuucugccguugggucuucagucuugaaauagucuagcuccucucgcucaccuuuaccuaaaaugagaggagaacuugagggucugaguuggaauagagauagaccgugccguguggggagcaugucuggcucuggcaaugaucacugauagaagccagaagguguauaggcuuugggccugggguugggcuguguggcaauaguacaaagaggaaaagggguagagguaaguugguccggugguccacaggacucagaccagcagugcccauggccauccaaacaagcuggaagccuucugucuacccucccugcccauuuaccaugcagcaguuaccggcugcugacaagguauuuuuccucaucucuagaaaggcugguguuugggagaucuggaucccuucuagcuuggaccucucuaggugggccuaccuuuucauaugcuagacacuaugaugccuccaugcugggccaguagggcaggaguggcugcugggcccaaacauguccuaccaccaccaguuugugggcuuguugcaguaucugcuaagccagaucuacccaagucuaagcagcagcaaccuggcccuuagaccugcugucagguuggugcuuacuuccugggugcuugccagggcuuccaccugggccccauguacaugaagccucuauggucagggucacgacauuugacuucaaugugcugcuuuuguuuuccuuuuaggcuacaaaauuuggaucucaagcaagucagaagguaaaaagagaaacuccucucucacuuagucuggccgggugguugguggugcacaccuuuaaucccagcaccugggaggcagagacagguggaucucugaguugaaggcuagcuugguccacagaacuaguuucaggacagucggggcuacacagagaaauccugucucaaaaaaaaaaaaaacaaaaagaaaggaaggaaaaacaaacaaaaagcaaaacccagcaacuuuagucauauaucauaugcagugucuggaagcacccugggcugggcuggugcucgggaucuaagguuguaguccugaagaagguccucuucuguccucgcagugugcucguuucagggcuuccucagcccugugccauagccaccgauagacaugaagccauaguaccacagcugucucaaaugggaaagauugccuaggccauggcucucagccucggucuguucaccuggacaggugucaccacauccucacuuggcagcuugguuuguauggccgacucuuacagucuccggcuuggcaguuuauuuuuauuccaagcugaguauaauaguugccaugcuuagagcucuggucgccacugugagaugggcaggaguuuagguccuuguguccugcagcacucuauucauguacauuucugccucucagggccucuuccagccccacaccccuaguaaacaccuaggagaagucuucuuggcuuugccucagagcuucuaaguuuggaucaggcuccucaggcuaucauggagucuggacugugaugaguuuggagcagagaaaaaauuaugccagggcccagaacagacugccgugggucugcugcagguaaaaaguaguucacgcuggugugguaaccacugcagucccagcaaccaggcagccgaggauccgucaaggacugcaucaugagacccuuuuuauuaauaaaaagaaaagaaaaaggcuauggugagggguguguucucugccacuugugggcguugcuaaugcgacucccacaccugcucuuucucuguaacugccuucgugccuacugggucaaguuuugggguuacaagcagcagucagagccgguaaaacccuguuugcgcuggugcaugcugcccuaugucuguugagcaugugcauugcuccuggcuguaucucccuuucugcuugggucaccugugugugcugcacucgcaccuucuuguccuguuggucuuggaagcucaucuuccccaagaucgacagcccacgucugggcccagugagcucuggagagaaagacugcuugguucaguuuucauuucaugguuuaauuaucccaaaccaaauagcagcuggaauuauacccuucuggaaaagagccuuccuagguuaaugaauuaucucccuucaagcuuuuauuuggucuugccuugagguggagguccaggcaagucacuuccuggguugacucaaagcuucguggcccuuucugcuguuucucuuccuucccuccaccccgccucccauacacuucucucccaugugaguuucagugccuccuucaggagauggaugaagaguugccugcagcuagaucuguguccauccuccugacucguggaugagagccagagcugcuuccagcaguaugagggagcucccuucauagcgugauucuuccauucuggugucacuugugugacauugcuucccaugugggcccacaucucacugccucccucucuguuggcaaagcuugugcuguccugugcuuacugaccagcagcuaaugguugcuguaugcagagcuuacacggcauuucuucccacaggcuucggaguugggccacagccugaaugagaauguucucaagccugcacaggagaagguauggguggcaccaaaaaucaaggugcuggugugucccacugaggcucuuuacuuaucugggaaauggguacgcuggggaucagcaaaaucuugccucuaauuuucucugguccagauggucuuaggcuucuuuuucuuagucuuccuagucaguucccaaggacaucccaaggguguccuucucuuccuucuguuuuacuucaguggccaggccauaggcagugguguugaaguaggagucaguaguccccaaccuuccuugcagcaggagucugggcagcaguuggcuucuccagagucaugugguuugauaagguuuuauggagcugaagccagaugggcuccugguagaacuuugggagcuuaaugugacagguauuugugcagucuggacuugcagucuuccuaacgaugcccuuuaaauugcacaggugaaggagggaaggauuuuugaugauguguccaguggggucucucaguuggcauccaagguagggccuacccugcugacugcagcacagcccaagccagucuccauauuccaggcacggagccccacagggucuugggccagcugaggcaguggucagugcccucugguuucugagggcuugaggaauauggaaacagcuugguuguuggggacuugcuagccacuaaccuguguuucuucucugucuugcugccauuggccuaucccuugguaagugccauugucagcuauugcugguccugugaccucggggccuggugggaugggagugaggucaucagcuuucacaacacaauggcaauagagaauaucuccugaagacuuucauugcauuguaguaaagacaaggccuguaguggcccacagcucugaaaguaucucaaguguugugacaucaggaaggccaugccuuccauuaucuauguggcauugucccagccaucacagaaacuucugcggagaaggcagagauagaugcucacagcaaacuaaacagccaacaacuaguguucuucagcacugcugcuguguuacugugcacaaguguguguguaucuauaugugacacuccuccaaguuuugucuuagcagagcagcauccauuuucguugauguuuuagagccagaggugcuguguagaguggggccccaacuugguuucaugucuccuucuagguccagggaguuggcaguaagggauggcgugaugucacuacuuucuucucugggaaagccgaagacucuucagacagguaguccacguccucaccccaggcccugggucccuugggcucccugagagagagcugguggccuggcccgucacccucugccccgugugguacacccaguucuuuauuagaggcacagugacugcccucucacccccaccaccagggcuccucuuuccuagcacccuagcaaacacgcugcaguuugagugaugaugggaaugagguagcaagagacgaucccucccuuccaagaagcugcuuguccucaguaccugguuggagccuuacaaggccaagucucgguccuucaccugcugggcuacucugacugcaaggguggcuaagaagcaccaggaaaggcagcagcuucuuccuagccaggaagagagcauagagcuguuacaggcauuuggcuacaccuuggucaaaugugggcugggcauuugaagcaaugagugggucuuguucuagagagccccugagacuugagcagauugggcagcuugaggaauacagacagcacaaguaucuuucugugacaacuauugagauuuuguccuuucucaaaaauuuuugauagacccuuagagggccacagcuaccagaacagcaguggagacaacucucagaacagcaacauagaccagagcuucugggagaccuuugggagugcugagccccccaaggccaaguccccaagcagugacagcuggaccugugcagaugcuucaacagggaggaggagcucggacagcugggacguuuggggcucagguuccgcauccaacaacaagaacagcaauagcgauggcugggagaguugggagggagccaguggggagggcagggcaaaggccaccaagaaggcagccccauccacggcugaugagggcugggacaaccagaacugguaggagccuagcacccuagcccagcccugcuggggaccgcuguguuugcacuuugcccuucuuguuccuccugcauuugaccucagugugaagacaguggcucaggcaggacuugaguuggugcugccugccuggugugggguggcuuucucuuagaccucaggggacgugucauccaccugccucuuggguccucugagcagcccuccuggacucuggguucuugggacccaggcauugucucugcagcccuagcacagccugggacugcagcccugugcaaugucagccaagucagacaucugcuuuccuugaaaugucuuuuuaaacuugaaaggucugcuaguucuuucuucuugaagaaagugccuggagccuuaaagcuggaaaugagaugacaaaagcaauacuggagcucacacugccaccgacacccucaccuaaguccacagccuguguggccugugcugugaaacucaccuugugacccuccgccuuuccugcaucagccuguccagcccucaguuaaaugggacaaacucuccacagauggccacacaaagcagacugggcucugguccuccuuggacaccugauuugaacuuggccagcccuggacagcucagaaaugaggaaaggagaguaaaggggccgggagcauuuccuacguaucugccgcucccaccugguacaggggagccugagcauggagggggugcucaggggccaacugccacugccagggucaagcaucuuaauggggacccuccauccgggcagagcaccuguuaguauuugccaugcauugugucugugacagcccaggccuucucccagccuguucaggcugcucagagcacacuugguugugucucccucagcaugcagcuguccuuccccacuuaucgccauguggauuuuguggaacacugcaguugagacccauguguuaucagugguuggugugacagccgcccccuccuaggauuccgugacugcugugugcuguggcuggagagaccagcuggggucucugucuccuuaaacccacuccugucugacccucaguuugaccagcagugcaugaccugaaguucugugguuugugugucugucauguuugcuccuacuuucuaauguugagcugucugggcccuaauuuuccagugcuugcuucaccccccgccucccccauggggauucaugguucucugcugaacugguagggcuuaaguuuggggaauccucugggauugcuuuguccucaaguggacaugacacuacucaguagucauguaacaggacaucuccgagcuagggaagcaagggagaagauacccaggacuugugccugauagaguaaccacugauagaugacaucauaggucagagacuugggguuguugaguacacagaaagucaggagucaaggaagucugaacauggaagaagaaccucacugaaacuggaauauccccagaaugaaggaguccuugauuugguggacauaaggugauaaaaggggaaugaaaucuauugguucugguccaggaagcugccugccucaggucauuugggaguggcaaauagcccuagcuacaaacagguuucuggugcuauguugaguacaggagcugcauguuuugaggcuuguuuuuaacauaauccagagcccucuauaccacguuucuaau

SEQ ID NO: 1338 - RNA, 2342 nt, Mus musculus
aagcaagcaacaggaauuucauuuuacuuaaaaguagauagggaaagcuuacaggcucaggccauauuugccaagacugcauuaacaagauuccagagagaggugguggaaaaaauucagaugcauaugauagcccagcuccagcuggggagagcucugguccaggcugaagcgcuugcagcccacaucagaaucacccuucagccgggcgcugucccuucagcaccuccuugacagcccgccuggagaucagccuguuccucucuccaugacgauggcucccugcucagcuauugcugaacaacaugauguugcucaucgugcucaacaggcagagauguuggaccaucaaaacacaagaucacuuccaggacagccagggcuauacagagaaccccugucucaaaaaacaaaaaacaaaaacaaaacaaacaaaccaaaaaccccccacaugaucacauugacuccuaccaugucaaagagcaguuuaaaguuuuugccaguacccgcggccccugaaguaguccuucaauauaucccuuccuauacaaaacaauaauuuggggacauggcuuaguaguaaaaguacuuguuuugaaugcauuauauccugggucccauccccagcacuuuuuaaaaauuaauauauuuagccagacacaguggcucacaaugugaucccaggacucaggggcuuagacagaaggaauaucgagaauucagagcugccgggcagugguggcgcacaccuuuaaucccagcacuugggaggcagaggcagguggaucucugaguuugaggccagccuggucuacagagugaguuccagaacagccauggcuacacagagaaacccugugugcauacaaauacauauacacacacacauauacgguuuauauguauacauauaugguucauauauguacauauaugguucauauauauauauauauaaacauugacuguucuuccagagaaccugaguucaaucuccaaaaccacauggcaccucauaacugucuguaacuccaguugcagggggaucuggcacccucauacagauacaaaugcagacaaaacaccaauacacauuaaaaauaaucuuaauaaauuggaaauguaucuuaaaauaaaucuuaagaagagaaacaagcaaaaauccgagaggcuauguccaauauauuuucugccugggccuuucugaacuuguaucuuuguacccacugucucagagccugcaagggugaagaaagggucuaugagccaugguuauugugacuacucaugauggaggcccaccagcaugucaccucucuagagagauacacacagcaauaugggucaaaggaauaccagugcuuuuuggauggaaaccuaccauucuuuuucucuccagcugagauugggacucaggucucacagaugccaaguacagggaauguugugcugccucgauggucugugguggccagacugucagaacccuccagugaagccacagaaagugugugccaccauccauagccccuucuaggaagcccagcuuuauaguuugagcaagccugauuguuacauaauagcauuuaugcccaggaguucgaucacccucuuuccaagggucagcuaucacagucagcaguacauggggaucucuuccaacagagaccuccuuccaaggaagacagagcagcugcuaagaccagaagggagaacacugccagccgggaaacagacucaauuuggggaaaugagaagagacagguucucagucacucuggcugggcagagcugugguuguuuuaauccuguaauuuggaugacaggaagugccuacccaggcagaaaggccccccucaaaggaauuuuccacuauuaagaagaaagacuguuggucuggaucauaaagagcaaugcagugagggaaagaaaagauauaaaagugcuguguuuucuguuuuuguaaaucugacaggaacacuuacagguugaagucaauaagaauuuaauuuauagaaggguguuuguuugauuguuuguuuguugauugguuggguuuuuuuuuuaaggaccugaguucucaaagagcugcccuagccccuggcaaacugacuaauuacuuccagaacugaacucgucuuucucaaccacugauaauacuuucauggcagguguccccacugugauggaagagauagugauagccagggaauggugguggcccgaggaguguccaaagaugccccaagacaagcuuucugggcuucuagaaaguucugucugcccucuucugggacagucuuauguccuuagguuccucuucuuccuccuccuccuccucc

SEQ ID NO: 1339 - RNA, 7625 nt, Mus musculus
ugugaaaccaccagaacauguuuauugaagcugacuuuguguuccuaagguuuacugguaccugugggcacuggguaggggcaggugaugcugcuguccccuaaaaguacauagcauguaauggcccacagccagcccuaguaucggcuacuuaacccaauccacaacaagaccuggggaaagugagcuuuuucauccuugguucuaggagggagcugaggugagggcaaggaggaaacugcuggcucucgucugucaaagcacauccuugcggcuccuccucuaugcuuuaucaacacuuuggagacugugccaggaggagggcaucagccuucauaucuguguaagugcucaugaccaggaccagucugaacacauccauccgaugugcacauguagguacaugagucucucuggugugcacauguaguugcaugagucucucuggugugcauauguaggcaccagccugugucagugaaggagccgcaguguuggagcccagaggcuccuaucauucucaguugugcaguauuucccaugggcacuggugacaaauguuuccuugggagacacccuucaggaagcggcagcccuagcugcuacugagggucuggagaccuggucacgugaggcccagauggaggcgucuguuuauggcauucagcuucucccucaguauggcaaaggugggacgcuccucagggcugcccuuccagcacucuaccaugagcacauagaccucugcugggcagacagcugggcguggcagccgguauccacgacuaaucugcuguagcgucucaugguuggucauuccugauaaggggccagcaagaggaccagucagcggcugccuugauccugccuaggugccaccaaagagacuaccccacccccagccucuacauggccagucugugcugguacuccagccccuaugcugguaccuuugggggucagugacucccaggguacaucuccucccucagacuggauuccaggcuaccucccucagacuaaacuuucccugaugagucaugaucuuguuuaucucuucucagauggcuuaccuucauagggacacuggccauaagugaagaccucauacagcaggaugccaaaggaccagacaucugacuuuugggaaaagacacgguaauuagcagccucaggugccguccacuugacagggaucuuggagccacugcuuggggaguagacaucauccuguggaugagguauaaugguugggaguucagaguaguauuuuccucuaugcagggauuaggagcccagagccucacugaccuugagcagucuggccaggccaaaaucagcuaccuugcaggugaggucaucacccaccagcacguuccuggcagccaagucccgguggacgacacgccgcuccuccagguagcucaugcccucagcuaccuggcaggcaaaucccaguagauggggcaggcucagggccuuucccucagagccugcagagagaggggcucagggaucagggauggguggcaguccucauaaggacacaggauaauggcgggucaggcaaguacacaugcauacacaugcuucaucugugccucugaucccccaucucugagggagggagcacaacaccuacuaaggcccagucaacaaugaauaacauggaaagggaagucaccacaaggccucaagcacaaccugcuucuugcuaccugcuuguaaccccaagggagauacuacccaaccuggcaacgcaucagaggucagugacacaaagggaaccucuaccacuguauggcaguccuagccucagaacuaacaggauuugacuacauagccuuuagccaaaucuaggccuggaccagauccuuggccucauuaggucauuaggaccaaguaucugcaaccuaggccacaugugucucucacaaaggccuaaggauucuucuuuguagacccaaggcauggaugcuauuguaaggguuggcagauguggcugcuacaggguagggauagggagaguauucacugcccgaguagagguuacucacugcccagguagacuugcaaguugcccuugcccaugaguucaguaacgauguacacagguucaccgagggaacauauagcgugcagccggaucagccucucaugccucaagcucuucagugccucaaucuccuuggugaggucugccagcuucaugucagcugugaaaaggauguuguuccaggacugugcauggccaccacugccccaggcuccagggucagagggcaaugcuacagagccucaccugauuugauaaccuucacugccacagggauagagcccagccacaggccuucccacaccuccccgaagaaaccuucacccagcuuucuccgaaggacaaauucugaacguggucguucccacucguccugaaccaaggguaucugugggaagggacauucagugugcugcuuuagaccccccuagcagagugggcuggaagauagagcuaauauuugaaccuagccucccugugagucucaggaaaagccccagcaucaggccucugccucucccuccccagugcaccccuacuccaggcccaggcuaggacaaaggggagaccagugcagaccuccaggaggccaagcucagaguaggaagcuaauugcuuugggaacuuaagcggccccuuuaccagaaccggacauccguuugcaaacacucauuacaacccuggcuaggcugucauuacagaaccagagaaaccagaucgcuguccuggacccaguaauaccagauacugggggaaauaguaucucuacucucagcuucugcccucagggcuuggagcagcugugggugccuuccccacacuggccauaacuccuccugauguccugcagauugggugcacacuauaccccuugaagguccccaguuuucuaacagccucugaguagauaaaaccgccgaagggggccaacuccaucggaauagagaaaucacuggacacuggcuauucccgggcaagccuaggccagaggcuugccaagauacccugaaacaggguucccagugguccccagguauggggaaagucucagguccaccugggguaugcagggcugcagcagaggguucuggaucagcuuccaguuggucuuguaguaagccagcagugcauccaggcuggggaagaguuggcccuccugcagauagaggcugccacugggugccaugcagaugcgguaguggcagacuuuggccugggcccugacuggagacagagauggaaacuagugccuuggcuacaccugcuucagacacccacaccccagcauaucaaguggcuucucucagauugaccauggggucgcugagguggacaauagucuaugcaagagggggcacggucaagcuacagaccccaggacagucaggggccccuggggacaaggaguguuaaauagguuaguguugaauggaaugcuaacucaacuagguagaaaauggaggaaguggggaaagaaagaaagaaagaaagaaagaaagaaagaaagaaagaaagaaagaaagaagaagcaaggaaggaaggaagggagggaggaauggaggggaggaaggaagaagagaggaggauagggaggaaagaggaaaggagggaagcagggagggagggaaagaagaaggaagagagggagggaagaaugaaggaaaaaagggggaagggaaggagggaaggaagggaggaagggaggguacuuaauaacuagcaugucuauaugaaaggcugcuagugugggaaucaacugccccaaggccugggacagaugagcaagaugccccccuccaguaaaugaagucuugagggguuguucaaguaccugauagagaauagcccccgaugcugcuuucgcugggccggaugaggaaggccccuggugcauuggcaggagacaagagcaacugcugggccugagcccugcugaucccacugaaguaccaacugcaaauccaggacacaaaagucauuuuucaggcccagccaugugacccuggcaaggugugaagcaucaacuucucugcugucucucaggaaggaaaugugcccagugccugaagcugaggucccaggccgccacuaucaggugacuggaagcuccuucauacagguaugacuguccacucaccuaggccacuggaucuauuacucuaacauaacuaccaggccucaccaaagaccaaaaccccaaacuugaaacugccuaauugcuguggggguccaauaagcugcccuagaaauacccauagaacucuaguauggccagagacccuagguguugccuggcuggguauggcucaucuaaagguuggcuacuugggagcugggagccccagaagagggagacuaagccaggguggucaggauguuagcagaggcagauaguagaagcugggggguggcaauguaccuugugcccucugaagggccaugccuaggugggccagccccugaguucuaagucacaucagguaccucagguauggcuccauucacuuauauuuuucuuuuucuucuuccuuccuuucuuucucuuucuuucuuucuuucuuucuuucuuucuuucuuucuuucuuucuuucuuccuuccuuccuuccuuccuuucuuucuuucuuucuuccuuucuuucuuucagauaggaucucaguauguagucuuggauggccacuacauagacaaggcuagccucaaacucagagauccaccugcuucagccuccaagugcugggauuaaaagcauauaccaccaugccuggccuccucauucucaggaggcagaagcaaccucggaaagauaaagucagucccagacccacccuauugaaugcaucucugcuuuccaaggcccagacaagguuccauagcuggcucaacuucacauccaagcuuuuccacuucugagagauuucaggaaccaguggguugggaaccacagcaaugcaugaaaagacgugugagcuuagucccucagucucuucggauggaggcaagguagugagagauacucggcaugauucagguuaacccacaaagaacagacaggccagucucccauccccaccccucagauguacagcggaggaacccgcauggccagagugugggccuaggcuagggcuggagggaugaacacagcugaggcagaaagaugagcaaguaaggggguggaggccgaggccugagaaaugggaguuaacacuggccagcugaauggaugugagggacugucguggaaacagaugccugggcuaggcagcaugcuuagggaggccacaaacucacuucagaagcuguaggucuagucccuugaggcuucuuaucucucuacugagagcuagagacccuccuuuuuuuuuuuuuuuuuuuuuuuuuuuuuuuuuuuuuugagaagcuggauccuacacaauuggugggcagggaacugagaagaucuggcaggucaagagucccuaggggugagaucccuucucagcagagucaaacuguguggggauggggagugggggugaaccagaagugggaguuucuccagcauaaccccagcuuuuccuugaagcuaugacaaggugcaagccacuaugggauacagcuggacuccugugacagccugaacaguggaggaugugccucaggggucucucccuagaugauggggccaggugucugguacuaaugauaccauaaguguggucagcucuuugaucucuaggucaggcagucauuagcucuccauuagcaacccuacuuccaggagcccagcccugccuuccaugcugccuguuccgugaacaggacuguucuuauguucugucucccauaacuuaacugagagaccccuccauuaaaacagcuucuuggcuuaguccuacucacugcugggggccagcaaacaggcacagggcuugugucuggcucucuuuccugugacucuacuucaccggccacacuaacucuccugggagguuguaacugcugagggauccucaggaggcuagagaugaauuugagcaaugccagguaggaccugaggacucaggccaggaccaguuggguguaaggccagggacaguuugguagacaagcucuucagcuuucagcuuauuuuugcccagcaugaacccugcugagugacccucugguaugccacucacuggcagugacugcccagccuuggggggcaaagaguaagcucuuccccauacccacucagcaaagcaaaucagggcuauaucugccuuacacuuaaacccauuugagguguuugggugaauauaaauagauaaagaggagcaugugaauacuuggcucugaucugguuugcagcaucuacaaguacuggggacccagagccaccuggaggcucaggugugugcccccucccccuccagcuucccaaacagugcaaggcuguaucaccuggcagggcaucucaguccucaacuccuggucuggaagcaagguaaaccacucacugcaaccuccguauggcggcaggguccugcagugacuauggggaguaauuguucuagccaacaacugguucccaggacuugcucacuccugggugugagcagguccugugcaacucuuccuuuuguacugcccgggcacaccugucugcucagcccgguaccagcaggcacucaauaagcccucacugacuguaagcagguauugccuacucucaaaacuccgauuuacucauugggcuuggcagcccuaccucccaagcccagguacuuacgguuggucugagggcggcuccgggguagccuuggcaagguaggugacaggaacuaguccggugcuggguggaccagagagccuuugggcaaagauguagucccccuccuccuugagggcguagagucuguccccacggcugacgcucaguuccucugcacaucgagcagugaagucguagagcgcgcggaagagucgggcgcguggggcugggaagcuacaagguucaacggcagcggcuugcuccggcacuggguugucgucgugucccuggauccuggggaugucuuccuccgauucauccgcuggccauaucuuaucccagaaaaaggacaagaaagugagccgcuuccugaggaagggcuccaugccuagggggccugguugcggacgaaagcgcauggagccgaccucgggucaguacucugggaccuccgugcugccgcugaagaagcugagcacuacaaccaugcaccaggaucccagggugcaagagagaaaccggaaaggcuggugggacagccaggcuuaccccgggcuuucugcccacgucccuauuugguacagaaugggaagcgacaggugacacggacccuaacccuaaccccggaggucacuacagagugcuccuuaaucaggcauacaacagucaguuucccggaugguguaucaaugcguggggcggacggugaccuccgucccaggaccacacgggcugcuccuccuagucuacauacucuucuacagcugugcggucuggugagcuggaucucugcugggguuaaaagccgcugggcuugagauucgugucccagu

SEQ ID NO: 1340 - RNA, 14415 nt, Mus musculus
ugagucgccccaggggcagaaacgaaacugaucgcuacucuuaagucgaugcuggugcacugggugaguauggggugguggcuggggacuggaggggccaccuagagaggugugaagaccaccccuuugccugcaaaugggcaagaucaguggccucagacagacccuagcaucggacaacuccauggaccccucuuccugcuucuccagcugccggguaugggguucuagcucugacgacuuagaaaacuccacagaggagugcagggagggacugcaggcuuugccuguugcucauucuuuccauuuaaaacauaaucuuuguaccucaacgauugccuugaaaguuuagagggcuaggguauaggucaguaauagauuauuugcuuggcauguaugagugagagagagagagagagagagagagagagagagagagagagagagagagagauaugaccugacuagguguuucagggagcuagcuguucucucgcccauccuugcuggguggugguacuaacuaagacucugggcucugggcauugccucuccuucuggcaucucuaugggagcucugaggagggcuauccaaccuggguagagcggaauuucuacaaggcuguguccuccccuucagaggcuccuguugccaaguccaggugggcuauaguagucccagcagucaacuagcaggucucaagaaaggggguacucucuucagacggccaggagccccagaguuaccagauggaggauucugaggccucccaacucuuuuuuuuuuccagcagccacuugggcaggacuuggagaggccuuucaggaggaaagguugaguuagaguucccccaacaagccaagacugggcagaagucucuguccuacacccgacagagguguagguccuucuugaccuugggcugacuugcuucucuuguccuaucaccucuccagggcugacgguuucaguacagcagcugcccagaagccuggcucacaauccugaaggaccuggccuuuguccgagauggcauccguggguugcagucugaggucggccagcacauccgccaccaacgggccauccuuagccggacucugugcuaagguagaccuuuaccugggcugcucccgcugcacccagugccucaaugagaguaccuacauucugcgugagguagagcacaccugccccagggagaucuugcuggcccgcuucaagcaagcagcagagagcaagaucuggcguaaggugggccgcaggccuagcuucccaacgccuaugcgcuaucaagucugucacuacuauaggccaggguugggcuguaggcgucacuggaauagaugcaccuuugcccgaagcccugaggaggcacuggucuggacauuugagcucaagaacaaccuuccccgauugaaacugaaagaggcugugcagggcaccagagccccagauaggcugcagaccccagcugacaccauccgagcagaguuugguggccacuuccaacuacucugugccaucugcuucacgugcugucccccgugccucugccccguggaucccaggggccauugcccuaagcaccaaaucugccccacacuucucauccauguuauaguugagggccuaaagcgacaauucguggaggugcggccacugccacaaagaagacauccuuuaaacuacugcauguaugugggccgugggguaccaugccgccauggggccucacgcugugaguaugcacacagugcuguggagauggcuguguggaaggcugagcaguuggaugggcuucagagaggagaucugcucacauauccucucuuuggggaaaacaaauggaaagccagcccuaacccuaacccuccugugaccaaacuguacugccaugccugccuggucaccuguaauucucaagaggcauuugagaaccacugcuccucccuggagcacgcacagaugguggccuuugaccaggcugugcccuggaaacaccgugccccaccaaugggacucuccaaguucgaucucugcccuagguaaggagaauugugugggagccuagggugggagagcccccacccaacgcuagcccaagggauugugagguccacaaggccugagaccugccuaucauuugcugugcccucugcaugucaagcuaguacugcaguggccucugagggagguuccuugugccagcccuuguccuggauauucaggguacagagcaaauaaaacccccuacacaauccauuccugccccccauacaggccaggguugggcugagaggguugacucccgaggcuggacaucccugaaguccugcugaccucuucaucucuccaggccugaucucugugagcacggagaggucugcaucaaggcacacucaaaacaggaguuacaggaguggguucagcgggcacaagacauggaacugcgagaacaggccgccuggcaggaugggcugguaccuuaccaggcacgacuucuagcggaauaccagcgcagcagcaaagaaguaucagugguaaguggagacuugugagugggugaggguggguccacagcugcagugcugaaagcccaacuucucugugcagauggcugagaccauccguggagugucugucacuugccacccaccaccggugcaucaggcccaggagaagauccagcaccaguggguguucaccauccacucugaggugagggucagacagugcugagaucacaggucuuguggguacccccagguuuggguggagggauucccaggguguuaaggaccacaagugggcagauauagaaagcaugagauuuggaguggauguugucaguaccuccacuucugugucugugugaccuaggacaaaccucauagccucucuggcucagucuccuccacagugauagcaccguggcacccucacucuauggaugggaucacacaaugaaguaaauuaaccaauacaggaaacaagugugccugggggaggggggggaagagauaggggauuuucggagaggaaacuagguaaggggacagcauuugaauuguaaaugaagaacacaucuaauaaaaaaaaauacauuaaaaaaaaaaaaagacacaagugugccagugucuggcaccuggagagugaauguaacuugugauuacaggacccugaaaaucccaacuguucauuuuuuuuuuuuuuauaucuucugggccuuaggcaagguccaugagcagaagugaaaagcaggcaggcugagaaaucagugucccacacucagaaaguggcaagcugccuuucucaggacgguggaaagggucaggcugaaggagucaccacgggccuugacagggucucagggcccauuccaugcuuuauggccuaugucuccuucuccaggaucccuugcuacauguggcccuacucaaucaagagccuggagcagcuuucucacugguggcccccagucucccaccacaccagcucuaugcacagggaaagcacuucuguguacaaagcuccccagcccaauacaagguaggggugcuugugcaggcugucgccuucggcagcuuugagcaguggguggucuuugacuuuggucgcaggccagugcuucuccagaagcugaaguugcagcuaggccagacacacagccagggccuaaaugggaagccagcacccagccacccccaggagcuggaaugcuggcacacaggcaaccgccacguggugcuugagguagauuggacacccgagcaggaagcccugauggccaaguacaaguuacccucccuggcccuggaguucaaucagauuguuccggacugggggcccaucucucguucgaacuaccgacagaggaugcacaaauuucucuaugaggaggaagcagcccagcagcagcuaguagccaaguaaguggggcagugggcuagcaggaguggcuaaagucuggacuuagagauaggucuuugacuauggcauagaaagcugaccuguaacuuucuaccaggcuggccaugaagggccagguaucccugaagacagcacuggagacaccagcacucggcaugcucuucgcaccaccaggggcccucuaugccaagguccccuuccacuccucucuguugccagacacugaucagggcuuccuguugagccgagcagucagcacagcccuuguggcucccgugccugcgccuaacaguacaguauaccaagugcggcuggaggcacgggccaguucagaccaugcgcuguggcugcuguuaccagcacgaugcuguauggcuuuggggcugcaggcccaagacagccccaucuuggaggugcaguuccagauugacccuaugaccuuccgguucuggcaucaggcaguggaugcacugcucgaggagcaccuggugguuccugaccugccugccugcacccugccccaccccuggcccaccccacccucauuucguggcaaucacaaacagaagcuggcuguggggcucauugcaggcagaagacccgagggcacaaagcacaucccaccacugcucaucuauggccccuuuggcaccggcaagacguacacauuggccauggccgcacuugagguuguccagcagccccacaccaaggugcucaucugcacacacaccaacaggugagcccagagcugcuuccagguugcucaccgcugcccugcuucucagagcacccaucucucugauucuuauggagauauggguuccuuuuccacaaacccuagaccaaggagggaguuauaguaguaauguguuuuggccuacccuauguuucuuaggcaaggcucucucucucuuaaauauagaaacaggcuauucaacaaagaaguuccucuuugacuaauguggguuuuuuauuuauuuauauuuuaguucccuaauaacacauuauuacaggcacggaguccucuuuuagccccagaguaugggguggaagagcccaggucaauaaccacauguccugagcuaauuucuaggcugaguugagggucugagugucaaggcuguuguugcuuaucugaagauccuaggcagugcuuccuuggccucuuaacucucaagcucuacuccugaagaucagacaccauucuuguugccaaagcuugcagcacccaggagcuguguucaggaucagugccaaccccuagccauggguggucucaggccauagcuaucuuuccccuuggccucaauuaagagacugccuucucuaagcuauuccugaccacccaugcucuccaagucuugcccacuuuucuucaagaucugaccuucccugugucuuugcuuuuuguccucugaggaauuugagucccugggcaagaccccugucuaucugcccuaugaguguuccuggcauccaggcaaggcugcacacauguuuuagccagcagccugaguccuaaagcagcagcccauugugccucccccuuccuacagugcugcagacaucuauauccgggaguauuuccacgacuacgucagcaguggccauccagaggccacuccacucagggugauguaugcagaucguccuccaagacagacugauccaaccacguugcaguacugcugccuaacugaggaccgccaggccuuucgcccacccacaggcccagagcugguacaucaccguuuaguggucaccaccacuucucaggcucgugagcuccaggugccagcgggcuucuucucccacauuuucaucgaugaggcagcccaaaugcuggagugugaggcccuuaucccacucuccuaugccuugucacuaacccguguaguacuggcaggggaccacaugcaggucacaccuaggcucuucagcgugccuagggacaagucagccaggcacacgcugcugcaccgccucuuccuguacuaccagcaggaggcacacaagaucgcucagcagagucgcaucaucuuccaugagaacuaccggucaacugcagccaucaucaacuucgucucccaucauuucuauuuagccaaggguaaucccauccaggccaguggcaaagucccacgucacccccaacacuacccucucauguucugccauguggcaggaagcccugagcaggacauguccaugacauccuggcuuaacucggcugaggucacccaggugguggagaaggugcgggagaucuauaacaccuggccucacugcuggggaccccgggagcagagacacaucugugcugucucucauggugcccaggugagcugucuccucuggccuuuccuuucuuuaucugugaaggcugcuuuguuccuuuccaagcugauccauaugaccgugagggugagggugagggauuggcaggagggccuguuccuuacugggugacaggccccuagaacccuggacuugucugcagguuagugcgcugagacaggagcuaagaaggaggaaccuuggugaggugucugugggcagcuuugagauccugccagguaggugacagaaaugugggccagaggcuggccuaacagggaggcagcuuccagcccauuucuuugauguacauauauguagggugggacugagguggcggggcugcugguucuaccuggccaucugacccaucucuccuauagggcgugaguuccggguggugguacugagcucuguccacaaccgcaauagucugcuuagcccaggggcaccaaccucagaguucuucacugagccucgaguacugaacacggucaugacucgugcccagucucagcugguggcugugggagaugcuguggcccucugcuccucuggagccugcagaaaucucuggagaagcuucauccgcgagugcauagaacaccacagcgccuucccugaggagcugucacuggaacagauugagcaggguguggcccagagacagaacugggccucauugacacucaaagcuaggggcccagagacagagcaaaaaucuauggcccagggcccacaaaggcucauagcugaagggaccauggucacggugaaggcagagaccagagccgaggcagcagccaaggcacagacugcggcagucgcagcagaagacacagcaagcgggaacucagccucuagagaugcagcagcagaaguguccacccuggaaggggggaugucugaggaagauucugagucugacuucuggcccucugacugggagcucaaugcugaugacgccauccugaaggaacuucucgacgagagccagcaagugacugugacuguuagggaggacggacuucuggacaccgugguuugcucugcaccacagaaggcccgagaguacacaaaccuacccucaucugugcuguggaaguuccugcgcucaaacuccaagcaauuccgccgcugcagcuuccuacaggagaccuuugagagagcauuggccacuccgcuggacgacauggccucuagcccuauccaggucaggggccgucugaacugugggauggcauucacgggggaugaggugcuaguacagauccuggguccggcaggagaugacaggugcgucccugggagccugcagggucgugugauggguguguugaagaggaggaggcacgaauuggccuuugugugucggauggaugagugggacccccgcaucaugaucccuaucaacgguucugugacuaagauuuuuguggcagagaugaaggacccacagcaaguucccauccaccgccucauucaaggccaggugcagcgugugaggcaugagacccucaagccugaggaucggagcacccggcuuuucuggguccguauuguccuuuggcgggaacguuucuacuauccacuaggcauuguccuggaggugcugcccaaggccaucaccugggagcagggccuuuauauccuugaccuagagcauggccugaaggcccacacaccagacccagccucaguuuccaaggcucugcagagauaccgcucagagcuaaacacggccgcuggucaccgagaggacuaccgccacuuccugaccuucacuguggacccccagggugccugcaaccuugacgacgcucuuaguguccgagaccuaggcccaguguacgagguggcagugcauauugcugauguggccagcuuggugcccaaggauggggcccuggacguggaagcccgccagcagggaacuguguucuaugcccccaauagggagccaguacucaugcugcccgccagcuugugccaggaugcacucagccuucucccuggucaggaucgccucgccaucucucucuuccucaccauggagaaaggugguggccagaucaagagccugcgauuugcacccuccauaauccgcucugaccgccagcugucguaugaggaagccgaagaacugaucaagagacacccuggggcuggccuggagcuuccagcccaccuggacucuguggaggccuguguuguagcugccugcuacuucucuuggauguuacgucgccagcgccucucagcugccuguuacuaugagccgccagacgaggacagugugcugggcuuccgcacagcucacaucaugguccaagaguacaugauccaguuuaacagccauguggcugaauuccuugugagcaacaagcacacacagacacucacaccacucagguggcagcccacacccaguaggcagcagcuugacaguguuuucaagaaguacagaggccuggugccucugucccugcaccugugccaccacucgaacacugacuauacccccaacaagcagcugcaucuccugacuucccucuggaaacaagugcagcuugcagcugguacucaggauuacagccagaugguggaccuuauugcugcagaugacaugcacccuucacuggcuccugcuugccuggacuugcgaagggcucuaggccgcucuguuuuuggucgcuccagccaggguaagcagcaaccugcuguucaccacucgcuacagguggauugguacacaugggcaaccucacccauccguagguaucuagauguggugcugcagcggcugauccugcuggcauugggccacaggggcucuacauauucuaacagggacauugaugggcucugccuggacuucagucgccaguaugcaagugcccagagcuaccaacggagggccuacagccugcaccuggccauccagcucaagagccagccucaaaacaagcugggcuucguaguggaugucgagaugggugcccgcugcuucaaagugcuuuucccuauaaaccgggaaacgcugcccgaucccugcccaauucacuaccauucccugcaguuggcugagcacccccaggagcuagugagccagacaggcgugcggcuuguauggcggcgccgcauguacucggugcaggcguccaagcugccuuuaccacuucugggcacgagucuugauccacacacccagacuguagaugcagcccuguggaugaagcuacugaugcugcugaaggagcagcgcuggccugagauagcugcccucauccaggagcaagauaagcguuuucauccaagggagaaaguaaagauccaccagagccgcuguggacacuuuguagagguggucuacgagcugggcaguggagauacccugcagguucagcuugguuccagccugcagcgggguuuccuggcaccaacccugaagcuguggacuguggucccuggcuucagccucugucuggagcacauggaacggccaggugacugcuuuucaagccaugugcaccaggcucugcaagaccaguaccuucaagucggcgaguacucaggugccugggggccacgcugcgcccuggagucgcucaccaaugcuguuacagaaaacgacuccauugugcugcacgaugugcauaucucuugggacacaucccaggggcaguugcagggcaccuuccagcuggaagcugcuuuucuccaggagaaaugcaucaacauccacuuuggcuguugcuaccucugcauucggcuggaggggcucccucucccccuagauagcucacucccugggccuaguggccuuggccccuuccugaacauugaccccaauacauauaccuggguggcccaugggcugucuggugacugggaccaugaacuggcugguggugacugggaccaggagaauguggaugaucggcaggaggcgcccaagcagguauauuuucucauccaucacaugaccauggagaagguuccagaagaggugcugagaccuagcgcucgguucacuguggaagugcugucuaagcagcuuccugaccugugaguagcuccuaucaccugaggucagggggaaggucccugggcugaggucuagagccaaggccucccugggcuccccucuccugggaagacauagcucccucccuaggaaaacccuauucacuuucugguaucuuuucucaucccaccccccccaccccccucgcccccccccaugccccagccgcaaggaagaagcagugcgucaacugaaaacagcauccccauuggucauuagcaucgccuugggccugccuaucccugagauccgcuggccaauaucugggccccgucgcuuaguaucugagcuccguuggccaauacccgggccccgucgcccaguaucugagccccaucgcccaauguccgggcccuguggcccaauaucugaaccgugucgcucaauccccgagcccugccgcggcaacuggccucgccagcauucuuuucacaaggguaggucugccccucagcuuuuccaccucuccccagcaccacggugcucagaugauccuuggcuucugcuacacucacacuccuaccccagcaucuaccagcagguucuuggagcggcagaacuacaacaucccugcuggacaucauaagcugaaccagagccaggacagggcugucaggagcgcucugcagaaacaguucacagucauccagggcccaccagguggggcccauuugcaggagccaggacgggcugcccuguguagacagauguggccauaggaacuuacacagcguccucucuccacaggcacugggaagaccguugugggcuuccacauuguguacugguuccacaggucaaaccaggagcagaugccaacugacagcagcccgaguggagaggagcagcuggggggcccaugugucuuauacuguggacccuccaacaagucuguggauguccugggagguguguuaggcaugaagugugggacugccagagggugcuggguacugaguuucagacucacaucuucauuugaccuaggacugcuccugaggaggaagacagagaugaagccccugcguguauauggggagcaggcagaggccacugaauucccgcugccaggagugagcaacaggagucuguuuggcaagaccucucaggaaggaagaccaaaucagagccucagguauggccccuucugucugugcugggauugaggccaaggggaccuccacuggccaggguuucaccaaggucuugccuuccaggagcauuacccuucaccaccggauccgccaggcccccaacccauaugcagcagagaucagaaaauuugaugcccagcuucgggaagggaaaauauucucaaaggaggaucuuagaguguaaguggugaucuuggagguggagcuacccaucagcaagcucauugggugacaugagugaccucauauagguacaggagagucuuggggaaggcacgcaaacaugaacuggagcggcacucggucauccugugcacgugcuccugugcggcaucaaagagccugaaaauucugaauguucgacagauccuuaucgacgaggcaggcauggccacugagccagagacccuuauccccuuggugugcuucucaaagacgguugagaaggugaggguuguggggaucuagugcuccugccuggauuccugggggcagcugauguuggggugcuaaggguguaauaggugagcauugaagauggccaagaaguuggaaugcuucuggcuccaaagaugucaaaaucaauagcuaucugugccucuaggugguucugcuuggagaccacaagcagcuucggccuguggucaagagugaacagcugcagagucuggggauggaucggucucucuuugagagguaccacagggaugccaucaugcuggacacacaguaccguaugcauaaggacaucuguuccuuccccuccguggaguucuaugggggaaagcuaaagaccuggucugaccugaggcgucugccuaguauccugggucacacuggcaagccgagcuguuccgucaucuucggcucugugcagggccaugagcagaagcugcugguguccaccgaggauggcaaugagaacucuagggccaacccagaggaagucacacaggugguaagugucagagugacucuccaugguguuuggugggucagggaaggcuuccuggaggagggugaaggccaaggaaagcuucacuggaugggaaggcugguauugagugagguugcugagcucagaaaagaacagggucuggguuccagcuccgucugcccucuuaucuacuuagguccgcaucauaaagcaguugacccuggaucggacgguggaucccaaagauauugcuguccuuacacccuacaaugcacaggcugcugcaaucaguaggggccucaugcaaagaggagucaccggagugacugugaccucuauuaccaagagccaggguaagguuggcucuauggggccauuuuuauguguggggucagcaggaggggucagugggcagagcugugaauucaucuauuaucuccucucugccucccagggagugaguggcgcuaugugauagugaguaccguccgaacaugccccaggagugauguggaccagcggccaacaaagagcuggcucaagaaguuucugggcuuuguuguggacccccaccaaguaaacguggccaucacccgggcccaggaggcguugugcaucauugguaaggguuuguaugucuggagaaaggcuggggaaggcagugccuagcgugcucagggcaaaaccaccuugacucucccuugcaggggaccaucuacugcuacgcugcugcccacucuggcaccgucuccuagacuucugugaggcucaacacagccugguguccgcugagaaggugaggguccagagaaaaucugcucugucuucuugaggaaccccuaccugcccagccuuugauguaccaucaacugaggguaugucccucauucuucuaugccaagguccugggcauacagaggauugccacaggucacagucacagcucaaauuagucaaccacuucugcugucuucuugggaaaggcccugguauuggcugcagucauguagcagugacagucuuaugggugguggcugcuuccugugcuggaagcaggcuuaauaaugaugaccuuccuguuuguacuuggacuugaauggaggggaaagagcuggaggucggccccuuucucccaacucccuuugcuuuucuggggcauuugaugacugggacaccucuuaguggucacagaggaccccagggacauaccuaugcuguuacagggggccuaaacagaaauaagacuccucugagacuacacuuugacacugagaucuaucuaugguugcacugggcacccuguauucauuugcccuauuuucuagucguaguaaccuaaaccagaucucuuacaggcacucucagagugggcaaggaaacauucccgagagaaagaccuuuuucucuuguacuguuuacugccuuguauccuacagccccucaccccgcccccaagcacaggggcaggaaggacagagcugaaccaaaugcucacacagcccuaccuccuggaauguaaaacagcuggccugugggcaggcagcugggaauaagguacccagcacuucugggccuguucuucaccaugcuuccauaccuauguccagggcuuuaggacaaccuuccuggcaccaucauccuuuucuacuggacuaagcaggugaaaucucucccagcaugucucccucuuauaugcucacuuccugacaauuccaaagcugggaucaucucccccuucagugugacaaccccacccccaaccccgccgaggucagaguugcugcaagugaaauauacaccaggacaucuggggcuucuaaggccuggcugcagaaccuccugugaggauaauaucugguguuuucuacaaauuaaguuccuacauuccaauuuuuguaucuuuucucagguuaugccuuauguaacuggauaauuuuauuauaaaaauuucucugaaacuucu

SEQ ID NO: 1341 - RNA, 34961 nt, Mus musculus
ugaagcacugagcaaacaacuggaagaagagcaguuuuacucgcggagugccacuugccugccuuccagaggcgaacccgcaagccuaggccuugccucugcucccgggcuguagcuuccggcuuaguagcugcaggcuccgcccaccaccuuaacccuucccggugaucgucaacuggggcgcaaccuuucggggaccgaguucuaccggagcuccggagcuuucgugcggcgcugccacauuggcuccgacuaugggcggggccucaguguuggguucuaggcgcuugcgcagccagcucugaccugccagaacacacgucuuuuuccgggggcgcgcgugccagugagugagcgugcgcguucuugcugccgccaguguugcuuccgccguccucugccgcugcuacggcugucgccgcccgggauccucaggccgagcaguaggccggccggcugcccaccacugccccgggacggaaagcggagccgcggaaccgguggaccggcgggcgugccgacaggugagcucacucuccaguggcucucaaauuagguggggccgcgggguucaagcugccggagccgggcaaaggggaggggaaguggggcgagggcgccgcagcaggaggugaaagcugcccgcagcggaaauggcggcgacccucagcagcggcggcgagcccggcccugggcaccacuaggcccugcucgaccuugcgcacggcggggcggcgcggagacgaggcuuuccgggccaacuccgguucgcacgcgcggccgccuccgcggcucccggaacgcagaaacugguguguagggaggcgggcaguaaaggcuccgaggcuuguucacauucugggacgcagaaauugccuuauaguuguaaauuucaaaggcauuugauguauaaaaaaaccccuaguuuauauaccuagggacgacauuuuaagaggcgauuuugugucgugcucuuuggggagagaauuagggacucauucguuuaggcuccaacuuguguuauauggcuggauuaaagacuuguuuuuccuugugucuaggagaugauuucuccgaauucauuaagugcaucuucggaaaaauaaugcaaaagguagcuuuaauuuguuuucagauuggacuuuggggaaauugggucgccguuuguuggacgcucagcugaucauucauccuuuauaggcagugugucucaauugcuagugguuugucuguuuaaacaucaaaacgcuacuuaauaacacaaagaauuauauugucccauauauugucgugguugccuaaagacaaaacucuaaucguaggauaauuuuguucauuuauuugcuuucuuuaaggaaagcgugaucuguuaggugacauuaaaagccaggacuuuccgcaguuucuaacuuaauauguguuacgaaucuguuaccuguaucaguauuuucauacuuaggcuggcccuguguguguggaccgcaaguguggagccaguggagccucuaaauucguucggguuugggaacaggguaccugcccuuggauucuuuaagcaccgugccgcacaaucucuuugccccagcagccuccuugcuagucucuuaaccaauuuaagugcucaacccuugacauuuuuuucaugaccacucucauguuccuguuaugugagauauccuucguuucuacuccucuguuauuccacuguguacugcuguaacuagucuacugucgaauguuagacucucugcuuuacuuuuccccuccuugcuuaauuguauacagcacuugacucuucguuuacuguguuaacauauuuaacauuguuuuuuaguuaagguuuuguuuuguuuaggauagucagauaguaugugcccaguaaauacuuacggaaugaauggaaaugaguuuaguagcagcuaggcuauuacccuuucaccaggaagccaauuagugaguagugagcgcuuaagaaucaccaggcuucuguauccucaaggacagagccaccaacuuuccccugcccuuugggggugggaggggggcagucaguuaagagaaagggcuuauacuuuccuguaaaaucacuuuacaacuuuugggggguggggcaggaggaggauugguuuuucaagacuagguuucucucuggcuugcccugauacuugcucuauggacagugugcaccauggccuugaacucagagauccaccugccucugccuuccaaguacugggccuacaggggugcgauacgauuaucagccagcucuguaacuuucgauuugugauuuuucagagcuaaaagcuuuuaaaagauaugcuacugguucaguaaaaaggcucuuagaaauuuugucuuugguuacuugucucaggacuugaggugaaggugauaugaagucuuccgauucuuuagucauuguggagaaguuguuuuugugaacaggaucuugcuauaguucaagcuaacuugcaaguuguguugcuccugcuucagccuggcaaagggcuagaaucauagacuuuuacuaccacacccagcguaagaucuagcaguugcuggugcccuuagcuggaagcucauuaucuagugcuaugacaacccaguagagacuucuuugugacugaaugacacuauaguucuuuguaaugccuuugccucauucccaucuagguuuagaagaauagcuagauuucucuguauuuuuuuaaaaacuuaugugugcauuuuuuaaauguaggugugugcugucugcacauacacccacaugccagaagagggcguuugaucuuuauagaugacugugagccaccuggugguugccgggaauugaacucagaacuucuagaaaagcugcuaguguucuucacugcugggcuaucucagcguccugauuucucuguauuaucgagaacaguucuguuaauguguaguucagugcugggugcaugcugcaugguucuacccacuuuuacccaagcgcacaugggagagagugaugcuucugggugugguuguagacccacccugacaaccuccuuugcugacgaucuaacuuaaugaaucagacuuagagcuuccaaggcuucugagccggauuucuucuguuuguuaaccaccuauagcuuacaguaucccauaaucugccagaguugugucuuuaaagcccaggugcauggugcucacagguacuuguugaaugaauaagaugcagugaaacugaggcuuaugauaagguagaguuuuagaaguuugcuucugaaagcagagcaugagguaagcaugaggugugggauuugaaguguguaauacugugagcaaacuagcagcaaaugaaagcaguuauucgucuccaauaaagaaauaaaacucccgaaaucauagggaaacugguuaggagccguuuguaugaaaaugaagcauaagcaucaauucugcauaugaggaccucuaguauuccuguggugccuccuggaaguuuucagguaugauauauuaagcauuuaaaaauguaauaaucaggacugaaggugcagauaagaggagagugguugccuaucaugugucaacaccucaaagaacuaaaaaguugcacuccuaaaaugaggcuuauuauuguauacuauagaguccaagugaugaauuuaaagcuuuuugucaggcaaaucuacaguuuugcuguacuuccucauccguacaucagcagaaucuacuagacucuccuuccugaaaagggacaagguuagagcucacaccaccacagcuccuuccagcucugggucucucucuguacucuauaaaaugaggggaaauuuuucuaucauaucugcuuguuauggaagcaaaaaaugauaaauaggagguauuuuacugauaguuuuccuaaauagaaaggacaaagaugcuaaaaauggugauggccuuauuuuguaaaaauccuaccccuaaaacauuauuaaucuuggagccugagcugcugugccagggcugccucugauggcaacccugacaaggauuaacagcuaaucugauaacuggcaacuaaauaggaagacuuaaggauuggauuacccaacacccuuuaguguggguuucgcuccuccugacacuuugcauuaacuugaguucguuuauuaaugaaaaguuuguguucucuauucuuaguauaugauauuuaauaaguguauuaguuaggguuuuacugcugugaagagacacccugaacauggcaacucuuauaaagaacagcauuuaauuggggcuggcuuaugguugcaggggguuaugccguugucauuggcagcaugcaugcagacauggugcuggagauggagcugagaguucuacaucuugauacacaggcagcaaagagagacugugugccacacugggcauagccuaagcauaggaaaccucauagccuacccccagagugaaacaauuccucuaaaaaagccauacuuucuuauagugccacucccuaugggccaagcauucaaacacaugagucuaugggggccauaccauucaaacuaccauaauaguuauaauuuuugguuuuguuuaauuugguguauguuguggagguauauggguaugauacaugugcuagcauauauaaauaaauauacccuccuguguguauacaaaggccacaacagaauauggguaucuucuucuguggaucuuacuuauuacauugagccucucugacccagaaguucucucagacugucuggcuaguaaauuuauaggaucuguuugacuuugcuccuggugcugggauuacagguacauaaaacuaugccagacuuuuaaaguggguugggucuuggagauucaaauaugacuucaugcuugcagaguaaauauucuuacccacugagcuauccuagcccucaguauaggcuuuugauuuuguguguguguuuuaacaaguaaaaauugcuucaaauuuugaguuucacaaacauugaaauuuuauaucaaaaugacagaaacaaaguaucuuauggcugccuuuaaucccagcagaggcacuggaucuuuguaaguuugaggccagucuggucuauaaagcagguuccaggacagccagagaauacacagcaguuguacagagaagcuuugucucaacaaaauaaaacaaauccaaaaaagaguaaggcuagguuugggagagaugacugaaaguucuuccauaaguuuccucuccacuaauuuguauguguucuuuuauuucauuccauaaucacuguauguuuuucacaagugacauuuaguuugcagcagagagcuuuauuucuagauauuuuggacccaacuaguauuuuuagauuuugugagauaguaugaauucucggucgguauuccuugaauuuguguaagugaagcuuacucauuaucacgaguuguuggugauuuugucaguuuaguugcuaaauauuaacuuuggugcuuuacaagauaaaauaugcagacuucuuuuauguguucuaaggaaugcuugccuauuggcuauaagguuacaaucuuggugagucaagaguauggaaugaggauuugcucggugaugcuagcagguguguccuguucaggcucucuugggaaagaaguguggccaucuuagagaaagcugccugaaugacuguucaguuucauccaguggaauauguuccagugaagagcgcaaucagguaucccaugguauuacagaucugagcuaaccuuaaggggcagguucugagucaggggccuagaggucuacggcugcaggcugcucaucugaccaccuaagugaaggugaggugagagugggaacaggagugaccugaauucuguggaggaaaaaggugcugccugccuuuauuuucucuuaauacaggaaggaguuaacaggccuauugaguuucucuguuaaauagggugcauuuuauugaaauuuuucuuugacaaagucuguuagaauauaaauguuauuuuuuaacauaaauuaucaaauuuuauuuccuuuugauauuugggcaaauguaagggcaaaccuguucaaugcuauuuugucuucaguaccugauguaguaacucuuuugccuuuuuuuucagcccagcagcacccugagacuugacuuaggugcaccucauaagggggacaccuuuuaaccuuuaaaaaagccuuuccuuaaagccuuuuaguuccuauuacagcuuugcccuuccuuccagcauaagaaagcuucuguagaaacaaaagacauguccugaagguugcauuugggugacaucccucuuaaauaucuaauuuaucuagcaggugucagaaauguaucacuuaugauucauuauauuauuagaacuaagaguuugagacgccaaauguuuuguacaaaccauuuuaguaauuuuaguuuauuauuuugugguuuuggauguuaugucuaugcccugcuuugugugccuggugccaguguaggccaucaacaagacuccauacagcugugagucaacauguagguccugggaaucaaaucacuguccucuggaagaacagacugccgagccaucuuuccaggcacccucaacaccccccuuuuuuuaaagauuuauuuauuauuaugucuaaguacacuguagcuguccucaaacacaccagaagagggcgucagauaucauuuuggaugguugugaaccaccaugugguugcugggauuugaacucgggaccuuuggaagagcagucagugcucuuaacugcagaaccaucucuccaacccaucaaaccccauuuuuuuaaagcaguuauuuggggcuggagaaauggcuccgcaguuaagagcacugacugcucuuccaaagguccuaaguucaauucccaguacccaaauggccgcucacaacuuucugaaacuccaauauauggcaucuucacacugacauacauacaggcaaagcaccagugcacguaaaauaagaauaaagcacuuacucaucaauaacuuugcuuccuuuuuugugcuuuuuuuucuuuauuuauauuuuuugagacagggucuuguucuuuccuaaccugauuuuaagccugcuauguagccggaggaagacuuugaacucuugcucuugccuccacuuccaguaggcauaucuggauaaguuuuagaaauucuuguccuguccauugauauguucuuguuuuauuuauuuuuuuuuuuuuuguauuaagucacccugaauguguauuuuuuuuuuguuuguuugcaaaugggacaguccuuuucugcuuucucaaaccucuaaauuagauuauuagguuauauggccagucuaaauagcaacacacuccuauaaucuaaggauuuaggagauugaagcacaaaagauugugaguucaaagccaggcugggcuggauagugaaccugacaaaaaaacauuaguuauacaauagaggacauauauuguguaaagugcauaguugaaacuggcucuaacuaugguauuagggucuguuccacuuucucuugaucuucuugcuugauguguuggcuuugcuuucaaacugguagcaaaauauuagucacauauucagcaucacaucaugacagcaaccucuguggugaaaagagccacuucuucucaaacucuucaggcugaccauccuuccucagagaacacaaggaucauggguacuaaaggcagcugugucacuaggaaaccugccacgucaugaaugauaacucauggaaguugcacccauggagcucccagcacagcuugcagucaaccccucacuagauuguuuucaaaguaaaaaacaugcaaucuuuuucccuuuuauuuccuucaguuucucccacacccauaccuuacuucagaugcaccagaagaaggcaucagaucucauuacagaugguugugagccaccaugugguuggugggauuugaacucaggaccuucagaagagcagucauugcucuuaaccacugagccaucucuccagcccuaaaauuuugauuuuugagacuggauaugugacacaugcccacaacucacccauccaagaggccaagguggaagauuugaguguuugagaccagcuuggacuauauagaaacauuuugaaaaguucaucaaaaaacccaaaaaacaaaaaaccuagaauuuagaacauuuaaagcaaaucacaagucacugugaauaauaguccuuguucauuuaacaaccaguugaaaucauuaaagauuugagaaguaaauuuuaaaaauugccucuuugugagccgggaggugguagcgcacaccuuuaaucccagcacuugggaggcagaggcagguggauuucugaguucgaggccagccuggucuacaaagugaguuccaguacagccaggacuauagagagaaacccugucuuggaaaaaaaaauugccuuauuguaaaaucauuuuagauugaauuuuguaugugucaguguuuugccugccugcauguguguguugauccccuugagcuuggguuacugaucgugacccaccauauggguacuagaaacugaaccaugguucucugcaaaagcaaugcgugcucuuaaccucucagcucacuaaguuuaucuccuguagauaaaucuccugcagcguugucauucauaggcuauuguuguuauuuuuauauucauuuucucuuuucaaauaaaaaaaaaaaacagacauuuauuuggagacaaaauuacuuuuucuuuaaguaaauuguauuuuauguguaaggauggguguuuugccuguuucauaugugugcuugguuccuucagaguccagaagacggcaucagguccccugaagcuguagauaucagaauuugugagcuagcugcuuuguggugcugggaaucaaaccuaggucuucuggaagaacaauaaauguucuuaacugcugagccaucaucucuccagcucaaaaauuguuuuuucuuuaaacaauauauagucuuguaaccuccuacuuuucauuacuuuaucuuugguaacuggaaagugugucuucaccuuccuuuuguauuugaauguggaacuucccucacuguuucuuugauggcguaguugaaaucuuacccuuugaccuuuuaaggaacacuguguccagugaacacaaggaaggcagcuguuacaaaugacugacauaucaucagucuauccuuuggcaaaucuuugaaucccaacugcuggaagcaguuguuuuuccuguacuagucaguugucuuaguuauuuuuagucucugagcaguaaaaaacuggaagcaaaaucuuucuaguuuguuuuccaaugccuaagaacuuguuuguacagguuuaccuuagucucaacuuuagauuuccauccuugugcuagaaagggaaagguucgguaggaaucucacuacauaaccaaggauggcuuagaauucuugcucuuccugccucagccuccuaaguauuaggguuacauguaucaguuuucaaacucagcaaugcagaaaucccuuuugaaaaaggcauauaccugaggccuccagcuauguguuauuuaaucuuggaugcaguucaauuuaaaaaaaaaucacuuaaguaaacaagcucaaaacacaaauuuguguugcucgauuuagagagggaacucacccaugauccuguuugcuuuuagccauggacauagugcuuuuuggucaguaccuucacuuggcucugggacuggggguuugcggacuuuccucuuggacccacuccugacacuauagacuauugaaaugaaaccauagacaaaauggguugaguagauuuugaucaaagaggugauuaugaaugggcaacauucugaaucaguagaguucagagagcgccaccuggcaacuuuguaagugguuacacagagacagcuuaauugguuaaaucucaaugacagcaugucuguuuggaauauggcguguuguaaugccacuuugaaauuugguacaucucuucaguuuaucaugguuuuuguuguuauaccugauucuagguuacaugcuggaugggaugugaucacuugguuucugacaguagcugcaagcagccaggcauguucauuugcuucuuugaaaaaagaagguggaauauacuggauacuaaguguccaacaugaauuucucugaagagccagccucaggcuaggauauaagggcagaacugaugucacuucaauaaguuuuaucucagaauguaguccauuaaaacacugugucaucuaugguauuuuaugaauucuuguacccucuugcuuuucucuacugaaauugugucuuaaccuuucuuuuauauuuaauguggcguuuccaacaucccaaaaugaauaagauaaagaaaggcagcauguacacugcucugaacauguaucucagaauuuuuaaauagauguuguagucuuauacuguccuaauagaauuuuugguuuguuauguuguugucaugguuugaauauacuuggcacuacuagaagguguggccuuguuggaauaggugugucacugggcgugggcucuuaagacccucacccuagaugccuggaaaucagucuuccacuagcagccuuuagaugaaaauguagaacucugagcuccucucguauuaugccugccuggaugcugcuauguuccugccuuaaugauaauggauugaaacucugaaccuguaagcuagccccaauuaaauacuguccuuaauagaguuuccuuggucauggugucuguucacaucaucaaaacccuaagacagaaguugguaccaggagugggguauugcuguaauaagccugaccaugguauuguuuggaacaguguggauuuugggauuuuggauuuggaaagcauuggaauguuuuaaauggggcuugaugggcuauucuaauaggaauauggaagacuuuguugcugagaguaauuugaacugugcagaccugguuuaagagguuucagaggauaagaauuucaguauuugguguagaaacuguugugguauuuuggugaagaauguggcugcuuuuugcccuugucugaagagucuaccugggacuaagguaaagagauuuaugcuaauugcauugacaaaggacaucucaaaaaagcccagcagggacuuuguucuuugguuaagucucaugaagagcauagcaaucuuagaaaggaaaaaugaaaaauauauuguuaaguauuaaaggggcaccaggaagugaaauggagcugaauccuguguucuaggagauagcagauuaagggagugggacuuugggggaagauccuacccagcuaaauuuagauccaggcuuggugguguacaccuuuaaucccaggagacaggcauccauaucucuuuaguucaaggucaaucuacagagcaagcuccgggacagccaagcuuaggccaugaaggaauuggaaaacagaaagcuagagacaauguaauagaacaagugggccauguuccaguuccuacaagcagcagaacucagcagcuuuggccaugugguucuggcuuuagaguccagaauagaagggauuauugggacaauugaugcugguuagcuggaacuaagaccguaguggugauuaagaagagacuagaaucaccgaagugaaaucugagagcagaaagaagcuguguuccagagauagccaagguugcaccucaugcugcagcuguacuuagaguaagagucacccaguggguacugguuuugaagacaugaggggucaugaagagcagcugaggcuuggcacugugagaggccaugggaggccauuggugaaggugcagcuucaguuguaguugauggccuaggacugaggguucaugcaaaggauuugaggcuuggcaccaugaagagagccucugucaggcuauugguguaguguaguugcaguggaagaccccaguguauuggagaugcuggugccaugagaugaucaccaugaauagcagcagcaguggaguggagucaaccugagcuuagaguccuacagagggcagagcuggagaugugacaccagcccuuuggaggagcccagaagaucauguguggaucccagacauugaaacaagaagcuguaauauugaaguugccuuggagaccccaagauuuucuaaaugccaaagcuauaggauaucucuugagaaugcugcuaacagaguggaaccagcccaagaaaagaaguguauugcagucgacaaagaugaaaaaggaguuggagaucugaaaacugcuuugacaucagacucagagauggaaaguuuggaguuugcccagcugauuuccugucuugauucaugaauuacaauuaaguaauuagauggaucucagaggagacuugaacuucgggcuuuuaacauuguugauacugcuuuagacuauggggucuuuggaaguuggacuaaauguacuuuuuaaauuaugcuauggcuagauaugcccccccccccauaggcucauguguuuaaacaagccuaugggggucagggagugaauuucaugguuugaauaugcuuugccuggggaguggcacuauuuggacauauggccuuguuggaauaggugugucacugugggcgugggcuuuaagacccucauccuagauuccuggaagucagucuuccacuagcaaccuucagaugaaaauguugaacucucagcuucuccuguaccgugccuaccuggaugcugcuauguucccgccuugaugguaauggacugaaccucuaaaccuguaagccagccccaauuaaaugcuguccuuuuaagauugccuuggucaugguuucuuuugacagcuguaaaacccuaagacaauugucuuguauuuugauauagaguuuugcuaaguagccuagguuggcauugaucuugggauucuacucagcuuuagcaucccuucaggugcugagauuacaguguauacuaccacccuaacaaacauaaguauuuuuauaaguguauauguuauuuguaauuaaagauuugaauguugcauaucuuaguuuuguuuccuguugcugugguaaaauauccuagcaagaacaacuuaagggaaagggguuuauuuagcucacaauucaagguuguaguccacauuuuucagaaaucaugguggcaggaacuugaagcagcuaaccaugugcacagucaagagcagagcacuuggauuaacacaugcuuguacucagcucacuuucucuuuuguauagcccagcccccauucccuuagggacuaauuguuuucuucauacagucagauagguuccugguugguuugugaucaagcagaaaggccugaguuauuggcuaccucacacucuaauuggaaacugauuuucagauacuacagcaugaauuuuaguuaaagauucccucagaaaauuaggacuaacaucauuguguuucauuuuuaguaauucauuuucagcagagcuuuucuucuacugugggccaaaugugcauaaggcagagaauaggaaccugccugucuccucacuguuaggucacaguaguguuugcagcuuauccccuaugccugcaucaccaucacuuguguuguuuguugcucuguuccuuugcaucuuuaugugaaaucaccuugucauaguccaucaacauguaugcgcucucuuccucuaugugauaaauugauuaucagcuggauagguucgagagucauuuaggagacagauuucugggcacauauguaaaggaguaguuuuagguuggguuaaauaaggugggaagacccacccuaagagugaaccaguaccauuuaaugggcuagggucccagacucaguaaaaagaauaaagcaagcugagcaccaaacaccagccuuuuuuuucucugcuuucugacuaugaauucaaagugacuagcuagcuguucuugcuccuacuaccaugauuucaaaaaaaaaacaaacaaaaaaaaaaaaaaaacaaaaaaagauggacuguacacuuaaacugugaaucagaaucuccuuccauaaauggcucuuguaggcauuuuugucacaacaaaaaaguaacauuuucaucuuuggcucuguucucuauccuuuuuaugauaauacuucccuucuaggucauuaaaagccuuuugucacaguuauauaccaaggaaccaaacuggguccucagccagagcaauuagguguugagccaucucuuuugcuaggcucagcuagcaucuuucaaguuacaagcuccugugccugcucacagagcaguauaauaagaaucugcuuuguccauguauacacaaaaaccauuuugaaggcaggggauucuguacuucugugucuucaggcugcccacaacaggaugcauugacuuugugaucugugucuuuucucugggcacuuaccauccuuuuaaacauggcuggucgguggcucucagaacuacacaccucuaacccuaauccuggaauagugugaaguaagcaagggaagcuagaagugcaucagagaagcugugaacguuguuucuuuuguguucuuuugauacaagacuuuacugugcagcccaggcuggccuccagcucucaauauucaagccuuucaaguauugggaugucagguaagcaccuccaaacuugggauugaauucucucagccaucaaaggcuuucuccacacuuagcaaaggcuuuacuguugauuauugcucuuuagauuuuaauccgugaaggcccauaaccuaaaaccuugggauaugauucacaggguuugccucauaguuguuuugcacccccuuauagccaugagcuuuuucuauccccccucuuuuuuccuggaauacagacuaugagacuuaauuauuuaugaauaaaugccuaggccauaaguuuuggcuuguucccugauuagcauguaacucauauagcccauuuaucauauccugucugccacauggcugguuaccucucuucaguuucauguuucuaucucuuccaaguccagagaaaaaaucuccugcccuugagucuucuggaaucucauaucucucucucucucugccgaugguuuaccuucuaauccugcuaagcucauuggccaucagcuuuuuuuuuuuaaagauuuauuuauuuauuauauguaaguacacuguagcugucuucagacacuccagaagaggcagucagaucuuguuacggaugguuaugagccaccaugugguugcugggguuugaacuccggaccuuuggaagagcagucgggugcucuuacccacugagccaucucaccagccccuggccaucagcuuuuuauugacaggugauucuuccacagaauacacaagagauucuauaucucccccuuuggucaauaaaaggcucuuucucuaacauaagaaacuauauuaauaagaacaauuauaaaagcuaucagguaagaauuacagucacaauuuccaauccauuuguuuggcaaccuuggagagagacacuaguuugguuauaccguccaaaccaacuuauaaaagaagcuuaccugcucgaucagaaagcagaaaaucaucuuuagucgauucugcauccuauacaucccaauguuaaugcagaaauguguauuacuuguuaaaguuuguauguuuacagacacuaaugaaguuaaagcggcccugacaagauuaacccuaaagaaugcugagauauauuuauuccaguaucaugcuucauccaaccucagacuaccugaguagcuguuucaucagaacuugcuuccagcacagcucuaaagcugcuuaguccuucucuagggaaaauauauauauauauauauauauauauaucguuucuaggaaaaccuugcuuacagucccuuugaaaugaccuuucuuacuacaauuaaaauaucugguguuuuggauuuuuuuuuuucaaaaccuuuuuugaucaggucuaaugaagucauaucauaugaaugagaucaaauaucaacuguaauucuaauccaauaaucucuugaugcugaucuuuccuuuaaugaccucaucgccuucuugcauucaguauuaccuuuuuuuuuuuuuuuuuuuuugguuuuuucgagacaggguuucucuguguagcccuggcuguccuggaacucacuuuguagaccaggcuggccucgaacucagaaauccgacugccucugcaggcuagugcugggauuaaaggugugcgcuaccacacccggcugguguuagcauuuuugaaagcuaaagauucagugcuuuucuuacuugugaauaugauccccuucuaucuauagcugaagucaggcuucauaaaaagucagugaauguuucucuuggaccuugcauaauccgaguaagcaguucaaguccuuuuccuguuucuucacccugucccaagcugucaugugacauagugccaaggcugcuuccccauauaugaccuauuuguaccucaggauauguuccuucaccaaguagcugaucuugagaaauauugacuaaccucuggcccugugucucuguucuguguccuuagccucuucucuccaccaugaacgccauuguaguugugggccagguucuaacauugcucuugucauaccuuuacagucuuugggaauaauacuauuuugagucaucugagaauuuaauaccuguuucagaagcaguggauacauucuauaauugguggcaccuucuuuuaauuuuuuucaaauccaggacaucuauggagugccacucauauucuucuuuaggguggccacuaucuauuggcacuuacagacuaacuggauaaacuaagguugguuuucuaacaaccuuuggguggcuuuccagguuuucauuauaugaugaugcaguagacucuggcccuauucugucucuuaccuuaguuuauuucccauuuuuuuuauuuacaguuuugucucauuucucuuaggccugucccaauuuuucauauuucucuuuuccuuguaucucuacuaucuuaguauuuuccuuauuuuuauuuauagauuuuuuaaauuuuucauucuaaggccugucuccacuuuucauuuucuuuuucuuguaucucuaaaguccuuuucuuugagaaggcacagaaagacacuauguuuaccaagauaaggauuaccaaugugguaauaaccagaauuuguaauguuuuuuaucuuagaucauuuaucucuuucucuuuuguuucuaucuuucagccauuauuguauauccagaagcucuguuauucugcuuuccaucuuuaugugucuuauuucuuuaaauuugucaauuucaaauuaugucuaugaauuuuuauacucagucucuuacccuuuuuagcauuaaagcguuauuuuaaacauuuuuuaucugauccaaaguuugucugugcuuggcuuucuucauguguucucucaaucagugucuggcuucuacuucacauccugugacuagcuccaccccugcccuuucucucaccaggaagaggcauuuccacccauuucuauagcuggcccuagccaagucucagguuuaagggguuuaacugcucugggagguuguugggcccaugagaugagggagagguuccuccugccagagucuauaguugguuuccucugcccccucagcucuuuccagcagacugcuggcuccuggcuccacccuuccuuggguaagcuuucagaggagccuauugggggcugguccugcucuaugauugcugccuacucugggaagguggcuccagauggcagcauguugcugcuucugagagcugagccugagcagcugggaacuggucuaugcagccccagcugccaguguugcuuucgcugccuugggagcacaaggcuuccaggacccuguaguucuccuggucaagaaccugcgucuaugaaccguuuacuucaguucccuuuaucuaccgagcagcuggcggccucucuucucucuuaaagggacaaagcuacuggaaccugcucuguucccagggggugcaccucucaccugggaccuuuuuuaagcuugaauucuaugccccacauaugguacaucaaauguauccacgagcuuuucuacccauccucuccccagaguaacgacucuaagacuuaauuauguauguauaaaugccuagaucauaagcauuuggcucauuccccaauuagcuuguaacuuuauagaacccguuuaucguagucuauguuugccacucaacuacuuaccucucauucaguuucauucauuugccuccucugaguccagggcaaaaucucccagaauuccucucuuucugacaaaugucacaccuucaaauccugccucaguucauuggccaucagcuuuuuauugacaggaagcacuuccacuuagcacucaagagauucuuuccacacacccucuuuguuauccaugauagaauucuuuuacuaaaauaugauuguuugcugagagguggugacacauaccucuuuaaauccaauacucaggagucagaggcaggcagaucucuugaguuugagggcagccagggguacacacagaaaccuugucuugaaaaaacuaaaaacacgauuguucaggauccagcaguuugcuugagcaggcaaaagcaccaugccaccuagucuguugaccagaguuuaguucccaaaaccaaagagaggacugacucucauaaguuguccucugaccuucacaaaugcauacucaaauaaauaacaaauauguacaauuuuaaagauuguuuuaaugaugcauacaaaaauacgcgaauuugccgggcgguggugacgcacaccuuugaucccagcacuugggaggcagaggcagguggauuucugaguucgaggccagccuggucuacaaagugaguuccaagacagccaggccuacacagagaaacccugucucagaaaaaaaaaaaaauuuuuuuuuuuuguuacaaguuuuuuuggagacaggcuuguauuuugaguagaggguaaggaggaaaguagagcaaaauagagagcaagccucucagagagacuucacucgugaggggaaggcagaggggccuuugagguucuagggaaagauggaucaucugugugcccuuccaagucuugagaugacacucagaaauaggguugaccucugucuccugccauggaacaguaguaguuuugaucauaggcucuggcugccuaagaacucacucuguagaccagguuggccuuuaacucacagagagacccaccugccuuugccuccugagugcugggauuaaaggagugcaccccccuuuacccucccccccaagaccggguuucucuguauagcccuggcuguccuggaacucacucuguagaccaggcuggccucgaacugagaaaucugcccgucucugccucccaagugcugggauuacaggagugugugugccaccacugcccagcucucucuuuuuuuucacccauuuuuuaaaaaugauauuuacuguaaguaaaaggaucaaaggaugaguuuguaauuaaguagcuccccacccacucccaaauuacugagaguuuauccucacuccaggcgguuugauucuuucaccuucuagaacagugguucucaaccuuccuguugcugcagccuuuccuacagcuccucauaaaccauagcauucuuuuguugcuguuucauagcagaacaguuugcugcuacuguuucggauuguaacguaaaugccuguuuucugacagucucaggugagcccaaagugcugacucccaaaaaguugggacccacagguugagaacugcuauuuuagagggauuucuugaagaaaaacuagggggaagggcaucauugauaaauuuaagaaaguuuaagaauuucucuuuucaggcuagagagauuugaguucaauucccagcaaccacaugguugguggcucacaaccaucuguaaugggaucugguguaucugaaaacagcaacagugagugcacuuauauauauaaaguaauuuuuuuuaagauuuauuuauuuauuauauguaaguacacuguaguugucuucagacacuccagaagagggcaucagaucuuguuacagaugguugugagccaccaugugguugcugggauuugaacuccagaccuucggaagagcagucggguacucuuacccacugagccaucucaccagucccuuuuuugguuuuucaagacaggguuucucuguguagcccuggcuguccuggaaggcuggccucgaacuccgaaauccagcugccucugucccaagugcugggauuuuuuuuuuuuuuuuuuuuugguguguuuuuaaugguugugcuuucuccuucccuuccuucuacaggguagcacuguauaucccuggcuagccuggaauucauaaagauauucugcuucugccucuccagugcugggauuauaaagguuugagacacagugccuugcuuaauuaauuaauuaauuaaaauagaauuuauaauauagcuguuguauagcaaugugguugugauuaauguugcuguaucguaucauugaaaugauaaagaugguaagucugcuaauuuaucuuggaauuuagauuuugaaauuaaggaggugccuugaugcacaccugugaaggauuauuuagcuucugggcaugccugugagagauuauacugauuaguuuacuggagugaaugccauuuucuagagugaaugccauuuucuaggcggggauccuaucuucuacuuuaaacaggagaaagugagcugagcauggauacucauggcucccugcuugucugcauuuguaguaugaauagcugccuugggcaccuacugcugugacuuuccugaaaugauggacuguagccacgagcuaucaguucuaauaaaccuucauccauaaaaaucugcaguuuaucuguguaucccuggcuggcuugaugucgcugcccuggaccacuauuuucucuuucuuucuuucuuucuuucuuucuuucuuucuuucuuucuuucuuucuuucuuucuuucuuucucuuggagggggguguuggguuuuuggguuuguuuuuuuuuuuuugagacaggguuucucuguguagcccuggcuguccuggaacucacucuauagaccaggcuggccucgaacucagaaauccgccugccucugccucccaagugcugggauuaaaggcgugugccaccaccgcccggcuuggaccacuauuuucaaccaaguuauguuggccuuauuuucucuuggacucugguuauguuaauaaacucugauuggguuuucugguuuucucacugggcaccaagacuuugcccucauuuauuuuacuuuguuacauuuuguuuugagacaaaguuuacgccucacccaggcccauaguccuccuuuugcauuggucucaggcuccaguuuuauagucaugcagcacuauguccugcuucaguuuuaaaucguucuucuguccuucacacugauuaucaucacagaaucugcucuguggccugcauccuacugggaagcgaagucugaugacuuucauauguccaacuucuauuuguagcauuuccauguaguuauuauuuuuuuacauuguagcuuuuguuguugagaauuuucauucaccgugaguauaguauccuuacaucacucacauuucuguaaugauuugugguauuaaagcuuugacgcugugaaguaugacugccugcugcugcgggugaguuggcucucgccagcuccugcuuccuggagcaggucaggugcuuuacucucagucuguugugucuucuggucuuguuucuuuccucauuuucuugaaggacuuccucaaaugcugguuuuauaugggacaaacaaguacuuuucuccaacucccacuguugccugacacuugguuaguaauagaauucuagguucaauuuuuuuccccucagaauuuaggaccuacucaaagagcagugaugugccaaggcccaggagcugcuaauaacuauagcuccaccaucugggaaaugagagaauguguaguuauauaaggucaaguccaguccaagaaucuauguaccauuauaggcuaucacauaaaaaauaagcugauaaauguuuauaauuacuacucaugaacucagcgugcacaaaugcacguacacaaauaaaaggugcuaaaucuauucaaacuagauguagaggugaauacuuuuaaccggguaccuggggaaguggaagaaauugaccaucagaccauccagguuauguagugagacccuguuucugguuucuuuuucuuuuuuuuuuuuuaagauaggguuuuucuguguagcccaagcuguccuggaacucacucuguggaccaggcuggccucgaacucagaaauccaucuuccucugccucccaagcauugagauuaaaggugugugccaccaugcccagcuguguuuucuuauaguagaaguauuugcacacacauuuggcagaaacauauagagaucaaagguugauguugggaugucugggaauuagucucuuauuagagaugcuguuuggcuagacuggcuggcugcuggguugugugcugcugagaucauuuuuauaugguugcugaagaucucguguuguacagcaaacacuuuacucacugagccgucucucuaggccuucuaguaguuucuuaauuauaggccuuauauuuaggucugauuuauuuugaguuguuuuuuuguauauggugagaaacuggauuugaggauuuugaaaauagggauucuucuauauauugacauccaguuuuccuagcacaguuuucuggauuuagaaucacaguggaaacauacucuggguauaucuuugaggguguuugcugaaagguuuaauuuauggaagggaagguauaccuaaauguaguuaagcaccaucccguaggcugggaucucaggcugaaagggcucaucguuuaucgucugcuuccucacuaugugugacuagccaccucaugcuccacugccaugccuuccuggucauaguaguguauccccugaaacuaaaccaaaauaaacuuuucuuuugucaaagucagugugauguauagauuuauuucuauccccuauuuguucguggucucuguauugauuuuuuuauauaagccaguauauugcuauuuugguuacccuagcuuugugcguuuugguuugauuugguguuuuuugguuuuuugguuuuuuuuuuuuuuuuuuuuuuugagacaguguuucucuuuauagaccaagcuggccuugaacugagggauccuccuaguuguugugcaucuccgucaccugacuuguaguuugucuuauuagacaaugugauaucuguagguuugaucuuucuguucagguugcuuugacaacucagggucuucugugauucugugugaauuuagaauugcuuuuuuucuaugaugacugcuuuugagauugcaauguuuccagucaaugaacuuaagacauuuuuccauguuuguauauauucucuuuaguuucuuucaucuguguuuguuuguuuguuuuuuugugccccccaccaagggauugaacccaaggcuuuguuguacuagguuuuuuuuuuuaacuaccuuaccauguuuguuauuaauguauaaaaaugcuacugauuuuuuuuuauuaauguagauuuuugugucugauuucuauguuucuauauauaaaauuaugagcuagccagugguggcacaugccuuuaaucccagcacucaggcagaucucucaguucgaggccaguuuggucuacagagugaguuccagcauagcuagggauacagagagagacccugucuugaaaauaaauaaauaaacaaacgaacaaaaacccaguaguaaugauuuagaaauaaaauuauguugaaaccagcuggauggcucagugagcaaagacauuugccaaagccugaugaccgucuugauuuugauuuuuaggauccacauggaagagagaaaggauuuaaaucauaucugcaaacagggacaacuuugaauuuccucuucuguuuuauaagcuuucuuucuuccaccugucuaguugcucuggauaacaguguugaguaggaaugaaccauaugugguuguuguuuaguuuugaaugguugguuuuuacagcacuggagauugaacacaugcuaggcuaauaauagucugccacuaagcuaaauccacaacuuuuuaaaauuuuuauuuauguaccuaucucuguguaaauaugugguguguguguguauguguacgcgcacgcagguguccugagaggccaccuggaguuaggcagcuauuagcuaugcaauauggaugguaggaauuguacauggguccucuggaagaguaguaaacauucuuuaaccacugagccaucuuccuuuaaauauuaucuaucuaucuaucuaucuaucuaucuaucuaucuaucuaucuauuuaagcuagguggugguggcacaugucuuuaaucccaacauuuagaaggcagagauagacagguggaucucuugagucugaggccaaccuggucuccaacggcagucuagcacuacaagggaaacccuguuucaaaauaaaacagugaaugaaugcaugcauguaaaauuguuugcuuuuuguuugcuugucuuggguggggagugcagaugaaaugauucauaaugauauucugcuguacucauagauuagugccuuguccagucauuaucagacagagcgagugcagagacccacauuaugcaaugagagagucuggauuggaggucuccauuggguccuuuccucagagaugaagcaucccugaggaagagagggaguaaagacuaggagucagaggggcuggaauacaccaagagaacaugguggacugaaucagcuaaguagagcucucauaggcucacagacugaaauagcaagcacagggccugaaugggucugcaccagguuauagcuguuagcuugguuucagagauuacaggcagucucaguuuggugccucagaaaaaauacuuugaagguuacaaauaagggguuauacuaaaagaugggggcuggugagauggcucagcggguaagagcacagacuguucuuccgaagguccugaguucaaaucuagcaaccauacgaugcucacagccauccguaacaaaaucugaugcccuuuucuggagugucugaagacagcuaguguacuuaauuacauauaauaaauaaauaaaucuuuaaaaaaaaaaaaagguucuuuuaaaaaaaaaaaugcugggcgugguggcgcacgccuuuaaucccagcacccaggaggcagaggcaggcggauuucagacuucgaggccagccuggucuacaaagugaguuccaggacugccagggcuauacagagaaacccugucucggaaaaaaaaaaaaaaaaggauaaaguuggggcuggagaaaaggcucaguaguuguuuauacuguuguuguagagaggacccaaauugcauucacgacauccauguuggguggcuaacgaccauguguaacaccagcuaaaauaagugcuuagugaaaauaaaaaugcccagguaacuuuuaaacacguauucuggguuucaggguuuuuuuggcagcugcugaaggucuucugaaaagcucaugaaauauuuucaucaugacugauuugggguuuuguuguuguuguccauauuuuauuauuuccuuccguuucuauaaauguggguuuucuaaaacaggacuuuugggggagggaaugugggugaguguaguuagucucuaacuucggaucccuugaccucagccuuccacagagcugggauuacgggcauauaccccacauccagcacaaucuuuugcuuuuuucuuuaaacuuuaacacaucuuugguuuucugaaccguuuaaauaguugcaacauuucaugcguauuauagauaccagcgcccacauauuuacuuguggaaugggaaaggaacauaaaccacagcucacuugaggagcucagaggauaacuuuuaggagguucuucuucucuucuaccagaugaguucugggaguccaauuuaacuugucuagcaugacagcagugcccuuaucacgucucacagacccagguuuugucauuuucuccauauuucccuuuaucuucucuuguagacuaaccuaacauggccgaccagaggcagcgcucacucucuacuuccggggaaucauuauaccauguucuuggacuggacaagaaugcaaccucagaugacauuaaaaaguccuaucgguaagcagccguguuaaccuguaagaacacagauccucaucuggcuucuuguauaauuuaacaagaaccuuggcauaccuuuuucaugacagucucuuuaacaguugcauuuuauccucauguucauaguuuaauccucagacuugggaugcagagacagaaggauaucugugagugaggccagccuggucuauguagugaauucuagaauagccaggauuauguagacagacucuuucucaacaaaaaaaguuacacugaucuucucuagcaccaaaaaguaaacacacuuaaaagauauugccaacucuccccagaccaucacgggaucaagguuugaacccugggcauagcugcuaaaugcuauauuuuaaaacagugaugggauuuuuuuuuuaaucuugucauugcuguuugacuggacuugaagaauguuucucugagguguaguaugauauagucacccagaaagggggugggguauuuucacgucagauagucuuggggucuguuacuuguauuguucuaaauuaucaauauuauacuuuucucugccaucaccuuauucuucaaaugugcaauuaguaugccagcacacuggggguuggcaggagugaaugcuauaagcugugcucuaccuuucuuaguacccaggacucaccuuuguggguauuuccugguagaaaggauuauccuaaagcaauuagagacuucuuuugacucagaugaaccagaucucuggaaaguugacaaaugagaugcuaauggguaaguaucucuuccccuggacucugguggacaaaugagaaauguaagaccaagguagagccaggaaaugguuuugguuacaggaagcuggcccugaaguaucacccugacaagaacccugauaacccagaggcugcagacaaguuuaaggagauuaacaacgcacacgccauccugacagacgccacgaaaagaaacauuuaugacaaguauggcucgcuggggcucuauguggcggagcaguuuggggaggagaacgucaacaccuacuucguacucuccagcuggugggccaaggugagcugccacacuggaggcauugagaauucuaguucauaauuggacuacagauguugaaagacccguuccuucagucccuugaugugcuuucuggccugaggcugucuuccgugcucuucagcuguugcacuggccucuucauagcgagcacaguacacagcguacauggagcacaaccauuugcaucaacgugauagucucugaugcaugguaccaaccuacugaaaagauugagauauguguaggcaggcuuuuaguuagcaugggagacuuaaaaucuuacuuuaaggguuggggauuuagcucaaugcccuggguuugguccucagcucuuggggggggcggggguaucuuacuuuagccagguguggugguacacgccuuuaaucccagcacucaggaggcagaggcagguggauuucugaguucgaggccagccagggcugcacagagaaacccugucucuaaaaaaagucuuacuuuagaaacucuugacuuaacaccauucguuuauuuaauagccauuuuugcuccccucaucugucagccuuauacaaagucagaguaaauuauccuguaguucuuagguauagguagccugauuuugugauuuuagguuuuuacugguuagucuucaaucuuuauaguuuuagagagaaguccauuagagauauuuauaaguugaaacugaagaagagaaccaugccauuugaguuugguguggagggucagcugaacugggaauggggcuucagagaaaguaaggaagucgaaaguaccauacuuuggacuucaaaacagaaagcaugcuuugauucuggcugacauuugaauacaaaagaacuagaagagaaaaggggaagucacacuuuuguuucuagggagagccuccuggcuuguauucaaucccaucuuuagaaauuacuuauuacuucugcuucuccuguuuucacccugcaaguucucucuugucuacagcuuuuuccugaaagaugcccuuagcauuaguuguauacacugcagcucuugaccugucuucuccagggagggucuugugguauggccugugggcccuugaggccccauagugccagucaguauucucucucccaggcgcuguuuguuguuuguggccuccucaccugcugcuacugcugcugcuguuugugcuguugcuuuaacugcugcugugggaaaugcaagcccaaggcaccugagggugaggagacagaauucuacguauccccugaagacuuggaggcacagcugcagucugaugaaaggggugagugugcagcccagggccuugugagugugugggguggagccagcacuggcccugaacggugucaacugucuugucaaacaggagggcacugacacugugccgagaguguuugugguggcaucugggacuguugaggugugaacguggacacuugagguaaagcaggugcagggagcuguuccugcccaugaacugguagccguagaucugagggaccaaagguggggugggaggcaggcagguggggagggccgggggcugguguuaccugagaccacugaggaaaguguguuggguggaggucagcaaguagccucuccccugagugucuguccagguggcugaaugaugugaugcaaggaccaugucgauggguacacaauacugcugcugcccuugugcgaugagguugucugcuuacuuuucagaggcuacagacacaccgaucgucauacagccagcaucugccacagagaccacccagcugacagcugacucccaccccagcuaucacaccgacggguucaacuaaauucaggagaggcugugauuagaggaugaaucagcaucuggccacugcaaccuuagaaucaugaacuguagucacugagaugggaaggcagccgucaaccugaccugcucuggcuggucagggccacucccaccuccucuaaguccacccaucugucaauccuugauacaugaagugcguagcaugcaguauuuaaagcaguguagcuacggucuucuucuguuuuauccuuuuuuuaauagcauguauggguuauguucaaugucuguguuguggacgugcugcagcugggcugaauuaacuggaugguagugcuuauuuuggguuuucagccaagcggguccagugaagguucagcugucuccuugugcuuacaggagucagguaagcaccuggagcuacaucuccuuguuggccucuguguccugugauauggucuaguccauggcucugaucucauccucaaggcugcagacagggcucugauaucaccugcaaaggagggaacugggccccgucuuccaggcaccaccagcaucagucguuugcacgguguucguguugggaagcuuucauagggucucugcaucaucucacucggccucgugacaguuuuccuguuagaucugcuauggagagugcagguaugccccuucugaaagugggagcacacucuguguaaugucacuaucuugggucuccuggccuuguggacugaaauccuaucauuggaggcaugucucuugcuggugugugggaaaucauuugucucuguucugcaccuuuccaggucaaaagcuggauugacggggccacagccuccuucccucauuccugggucaucuuccacauuccuucaagccaaccuuuuaaucuuuuuuggacuuuuaagaaccacaaauggcagcaccugccacuuagucauagucagaaagucucuugaguccaguuguggguggcaugcaacugcuuaugcagagucugagugcccaggcuccagaaccuccucccugugcuugccagugccccacccccugcuugccuucgcuuccaccugucacuaucaaugccucuggcagcuggaguguuggguuccuggagcagguggcuggacccuggugcuccuggcucagaaggguuggcuucuagggaagcuaugguaguagucacucaaccugggaggccagcucccggccacaggauuccuuugugaaccucucuccagucaguauuccagucuugguucuaggguaccaugguggguggaguugaaaaaugugguuaccagugauauggagccauccuacccuuuuacaguuagcuagauaguuguaccagacuucaaugagccagguuccuccagaaccuucccguuggcugcugcugcccaucugcauuuccagaacagaugaagaaggagaaggcucaugugguggcucuguggcccagacaaaccaucauguguuucugaagcccaccccgcccaccuccuggccccagcucaccagggccuucaggaccagaucagguugucaggaaguuacaagaagaggcagcacugugaggacaaacauggcagugaucaagggaacccauccagguccugggagacacugaugccaaguucccaguugacccuacaacagaacuacaugagccaagauccucccauggauuuguuaguuucguucuuuaaaggauuuuagggauauccacuaacauagucaguuaaaaguaauuuguaaacaucagaccugugucuagauguagugggauacgccuauaaucccagcacuagggaggcugagguaggaggaccuugaguuguagaccagucugggcuuacacaguaagacccuaacucaaauaaaacaaccuaaaagaagaaugagaaaucuauuaauuggcccauauuugggacaaaggaaaaagaagucacuggucaaccuggggugcugggccucuuuuccuacagugaccaggaaccagguccagacuuguagaugaucaguugcagucugguagcacaccccuccugcauguagcucuguggcccuuucccucacauccuaacgagcuagauccugaacugggacuuguggugcugucaggaugagaacauggaaguuuugaaccuagugucuuuuggaauucguaaagcuaaauaaaugauguugaacuugaaacccuccauauguagaucaguuucaaagugauaauagugauugccacggccaguaaguacccugaccugucccugugcagacucccuugcaggguuuuacuauguugaucuaaggucuccuugauuucauuuguccuaagcuaagaacuggugagucucaggaucagucugacuguucuuguccaaauauaaauauuaaauagagaaacacacacacuccccuaacuccuauacuggcaggcaguguagauggugcugugcuguguugcccagagagugcuggaaucugugcaugcaagcucauccugugcaguggagaccacuucugaccuacagaaaguagucgggagagacccugggggacccgucuaccaaggcugcuggaguguagguuucuguuugugcccagugaugucuuuccuugucuuccuuuugacuguauuuuaagauuacuuuagaugauucugugcaauguuuaugaccuuuccuacccuucuaauguucaguuaacacagccaguacccaauggggaaaaaccaggcugggugaugguggcagaugccuuaugucccagcacuugggaagcagaggcaggcggcucacggagccuguucuacagaacuaguuccaggacagccaggacuacacacaaagaaauccugucuuaagaagaaaaaaaaaacaaagcaaaacaaaacaaaacaaaagaaaaaagccagugcuuacugugguuaggcaacuuuuucccaaguuacuugcuggauuuguuccugaaucauaaagccagucucuucagaugucaagauuuaauaucagucaguacccguuguccugcugauccauggugucuguuacaggugagccuuguuaaaggaggugccagugcugcagcugguagacuccagagagagugacauaaucauucaagcugccccugagggugugggugcuguaguacagagaaccugugggccgugagcauccuacuuuggcuuucagugcaccuuuuauugaggaacaguugugaacaguguaaaccgugacugaucuuauucuuuuuccaguauuuugagcugugaacccaugugucccagcacuggcuuguuccuuuuuaguuugauugaauuauccuccuauggaaguggcaaaaucuaugucuuuacuguccuuacaagcacaguguguguuaccacauacugugaguguggguuguggugugugucaguguguguacauauguguauauguauauaucacacagcaggccugucaugccucuguuugguggcaaagcaacaaguacaauaaaagucagcuccaaaacagcugugguuucuugaaguguugggcagggguagggucuccuugcagaacacaaaaggaaacccuaaguuuauuguguacauagauacaugaaccugaaugcauaagcccuggccaggguuggcuucagcucuauguggauaaaaggaugaucauaccaaauauaucccugggaaccaugugaaggucgccugacccucaaggauaugagggucuaggacaugacuagaaacuccucucuugaaaacuaagacuaguuuuauaaguaccagguaaaagucaguaaucugggugcauguaaaggacaggcuaguuagggucucugcugccaaggaagggccugggccagugccccauagggugugcucuugauauguucucuaggaaagugucucaauuccaaguuggggaaagagagcucaaagcaagagcagguaaagccugucuuagguuuacccacugcuacagacugguuuacaucaggguacaaguugcugucaguucaggcugacugauguuccuccaagagccaagcugaaagcuguggugguuccacauggugagcugucuaaauguugaccuaaaauaaagauagcuguuguauaauaaauguuuucacuguagaccagauaagugucuuauuagugauuuccugccaaauauuauuugugaauuuggcacugaaauggcaccugauguugaccccuguugcugggucccuuuugggcugacccucauuuccugguccagcugugagcaccccucccucucaguucugauaccucauuucugaaucucaugacuagaaugauggaaagcaccuguuagucccuugcaucuuuaauuccugcuaaggcaaguggauuucugugacaugaaggccagccuggucugcuagucuacauagcaaguuccaggacagccuaggcuacauggaccuugggggaggugggacauggacagaccuguuaaauagucuaagccaaggguuucuggagcccucacagugucuggccccuuagugguugaauucuugccuaacagcucuagcuuuuuacuccagagcaaguaaccauguccucuggucuuaauggccaaaccaagccacuggauuaugacuucauccacuauuucuucaucuuccuggcuugacacaucucuagcuucugcuuguagcuucuagaagcuucccugcuguucuucauauauaguuguucauacuuuuguagugaguauuugggcuggcccuauuucuggugcacugugaacaagaucugggguagcacacggugggagcugcaugaaacugguucuggcauaugugguacuugcuaauccugagagugagaccuugaccacauaacaugcuucuguccugaauucaaagcuuaagaggaaugcauaguguagagggcaucuagauagcucagcucuuacucaacuagguaacuucaucucuugucuaccguuuguccuggccauuuauauuucugagagauguggucuauauagucuuccuggguguguaaugacugguaaaagaacagcuccuagcuguuauuggcccaguuuaugcuccagcauuucuugguaggauccauccugcuaugucuuaaccaucuggcccuccagaugucauggucgggggugggggggggguggggggaggaggugugaguuucuuuguacacacucaugcaugcacaccugacggcagaguaaaagcaaguggccuaggauaaucagcucaaguucucauguccuuuuguuuggugucuguguuucccccacuacugugaugaggguccaguccuggacuacuacaaaauccauguguuccuggggugccauuugaagacuggaccggggucccuguuuacagcaauaccagccugaggcugagcuccagacacuucuauuagagugcaagaagacaccuugaccaugaagucccucaggucugagcaggucccuccucgucugaucugcacccugucugauggauggaaccuuuuguguccuugaucacuuuuuccguuuccucccuuccuugcugccucacucuguaccccuggcuggccuggaacucgcuguguagggaacccaaccauuaagcuuuggagacagaguuucucuguguaucccuggcuguucuggaacuugcucuguacaccacgcugaccuccaacucagagaucugccugccucuaccucuugaaugcugggauuaaaggugugcacaaccacuac

SEQ ID NO: 1342 - RNA, 6693 nt, Mus musculus
caagucaaauguggucaguuccauugggaagugggguuuucaucagcagggacucugcggcaacucaccugcuuucugcuccaagaguccagcacccugagauccugaugccaggguaagcugggggacugcucauagccaaagaugcagguaagcacagagggcucagagguggaugucccuggacagugggaugacccagguaugugugguauagguucuaucaguuagaguaucacuaccucuuagaauuacaguugucucuaaagacagcuugggaguucuagccaccugaacuggucuuccauggguggaaccacuccuaugggcagcccagcugaagagcuagggggguuggaccccuacuugcagaaguagguugcuauauacagggaguagggcacagcagcuaggaggcccugggagcccuacugcacuaaggaaacacacucaaugcuagucucagaggcuaaggccacacacacacauaagaggaucacccagucagggcuaugcccagauauuaauaguacugacucuggccugcacaauccccaggccaguugcugugaguguacuucaguguuagcugcuugcacauugaccuggacuugcugggaaccacuaguaccucuccccaaauuuucuggaagaaacacaguucugccucccaaugcauacacagcacgacaaggaaaucugaggccccaccaggccaggcgaucugaaugucagugcugagcugggugccccuccccuggccccaaggugccuccuacaaggauaaacaaaucugaaauucuacccuagcacauccaagaauaacuguuccaccccaccucacacaggcuccaguaagcccgauggccaccuuggccucaucagucagcaggggacacagcaaccucccugcccacagcauggaaagggaagauccggucccagccucagcugaaaucccuuuauugacuuaagaucuaaucagagagguuuugcuggcuuugggguucucgucaaggggugggcuggccucauugcaaccucauccuaccuggcuggccuacagcacuaagucuggcagggcucagagaaggaagcuuccaaguggacuucaugcaucugaaaaggagccacucugggagccgccucggaggcagcucuucucacuaccuagguaacuuguggguaugucuacauccccagacaccaggagcaggaagagccaaucucuguuugcaugugcauguauguguuuauaguuugucugucccucugacucuacccuuagauaugguuggcuggauaugcccuaggauugcucugggaggcuaauauuguucugggcaggggugcagaguuaaggaguccuagggaaucaguucucuaaguuuggcuggcuaagcacaacagaggauccugacauguuccuuggguaccccagcaggucaggaucaguggguagcaaaaaggccacaggucugugggaagcuaacaucgugcuggucuuagaaagggaaggcuuuacuuaauuccagauuuguuacugcuuacagaauagaccugucccaccuauugauucacuagacuuggcuccaaaauaccacacccugaccccagaacuucaucuuuaccuaagauacaccaggcuaccuggcuacuacacuccuuaacuuccaucuuugagguuuucuucuuucagggcuccauuuuaggccucagggcugucugagguagguggugcuggaagcugcugcucaguuuucauuuuccccuggcuaucccuuagguaacagcgcugucaucuauggcucaaagccacucaccagggaguugcugcagaccuguauguauccuuauacagagaaacagagagaggcuacugaggaccuaagccggugccucauggauaaggaaacuccauggaaguuagagcugcccuguaauuugcaucccccauaucuuagaaaccagaaugaaaggccuacagcagagacugaagagaggaaggcucaucacuuggaccaccaaagaaaggucucaagaucccucugcuaugguuaaaucuagucaagcaacccaucccggugcuacuguggaauuccugcaagaggcagaaggcgguucagagucaucaaagccauuuuuacaagguagacauaggacugggggauuaaaggcuuucauggccucacuugccaaccugccucccccccccccccccaaggcucugggugaguaccuauuaacuucucuccacucucuaaucccaaauccaucuccacuuugcauaucgacaugaaagccaauggcggugcuggcuaaggucagacaacuccaaggaaaaggccucaggggcaggcagauagggagccaggugcugggaaaggcaauaggagaaaccucaagcugggcuuuagucuaccagcgacucccuccccuacugcugccagugccugaggcaccagggcaguuuguaucuucucaagguguauccccaggaaccuucggaggaggaauuuggccacggccucacaaagucugacuccuggucagaaugccuggagugugugaacuagcugggauucaccucauccacugccagcaccucacuuucuaaaggcguccgggguuacagcuucucaggcggugcacuguggcaugcaaagccggaagacauuuggccuucaacugacucauacagaccggaagaggugucacgagcaguuuccaagcauggucacugcccccuggcggccacgaccuagaguugcuacaagugaugaucaggccgagugaagacaaggacccuuaagucuccuacuuccuacaaggacccuuaucuccccuuccauucuccugaaagccucgaaagucucaaaggcccccaaacucucggacagguggcaaucaccaccccaucuuacauucacaagcaccacuggccgccaggugcaacuuugcgcucaauuucgacgaacucagaaggucgaacacgccuaccgcccagcugggggcccagagccaagugcgcacccacuaggaacagagacccacgcuaaagaugucaaacagguuuccauucucagugccuccaaaagcuggagcuugggccaguuccgccuuccguccgcuggggcccuccaggucgucugccaccucccucucccuggcaggggguggcugacacauagcccaggaggccccagggcgcuggagagccgccgaaaccuguccaggauccacaaggcuguagagaucaagcugcccaucuauggagaugccgggagccgucccggcucuaggaagagaugcaagccgugcuccgaccccucccaagagacaagcgcggccccugccuuauucaggcccgcgccuaccgguccucgcacgccguuucauucugcucggccuggcggccaggcacgucuggggccacagcagacugcaggggcgaaggggcggcgcucauugaggccggcggcgcagccauggcgucccgaaccuggcggaggccggggaggcgcaccgggaggcaggcacgcugcggacuacaauccccacaaggccgugcggcaagccccgagaaugaccuuugccucaacacaaacucagccacacaaaaucccuggaaaaaaaaaaucaauaaacauuuauuugauacagugacuuuaauacauaguugauggcccaccaccgcaccacuccgggccaggggaugaggaugaggacagaugaccacaaggcgggcaggaccaaagcucaccucaaaacaucuugcaaauaaaacacuuuguagauagaauauauaugcauguauaucuaugguuacaagugauagccagaaaugcacuuguguaaugagaacugcauuauaaccaaaccaaggaacccaaaguuuaggaggcgcugcagucagguauguggggugaccugggaaaccaggucuccagggcaagggaccuggguuucacccaacaggggaacagcucucccuucagaaccaccauagggacaggaagaucccaaagccuccaggaggcaccaucaucugccugugcaggaacauaaagugcacccugguucugcaugaaaugucugcccuuggcacuucuguuuuuuuagggcagggcaagcgcugagccagagguagaucuguagagacccugacuuuugcauuuugccaaggacccaggguugguuuggcccucuaagucuaugcccacccaccuucuguagcucugccaugauggucccucuuacugaggaucuguguaggcuggugguuaccuuugggccauaguagggaggugggcagaccgaugagcccugccaccauggaagagcuuuacagucuaguuugccacuacuuaccagucaccacaggcugguaccuauccaacugcagcuuuugacagcugccccaaaacugaccucaaagacugaguuaaagugcuaacaucaaguuacccagaacagucccauagcaaggcuguauaugggcuuucugguucguccuggaaaacucagcccccagcaaacccagguccuacuucucccuacaagugccaaguaccugagaggcuaggguggauggucacaccccacagagguguugugaaaagugcacuuuggcccccuucccuuccacaguugcacacaaccacuccaaagccccagccuacccuuugacacuggaucauacccaccucuguagccaccucugaccacaucaaaguguguaggaauuggagaguccauucaacaccuacaacacaccaggccaugguuaccuugcccagagucagagccuuucuaaauacauguguacaaggaccucaccccaaaucucccuggagcuggccuucuuggaaacgcucccugcugaggcugggggcaggugcuagucaguaccacagcaauaccuucggcaccaggaaacccuuagcaccaugacauuaagauuguugaguuuuguauaaaaaaaacccagaauuaaaaaaaaaaaaaagaaaaaaaaaagguugcuacuugucacagcaacaagacuggcaucaacaacauccaggagacacacagaggcaaauaucaaaauucacaucauccaggaucagaagcagagaccucaguccaccccuaccaacacuauaaaaagcucguuccaacccccuccagccuucuccugguguggcucacagcaggguugggagauggggauaggguuagaagguagaaccaggaaggaggccagaugucucuuccuggccuuguccaaccugcagacccuguuagccucagggccccuuaaagaaaggggugaggcccagccuagaguugcuacacuggcugagaccccaucuuucacuauccuuccauuucuauaucaaaugacugacugccacuagaucccaagggcagauaaaauaaaagggaaaaagaggccuuccacagaacuuggcuuauaggcccaccuagcauagcagacauuugcagucucuccuaaguacuacuccugagcuaggcuccuucuggccagccucugcuucacauggcuguggccccagggaggcaccccaaagggcgauaaccacaaaauuagaagcuaaaggcuggaugugaaacauccuagucugggccucccugaagguagaacacacagagcucuuuccuugccuggaagguuacauacuccaccaugaucacgccagucaaguuaggagaggccugaagcacacagggaugacagaggaggaagcaggcccagagagguagagaacagaagcaagggggucagagguggaugcaaaaggacagaugaguggguggcugucagggcagcauggcaguagacagggucuguccugggagguagcugggaguacuggaguuccaguguuggguggaggcgaggcccaaguuauggcagccagacugcucaggugccucaucaguccacaacuaugggucaccaggaaugucugagccuugaaagagucagauuggggauccuacugggccagaggaagguggaaacugggaccauuugacuguuuaagcacacuucaugccccaugaugccaaggcuccugccaugaauguccuuguaggaacggcuggguccuccagccuauugcacuuuugcugcugcccuggcacucccggggagccccaucuagccuuguugaggcagccuaaacaggggaaggaccacuuucagggagagcagaguaguuugccaacccucuggacagauggggguguguguuggagguggaggaccagucuagaacuggcuccccuaaucuggacaaugcagggcaugauggguaggcccugcccacuaggcucacuuuucaggugccuucccagcuccagccuucuucccaguggagcuccgggacccccugucucugccuccugggggccagucaucccuguuaggggggagcuuagaugcuggcuccucggaggaucguuccuuggguuugcggccccgcuucuuuccuccugacagacuuuucuucuucucuuuccuaggcaucaaggaguccuggcucuuguguuuggaagacgggucagcugagguccggaaccaauucuagggcaagaaaacuugcaauaaagacugagaaauuuggucuaaagcuacagaucuaacucauuuucuuuauuaaaaccaaccaacuaaacaaaaac

SEQ ID NO: 1343 - RNA, 63801 nt, Mus musculus
ccaacauaacucuauaaaaaccuuuaaugaguaaaagacaguguaggguuugugcccauuguccauguguugcuccuauugucaccccuccuaucagaagguauuuuugaugcgggcggccaccaggacuaggauuuccccaaucuuccucugccaguuggugauauccuuggacacagcacaccacagcucuccaugucggggcucugcauucucacagcguuuccucaccuccuccuguugcuccuggggagacgaaagggugcuuuagguggguuccuugugagguuuacgucuugugagguacaggucuugccugucuccuuguagaucuggccccagcagauuuuaagccaucuccuucucuuguggaacaugcccucauagucagugcaucucuguguugaaucgugucagacucccuauuuuuugauucccgcaaguugccagaugcacucucugaacuagguacuuccuggauucaauguggucuagccacuacuucuaacgaggaccccaggacacccuggucccccugccuuauaagcaugguuccaacaaagcucaacaggggaggagcuccuagucuuggccacuuccugccucuccuuccccagggauuagauggagcuuucuacugucucaggaauagcuagggaagcaggcagauuaccacugcacaccagugugcuaguguagccucaccucaguuccaugcugcaguucaaauuuguagaagaaggcccaggcaucccccagaucugagucaaucuucacagugcgauggaaccacucccgagccuuggugaucuuucuuucacuccagaacaaccuguugugggagagcaagggacauagaauagugucuaccaugcuugggagucauucuacguaggugaucagcuguacccugcuccugguaagaccaacaauccuagaaauauguuauagaaaaggucugagucaugguucagggcucccuggaggucauuccagauccuucacugauccacaguguuuuuuagaauauuuauacacagugagaucuuaauuucuccuuuuuauuuuuuuuuuauuuuuuucaagauaggguuucucuauguaaccaucuuggcuguccugggauucauacuguagaccaggcuggucuggaagucacagagaucugccugucucugcuuccugagugcugggguuaaaggcaugcacuaucaccuccaccaggcuagaucuuaacuucuuaaaacuaucugggccaaaugaaauuugaaacuaaccuugacaaacauuaauuaaggcagauuuaaaaaacaaaaccugaaaacucagacugcuccuuaauaagauaccaacccuacacuauuaaccucccuugaagcagauuuaaaacacaaaaaaaacaagaccugaaaacucagacugcuccuuaauaagauaccaacccuacacuauuaaccucccuugucuaccccucguagcaaccuaagcaaacacaaagaucagcuuccacaugucaguucuggggaccugggacacccagaccauagcacaugauuguuguaccugacacagacacuugaauagaaauccgaagggaagucuggcaggaagccaagaacuggacuguuagagacuaacuuagaagugaggcauggugcaggucuuuaaucccagcacccaggaagcaaaggcagguggaucucugaguucaaggccugucggucuacauagagaaacccugucccagaaaaauaaaacaacaacauaaaagaaaccaacuuagggucgcauggcaccccccacccccacauaguuacuguaguauagcaggguguacaacagggaggguggcauggaaugcuguggggaucacucuggcagggccaggacuugggacuguauucaccuggucuuggugaggcagcuggugcacagcuaaccuuuccacugcaggcagcugugugggcugcuuucaggaccaaguggaguaauuucaugcugauaacuugauuguuuuuuaagccauauaguacucuuaauugcccaguguuagauaaacuguaauuuaaagaacauaaacucaagauaggaggcacauggaacacuggcuugggaacagcaaggagugacuuauuuacuuuaauaaagcucuuuguaagguuuauggcugcucuggcugagggcauacagaaguuacucugggaaagggaagccuaagcuagcaaggcugggaccuaaaaccuuggccaucugcuagggcuacagacacuacagaggugccagguagcaaugugaagguaguugcaccagaaucugaacacucaaugccacuuaaaaccaaauuggucuaaggcucugucuccaccaguggcacaguccugugcuggaaggugauaaaucacuugaugacauugcaguucauaugaaccauggauaaucauuucuguacuccaggacaauggauuacagcagguuauucccagggucacugagcugaaagggucugaguucugcuaacacaaugaaagugcaagccucuuggcucucugggcagugauggugauaacuuuagucccaccaguucagaggcagaggcaggcagaucucugaguuugagacuagccugaucuacagagugaguuccaggacauucaggauacacagagaaacccuguaucaacaaacaaacaaacaaaaaacaaacaaacaaacauccagccaaccaaacaaacaaaaaaccucucagauaaagccccuucagucaaaugggcuuggcuuaauacuuaaauucuguguggaccaauaucaacaaaucugucuugcauguaauccaggccccaugugguacugaaacaaaggcaacagucccaucagaagccugggacugaggaugagccaaagaacccaggagaccugagaagagggagugaccagacagaugucuagacugcaccucaaggccucuagcaacagagugcugcccagaacgcuggagcaggaguuuuggcagcagaggcccauguagcucauccugugcaaacaaagucagaauagccaggcaaagaggcuggcaaaacuauaccagaaccccaugcuaucccaaaagaacaauuacucacuuagccacagcuaaaagcacaugggggucauguucacacuucuucagggcauccacacucuuggucuuucucuggggccuugccucaaggaagacagcuucagaccacaggauaccugaaauucacaagcaaauaucuaccccucagccucacuucuggcuugagaaaugcacccucuucuuuaggauugcccaaaaaggguauacucagggcaaccacaagggucucaaacaucuaaccaguaaccugaauuauaccagccuugccagaacagaaucagguagcuuuaauucuuaccgagucagcaaacaggcaaugggcaaugauaaucugaaagcacuaucacauacugcuguuaaaaauaaagaaagcagccaggugggauggugcacacccuugaucccagcacuuugaaggcagaggcaggaagaucucuaugaguuugaggccagccuggucuauaaaguaaguuccaggacaacacucaggacuguuacacagagaaagccugucucgagagagaggggagaggggagaagggagaggggagaggggagaggggagagguguaccugcuaguucccacagaggcuagaugaggguguggguaagucuagcaaaaaacucaaaacaaaaaccaaaacaaaaaacuaccacuacuagcacaagaaaacuuagcaaagcagaugguauaugacacuacuguccgacuacauuucuuauauaccauauauaagaaaaauaauaaaaguuaaaacuugucuuaagggauuggagagaugacucugaaguuaagcacacugacugcucuuccagagaucccaaguucaauucccagcaaccacaugguggcucacaaccaucuguaaugggaucuaaugucauuuucuggcacacagguguacaugcagauagaguauacucguauacaucuuuuuuuuaauaauuuuuuaaagauuuauuuauuauuauauguaaguauacuguagcagucuucagacacaccagaagagggcaucagaucccauuacagaugguugugagccaccauaugguugcugggauuugaacucagggccuucggaaauauagucagugcucuuaaccgcugagccaucucuccagcccccauuuacauaaaucuuuaaaaaaaaaaaacuuagaaaaaugauagugccucagaacaugaaaucaaacugucccauacuaaaacugaggauuuagucugaagucuuuguaaccacaucaacgaagcuagacuaaaaugggacacacaggaugugucuuccaggagucccugaaagucaacugaucccaucccacaaaagauuuccucugugccauacgacacacauggccaggaguccuuaccagaguuagggcacuccugcagcgccuuggccaugaggguauuggcaauguucuucagcccugcccgguacuccagccgcacugacuccaaccuaggaaaacaggcccagggaugggacauccccaucuaucauagcacaaccaacuacuucaacuggccuucugccagagagacccuuuuaaaaggcuuuugcauuuuuacuuuauuauuauugucaugcuaccacacauagguggaagucagaggaccacuuuuggaaacacuggguuccacuaaacuaaaugcagauugucaaauuugcucaguaagugauucuuccccacugccuguaaaggaaggcucuugucuccuagaaggggguuagaauuucauucucuacauggaugguaguacugguguccagucuauaagaaggcagcauucccaucuaagaucccagacuccacaggauccagauacaagugaagacaagggaacaaacacagaccauacaugaucacuacauggcaggcaccuaagaaugacaacccccgucccccagcaguguccucucucaucucugucuaaccccuagcuggacucugcauccauuacccacaccucgucauguggcccaaccuggcauaacucacuagccuucuccauugaucuuccagguacuagggaauauuaguaccaccauacucagcucccucuagcaaguuucuucauguuacucaaggccuucuuguuaccucuuuuauaguccacuuucucaguuccguucccugacaucucagaacacgucaucaaaagugcacuuaccaucuagacccagcucucccaagcaggacuaugacccucauaaaagcugucaccuauuauugaguccacaggagacuggguaaaaugaagaaggaacugaggagccucaaagggggaagugaggugauuaccgagaacucaccauagcccaggguucuuuggguuuuucagacgagauuucucuaaaauggcccgagcacgugucagcugcccaaucuuuuccucuagucgggaaagcaagagccaaagcgguguggaaugaggacauuucuucagcugugaccaaaaaauuguacaaaauaauaguucagagagcaucuacaaaagacugagaacuguggucagcucauaggagcacuuuagggcuguuaagacacgugcuucauacucgacauggcucuacagugugcacaugcaaacagguaugcaucggguuacugugugcaauuguguuguauacagguacaguaaaggaugccuguaggacucugaauaugugucaugcacauguguacacagggugugcacuuuguacacaaugugcucauuguacgacuuuugauguacugaacaaacccuauauaucccaaacacagggugugcaacuuuguaggaaaaaaacacaguacccacagugacaggaagaacaaaggcucaauuccaagcacaaaguucuauccccgaccacuggcccuccacuucuuucccagcgugggaaugacugcugccaugucaugcugccggguucccugggauaccuugacagaggcuuacccccugguuguaggccucccgggccuucuccaucaguucucccugcuccucaaucugccccuucaucauccacagcuuggggaaaucuucauagugccucagagccuccucacacagcuccugcgccgcagagauguuccccagaacccacuccagcuucacagacuucaugaauaccugcaaagcagaacagcacugucacaugagggacacuucccaucauaugcuugaagucacagacaucuucacacaucuguccugggccucauccguuuuuguauuagcucuucugcaaauacaaaagguauagauaaauaaagggaugcauguuaaagccaauaccaagacagggcuggggucuaagcugugccacucaucugucuccuuccaaacgccaugcgggagccaagaggcacccugccaacucucccuaacccaccagucaccacucacacgggcagugggugcgcugcuccgagccuuggccaguagccuccgggcucgcucguauucauuguucucugacuccagcuucacagccgccaaccagaucucuucgcuguugggguuggccuggagaacaaacacagcugcaucagaaaggcucaucacagaagugaccaaggcuagauuaugcuuaaucaaaaacaggcagccucaaaacugagcuggcccucucccugaugcaugacuaguauuaguacacuccugcacaagcuacaaacuaggggaugacuggguagaccucagccaggacccaagcuuaccugaaggaaaaacaaaacaaaacaaaaacacaaaaaaccuaaaacuucacauuuguuuuuacucuuguacagaugaagcaacaaugcuagagcuguagagccgcccucucuagaauccgucuaaauucuacacagccucuaaaacgcaugccuuguguuaggagcugcucugucuaacuuaaucccuuccccuuggcuagccacaccauauggucaggguagaaagauguucaaggugcagauaaugacguguaaagggcucccaaaggcaugggccaagccacacaaacacacaguccaggagacguaaaaguggugcacucagaacuuguauccaccuuccucugggacuucugcuacauggccaugcugccuacuguuaugggaaaggagaaccaaccaucuuagagcuuuggcaugcaacuagacgagaaaacuguaugugggaaaaacaucaaucacucugcacagcacuaucucucugcacagcacuaccacuugcuccucuguccuuuccaagugacagcuggagcaaaagauugacccaaguuagcucuuuuucugauguuucuguugucucacaagaacaaacuuuacugugaccuuaggcuaugauacuagacugauauuuauauagcauccuauaacuuauuaaaauaaucuaacaccuauguuaugauaaaauauuaggauuuuuuuugauagaaauauuuuucgaauguuauauguugacuggggagauaucucaguggguaaagugcuuacugggcaaugucaguggguaaacgucaggcauggcaaugcauauguguaaccccgugcuggagaguggagacagacggguucuaaagacagcugaugugagauaaaccaaacuggcucuaagcucuaagcuccgggcucagugaaggauccugcccuuaaaauaaaugaacaacaagaggaaggcaauagaggaagauacucuaggcugaccucuaguacguacacacacacaacccacacacacacccccacacacauauacacaguuaccaugccugccacauacacacgauacauguuguaacagcaaaccuagucaguccagguaaguacgacuguuuuaauuuggucccacucucaaagagguacuaaaauacccuggcagcuugugcuuugcccuuguacucuagaauacuuagccuacagucauacuaaguaugacuaagaggucaauguuccugauugggguguucuucaugcuuugaccccauaaaucaggccaugcacauaauuuagugucucuagacuagaccauggcauauccuaaaaaauuuguauagaauaaauucugaggcuacaguagcaccaaaucugaguuuguguucauagccccuuccagggcagguauccuucaccuaccugaaaggccagggccaggaugcuccuugcugcagguacauccccugccagccacuuugacuuggcacccaugagccauagcaccucugccuuggggcagugggcuacagcccucugcaagagugcuuccagagacucccugaaagauagaggacauggucacuagagcuagggccauaaaucagggcauauagcuacuaagaugcugaaaagacaguuaccacuccaaaguucgguacuauuaaugauuuacaagauuuuacgauggggagaguguggggaaaucuuuccuuccaacaaagaaucuaaaaucaacuacugaagagugcucuauaaagcaaagcauuguuuaaacagcagagccuuuuauagccauguauccugggcacugauaacauggcagucuggugacagugaaggccuuuuuaucuugaagcucagaggauacccuggauacacuaauaaagauuaaggucccuaacccugucucccucccccaaaaaaggucucauugagagugauuuaaggacauuacugaacuagaauauuugucagccuuggauacuggguaugaagucucugggucaucucuggccaccacuaccugugggucauagcaccuucacugaugaaccccacgugcccucauguucacgagcaaaccgaaggauaugcaaauccguaucauacagaaacaccaccauguuccccagagcccugggcccaaguguuuuguuuuguuuuuuuaaagauuuauuuauuuauuauauguaaguacacuguagcuguccuuagauacuccauaagagggcaucagauuuuguuauggaugguugugagccaccaugugguugcugggauuugaacucgggaccuuuggaagagcagucggcgcucuuaaccacugagccaucucgccagccccugggcccaagucuugaugacuuuccacaucagucugagagcuagccgcaaagaaagaauagguugugggagggagcuaaccauugaaacaugugaguaggcagcagcauacacuaaggccacaagucaugacuaccaagugacauucuacagaguaaauccuaaggguccuuucauaaagaacuucaaguccccuaaggaguuaacucagaaauaccaaggcagcuggcagaguaagaaaaaggcccuguggaaauuaacaucaaauaacaucagaaaaaaaacaagguucaaagucacagcugcaaccuuggugaaaccagcaaggucuguguccacccaaauagggaaaagcugaggacccauaagaggaugauauaggguacccagggacaugagcccaaaacccuagagaguuacacauuuaaaacaagaaauuacaaugccuaauuuaaucagcauuuacagccaauaaggcagacccaaagauuuuuccaauuaaaggguacaauuaaaggaaauugucaaggaccuccuucuguguacaaaaaccagccaaaccccagaaagcuagagcaacguaaaugaaaaacagacugcaugccccugacaccguaccgcccucugcuaaaggcagugccccagcauuaacagccugcauuggaaacucuuagacccaaggggcacuaguaaagaacaggcuuccaagaugccuugguuucucaacuauaaaauagugauaauccaaucacugaagggcuauaaagaaugaggcaguuucaaagucccaagggccacaaaauuguaaccugaucacaaccacagagaaacagacccaaaauggugucaugcaggaaagugagguuugaauccagcaccaugcaaauaggaaguggaaacugaccacauaccugguaccaugauucuucucaaaguaggcagcucguaaccacacacuuuucuugcuggggaagacuuguagggcauaggcauauauggcucgugcacacuccagggcauugugggccacacacuagagcagagagacaccacgaggaagguuacucagggcugccaucgagcagauagaaauacuuuuucaagccucaugcaauucucaguaaugcugucugguagcaaauaugcuguggcacugauguaauuaagcuauaaucuaagacagacaccuggggauggggacacaaaauguugagaaagcccagaaggcaaccuucugggccuggcaugcaaggacagcuaguaagaggaguaccaguucuuaccugcaggauaacacaugcgcacaaaugcacaugugcagggcuauggcuaaggcuguguguguaugcacauacacuagacuacacuacacacacacaaacacauguguguuguguuuguguuuauguguguaucacaugcugauucuuaacuaggaguacuauuuauuuuccacuaaaaagguuaagcuauucaaaaccuguauaagacaaaucaacacaaagagguuaggagcccaccaaccuaguagaaaucacagcagacaccauuaggcucugcuuccuuuagucuccccacccccauucuauccuccaacaccaggauuuaaacccaaugcuagggcccuguaaugacaagcacucuaccaccaagcuacauucuucacccuuuguuauuuugaaacaguuucucucaguuaucagacuggccuugaaacugcaaucucagcuuuccuaaggagcuguuuaacagggcugcaccauuaggccucgauccucuaaauuucuuuuucuauguucaagugauuuuaggggcuggagagaugauucagugguuaagaguacuugcuauucuuacagaggcuacaaguuugguugccaacacucaaaucagggaguucaccaguaacuccagcuccaggggauauggugcccucuucuggccucugcagguaucugcaaacaugcagcacauguucacauacauguauuuuagugguuuaaauaaaaguggccuccauaggccuauacggaguggcacuauuaggaaauguggcauuguuggaguagguguggcuuugcuacaggugguaugccacuuagggggugagcuuugagguuucagaagcccaagccuggccaaggugucacuguuauuuuuggcugccuacagauccauauguacaacucucagcucuuccugucugcuuacucagagccaugcuucccaccaugacaauaacggauuaaaccucagaaacuauaaaccagccaggcagugguggugcaugccuuuaaucccagcacuugggaggcagaggcaggcagauuucugaguuugaggccagccuggucuacagagcgcguuccaggacagccagggcuacacagagaaacccugucuccaaauaaauaaauaaauaaauaaauaaauaaaccgaacugaaauggagucugaagcaagaagaucauaaguuugagaccagccuagguuacacaguaagaucuuuucucaaaaacccaaaagaaaaaccugggauguaaagccuguggcagagagcucguugcagccagucauggggucuugggcucagucucuaaaaacacguaagagacacacugguucacaccuggaacucuaacacuugggggggggguaaaggaaugaggaucagaaguccaaggucaucuucaguuacacaugaaguguaagacugcgccacaugagaaguuacuucaaaaaauaaaagugggagcugaagcugcauaguagugaagaacauucaucugggugacaaugauucaucgcuagccaugcugcuucuuuguggagaucucucugucucucucucucugucugucucugucucucucucucucuccgucugucugucucucucucucucucuuucucucucucucgauaggguuugucagcaguuaagagcacugacugucuucccagaggacucagcacaacguucucuucuggccucugugagcacuggagacacacgagguucacaugaagcuuaaccacucauuuacauuaaaugcacaaauaaacaaauaaauaaaugauuuaaagagccccaaaccaaaucaaaacagaaaaucagcacuuggcauaaccauagaaacaaccauuucaguaaaaauacauuuuucauuacuuuggcuuagaggcucuugccuguaaacuuugcacuugggagauuaaagaaggauuucugucagcuugaggucggccugugagacuacaaugagacuaucuaaaacaaagaaauaaagaaaaaaaaaaagaacaaauaacaaaaacaaccauuauuaacaguuccuuaaacuaguaaguuaaugcuugaaggauaccaacauaauuucaaaaugcuuccucaaaaacacucacaaaggaaacaacaguaagcuuacaaguaaguccuaacagcugcugccugggacagcuggucagagugaacacuucuguaucucuguaggacacaucagagucagaacucaguaaguauauauacuuuguaugaagggagaccugacacuauacugcuaaagacaaaccucaaucaagccacaagcaaauauaauaaacagccaggucaaaauguauuccggaauaccauuggccccuaauacucaaaaaucuagauuuggguaggagacguagcuuaaugguagagggcccgaccaauauacccacgucccugguuccacaauagcaucagauaucaaaccaacuaaauaaauaauaaaaaggagauucaugaaacaaagacagauugaagccuuuuuaaggucuuucucggguuaagguugaccugaggcuguguggcccuggcugucuugggugcugggauuaaaagggugagccaccaucaccuggauuaaauagauauaauaucuauaauauguauuauauauuauauacauuuuuaaaaggagaacuccuaggaaguugguaagauucaagaagauccacuaugaaugacaaugcuccagccucacuuccugauccugacacugugugugugcuaaggaacccacagcagugguguguagaguguagggaaaugaugcaagugugcaaaagugugaagggugauaaggcacauagguaaaguguguaaguaugaguauacaaacucuaauucuguaauauuccuggguauuugauuuuuuuuuuuuuuugagacaagguuucucuguguaccccaggcuguuguagaacaugguccauagaucaggcuggccucaaacucagagauccaccugccucugccucccaauugaaauuauuuuuauuuuuaaauaaaaagccaacuguggugguacugcauauggaaagauacuaccuacuuuuaaggcagaagcauaauaccauaaucuaaagcuagccugcaauacugaggaggaccuugucucaaaauuaaugaaaaaaugaauaaaugaauaaauaaauaaauaaaaagaugggcauggaacccauaccuuuaauccaaucacucaagaggaggaggcaagcagauuucccugaguuugaggccagccuuguuuaccuagagaguuaaaggccaggcuagucagagcuacgcugugagaccuuguuuaaaaaacaaacaaauaauuaauaaauaauaaaagguucaaacuguuuaauuacugcuuagccuguuacuucuuuguaauauacucaauaaauugguuuuuuuccaaaaugacuagaaaaggaaggagggaaggagggagggaacgccauaucuguuugaaacaacuuuuuauuuguuuuguuauguuuuguuugagauaaggucuacagaauccuggcugaccuggaacaugcuauguagccagacuggccucaaacucgcaagauccaccuuaucgggcugggcagugguggcacacgccuuuaaucccagcacuugggaggcagagacaggcggauuucugaguucgaggccagccuggucuacaaagugaguuccaggacugccaagauuauacagagaaacccugucucgaaaaaaaaaaaaaaaaauccaccuucucugccuccugagugcccuguuuuuguuuauuuguuuuguguuuuuuguuguuuugacuggcuauccuggaacucauuuuguacaccagguuggccucaaacucacucacagagaucugcuugccuccugugugcuggguuagaguugugggccaaccaccaugccuccuauuuuaauauccuaaacauguuuauaaauguaucccuauaguuucccucugggaaaugggaaacuacuuugagaacauaauuucaaagaggcagcaacucuaugcaaaauguuuccugaaaugcaaucuguagaggaagcagaagugggagaaacucuggugccauaagguucucagcugagcagguugugauugcagcagccacaacccugcaauagcugcuccuccacuuagugagcacucagacuuacacucaugauuauagaacucugcuaccuugcacuguaacuccaucuaaaguaagugcaucagaacuagauguaaucccagcaaugaggaugaugaagcaggaagcucuccagccuaaggacaaccugggcuacagagugaggcccuguuucaaaaacagacaaaaaauacaaauaaaaucaagcacaucagaaagacuuuuaagaagacagaagagaaggagggggaaaagauauggaaaauaaccuacaaauuaauggggccacuguuccugucaaggcuacaggcuggaaagcaagcaaggaagcuuacacugucagcgucuuccauccagguguguuugcgaucuuccuccucaaucccaauaccgauuacagcacgcaugacagccuggcacguggccacacucccugcccugucacacuccucagcauccugaaggagaaacagacauuuuguuuggauuuuuuuaguaaaaugaauguuauuccugaaugaugacgacauaccuacuaucuugggcauauacucuggcaaacccgaauagcauaucugccauaguguuucuucaucgaucccccuguccuaauuucucugcaguuaaguccucaauuaacaugcaugacugagugaaacuacauuuauacauacaguacauuuuaagcaagauccagugauauaccacuugccuuauucagggcucuggguucaauuccuaaacuucggaaaaaauuauuuuaaagauguuggagggggggagggggguggggacugguaagaagguaaagacauuugcuaugaaauccugguaaccugaauuuaaucccuaggcgagauccaacuccaaaaaguugucuucugauuucuacacuuacacuauagcacaugacccaaacacauuaaaaacaaggcugcauaguggcacauacuuugagcuaaagaaacuuugaaaggagugggaguaaaagacaaguuaaaaaauauuuauacccuuuggacuagaacucacaacuuaaauuuaaaaagaaaaagaaaaaaaagaggaauacuuaggccuauauaagaacuguuagugggcugggcagugguggcgcacaccuuugagcccagugcuuggaaggcuggggcaggcggauuuccgaguucaaggccagccuggucuacagagugaguuccaggacagccagggcuacacagaaaaauccugucucgaaaaacuaaaaaaacaaaaacaaaagaaagaacuguuaaugggaguuccgcaagggagauuagauaaaaaccuggguuaaagcagauggccaaucacaggaagaguccaccgggacaggucagcaugcagcaaggcacuucuaauuuuagggaagcagauuugggacacagagagaagacauaucugucuuaggguuuuacugcugugaaaagacacuguggccaaggcaaguuuuauaagggcaacauuuaauuggagcuguaaauccauucucaucaaggugggaacauggcagcauccaggcauggugaaagagaagcugagaacuccacaucuucaucugaaggcugcuaguggaagacugaauuccaggcagcuaggaugaaggucuuaaaguccacaaccacagcaccacaccuauuccaaaaaaggccacaccuucuaauagugccacucccugggccgagcauauacaagccauuacaauauguauauccaauuuuuuucuccauaaaaaaaaaaaaaguucuacaucauaagacagagggauguguuacuaaaaguuggguauaauaaaaggauggaccauguagacacuagcauauccggggauccaucccauaaucagcuuccaaaugcugacaccauugcauacacuagcaagauuaugcugaaaggacccugauauagcugucucuugucagaguaugccugggccuagcaaacauagaaguggaugcucacagucggcuauuggauggaucacauggcccccaaugaaggagcuagagaaaguaccaaagaagcuaaagggaucugcaacccuauagguggaacaacauuaugaacuaaccaguaccccggagcucuugacucuagcugcauaugcaucaaaagauggccuagucggccaucacuggaaagagaggcccauuggacacgcaaacuuuauaugccccaguacaggggaacgccagggccauaaaaggggaguggguggguaggggagaggggguggguggcuaugggggacuuuugguauagcauugcaaauguaaaugagcgaaauaccuaauaaaaaauggaaaaaaaaaaaaaaaaaaaaaggaauuaaacuagugauccaacagacaaauguuguaaaggaugaagacauacaguuuaccagaaaacaaaauacaacaaauuuaaguaucugaaaagaaacuauaagcuauucucuucuguaagaugcuaaacuguuuccagggacauuuucagaucaguaugguaucuuauccuuucauuagauagcacuguaccaagugugaggagauugagaucgcuagugucagagguuagaguuguacagggcaggagcuuugacaaucagacuccagauccuccauccuguucagaaucaaaaugugaaauuuuguguguauguauguaggccgggaccgaagagagguaucuaaccaagugguagacauaaaauaguuuuaaaaaguuaagaacuaguccaggaaugagccaaagcucauggccaacacauuuaauaauaaguaguaagucccagagucauugcccuugggaacuaaauggccaggaggaaaaagaguuuauaauuuuuuaaaccuauugaggaccugaguucaaauucucuccaaguacccacauaaaaagcuaagcaugucugggcaugugugugcaagccuuuaaucuuuaaucuuagcacuccaaaugcagaggcagacaguucucuaaaucagaggccagucuaguguacucagugcuaccagcauucaacacacuuuuccuuuuuuuuuuuucccugauggcuuuuuguguacucugguuugcuuuagcaaggguagaaacuuauaaaagccaugaggagccagccaguaagcaccccuugaaggccucugcaucauucccugccaccagguuucugccccguuugaguuucugcccugauuucuuuugaugaugaacagugauaugaaauguaagccaaauaaacccuuuccucccaaguugcuuuggucaugguguuuaaucacagcaauauuaacucuaacaacugcaaaagggugcuagucauccaugucucauucagcacaagacaacucaagggacuggcucuggcaagagcacacucacaaugagcccgugugggaacucuccagugcugcccuguaucuuacgcgagaccuuauguagaagagggaggaacgacuugguaauuagaagcacuggccacucuuuagaggaccuggguucaacucccaacacuuacauggcaguuuaucuaucuguagcucuucugagcacaaauaugcacgcaaucaaacaccuauauaaauaaaauuucugggcuggugagauggcucaguggguaaagcacccgacugcucuuccgaagguccgaaguucaaaucccagcaaccacaugguggcucacaaccaucuguaaugaugagaucugacucccucuucuggggugacuaaagacagcuacaauguacuuacauauaauaaaaauaaauaaauaaaucuuaaaaaaaaaaauuuccaagaauuguuauuuacuuacuuauucaaaaaagucuugccuggccuuaaacuugcaauccuccugucuucacuuccugcgugcugguacauguauccacuaccaagccugacuguuuagaacagaacccugagugaaagcuuaccuggauccacuguucgcgguugaucucuacaccauuggcccguagggaggugauggcucggucaaugaucuuuuccaccaucugaguguucccauuggccuccuccaguuuggcagcugugauccagaugugccgaucuguaggaauguucucacgugcuuuauuuaagaccuugcgagcauuuucauaaguuucuagucuugccaaagcaagccauagcuauacaaaaaagagccaucagggggggaaaaaaaaagaggagaaguguguugaaugcugguggcaccuagugucuuccagacuggacggcaagccagucucaaugguccacagcacuucugcaaagugcuuucugaaagcuuaagcagagccuauaucacucauaggagccguuuucacuacaucaacuguguagguauacuucugacacugguuaacacaaaagguugaugggacucuuuaaaugugcagggugccagacuugacaguaggggcuaggccaaaggugagcaagauggauucacagacaguuguaugaugaaacuuagccuucuggaauucucaugccucaaagcuacuaacugcaacauuccaccccuaaagugugcacucacucuuuauuuuagugugagugugaauguguguguaugugugccagaguauaguucauaacauaguuuucuguagcugucagggaugagcaaagaagacucgguucugucuaucucugucugucuaccacaugcacugugcaccacucacuuguacuuugcaccauggcaacugaagcuaccuguuaccuuauuuggcagcuauuguaggaugccauuucaggcuucauauuguccucuacugccaggaauuauaguuuaaauaagcagcauacauaugcagucuuaguuaggcacuggacuuaggccuucugcagugggguggugggccugagcccggcagacucaccucuacacuggugggacagcacucuacugcucggcucagcaugauucuagcaucuucaggcucuucaagcucaacagcugcuuuccacaaucgaacagaguuuggaacaugcucaagugcuggaaaaggucaaauaacaagagugucaggaaaguacugccagauggauaagaaaugacccccuccaugccccuaccccuaaccccugauaaucaagggcuacagacaugcccauuuuguggguucuuugauguugggacagacauaaagccagacaggagacauuuugauguaggauaguucugccauuguuugagagcuuuguuccucuaagccuuugugccacccaucagggcaggcaaucuuugcaauguuccuuccauucucagagccagagcagaccggcugcuccaaugcauacaaacuaagccuuagguguacaucacuaugcugacuauagcuggcaaguaggagcaucaugcacuugagauguacaagccagaaaaaugggagacauucuauacaaacccaaagggccuaccuuugggggaauuuuauagguucucaaggucuggggcacauuaggacuucccuucuaugaugaaacccaguaccucuuuucaguagguacuucuacugaaaguuaacaccuggccuggagcaaggagagauggcucacaaccaucuguacaguuacaguguacucauauacauaaaauaauuaaaaaaaaaaaagaaaguuaacagcuagucucagagccuuaacccuacaggugcacccucugccaauugcuaaguacucuagauuuugccacauggugagaccuaaaaggacagacaacucaaccgugaaucuacuagcuucuucuuacuccacagauccgacuccacagauccgacaccacuagaauuaauugugcuaauccucagcacagaagaaagcuacacucuccugccacaucugcucaccuacugaggaagaugauccuagcagggaacuaggacuggcuaagaccacaaacauaccugaccaugccucgggauggggcagauguggagcuucaucaggauggaaacagaaaagaugggguggagcaaaggcaaggacagcauagaucccaauaggauccacaggcagacacuucccacaacuagaagcuaaugacuugucugcuacccuaugagcggauauaugguucuagaaaagccuuaggaccgaaggacugagaagaaaaaagucuuguccuaggaguaaagucacugggauaguccauuaagacauacagugugguggucugaaugaaaaugcccccauagauucauagagaguagcauuacuggagguauggccuuguuggaguuagcguuucaccgggggugggcuuugagguuucagaagcucaagucaggccuagcagcucagagucucuucccauugccugcagauccagauguagaacucacagcuccuucucuaacaccaugugugccugaaugccaucaugcuuccauccaugaggauaauggacuacugaacuguaagccagccccaacuaaauguuuuccuuuauaagaguggcuguggucaggcagggcauggugguauaugccuucaaucccagcacucagaaggcagaggcaaaugccuggucuacaaaaagugaguccaggacugccagggcucuguuacacagagaagcuguguuucaggagggaguuaggggguugccauggucauggugucucuuucuagcaauagaccccuaacuaagacauucauacaggacgagccuucuaucuauuuuucacuuuagucagcaugguggccaggcagacuagcuggauaauuucccaaagcucuuaagagcaccagaagacaaaaaggccuuuaagucaagugcucaaccuaacacgaagugccaccacgugcauaugucaacuuacacagcagagcacacaggucucugaaugugcagugcugucugagacauucccauagucuucacguccuacuuuuacuucuccaaaccucaccaccaaaaggccuaguccagaagcagaaaaauucagccaagcugugagaccagcacugacuccugugguacaaucagguugccaaccacacucuggggaggccauuuuccaggucagaugaucuugagucuuaauuuagcccuucuauuugcaaguauaaaguuaagaguauguagaacccacaaggcaaaaacaaaaagauuauacauuuaagacuagccugggccacauguaagacauggcuacgugucuuuaaaagagagagaacacaaaagaaugaaggaagggagggaaggaggggaggggggaaggaaggaaggaaggaagggagggagggagggagggaggggaggaaggagaggaaggagaggaaggaaggagggagaaggagagggagagggagagagagagagagacagagagagagacuauagucaaaaaaagcaaaaaagcaccaacuuaugauccaggccuuaaaaggucuaggucgccgggugugguagcgcacaccuuuaaucccagcacuugggaggcagaggcaggugaauuucugaguucaaggccaaccuggucuacaaagugaguuccaggacagccauggcuacagagaaacccugucucggaaaaaaaaaaaaaaaaaaaaaaaaaacccaaaaaccaaaccaaaccaaacaaacaaaaaaaggucuaggucacuggaucacuaauccagguagagagauaacccuugaucccuacacaagagggaaaaggaaauccuaagucuaguaugguacacaguaugguauauuugccccuugugugcaugugguaacagugguguuucuaccacuucuuccucuuccuuugugcacuucacaauuccauuuccagagcacaggcuauccuggaggggccacagagucacaaaccuguccugaguaaggaaaacuuggaugacagugagugcugagcucaugcacuauagaaagguaaugcauagccccccaaucaguaugagaacaucccuacuaagaaaguccaagggcaaaggcaaccagcccaggaaaaaggacuagcucauuaccagcuccuuaacuaugcucacaaaaagucugagcagaggaggagugaaacugcucuccaagagaacaaaacaccagaaagcaaggccacuaccuccaagggacagucugaggagcaccucccagagacgcuuaccuuuccgaagaacacgcuucuuugcucgaaugucuguuucuagcucugcugcucugauguaaauccuaacagacugcgggagaugacggacagcuugugccaccacagccuuggcuguguccccaggcuguaaccuagcugcuucuagccagacaucuucacucugggggaaagagagcaauaagaacauggacagcaauaagaauaagaacauaugccugccugggaaguucucauuugugccuaaaguucaaacaauuccacagaggguuucuuuuauuaucagaaauuaccuaauccacacaggaaagcauaugacauucaguugguuuuauagcacuuuuugaucucaucuuuaucaucccacacaaaaccuguguuuuguuuuguuuucgauuuacuuauucuuauuuuauguauaccgguguuuugcuuggaugcauauccagaagaaggcaucagaucccccagaacuggauuuauaggcaguugugagcugccauauggugucuagcaaucauaaguccuccaaaagcgcagccagugcuccaaacugcugagccgucuguccugagucaacaucuagguuuucuauauuauguggccugagaagcucccagguuuaucacuuuuagugauguuaacccugccauuauaaagauaagucagucucugcuccauacaaaagcaucaagaacuuccuuucccuccguuuauaaccuuacacuggcucuauuuuuccaguguagguaccaugcccagcaaaaaauagaggguuuccugggagcauaaaucaugcagcuguccagagaaauaugcuauagcuucaccuuggggcacaucucugucccuuucauaauaagguuucgagcuacuuguaacuuuccagugacuucuuccaggcgagcugaugcaauccaagcuggugggugaugaggguuuguuucucgaacagauuugagaaguagucgugcuuucuugaugucacuguaaauauuagaaggcacaaaacaucaggccacacuauuagagguguggcaagacccagggagaaggcugcuccacgcauaaauuguuaaggaaaacaugcugaagucauaaaauccaaaacagcucuacucuuuuuuuuggggggugggggggacugagcaaacaaacugaggucugacuauccagacaggaaacaugaaaccauuaacaagcugcuuucuaguucaucauaggcauugaccuuauuauuuauaaaauauuuaauauacauaguaaaggaaaaucauuucucagaacauccaugucauauuuugacuguauauucuuuuuuuagaaacuccacaacaacacaguaagcagaguucccacuucacccaucaguccuguggcacacucacuuuauguccccgccauggguugggaucauggaauuuagaucugucagguagccuuugggguccacaacagucugcccacucacugagucagauaccugcgagacagguaaaggugcgaaucagcuagacaucaccaguaauguuuaaaacaaugaauuauuaacaaccccgaaggcccucccaucacaucucacuaagaguaaguagucaggaggaaaacaaccuuauuguaacucaaacaacaguuagugauuagaaaaaugucuucuacaugaaaaguguagaaaucgucuacaaggauuaauacuguaguauuaauuucagcaucacugaaagugauaaaccaggcagcuugucaggccacauagaacaccuagaggcugaagccagagagauucagcaguucagagcauguaaaaauggcucccaucggcucauaugcaaauacuugguucccaguaggugaaacaauuuggaaaggcuuagggggugugcccuguuggaggggauguaucacuggaggugggcuuugagguuucaaaagacuuggcuacucuaguagugugugucucucuucuaagaaaugaaaugagaagagaaaauaaaaguaaccaagacacuaagacacagagagauccuaaaaguccuagggggggggggggaggaacucaaguaaacauuaaaaaaaaaagucuuuucaagauugacucaaguaaaaaguugguaauuucaacuuuuuuaaaauuucaauacagcaguucauuguacuauucuuuuuuuuuuucuuucuuuuuuuuuuuuuuuuuuggagacaggauuucuuuguguaucccuggcuguccugggacucauucuguaggccaggcuggucuccaccugccucugccucccugagugcuggaauuaaucauucuacuacucuaauuguaaguuuuuacauuuccaugauaagccaugucugacaacagacauguaaucccagcuaccuggcaggcugcugcaggaauaaccaaaguuuaaggccuaucugacuacaugaugagcucaaggccagccuagacugggagcugcugaguauuaguuccaaaauuaaaaacuacaaagaagcugggcauggugaugcauggcuuuaauccuagcacucuggaggcagaagcagguggaccucuguuaauucgaggccagcuuggucuacaaagugaguuccaggagagccagggcuauuacacagagaaacccugucuaaaacaaaaauaaacaaacaaaaaaaacuauuaacagccagccuggguacacaccuuuaauaccaguacucaagaggcagaggcaggcagagcucuggucuacacaucaaguaguaucagccaacuagugagacucugacucaaaaaaacaaaacaaaacaaaaaguauaaaaaaggccugaagacuagagagguggcucacagcaagcauaaagacccaaauuaagggcuggagagauggcucagcaguuaagagcacugacugcucuuuuuuuuuuuuuuuuugguuuuucgagacaggguuucucuguauagcccuggcuauccuggaccucacuuuguagaccaggcuggccucgaacucagaaauccaccugccucugccuccugagugcugggauuaaaggcguaugccaccacgcccggccccugacugcucuucugaaagguccuaaguucaauucccagaaaccacaugguggcucacaaucaucuguaauggaaucugaugcacucuucuggugugucugaagacagcuacagugugcuucucuaaauaaugauaaauaaauaauaucuuuuuaaaaagacccaaauuaaaauccccagcagucauguguuacaaacaaacaaacaaaacaaacccuaugcaugaucauggguacauguaacgcagcacuuggaggaauccugggaguucaccagccggucagucucaccacaacagagagcucaggcgucaggugcgaggcaggacaccuaacagccucccucugcucauguuuuccuacucuaacuccauggguauaggcucuuuccugagcagcgccuccccccccccccauuuuuguuuggguuuuauugcugugaagagacaucacaaccuuauaagaguuuauaagaaacucuuauaaaggaaaacauuaauuggggcauaguuucauaucuucauggcaggaagcaugacagcaugcaggcaggcauggugcuggaggagcugagaguucuacaucuugauccaaaggcaguagcaggagacugcaucauacuagccagacuugagcuucacagaccucaaaaccugcccccacaauggcacacuuccuucagcaaggccacaccaccuaauaguggcacuccauauaugccauuccuguucaaaccagcacucacccacccacccacccacccacacacacacacaacaaagguuuaguaguucagaaguagaauauuugcccaacuagcguaugcacagcccuguguuugaucuccagaacugaaaaaacagaaacaaacaaaaaagcaaugacaagcaacaauaaaaguauaaauagcuauaauaauuugauuuuuaaaauucacaggguuagggauuaguuugacaggaaaauguuugcccaguauguauaagacauggauuuaauccucaguaccuuaaaaaaauugcaaggaggacaagguggacaugccuacaauauaucagcacuuacaagacaaaggcaagaagacuaugaguucaagaccaccugcacuucauaguaaguccaaagucagucuaggcuaacagugagacuuaucucaaaaaaaaaaaaaaaaaaaaaaaaaaaaaaaaaaaaaccucaaagagggaugcaagggcaggucaaauguagaucaaacaguagagugcuugccuaucaaaaccucccuggguuugaucucuagcaucauauaaagcaaguuguagccucaguacuagggagauggagacaggaagauccaaaguacagggucauacugaacuacacacugaauucaaauuuacccuggaugaaacccuguuucaaaagaagaacaacaacaacagggagacuggagagaaggcucagugguuaagagcacuuguugcucuugcagagaaccaggguuugguuuccagcaucacauaguugcucauaaacaccugcaacuccaguugcagggacccaaugcccucuugugaauuugaacaccacaaagcacaaacauguuacacaaacguguauucaaacaugcaagcaaaaccacucauaaacauaaaauggaauauaaaaaaauaaauaaaaaggacaaacacuaagcaaacaagggcaaacaucuugaauaucuauuucuuuaaauauuaacuacauaaaagaacggccaacauuacuaaucauuaggaauaugcaaauaaaauuacuacuucacacucauuacaauggcuauuuugggaaccaggaaagaugguuuaauugguaaguguuugccaccaaagcaugagggccugagcagugcccaugagagcugggcacagaaguaccugcuuguaacuacagugcuagguggauggcaacaggaaaaucuucugggaccugcaggccagucagucuaguggaaguggcuaucucuagcuucaguaagagacccugucucaaaaaagaagugagaugagggcugggaaauagcucagcauguaagagaacuugcugcccuugcagaggauauagauucaguucccaguacccacauaguggcucacaagugcaagcuguaauuaagaucuuauccccucuucuagccuucaugggcaacacauauauauggugcauagauauacauccaggcaagauguacauaaaaugcauaaaaugaaaauaaaucuuuuaaaaaaaaagucugcuuaguugcaguaggaaggcacuguguguuaucuccaacuaccuggagcaguccacaaauucugagaaagaacaaaaccaaagagaaagagauaaggcuugcuuagagcuaggaggugugggggucuuuccucacccacugcaaggggcaaaaauuaugccuuuaaaaauguuuuuaaaagacaagaucucacacuauaaccaggcuggauucaggcucaaggugauaguccugccucagcuuccuaaguacugaaauuacagguguaccaccacaccuuucaacacucuuaagaaaagacaggauaacagcacaaagcacagaaaaaggggaagggagaagaauuacuuuucuagugacugggcaugguagugcgugccuagaaucccagcacuuggaagaucacaguagaaggaucaggucauccuuggcuacagugugaagcccacuaggcuacaugagacugucuaccuuuccuccaaaaagccagguacaguagcuuauaacuauaauuccagcacuuggcagucagaggcaagaaaauuucuacaaguucaagacuagccuggucuacauaguuucaggccaauuacaugccaaauccugucucaaaauaaaacaacaaaaauaccaagaagaacauggcagaagcauucuguuuuauacagcccuggcuuugguauuauuugccaauuuaaaaaaaaaaagaaagaaagaaagaaagaacgaacaaauaaggcuaagguaagagaauaaaagacacccaaagcugaugucuggcuuccauacauaagcgcauacagacaugcauaaacccacauaaacauguacugcaucacacacacucacagagagacagacagaaagaauauugagcuagagagaaggcuuagcaguuaaaagugcuuucugcuccuccagaggaccugaguucaguuuccagagcccaugucaggagacucguaacagccuauuaauuccaagaccaagaggacuggaugcuucuggcauccacggguaucuguacacauacagcagacacacaacacacacaaaaaaaccauagacacaugaauaaaaauaaacauaaaauaaaaauuggggaaaaugaggagaaucuagaauccuuacgcaguuagagcugugaaauaaugcaacuacuacuacuauggaagccagugucacuguuccuaaaaaauuuaaacaaggcuaucauuaugccacaauuacacuucugagaauauacccuuaaaaacugaaaacaaggucugaaacaaguauucguaugaucauguucaagagcagcauuauucucagaaccaaaagucagaaacaaagcauguguccacugagagguugaugaauaauacaugaauauacguucauacacacaauuaaauauuauucagucuuauaaaggaacaaauuucuaauacaugcuaaacaugauccaggaagacaaagagccaaaagcacaguaaaugaaaauauaugggggcuguggagauggcucagugguuaagaacacugacagccaggcgugggggugcacgccuuuaaucccagcacucaggaggcagaggcagguggauuucugaguucgaggccagccuggucuacaaagugaguuccaggucagccagggcagagaaacccugucucaaaaaaccaaaaaaaaaaaaaaaaaaaaaaaaaaaaaaacaaacugacuguucuuuugcagaggaucuggguucaauuccuaacacgcgcaugaaagcuuacaacugucucuaacucugguuuuagaggguccaacacccucccacagacauacuugcaagcaaaauuccaacauaaaugaaauaaaaauaagaauauaaaacaugggggcuggugagauggcucaguggguaagagcacccgacuacucuuccgaagguccagaguucaaaucccagcaaccacaugguggcucacaaccauccguaaugagaucugaugcccucuucuggugucugaagacagcuacaguguacuuacauauaaucaauaaauaaauuaaaaaaaaaaagaauauaaaacauuuuuuaaaaguuccucuauugagggcuggagagauggcucagagguuaagagcacuugguuguucuuccagagguccugaguucaauucccaagaaccacauggugucucacaagaaucuguaaugggaucugaugaccucuucugaucugucugaagacagcuacaguguacucauauacaugaaauaaauaaaucuuuuuuuuuuuuuuuaaguaacucuguuaaagacaaaggaggaggagaaggaagagaaagaagaauagcagcagcaagacagacagucaggcagugguggcacaugccuuuaaugucagcacucagaggccaaccuggucuacaaagugaguuccaggacagccagagcuaccuagagaaacucuguauugaaaaauccaaaaauaaauagauaaauagaauaaaagaaaaguaccuauaaugaguccaucuaaguuauugaaagcagaauggagguuguugaggauuaggguagagguagacuguuaaguguuuaacauaaauaguuuuagggggucugaggaaauggcucagugguuaagagcacugacugcucuuccagaggucuuaaguuaaauucccagcaucauggacaugguagcucaaaaccaucugcaauggauuccgaugccuucuucuggugugucugaagacagcuacaguguacucauauaaauaaaauaaauaaaucuuaaaaaaacguuucaguuugagauggcaaagaguuuuggagguggaugguagugaugcuuguauaauagugcgaaaguacuuacaucgauaaacauaaaaaugacuaaaauguccaggcaucaugaacauuauuauaucuguauauauguauauuauauuggcauauuauaucuguagccccaucaaggcaagaggcucacuuaaacaacguaagaggacagccuaaccacaggcauacuaagacccugucuuacauaaacacaugcaaaaugguuaaaaugguaaauuauagugcugggguacaguucaguaaguauauugcuuaucuagcaggagugaagcucuggguucuacccuaacaauuauuuuuaucaaggguagagagggacauaaagaaaauaaaaccugucagacauagaggugcgcaccuuuagucccaguaauccccagucagaggcagauggaccugugauuuagagcccaaccugguuacacagugaauacccagucagggcuacacagugagaaaaaaaaauuuuuuuuaagagaaagaauuaaaaaaaaaaaaaaaaggauguaaaguuaucacgguacauauuuuuccuguuuuggguuuguuuguuuguuuuuguuuuuugugaagguuuuuuguauuugauuuuuuuuuccccaaacaagcccuggcuauccuggaacuuacucuguaaaacuaagcuggccucaaacucagagauaugccugccucugucuucagaggggagugugcuccuccaccaccuggcucuguuuauuuuuguuuuguuuugguuuguuuugguuugaguuuggagauaauaguucugagguagaacaccugccuaguauaaucaaggcccuggguuccauccuuggcaccacgagaagagaagagaagagaagagaagagaagagaagagaagagaagagaagagaagaugaaacagaauagcauuaauugcuucucacugcucuuacaacagcucuggaggaaaaacaauaaaccaaaggcaacaaaaugacacugauauuaaauacaaaucaaacuggaaaaucuacugucacaauaaagauguuucucagacccucagagacuaacaaggcuggagagauguuacacugcucuuccagaacccagacuuuugauucacaaaauccacaugcuggcucaucuuuaacucugauuccagggaauccaaugcccucuucuggcagcuguagacacugcacacacacaguauacaagacauacaauacagggaaaacacccauacacauaaaauaaaaauaaacaaaucuuuagaaaaaaauugacaaacuggaaguucacugaguucagagauggacaguguacuuuaaacaggcagagguaacaaacagaauccagcugugccaggugccagagcaucaucagcagguccaggauaggaguguagaacaaggaagguaauauucaaaguaaaaauuccacuucaaagacauuacaaaaaugcuaacuuaaaugugcugcauagaagucuaugaauucgaaacacaguaaguuaagagaaaaaaaaaaggaaaaaccacccagaauuucucugaaaaucaacuacugagaccaugcauggcaucagucaacugugauucuagcacacagaggcugaaacaggaguuugagaauaaacuugggaggaaaagauaggaacucugugaauucuaagucagccuaguuuauauagaaaguuacaggccagccugaggcuacacaguaaaaaugcugccuaagaaaagaaaagaaaagaaaagcagagcagagcagagcaagggccagggccagggccagggccagagaugcagcucagucauagcaugcucaccuagaauauaaaaaaaguccaucucuccaauagcacacacaaaaaaaccauuaaaucacacugcauauuuuacaagguaaaauaggcauacacaaguuaacauaaaaggugcaaucaauaagcuauugaguuuuuuauuauaaaauacuugcuguuauaaauuuucaaaaauacaguaacaaaggguuaggaauuuaguucagugguagaacacuugccuagcaaguauagagcccugaauucauucccagugcuuacagaguuaagcuuuaucaacagagcauauggacuuuguugggaacacacucauccccuauaauggccauauaccaccaagggacagacuagcaggacaaacggggcuggaccuuuauuuguuuugcuguguguguuggcaugcccuauagagaaucacacaaauacucaccuguagaaagaaucucaccuacucuaugacagggcagaguaucaauuucaugauaaaacacaaagauaaacuuuacacauuucuguuuuuaauuauugaguguuuuguugcacacgcuagguaagugacgaacaacugagcaacaucccccaaauauuuugcuuuuuccccauuucaguaauaagaaaagaugcauuacgaauucucaccuggcuaagccucauguccaucaggguauuccuugccuggccaaucuuccucauguccagcuccccuguaccaggugucaucaauccaggugucauuccaccuggguauggaguguucaggccucccggguaggguguguucagaccuccaaauugcuagggugaggauaagacagugguuugaacugucauacugaagauccccacccaccucgucucuauguccuaaugaggcauggcuacacugacucuugccacagcacaguuagcuacaaaaacaaucaacacucacccuucucaccacacccucauccagacuaaagaagccccauuugccucuguucaaauacucacagucugucggggauccacagaaguaugguucucuccagucuguaaauguuuggcaaagaaacuaucaggaacaggagucagcuucucauaacguggguuccguugacguuuguuucuggcaucgccaacuucugggaugcucagccacucuucuucugugacuucugccagcuuccucuggagauacauagaucccaaacaugaguucuuguuagaugucacacuugcucuccccaagccucuggccuauugugccuuagaaaagacagaaaugcuuuuuccauuuaaaaaaacuugauagccaggcagugguggcccacaccuuuaaucccagcacuugggacgagggggcaggcgaauuucugaguucaaggccagccuggucuacagagugaguaccaggacagccagggcugcacagagaaacccugucuugaaaaaccaaaaaaaaagaaaaaaaaaaaaaaaaaagaaaaacaacuuuauucuuuauugcauguaauguauauguaugugugcauacgcauacacgaggauacaugcaagagcuuuuaccuacugagccgcacugauagcccugguuuuccacuuacuuuagagaaaucaauucauuggguuggcacuauuuuaccaaaaaguaaauuaucagaucaaagucuaauagguaguuuggaaagacuaugccuaaaugaagagaaauuuaauaaagacuguuuuccuaccuuuaacaguaaaaaaugggauuucuuuuuuuuuuggcuuuauuuuuauuuuuuuaauuuuuauuuuuuugguuuuucgagacaagguuucucuguauagcccuggcuguccuggaacucacuuuguagaccaggcuggccucgaacucagaaauccaccugccucugccucccaagugcugggauuaaaggcgugcgccaccaacacccggcuggcuuuauuuuuuuaaggauuuauuuauuauuauacauaaguacauuguagcugucuucagacaccagaagagggcgucagaucucauuacgggugguugugagccaccaugugguugcugggauuugaacucagggccuuuggaagagcagucaaugcucuuacccacugagcuaucucgccagccuuuuuuuauuuuuuaauguauauaacagaugaucaaacugacacugaagcacaaacuucccuaagcaauuaauccucugagcuaaguaaagagcaucauuaguaaaggcuccauagcauugcaccagagcaguccugccuucugcugcuuaggugaaggccuggaagccaguaaugcuagcccaccugcucaccuuaaggucugaaaauugcugcuggauuuugggacguuccauucgguauuucucaaucucuucuuucucccuuugcucucuaggaaauaaaacauguaccugcauuagaaauaucacauguaggcuuagggcacuuguucccauagagaacccaggguuauuuucccaggaccuacgugguagcucacagccauccacugcuccaguucuaagggguccaaugaaugccuguuuuugacaucuaugggcacuaggaaggcacuuagaacauauacauacacguaggcaaaaaagucauauauauauaaaauaaauaaaucuuaaaaaugaaacccauuaaggaaagaaaauuaucuauugcaaaacaaaauugguuuguuguauaucuuaauuaaauaaccaaaaacaauuccacacauuuaauagcuaacuagaauguauuuuaggcaacuauagauauaguagcaaaucuaguuguucaauuauuuaccaaagaaaacaggcaaaaacuaaauaaacuggguaucuuacuuucagagauauucaaguaauaguauguuuacaucaaaauaaaccuauuguagucaggcaaaguaacauacaccuguaaucugaauacugggaggcagagguaggcaaaucucuguaaauucaaggccagucuggucuauguaucuauguagggaguucugggacagccaggacuauguagagagacccagucuuuaaaaaaaagaaaaagaaaaagaaaaaaaagaacacuaucaggaaaauauauuuuacuccccuaaacugcacaccuggccacacuuuaacccuguacacuguaguguuagauguaauggaccagccugacuccauuuuaaggauggaaaccguuuuguuauaaggucagaagaaguucauuuccauuugcugcaaaauucaaguugaccaugcguuagccuguuucuagaauuugacaugguccccacccuauggaguuugacucacaccuugaauauacccaaauaaaauguucugccuaauaauuuaaaaauguuuagccaaguccccacauaaccaaaauucucuaaaaaucuucuaacccucaaacccccccuagccuugcugggguuuuuuguuuuuauuuuuuaacuuuauaaacccuauauuccuauguacaaugcuauguugcuuaauaaauggagucaagguggcaagugaaagucuagauuguuuugguuugaguuugugguuuggaaguucaugccacaugucuccacuguaaaacggaaugagucaaacgaggcuuggugggugaagcagacuacaggggucguguagagagcaagcugaaguggucacugugguggucacuuggugcuauguugggcagguuuggaaccugggugcccuauuuaagaugcaaggcucucauauuuguucuggagggcuuuaagguagcaucuuacacugaacucuuaaugugucaaaucugugugucuagcuagcccucauuauacaagauacaaaaaaaaccuuguauuuuauuugacaagcuguaagccaagauugagcggguccugagcuauucuguuacauccaacccauaggcccugcauuaacuuugaugcuuaagucuuacuggguuauuucugcccugucaaccuguccucaggaucuacuucuccuugcaagaugcucaggauucauccagccuccugguggccuccuccucucuccaucuccugucuucucccuguggucucucuugagaccccucacaugauucuuaggucccgccuuuuucucucuacugcccaaccauaggcuccagccuuuuauuaacuagucacuuuaaauuggggagcaagguuuacacaacaaaggccaguguauguaagaagugucacucaucugggggcaaucagaucuuggaguugagaauuuagcauuugaauacauagcagcagaccaaccccaaucccugugcuuauguucucuuaguacguuaccuuaauauggcaaguucugaauucuguguccuaguuuugggaaaguuuauaggaaaugagcacaugauacugcgaggcauaguuauguugcuauguaaguuuuguuuggauuuauuuuugaagcgaguaucuagugcaggcuuccuggaauuugcugaaauauagccuaggccugccuugaacucaagagauuuuccugcuuccacuucccaaggcacgagauuaaagacaaguuucauguguucagaagaaaccauacucugaggugggcguuguuaugcacaccuuaaaucccagcauuugggaggcagaggcaggccguuccauaaguucuggucuguccuugcagucagcaagaggaaaaaccuguuaauccccucuaacuagaguaaagcccauuacccauauuuuuuggucaaauuaaccaagcuuuauuuucugucauacagugcuaucuuccuaaagcgggguuugaaaauauagcauugaacacaggaauauaggguuuauaaaguaaaaaaaacagcaaagcuagaggguuuugaggguuagaaguuuuuuagaggaauuuugguuauguggggacuuagcuaaacauuuuuaaauuauuaggcagaacaucuuauuuggguauauucaaggugugagucaaacuccauaggguggggaccaugucaaauucuagaaacaggcuaacgcauggucaacuugaauuuugcagcaaauggaaaugaacuucuucugaccuuauaacaaaacgguuuccauccuuaaaauggaucaggcugguccauuacaacuaacacuacaguguacaggguuaaaguguggccaggugugcaguuuaggggaguaaaauauauucccucucucucccuccucauggugacuucccuggccuccuuccuugggaccagugaacuugccugcaguuucccaauaaaccucuguguguguguguguguguguguguguguguguguguguguuuuaaucugguuugaacugguucauuucacuaguggagaaauaacuuaucaccaagcacacauaugauacacagauauacauacagucaaaacacucauauacauaaaaauaauacaaguuuuagaagauucuugaaagcucaaaauauuuuuuuaaaaaaagacagagaaaaaagaaaaaaggaaaaagaaaaaaaaaaaaaaaaaaaaaaaaaaaaggccaggcagugguggcacaugccaugccuuuaauuccagcacuuggaaggcagagacaaacaaaucuuaguuuaaggucagcauggucuacagagcgaauuauaggaaaccaguacugcacaaagaaacccugucuugaaaagcugaaaaaaaaaaaaggaaaaaaaaagcugaggcuauauagcugagguguauggggaggggggagcauacaguuaauucacuaguaaaguaucugcauagcacacacaagguacauguuucugaaagacaaaacaaaacaaccuaaaagcugggcauugaggcacacaccuuuauaccaagcaccugggaggcaguggcagguauaucuuugugaguucaagaucagcaugguuuacauaguaaguuccagagcagccagaauuacaggcugagacccugucuggggauggagacauaguucccagguuucagucucugcauacucccucaaaaaagguaacacacugcuggacauggugguguacacacuaaagaggcagaggaagacagaucccugucaguuccaggcuggccaagcuacacaaugagacccugucucaaagcaagaaagaaaaaaaaaagguguagagacaauguuauugugcccuguguaaagauuauccuuguauuauuuaaaugcugauuuauguggccccauaucuaguugcaauccuuauuccaagaaucuccuaucucaaaguuguguaaacauugcuccccaguuauacccuguuugguaaauacagaacugaucagucaaugacugagcaggggagagaauggggguagacuuccagccagggggaggagaggaggagaaaggaaauggggauccagccagggacccagaagauaccaugaggaaacagcuggagcagagaaaaccauaaaaugcaagcaccucagggauuguggcugggagguggucagaccaguuuacaggguuaaaaagauuaagacuguucagugcuugugccuuaaaguuuuaaauaaauaaaauaguccagucuaaauuauuugggaauagcugaguuaggcaaaaacugcaacaguuauaaaucugcacuaacaaaaaguauuccugaucacaaaguaaugccccaaacucugcugcucugcugcagcuucuagcucugaggcuguccuagcucugaggcugucuugcaaacacccagcacuuacgcaggugcggcuguuacaaacuaagguccaaguagccuccaaagucaacauacagacuacuauugcaacuuuccucccagccccaaauaaaacagaacagcaaaaaaguuauuuugauaaacacaguauggaacagcauaccuucucucuuuucuucucucauccauccuuuuauccagagcugcauaaauagcaucugcuuccucaucaucuuuuucauagggcccacuugagaagaggcucccagcauagccauuaaacuaagaaccaaacaacacauuuaaaggaucagccuucccaccaacauagaaagcaugcaaaacacucacauguaaaauaacuaaaucuuaaaaaaaaaaaaaaaaaaaaaagacagaagggcuauuccaguuagaggaaacuaagcauacuuguucacuucugcugcuauaauaaaauauccugcuuuaaaaaaaaaaacaaacaaacaaaaaaaaaacuuaggaaagaaaggguuuauuugauuuacaauuccaggaaaauuacagagggaaaggcucagagagcugaacauagcacauccauauucaaaggcagaaaauaaacacaaccuugcuuccaucaggaaacuagcuuucuucacccuuauauaauucagggcccaugaaauauugccaccuacauucuggguggguuuucuuacuucaaucaauaaucaagacaaacgccaauagacaggcccacaggacagccugauccugauaauuucuuuauugagacuuucuucccaggugauucuagauuaugccaaccugauaguuaaaaguaaaaucuguaccuuaguuaauaauacagugucaauauuuauucuaggauuccauaauuuauuaaaauuuguaagauaagacaaacuuccuuuuuugaaacagauuucaccauguagcucuggcuggccuagaauuugcuauguagaacuugcuggccuugaacucacaggguguaccugcuucugcguccugagugcugggcuuaaaggcacaggucacuaugcccaauaguuuaauuacuuuuaguauuuuauauauucugagacaaggucacacuuugcaucacugacuggccuggaauacccuguguagaccaagauagccucaaacucacagagauucaccucccucuuccuccugacuacugaaauuaaaagcacgcaccaucacaacugcccuauuuuuauuuagguauguugugcgcgggugccugcaaaugugcagaugaccagaaacacugauuccccuggaaauagaguuagaaauaacgugagcaguuugaucuuggugcugggaacugaacuaaaguccuuuggaagaacagcaguacucuuaaccacugaaccaucucucuggccuuuacuaauuuuuuaagauauuauuuucccaagauccugcaaguuaagucuccugaaagaugucaguugcguauaccaagcaacaaagaaguucaacagcaaaguuaaagcagcauuugcaccaucccugaagagcauccagcacaaacaccaacaaguggugcucugaacccacacgugcaucuccuuacaagagagacaaaagcagcacacagcucuuuaccgcucucucacacacauuguuaaagauggaaaacaaagcuggcaguggugagagaugaguaaucccagcacucgggaggcagaggcaggcagauuucugaguucaagaccagccuggucuacaaagugaguuccaggacagccagagcuacacagagaaacccugucucgaaaaaccaaaaaacaacaagaaacccaaaaagauggaaaaugaaucggagcugccuccuuguggcuggagagagcugccacagaagccugacaaaaguuacuucaucaagaacuuuaucuccuaauucagagcacaacugugacaguaaugcauucuguaaguauucuuuuuauuucuuauuuucuguuauuuaauuugcauucuuacacauaugucucacgauggucuugguuuuguuuauacauugucuaguuagauuucucaugagaccacaggaaaagaauaaaccuuguuaggguuaagcaagagaagagaaaacuacaaaaucaacaaaaugacaagaaucaauacacaccauucuauaagaacugaauauuaauggccucaacccugucaaucaaaugaagagauagccuauggagagggagaaaauauaaaaaacucaagaaacuaaacaucaagaaaaacaaacaacccuugggacugaagauaagucauugguuaagagcauuccagaggagaggcccuuggucuugcaaagagcauaugcuccaguacaggggaaugccagggucaggcagcaggauuggguggguuggggagcagggcaggggagggcauagggggcuuuggggauagcauuugaaauguaaaugaagaaaauaucuaaaaaagaaaaaaaaagagcauuccaaagguccugaguucaaauuccagucuagaaugagaucuggugcccucuuuuggcuuacaggcauacagacagacagaauguuguaugaauaacaaauaaauaaauaaagcacugaaugcucuuccagagggccagaguucaauacaacaaagcagcucacaacugucgguaacuccaagaucugacaccugcacccaaacacacacgcaggcaaaacaccaaugcauguaaaauaaaacaaaaaaaaaaagguagcccaauucucaaaagaauacauauacauggcuaauaaauucaaggcugggcguggugaugcacaccugcaauccuagcaacucaggaagcugagacaggauuggugcuguugaguucagagacagccuucuggguuucagguuacccugugugaguguggucauugugaaugugagauccuacuuacuauuuaaaaaaaaaauuaguauucaagaucguuaaccaccagagaaaugcaaauuaaaaauacuuuaaaauucaucuuacucagucagaaugguuacugacaagguuagauugucaauuugacacaaacuuuaagacuugucaccagagaguguucuaugaggcaucuuuguuucuuucuuuuuucagacagucccacuauguagucuugguuuguagaccagauggccuggaacucacaaagaucuuccucccaagugcuggaauuaaaagugugagcaaccacacccagcugaggcauuuucuuaauuucuagaugauauacgagaacccaggccacuguggaccaugccaucccuaagcaggugggcaugggcuguauaaaaaagcuucgugaguaagccagugaguaacuuccuccaugguugcugcccugauuucccucaauaauggauuguuaccuggaaguguaagccaaauaaaaccuuuccuccugauguugccuuuugucaugguguuuaccaugucacagcaacagaaagcaaacuagguaagaaauggguaccagaagagcaggacugcugauguaauaaacuuaaucauguuguuuuggugaaggacuguggaaauaaauguguagaacuuuggacuggaaaagccauuaaaugcuuagagcuuaaugagcuguucuguggaaauuuugaacagugguuugagaaaugcaaauguuuggaggccuggcuuuugaaauuuugagugaaacaaagacucuauaaaggauaguuaugucacauuauguauggaucuauggaagucaaaucugcacuucacugggacaaugaauguugaucaccagggccugaugaacacuagcugugaccagcaucaaggugaaaucgucuagaaagcauuucuucagggucagccugcagaagcugcuguagagggagcuacggcugcaucuuaagcuggcagccagacuugguaauguguaugauggcacugguuuuguuugcaugaaagcagcacaacugaagaagucaugagaauaaacucagucuuuguaccaugugauagugucaggagaggcuauugugaacguguauccucaguugccauagagaccccaagauauugaagaugccaggugagaugaccaccaagaaagaauauggcagaggugaaguagagucaucuugaggcaaccagauaagcuaugugugccacauacggcaaaacugaagaagugcaauugcccaagguuuuuugaagcccaggagaucaugagugauucuauaugcuagauauugaacuacagagcauggguauacacuacuggguuuuguuuuacuuaaaucugauaguuaacuaugcccuggcucuuccuuuauaauaggguaaagguuucuccauauugucucagcugaagccaucuuugguuucuacucccugcccugaaaagucccaugggcaaauauccaacccuguucuagaaacucagggucgaaaugccccagcuaacugcauaugcuuggcucuuguuaaauugcuuguuugcuucccucugcaacugccaaccaugauguaguuuuuucuguguccuucaucuuuaaaaacucccuguaauaugcacuuggggcugcucuauguucuucuccaggcaaucacuagugagcuuaauacagaacagacucucaauucaaacucugaucucuggguuaccccauaacacuuuggggauuaaaaacaaauacauaacuuguuuuccauuuuacaaggcucacaauuaaagagauauugaacuuuuuaaaguguuggcaaauuuaaagacugugggauuuuuaaaguuguauuuuaauguguauuuaaauaugauaugaaaguggaacacagagaauacuaggaguuaaaaaaauuuaacuuggggaggggggugcuggagagaugaugacccaguggcuaagagcacugacugcucuuccagagguccugaguucaauucccaucagaccucauugcagauggcucacaaccaucugcaaugaggucugaugcccuuuucuggucugucuaaagagagcaauggugaauacaugaaauaaauaaaucuuuaaaaaaaaaaauuuaaccagccaggccaggcguugguggcacacgccuuuaaucccagcacugggggggggggggggagaagagcagaggcagacgaauuucugaguucgaggccagccuggucuacagagugaguuacaggacagccagggcuacacagagaaacccugucuccaaaaaaaaaaaauuuuuuuuuuuuuacugggaaugugggugagaagaaacaggaaaguaguugguagggguggguuaaccaagacuaaagauguauggaaaaccacuacuuuggaaaccauaauuuguuuuuaaaagaguuugaacacaaguacucugcaggaauagauuuggcgguuugaauaaaaauaguccccauagauccacaaggaguggcaccauuaggagauguggccuuguuagagaacuguaucacugucuauuccuguugucugugggucuaggcagauguagaccucuccuguaccaugucaggccugcgugccaucaugcuucuagccaugaugauaauggacugaaccucagaaacucuaagccagccccaaugaaacgcuugcauuuaugagaguugcugugaccauggucucuucacagccauagaaacccuagcuaagaaacaugggucauuaacugaaaaucucagaccagauguggcagcagaauuuuaguagagccauuauaucugauaugaacucuggagugauggcaccuagauuuagaaguagccuuuuguaaauauugucaucugaagugcauaacuuaguccuaugauauaccuggcaaaccaggaagucuccuauggauaaaaacucccucagacaacuucuagaucagauaagagguuuaguauuuggaaauugacuugcuaaaggcaccuuuuguguaacaauaaagaggcucugcaauggaguccagaguucaguccuucagaggcugauccccugcuguugagaagccugaaauugggcuggugagauggcucaguggguaagagcacccgacugcucuuccgaagguccagaguucaaaucccagcaaccacaugguggcacacaaccauccguaacgagaucugacucccucuucuggagugucugaagacagcuacaguguacuuacauauaauaaauaaaucuuuaaaaaaaaaaaaaaagagaagccugaaauucagccugcaaugucucuuucuuggacagaugguuccagaacacaggaugccucccaaugaauucaccggucaaggaagccccaaaggguuccuuuaaaacaacacaaacuguugcauuguucuuggcugcccuccauagcaagaugguagacccuauugcugaagacacaacacacuuugguugcuggacauagaaaauuccagaaaaacuggaauugaccugaaacuuuuuauugcuggcuggcuuuuguagggcugaaaggugucaugcaggccacuuaggaagaaaugucauuaauggccuuauauccaacaguuaaucuugaaugcaauaauacaagucuuccaagcaaaauguacccaugggugcaauagaggugggguuaaccaagugcuugaggccugcuccacuguaauauuuucauacaugagucuauaaaucugcacaaaagccuaugacuugggagguccaggcuauagggagaaaccuacuucuauugcuuuacuaaauagaaaugucaaauugggggacuggagagauggcucagcaguuaaagagcacugacugcucucccgaagguccugaguucaauucccagcaaccacaugguggcucacaaccaucuguaaugagaucugaugcccucuucuggggugucugaagacagcuacauacuuacauauaauauuauacuuauauaauauuauacauauauauauauauauauuauacauauuauacuuacauauaauaaauaaauagauagauaaauagauagauuuuuuuuaaaugucaaauugcuuucuacuuauguuuauauccauagauccaggcuacuccuaaucuuuaccaaaguagucuucuacagugaaugaaaagaaaaccuaacaaauugucaaagugcuaagaauaaauuauaguaagugcucauuccuaaaauaucuauaucauccgccccuucauaacuagagauaaucauugaugagagguuaaaagguaucuaagauucaaggccagccuggucuacagagugaguuccaggacagccaggggaacacagcgaaacccugucuuaaaaaaacaaaaaaaaaagguaucuaagagcaagggaugggugggugcugugaaaugcuaucuucugaguaugacauagcuacugcauuggggaacaagacaaaguuaacaucagucaauauuccaacagguugcacucaguggguugacucuguggguaccaaaaaagagaagagaucaugaagaugagaugagaaagagaccuguugggaaguacuaggguugagguggaccagaaguagauaggaucaaaauacacuguacacacgugaaguugucaaauaauaaacaaaacauauucuaaaaaaacuucaguuuuuuagagauuagagagauagcuuaucaauuaagaaugcauaacuccucuuucagaggacucuagcacaguacccagcacucucuuugggagagucacaaacaccucuaacccauguccugggagauccaguggcucugccuaccucaggccaugcauucaugugcacccaggccgugcauucgugugcacacaggccguacauucgugugcaccccggccgugcauucaugugcacccaggccgugcauuugugugcacacaggccaugcauucgugugcacacuuacucauccacagaacuuaaaaauaauaaaaguaaaccuuuaaaaacuauuuucaaaaucaccucaucguaguugguaucauucagaucuucaucaucaucaucagccgccugauuuuucuucaucuggucccccacaguucucuucccugguggggcauggcgaucauccacaggaucauuugcaucccgagcaggcccgaugucugaucggguggugaagccaguggcacuaggggaagcccagaaacaucauuauuuaagugaccccgaucccaugcucucuuuugaucaucauuuaguaacaucacuucucacacuucugggaacuuccagagauucuagaaccaaugaacuggaugccuacacauuccuggucuucuuuguuugcuaaacuuguaaccuauaaugaguaagucaaagaccguuucucuucauuccaaggugucauuucuucuucacauauacacacuauauaggccuauagaagucugagucucacccgggcagugguggcgcacaccuuuauucccagcacuugggaggcagaggcaggcggaucucucaguucgcagccagccuggucuacagagugaguuccaggauagccagggcuacacagagaaacccugucucgaaaaacaagaaagaaagaaagaaagaaagagagagagagagagagagagagagagagagaaagagaaagaaagagaaaaagaaaagaaaggaaagaaagaaaaugacaccucauuccccaaaagugggguaaguaguuuuuggccauucaauggguaauggguguuugucaucaaaaggcauggagggggugaaggguugguuaaaaauuguuaauggccaggcagugguggugcacgccuuuaaucccagcacucgggaggcagaggcaggcggauuucugaguucgaggccagccuggucuacaaagugaguuccaggacagccagggcuacacagagaaacccuaacucgaaaaaaauuuuuaaaaggcagauuucugaguuugaggccagccuggucuacaaagugaguuccaggacagccugggcuacacagagaaacccugccucgaaaaaaaauuuuaaaaaauuguuaaugguuuggucagggaggaaacaaaacaagggagguuacauucaggggacugcuuuuucucuuucuuuccucuauccuuucucuccuaucuacugcuggagagaagggaggagaagggaugaaaagaaaaaaaaaaggggaauauuagucuagagagaaucucauaugagugucaccugucaauaaaaaacccuauagcuaaagagcugagucaggaaaugggaggugggacacuagcaggaagagaggaugcugugaaauagagagaggcugaggaagaagcaggccaggacugaaggagagguaacuaaccagcagguagaugaauucagguuagaaucgaggggagaucugagcuggaacacugaggagacagagguaaaccucagggagccaaacucaagagagaauaaagaggagauucacccaggacuuggacacaugaagcugaggacaaguaaugaaccauauggaagacacagacuauguugaauagguuaaguaaguuaugaguuagucagggaaugagccaaagcuuauggguuaggcacuuauuaauaaauaauuagucucaaugucaucauucugggaacaggggcagaagagagggaaaacauuuauuuuuuuuacauauaggaauaagauauuugguuauaacauauuauguuucaacucaguuuaagggauuguaaucuaugggauucuuaaaacuuuaauguuaaguucuaguacuuuugaaauaugcuauuauaaacuguuaaggauaaguaagaaaugugaguuaguagucagacaaucaaacucacagucguguuagauaguagucuaguuuauuacagaaauguuuucaaaguugaaaguauaauaaauagcuagaaacaauuuauauauucuauauagucuuaaaaaaccucagagaucuacaaaauauggcauuuaaagauguuuuauuauuauuuuuaaaaggagugcuuuuguucuucuuucucacuauuuuuuuuuuaaagauuuauuuauuuauuauauguaaguacacuguaguugucuucagauacaccagaagagggcaucagaucucauuacgggugguugugagccaccaugugguugcugggauuugaacuucggaucuucagaagagcagucgggugcucuuacccacugagccaucucaccagccccaagauguuuuauuauuaaaagaucuuuuuugacgagacaagcgccugcuccuggcagcacccccauuguacuucaaagauuauauggcguaacugcagaccaacuauuauccaaacuagacaaaugacacagggacaucaaccaccaagcucugcaaagacaagguaggcaaguccuucauauuuccgaguucacagucugucauacagugggccagaaggcugaaugaagaugcugcuccuaggacucagagaaaucuaugggugacuguccagucaaccaccaaccucugucacuucaacaguucuugaagcugcuugacugcacguccugcauagccagggaaguuuuauuuccuucucagaucuacaauggaguugaagacuagcuagucucacaacuaagcuuaaacuguuuaggauuucagaaaagguuuuaaaaucuaagaagaugcugggcgugguggcacacgccuuuaaucccagcgcucgggagguagaggcagguggauuucugaguucgaggccagccuggucuacagagugaguuccaggacagccagggcuacacagagaaauccugucucaacaccccaccaccaccaaaaaaaaaaaaaucuaagaagauauucuuagguuuauaaaugcaaguuuugauagaaaauuauuuaaguacagaauucuaacucaccaagauaggauagauaguagaguacuuucuccaaaguugucaaauacaaauggacuagauauugugaauguaauucuuaccugaugguuuaauaauuguucuuauuguauacaauuuauugauguaagagaaaaagccuuuuauuggacuaaaaagggaaaauguagcgagaaccucuuauaagcaucaucugucaauaaaaaagcuuaugggcaaugagcuaaggcagaaaacaggaggugggacuuacagcagggagaggaagaauucugugaaacaguuagagagggggauauucacccuggaaugcugaggaguuggauguaaacaaacacacagcugaagucaaguuagaauauuagaauauaagggggauucaacgggaacgcugaggaaauggacauaaaccagccagaacccagguuagaauaaacaggauaaaaaagagcgagucgggaaacaagccaaagcuuauggccuaggcauucacuaauaaguaguuaaucugagagucauuauuucugggaauuaaguggucgggaguaaaaacccuuuuuacaaguggcagauggucuuuauguagucccaauucaauuaaaauuuaaaacugcaguggacuuaaaauguugugcucucuuucucugaaucuaacaaaugcuuguuaaagaaaaauccaaaaucuccucacaucacaagacccaccugguaugggacaggaaaacaacaagcaagggacuagucuauugucacggaucucucucaagcuuucggguuuucaucugcuaaaauguuucuuuuuuuucuuuuucuuuuuuuaaagauuuauuuauuuauuauauauaaauacacugucuucagacacaccagaagagggagucagaucuuguuacggaugguugugagccaccaugugguggcugggauuugaacucuggaccuucggaagagcagucgggugcucuuacccacugagccaucucaccagcccccaaaauguuucuuaaaguacaaacauuaucuuccagaacgacaagauuauuuuauuuauauauauauauauauauguguguauauauauauauauauauauauauauauacacacacaaauauauauguguguguguguguguauguguguguguauacauauauauauauauauauauauauauauauauacacacacaaaguuugucuugauacuaguagucauacagaguacuaauucuagaaauaagcuccaucuagcuuccuguauguguuuucagguuugagucugaagcagauaaccaggaacgaaguuuguguaucugauaaauugugguccucaaaccuuucaaagaucugcugaauauagcauuuuaaacauuuaaguuugcuacaaugaacugugaccguuccaaacaauaacuuuugaggucuccaaaaagaugggcccugcaacaaugaauccaccuggauuaugguaaugcuaaccacugagcaaaacuguuccaugccucuucuaccaccaaguucugugcaaacaguggauuccuuuggguuaccaagccaggauuaccacuaagcugacaaacaccacucaaaaauagcucuggacuacaaaauugcugaggacauucaaauugcucaguucauauaagacugaaacaaacauuuuacagaacuuugaacucaaaauacuuaauccuaagacugcuaaauacaaacaagcuguggaaagcuugguagaaacagcuucauuauugucaauaguuuugcuguauuacaguuaaaaccuuuccuuuucauuuagacaaaaagggguaaauguugcaggauauuugucacacuaugaacugaauuaugcuauuaacuggaaaaaccuguuucucguuguguuguggcucagucuuagcacacgcuuuaauccaagagcuuucugcuugaauaguguaaacaggauuaaauaaagucaaccauuggucaagaagcagagcaagcaaccaauugacaggaagugaaucuaggauuauugagaaaaaaacaaaaacaaaaaaacagaguaagagagagccaggaggacagauagagagaugcacaggaaguagaagggagggacauucaguuugaaagguuuuuuugagaaggcaaagagaggggggauuucuucucgguacuggcugaggaaggucagcugaguacuuuuucuggcucucugagcuagcaggcuuucaccccaacaucugacuccugauucuucauugguaaaaugaagcaucugagauauuguuuuuaaaaaacuaacaacagguaacucuagccuaauguuaaagucccugugacuuccagcucuucuucuugcaauucccacucuucuggauucuuuuuuuuuuuaaucuagccccacugggcuugaccuuguucuuuuugcauuuauuuuuauguguaugugugugaagcuguguauuuaacaacaccacaugcaugcagguggcuguggaggguaucagguccccugaaacuggaguuauaagcaagcugugagucuccugacaggggucauaggaaucaaacucaaguccuuuacaaaagcaguaagugcucuuaacugcuaaggaaucucucuaaucccuuuuauauucuuuaaagagguugggcaagacauuggaaucaaacccagggcuuugucaguacugcucagcuacaucuucagcugcccuuuuaaacuauuuauuuauuuagugugugcgugugaccugacauaucuguagaagucagaagacaauuucagagaaucaguucucuccuccuaccucgugaauucugggaacucaaacucaggguugacagagccuuuacccucugagccacuucaccagccaccuacuugccuuuuuaugugccuauaccaaauuccacguuuuuccuuuacucccccaaaaucugacacuucguaaacccaacuaaaaugccacacugcugaauaucucuugacuucuguccuacuuuuugugcuuauuuauaccaauaccgaacuugucuugugaacugcaagucuucugaaaacggcugugaaugccucccuucuccuaccauuaccaaggaagacuuauguuucccuaaucaaaugcauaaaaaguaggaaaaauacuauucaucuacccaacaccuuaugacuaguggcacugccaucucuguccagacggcugagaauuugaacaggugaccuacagccacacauccuagagaaaaauguuuaagggaagaaagguauagcacacucuuacuguauacaucaaagacucaacugcuucuuacagccaacucgcuuacggauauuacuucagacaccaagacacugagauucagaccccucagucauaucuuagagugguagucaggccucaugaaccuacauauuucgacacauacauacauacaugcauacccacuuugucggaaaggcauuaugccaaauuaccuaguuguggcggugaaaguuaaccuuguuuuugagacaagguuucguuaaguaauucuagcuguccugaaacucgcuguguagcccuggcuguuuuguaauucgcuauguagacgaggcuggucucuuaacuuaaaaacgaaggccucugccccugccccaucccaucccacccaccccccacaacaaugcugggguuagagacgugcgccacuagcuccagccccugguuuuuuguuuuauuuugagacgcggucucucuagcucuaguggcugcuaguccagaaucguucucaaauaggccaagagcgagcuguguuccagggcaccaggcacccuacccggggcaaacucccccccacugccuuacccccugcccagcccggguacguagcccagcggcgcaggcaugcccaggaacggcuucuucuucuuguucauggcgguguuauugaccgaaacacagaaaagcaggggagcaaguauacgacagaagacucagaguccuccgggugucgcagcaguaagagaugcaggcacuacgucacccgcgcaccggaaguagagagcugggucacggaaagccccgcccaccuagagcuucgggcggaagucaaagauguggguuugcaaaguguuuccggccagcgcugugugcaguguuuguugcgggaagacgcgcgugcgcgugacgguauucgguaucgcgccacaaggacguggguucgauuuucaugccagccuugacgcggagccggaacgcauuaguccuguucaggagcguuccggugcaagcaaggcugcgaagccacuuaguucaaccaccauaaccacuucagacuagccuuacuguacugaaccguaugcggccaccgacgguccagacuacgccaucagauccgggaccacuccaacccccgcgcgccuucugaggacagauguauagugcacucaacagugugugggccagcgucacaagcuugggagugauugugugcccaguggcuugaguggacucacaccacucuacuuugcacagauauuuucugugugcagcuccucccgaaacacaaugccagucccaccuguuguguaauaauagcuucaggccgugaauuaggcuguacagggcauuaaccccacgcuauaaaaaguugcuuagccucggcgaugucuaccugcagaagcaguaugccaccccugggaaacaacccugcuccgaguuaaaccucaaaaauagcuguaaacuccugguagcuacucuguguguaugucccagcccuuuuagguuaggggcccucaguguuuaaauaaagcagucucagcccguugagacagucugccucucagccucacuugucuuacaccuccuacacauggggagagcaccagacucuagggccgacaggaaaaacugcaaguugugcagccuggacucugcuggaucagacaaccaggccucuacagccaaugcuuuucagugagguacuaaagcaguccuggcucccuagacagguuuuuagggaggagcaggauugagucugugaacacugacccacagggaacugugccugacagaggggcuucacagagauaggaguauugccugaaguucaaagcaaagugguccguaaaugagggucagcaaauacuccaguaaagaaugagcuaguagcugacucagacagauacagacaccaacagccaagcaguggauugagcuugaggauucuuauggaagaacaggggaaaggauuguggguccugaaggggauaggaacuccacaggaagaccaacagagucaacuaaccuggacccuuggagcucucagagucugaaccgccaaccaaggaacauacaccggcugaaccuagguuuccccacucaugcauggcagauauguggcuugauguggguccuaaauaacugaaucaagggcuaucucuacguggaauauguucugcuagcugggcugccuugucuggccucagugggagaagcaccuagccucacagagacuugaagagugugugugugugugugugugugugugucccagggggggcccaccugcccagaggagaaggggagggggaaagauugagggaggggguaaucaggagggggcagugagcaggauguaaagugaauaacuaaaaaaaaauuaaauaaucucaaauauauauauauauauauauauauauauauauauauauggaacgaguuaguggaaauagaaauauagcucggugguuaagagaauuucucauucuugcagaggacauggguuuacccauguugcagcucacaacuguccauaaccccagugucaggaaaaccgauauccucuucuggacaccagguauguauguagugcacagguauacacucgggcaaaacacucauaaaauuaaaaaaaaaaaaaggaaugggcaaauuaggacacacagguguuugggagagaaugauguggcccuuggccagacugaguagcuaaaagcgcacaggcaugauuauccccaccaccaccagaccgaggggaccucgccugccaacugcaaaggcccuccagcggguugcaagagaggcugguccacggaguccuacccaggugcgcaaggacgccuuucgcucuggcggacauccuaagcauacgcagccccgcgcgccgccgauacaccuccgagcucccggagcgcgccuugcgcccagggcugggcggcaggugcuuugccgcgcagacuccccggccgcggggaccggcuugggcuuggccggcugcggcgggugggaacgcggugugcguugcccaccggccacacuggcugccuggugcuccgcgaggggcgugugcccgagccgcacauccgcgggcuccauguucaccgagcugcgguccaagcugagccccccgcgagcucgcgccggggcugugcguccgggcuucggggagcguccggauguggacggugagcugggauggacccaggcacaggaauaucgugagcagcgggcugagagcgggaaggguaccggggcccaaggagagcaccggggcuagacucaaaggguuuccgggugcggccgcugcggggaggaagucuuuuuacuagaguccaagggccuuuguccagcguuauggggcgggagggcggcgguuauucucaggccuugacuuggaguggggaugacuggcagaagauucuucacagagaugacaccaccacacuccugucacccuuuacuucacauaaagaaaaacccuccccaagcccuaagguugggguuggagacaaggcagaggcguauaauucugagguugagguugggaacgacagacucuggcccaguacagggaggaaauaggcggggccugggcggccuuggcaggugcgguuauagccaagacguccgacugguuucccucaugaggagccuucuagcccuagaccagggaaggccucagaccacagugccaauuccuugaaccucgcuccauuagaauaaaucuuaugguacuacaggcuaccucagaauaggggccacacacuucuuaagcccaccuucuuucuucuguugacuugcagguacuacauagaguuauauacaguacuuauggaugcuuucggugcaucaagacauuggucauccccagacucaugugauuaccauaaaugacccuaaaacuaacuuaacaagugcaaugaauuagugggaaaaggauuguguuaacugguacaugccuagcuggcacccuauucacacuuguuguccugggguaggcccugcagaagccacauagaaaagaaaucuggcaugugccuggcaagugcuucuugucagcuuucccaucauucaaacuuuuugucagugagucauaguuagacacuauuaaagacaaagaaaugugcacacccugguccuguaugguauuuagaaggcuugccugucagcccaagccaagggcaaagcaagucagggcagccuuagagaugcugcucgccuggccuggcuauggcguggaucauccuccaaucucaguacccuuggggccagagugugggcuaucagcugauaaagggaaaggcaagaccagcuuaucuucagaaaguucucaagacaacucuuggaaaaaaaaaaaaaaaguuuuggucccaggggcucacgauucccccuacaggagaaauuauuacuccccucauugguagagagaagauuuaauugucagggagcugagucacaggggaggagcuugccccugaccacucuguaugcacaucccugcauacagccucugcccauuucagcuucugccagacucuccuagaacacacaguaucagcugagaacauacccugccaccugccucggacaccaggcaccagccucacguggcaugacucccgcagccagagggcauccagcagcaggccaaucaagcuccuucaacagcccggcucagagaucccccaggugccuaccuaucccaccuaaauccuugcccuugcucucaguuuuauuaucuucacucaacuaacccuaccuccccaccugcaggcccggcucuacucugaucacuaugguuuguaccauacaagcccuucacuggguggccugacaaggccaguggucuuguggagccaacaagacguuugcaaguggcucaagaagcauuguccucacaacuaccucgucuacgucgaggccuucucccagcaugccaucacugguauaguggggucacuggcuagggagaaacagaaugcucaagacguagucagccuugucuucuccuguauccuccugaguucagccuugugugugugugcugcuucucugauuggccucuuuuaaucaauccugucuuucuuucuaccuuucuuccuuuaagaaucucugaaucucugcucuacuuucuuggucaugucugucuguuuauuuguuuguuuuauccugauagacuccuaugcuuugcuucuguuugccucacugccuucccuucucucucccuaggccgagcucugcuucgacugaaugcagauaagcugcagagaaugggguugacccaagaggcucagaggcaggaggugcugcagcagguacuccaccugcagguucgugaggaggggcggagccugaagcugcucagccaagguuaguaucagggaccaggauuagggggagggacuaggcugaagguggagggugacuuuucucgacacaaaagggggccauccaguaaggaccauccuugggugugccaaaacucagcuuuuccuccuauccauccuacagcuuccuucggaaacauguccuagcugcugccuauacuuggaccccagaccccaacacugugaccagagcccacagccaagaaugagucagaauuggcccuacagccccuuuggauccugcaggauacccuaguggcuaaaccuagcccagugaucagggaggagcaagacuuccaccuccaggugucucuggagaggcacuacagguucugcccuguggcugggugggugguuguugccugcuuauagacccuucuucugagauccaagcccaggucccauccccuggugcugcuggcagcaaacaggguagcugccuggaacuagaaugggguuugaauguccccagacucccagggagucuguuuauuuauucucccuccaacaugugaccaucccccaucugagucaugagucuuccccuuaaaucuuaguucugugucuuucccgggcacccccagaucagccacacagugggccaagcugucuuggcucucuuucaaguauaucuguccccuagcucuccuagaguacagcaggcccaaccugcuguccauacuaauggugaucaaucaucaugccaugugcuuacucggugauuaugaaacgucaguauacucuacccacuuguuagaagugagguugagagggguccaagaugcucaagcugcaaacccaguaaguggcacggauuccagugcuguacaggugacucuaugcacagcccaccaguucagcaauguucucaaucuuaccuuugaagaagucaugcuuuuaaacagcuucccuauucccuggcucuuaguagagaccauauugaagaauguguguuugugucugucugucugucuguguucaugugcaccucuguggcuuucccaagaaaaccuguucucaaccaagaaaaucauguagggcaguucuuucaugugucgccagacaccuggacaaccccuccuuggguauuugggggcuguugcugccaggaaggaggacaaggaggaugacccuggcagcucacucucacucugcucucuaccaacguucccagggacucuaaaaucucagggacaguugaggcucagccuccaguccccucugugugccaagagcuggccucgauucaagguugcucauuacaguuaauuugggccauuggccuggcaucuuccauccuguaugcccuccauccauggaagggggcucccuuauuguguuugccugccucuagaaucccccaguccuggugccugcagccagagggcccucucuguccccccucucucugucuuuucuucccuaugccccuguccuuucuuccuugguuuuuggucacuuuuuauauauacucugacaaaaaaaaaaucagaaauaaaucugguucucaaaugccucaguguugggucucuggggagcaaaggggugucuaggacagugccugcagauagaacaccacuagagggcagugguguugcauccugagaaagcuaccugguaauuccaggacaucagaacaaacaagaugucucaaguaaaaaaauaaaaaaauaaaacauccuugucgcagagagagaaagagagagagaaagagagagagagagagagagagggagggaggaagaaacuuaaaaaguaaaacaugucucaaguccuuggauaucaucccaguuugggacauagcaacccugacaggcucaaaacaauaguuuggacacauggaaugaggcuuucuggagcugaucuagcagcgaauuuuugcugguucauggucugggaguauagcucagugauauuggacaugguuugugucccaaaucacgguuugauccccagcaaagaaacagaaacagagguguucuaaaaguggagcagaguucuuuaucuauucagcuuuguaguggcugucuaguauuccugagcuagaggcuauaucacaaaucuauuucuguggucauucucgucugccucucaaauaucuucuuuaaauuuaggguucacuuaguccaaauagaucucagaaacgucaguuacaucuacaaagaccccuuuuccaaauaaacuaucacuacagcuuaacaugguuauuuguuggggcuuacucuucagccauacccugacauccauagcacaugaaucacacacucugaacacaauaaccagacauucaaauaggaacauugagguauaggccacaaacauagugacacaacacccagacaugcuuaaauauguacaaacacacuugcacaauuggccaaugaucugugcaaagauuuauaacauccccauaugcacagauauaauuacccaagugcauaaauacaauacauaaucacuaacacuagacaugacauaacccauggugcacauaagugcauugcaaaaugucuugacacuuagauacacacauaaagaaaaauugcagggagguggggcuagagagagagagaacacaguugcuguucuugcagaauugaguuuccagcacccucuucaggcaguucacagcuucagggaauguagugcccucaccuacaucaugaugcccauauaugacuaccaccugauaacacauggucacuuagacauguaauaaccuaugggcauugguauaucacacuugugaaaacucagacuuacacagggaaaguugaacacaccuuugugugcacacugauccccaccaacagucugauguuccacauccugggagacucacaaaagguaaaagacgucuuuaaucccagcauaugggaggcagagacgggcagaucucugaguuugaugcuggccuggucuacaaagggcuacauagugaaaaguuguuuuagaaaaaacaguggggggggggggcuggagagauggcucagugguuaagagcgcagacugcucuuccagagguccucaguucaauucccagcaaccacauaguggcucacaaccauguguaaugggaucugaugcccucuucugaugugucugaagacagcuacaguguacucacauacauaacauaaauaaaucuuaaaaaaaaaaaaaaacagugggcauggcugagaacauguaacaguauuaugacucaaaugaaagcugaauuuuucccuucccuauugagugcuccuguggagccccaggcuuugcauucuaccuccuuaucagccaguuggcccuuccuagucugucaaaaggguguuuauuucucugccucauuuauuuccccuuccuagucugucaaaaggguguuuauuucucugccucauuuauuuccaaguugugugggcugugcugucauccucccacccacccccuagaucuuacacuagcagcccaggcucggggccagagaaguuagauacuuacuggcuguuggucuaggaccacacuguucacaaagaagggagaaguugauucaauagccagugaccgcaauaaggccuaucggucuucgugucuagauuaagguggccuaagggacagauagaggcugaggugcccccugacagccuacagauguccuauaacccuucauaggaucuacuucagccagcgcaaccacaccgguugcuuaauccgucaggcaggauuugcgguaguguccagaguuccugacgugccucaguuuacuggacuguccacaaagcgacucuugcccaaggcacgcgugaccgaucgcucggcccuggaggccaggaccaccugggccacggaccgcacugcccggagcggcggaacggccccaccggccccuuccccgcagcggcggccgcgugaauaccgcgagaguucgccccccucccccccgcaguaaaacugucaaagguaggaggggcgggagcgcgcaugugcgcagcacggcgcggagugugcgccgcccggaccccgcgccccgcgccccgcgccccggcccggcucuggcuccggccuggcccggccgcaccccuugggcgcugcagguaagcgccggcccugcccgcuuuaccgcggccccggcgccacacgcgccccgcaccagcccugugcccagcccgccuccccgccgcgcccggacccgcgccgcgccccgcuccccgcgucggcgccguccucccgccuccuccuccagaaaaagucgccauuuugguucacugccuucgcccccccgcggucggcgcuuccgggccaggcugcagcccgcguccggccucaggugacagguggguggccacgggccuccaggugcgccucuuggcugcgcucguccggggccgggcggaguggccugcguccgcggcagcgcccuccucccuggaggcuacaagggagaucgcagggaccccagguggaggagggguuuucuuccuacuccggcggccaggccuuaccccuaacucugaaagacuagaagguugcagcaggccguauaacccggaccucaaauguaaucgggguucuggauaacucauuuccuuaugaagcugcaaaacgaggacauccagagaacuuuaguugacuucagacccccccuccccuccccuccccuccccuaggcccaggauggggguguuguccuuggcaaugaacggugauugaccuuagaccuccuggauaacgcagccccuacacauccccucugauuugaguugaucaaaaacuguuaggagaggacucaccugcuugaaccuugcucuuugguaccgcccccuucuguggcuuugggugccucugcgaggccucaccauucuaugcuuagagccuuccucg

SEQ ID NO: 1344 - RNA, 1807 nt, Mus musculus
aaacccuuuuaaagaaaaaaguuuaauuaaaaauuaaauauauuguauuauauauguauauauauauaaaggcaaaguaaaaaacacagucucauucuagaaaauacauagcagaaaagaauuagaugauucaaaaacaacccuggcagaggcagcuagcacguccagggccugagguuccuagggaaggcccaaagcacaggaacccccagaaggagguguguaaaugaggaggcgacagaaauggcaucuuuaggccaccagcucuaaaggcuguugcauacccuaacauacauaugcgaaaggaagggagcaggcaacucugccacuuggccacaugcagaagcgguggagggcaaggacagugucuagccugagaugcaagcacuguaauagaccgcgcugcuagcaucagacagcgcagaaaugaggcugcucucuucuggacaggacauggcgcgcggaccuaguuuggccagugccacgugguaggggaguguaguggcauccggucgaguccggcugcaauugagauacuggucaaauucggugagguccacaucggcccaaaggucggcgguaggcuccaguugcucugugcccucaagagacggggacucaggugguggugacagaggauugggaaacgggcccggagugcccagggugccauaguagagaccugcgaguggcgcggcaggcggcgcuguccugagcgcuucagccaggggcgccccguagcagaagcucgggucccgugccagcucaggggcauagggugcccggaaagcccgcagagcgcaguccucgggcgccaaaggcggugggaagaaggaggccucgccaggcuccaggccguccagaggcgagcgcucgggcguggguagccccaagccaucgaacuccgcacccagaguggguagcucgcggaaggagcgagcugacccugacgcugcagcgaaggccucgggcggcgcagacggcugcacgaggcccgggagcaagaggcccggcuccagccuccggaccuugcgcgccuguuuuuugcggcgaggccgguacuuguaguugggauggucgcgcaagugcugcacacgcagccguucggccucuuccacgaagggccgcuucuccgccguguucagcuccuuccacgcuuugccuguaggcgaagggagccuguuaguggaccagugucgggcgcacgacuagccaaaccgucgugcgccuugggcgcgcggcgugaaacauggcauagaccccagcgaccagccauaaaaucccgaaucccgacccucucccaaaguccccucccucgccgccccucuaagcauucgaggcucucacccagcaucuugcucaguacugcguugugcagauccggauuuuguugcgccagucgcuugcgcucguccuucgcccacaccaugaaggcguucaugggccgccgaaugcgcaacucgucggcaguuuggcgcucuccgcggccaaagccauagcgcccugauucggggcugcgcggugggcuccgcggaaggcuggacggggaggcgggcgaggugggcgagacguuggugacagggaggccgcgcgccucagcagcggccccgauuccaggggcccaugcacagucgcggcgggagggcgggucguccugugcgccguagccgggcggcgaucucugcauuccagcugggcaaggccugggcggaacgcggcgcgggagcgcaggagacaguggcgggcacugcaaagccaaguacggaggucugauggacgucggguggagacacuggggacgugguag

SEQ ID NO: 1345 - RNA, 7777 nt, Mus musculus
ugucgcacgcggccgccaggcggagguuuggaccgcggaucuaggcggcggcggcggccgaggucaggccgggcggcgcaaccggcacaacccgccgccaccgagguagugaugggcaaggaggaagagauugcucguaucgcccggaggcuggacaaaauggugaccaggaagaacgcggugaggggcgcgggccgccaggacccuggggccccgcuccgcggagaccgucugagccuacccucgggcagagugauaccuagcccagucagucgagaccccuugcccaggcccgcccuccacccuguccugggacugccgcuucgcaauggacgccgcguugaccgaaagcuacccucuguucgucgcccagcgguggccgcgggcgucccuggcccagccguugucuccccugucugccccccacccuucagcaccagguuucucuuaauaaauuuuuccccugcuuagucaggccucaggcaacagcaagucgguuugggcagacaguugagccuguggcguugagaccccuggccagugugggcuuggcaguccagccugccuuccgaccauggucaccugcguagccuuugaggagcauccuuaggggaugauggcaccugcaaucuugccuuccgugggugggaagggacuuaggagguggcuuuaagacugagugacucuagagcauccgcagcaccgcucugagggcagcccagauaguggcugagucaugagucuguacagccuccccaggacugugcuugaaguagaaggcugcaggacagcuuuuggggaugagcaggauugcucuagggguuggagggcuggggucuaaaacaggaaguagguuaagugcccacauaagccuuuacacuggaaacagaacccacuuugcaaucaucugggcuacagaggcccugcuggagcuucuuuccgguaagagaaagcacaaaugacaaacuuggaacuaaggguggcagagauaggaugggaauccaaagggagacccaguaaggauggaaggccacagauaggacuguacaguugagaagggaaccugcagagguuccaguaguccuugagagaggcuccuuggaacagcugaugguuuaucuggguuuucauuaugggagugcagggcuauuguggaugcaugccccuggcuccaaggaucaggucuucuuagcaaagucagccaccucagggcugauugguguacagcuuacuaacuuagggccaugaaacaaggcugcagccugagcagauaagucacacagauugaagggucagccccagccccuaccacggcuggauggguugguuuucucugccucuuuguggcauauaaagacaaaugagcucauaguggaaacuuggaggacagcaaacacaauaguguuggguguuagaagaaaaggcugucucaguuguaggaaggagguguuugaauauaaccuggaagugguaaagagaagagcagccuuaagcagagugagguuuaagguaggaaccagaggagccugccuacccuugagguucaaagaacagagcuuaggcagaggaagaaaaucaggguuuucuguuacaguaccuaggaggaggguggugaccagucuggaaaagagauaaaaagugagacuaugggauuuguaggugcuggcuuuaagaaaaacuucccuuuguauauuuaauuuuauuuauuuuacauuuguuaucucggugaguguguaaguaugaggacaaccccuggaaauugguuaucuccucccaccauuugggcucuggagauugaacuuagguuguacagcuuguuggcaccuuuaucugcugagucaacucaccugcccaccccuuugauaguggguauugaacccagggccuuaacuuaccaagugagagcuuuaucacagcugugucuacacagcccucucuuuacuuuguuuuaagacaaggucucauuaagaugcccaugcuaaucuugaauucacucugaaacucagguaagcuuugaacuuuugauccucuugccccagccuccuaaguaucucugagaugauaaggccugugucaccagguuugguaguuuucaauuagcaauaauugugccucugauaaaccuuguuggcuauggugcuguuacuuugcaaaucuguggcuggaguagagauuccugagaguuuagguagaggcuuuuaagguaggaacaggaagagccugccuacucuggaggugcagccugccuguagaugcuggggaaaagccagggcagaggaaggcagccaggguugucuguuacaguacccaggaguagugcugcccugauggguaggcgcuuugaggagaggcugcucucccaccacagcacagauggaccaagguuaaagaacccgugcuauacccgugaauguccuuccguguugagcaggaguuggggcauuuauuuucucuaguaguuuguucaguguccuccugugguuaguuaccaugaugucuggagaucaccguagaugcaggaugagaaacccccugaucuuugaggagagcacuguugagcuguuugccucuauuccugcccuauggcaggagcaguaaaaagccccuguugugauguaggaacagguauggagugcucugggaaucucaggguagaggaguggcuucuuucugacauguaaguugcccccuggugaugacaaagagguaggauuguccacuaugcccccugacaaguguuuucuguguaauccuggccauucuggaacuccuggccucacucuguaggccaggcuggccuuuaacucaagauucaccagccucugcauccugaauccugggguuaaagacaugcaccaccacuacccagcauccacuaagguuuaaaguccuuuaugaacaucccguuuccuuucaggagggagcuauggauuugcugcgggagcugaagaauaugccuauuacauugcacuugcuccagguaagugcuuccugucuuagcagggcucccuauauuaacucccacauggcuuaauuggcacaaacaacuuuguucuaaggagaggauuucugauucucucuggucauaagagaggugggagguaggucccugggucccaaauagccauugggagagauguuuucugucccugccauuccccagcuguccacugugggagccaagaguccuuggugaggauccgccucuggaacaggccccuccgccucugacucaggccacuugucuugcaguccacccguguugggaugucugucaaugcucugcgcaagcagaguucagaugaggagcucauugcacuugccaagucccucaucaaguccuggaagaagcucuugggugagucucagaauguaaagggaagcucuugcuggucagcacagcauagagugcuggcucugcuacccugauugaaacuauauauggugggauaugacaaacauagaucagaaaggacucaucccugggcuggacauggaugaagaugguagaagauggaugucaucuguugugauggggaggugauggccugggauguaugaucauugagacaaggguauaugcugcagaggagguuuucaggcugcaggaggccaacagaaaaggagauccaggcaggaugcuccagcugaaggaggaggggaaugggauggcuaccuaugcaagaggguagcuaggcagacagcaacuguuucuggggacagugcuacuaggcugcagagaugguucuauugauuaggaagguagucuucugcguucagucuacuucuaugagacaacccagagccuguuucucuuuacagucacaugcccugguccccuggucccuaguucaggcuuugggcaagguuucugcccauguuuucagaaggagccuugugugaggcauaugcuugucuuuuggcacgguugggccuugaugaguccuacagcagcuuguuggggggggggguguccuaaagaggcugguggacuugcuggggaccaguaggaagguccgguagccuccuggcaccuugccugucaaguagcuuuaagcaaaaaggauaauggccaggcugaggcugggcccucaccuggcugccugcuccugaccagucuacaccaucuguuuucugauaauggcagauguuucugauggcaaauccaggaaucaagggaggggcacaccuuugccuacaucaucaucaaaggaugccucaaggacuacggaucucagguagcauaccugaaggcagguacauacauuuaugccucuugacucaguuuccucagugggaagaggaggcuggugugcauuugccugguuacugcccugagggaaggucccucuccagggugaguuuuacaagguuugucagcuucauguuggauacugucccacuguuuaguuuucuucaugcccaucugagaugucuggcugugucugccugucacuggcaucacugagaccuucauuaaguagcuccuauccaacagagcuggcccagccccagagcccuuugccuacuuccucaaauccuaucuuugugcuacucaucaggacuggugaaugggucccuuuaugcaaaugcuaucuggagcuagaggugugcacagcucuuaucuccacauuucgguggcaacaccauugcuuuaaagguagucaggacagcccaguuaccauggagacuaggagcacuaguaguaacagacuauagaugagagacuacuuuagccugggcugaggccaugacaggcuaagcucuggacucuaguguagcauuccugauauguuauauccugaccucaauaguauaguugauuuugcuucagaaagucaccugaugcugcugauuuccagagguggugugaggaaagagucugguaggcacagcauuaauuuugggcaagucuuguguuaggcccagaugugaggaaaucuugcccaauuucauuuguguugaguggggccaccugugacaguuuaagccuugacuuugggugaccucccaccucaucuuuacucccggcaacuagauuuaucugccuaguucugccauuaguagagagagauucacagcauggcccaugucuugggccucuuaggaagcacucuggagguagcaagaauaucucaucccauuuugagcauggaguguugcucagacacugacuguggaggagcuggcauccacuuagggagugaucuguacucacuguagaccuucuggccaaugcucuacucugaugagacauaacacacaggcauucuaggcugaacuagggauagauaaagucauuuagccuaguuagaggucugucaggauagagcaaauagacuucggaggucagcaugguaucuacauuugcuuuucuggggaucaccuguggccuaggaaaggucaggggaccaccccgaaguaucaucagcuacuggagaugugcaacugagcacagcagguucaaucugaguccagcaggcuuugucucuuuagcugcaagaagccagauccaccuaggaccccauccacuccaaggaucacuacauuuccccaagugcccaucaccugugaugcuguacgaaacaaaugccgagagaugcugacuuuggcccugcaaacugaccgugaguguuacaagaucuggauuuugacccaugagguggucugggccucugccugccucagagcugcuggagaggcagcuuuucuuuuuagcucauggugaccuagcaaagaggcuaaaguuuuuggggucaccacaacaucugugucuugggaacugucucccaggaaugcaaguguccuauuuagcuucuagggcucuguguaaacagagggguggcagauggaaaaagacagugggggaaacaaguaaggguucccucuuacagacgaccacguggccguuggugugaacugugagcaucugucaucucagaucgaggaguauauccuuuguacaggguauauagggucaagggcuucugauagagucuacaguccacugaguuguacgucuucuguagcuauugaacacaacugguaggcuacccaguacccuuucuggguggucccuugaccuuuccuggaccauaaaugggcuaugacuaccuauuagauagaucugggucucaaacaggaaugggccuagagaaggcagagcaccacaggcccuugggucccccacaggucuugaguggguagauucaucuccaugagccugggaagaacauuccccauaugacucccaggagggggaggagcucagaaaccucagguggguccuuaaacaccugcacgcaucuuccuggacgugggaaauacugacaugaaguacaagaaucgggugcggagccgaaucucuaaccugaaagaugccaagaacccuggucuacggcggaauguguuguguggugccauuacaccccagcagauagcugugaugacaucagaggugagugccacuggaagggcuggggcagacugcuucugcagagcugucggcugaaaacuuugcccuuuuuaucaggagauggccagugacgagcugaaggagauucgcaaggccaugacuaaggaggccauccgugagcaccagauggcccguacagguggcacacagacugaccuguucaccugcaacaagugcaggaagaagaacugcaccuacacgcagguugggggccgcucauccucuucuuggauaccaccuaugucccuacuuuuggucugaggcucugugcaaaggcuagguggcuuggccaugcccagcauguagggauuggaguauaauaugcugcuugucagcagcugugggaccuucagauccugcuacggagguggaaggugggaaggcuauauggacucuaagggggcuugggaagaagggacuaaauuaagaugaucucucugguagacaacucuaggguuuguggaaacugccaucaucugcaguaggcugcagagggcuggaccugauggauagagcagcucaggcccugugggauaauauuugcuguuggguuuccaauauagccaaggccacuggcauaucugcugauccuuuuacuuuauagacccuccuguugggaauccugcacuuauccaacauucuagacaguucuacugagcacaauuguucagggccacagaagccucuguuaugauaauccaccuccuccauaggucuaguucuagaagguugauguaggucacugggcaauuucaaaucaucaauagaaaucaggggguauaagaccaguacugcccagaucagggcagcaaagccagggauuuggccacccacccuauacaggugcagacccguagcuccgaugagcccaugacuaccuauguugucugcaacgagugugggaaucgauggaagguaggugggugggcccagaaugcuugcccccaguccugucucaaugcauauugggccugaaguaggaacagggguggugguggugcacuauacccggcuagccacuugggagucugggauggagccuauccuauuucugccccagcgggucauguggggcuuuggccagacauuucucugccuuccuucaguucugcugagcccuucugacguaacccuggccauggcuaacacuguccuuccugcaauguucuugguggacacagcuucucuggagauacccugaagguggcacgcccuguuccagcccaccuggugugcacuuuuugcccucuuuaccucauuauuaaauguuuucuugcuccuaaugggcuaaacacaggcuuc

SEQ ID NO: 1346 - RNA, 5561 nt, Mus musculus
cuuuggggaaguaccgcggaggcgccugcgcacugcgcccccuccccggcgaccagcaggacuucggagcgcgcgggcggcgugacucggggacgcggcggugagugcugcgccggaccguggacgggcccuggcgauauagaugccggcucuguucccggacuucagugaccgguccacguggaucuaggucgcaguaggaccagacccaccccuugcgcgugggggagggagagccgcagcaagguuccccuuuuucuucagcucagagcguugagaagugauugcucaaaggugggggccggaagaacccagguuuccgcgucuccugcccgcuagcuugguggggaggggccagacgagacucccgaccugccaccuuacccacccuucgaguuggguccgcuagcaguuggcccggugagccauaagggugaaugcugcauccucggccccaucugagcggggacuccgugagccuuucuaccucgugcccgggaguacgucuugcugucugacuuaaaucccuacugcuuuagagcacgccccuucggcagccaggguggggcccaguccgaaccuggcccucccgcccccaucugccuuuaggucgcuggugaguugggcgccauggcgaauuccuuaagaaaggggugggggcgccagagacagcaagagggaccgugaaggggagaccagccuuccagacaaccccaccugcaaaaaagcaggaacugggugggggccuaccauuccacaggugggcuugggcagcuggguucgccauggugagaggccggcccugccauggagguauagguaggacaaugacaguguuggauggaagugagaacggauccggucaguccuccucccaaagguuaugacuuuuuuccuggaauuuuuuuggucugggugggcuugggcauucuuuuugcuucuguagagcaacacugacagccauucaccagagagcuucuauccccagagaccagauuugcugaaucuggccucuuagcauagacuugggaggccaauaccugggaggcuuggggaggaaaggaacccuccaauaggcauguggagcaggacaacccugauucagacucuaggcucuccuugcccagaaaggaggcaguagugaagagcacccuggacgacauggguggucccaacugaccuuugaugggugcaaggagcuagaaaaaggggcagggcacccagcguacagaccccauguccagucggcugacuggagauggaccccaugaggaauggucucuacagggugacaggugagggaugauuuugaacagcauggagaccucaggcuaccccaccccuuuucccuagaaacucaacugcuggaaaguacaacccaagcuacuuguguguccugauucgcuugcuuggagacuugagaacccaccaucucagaaagccucagguggugaagcugcccaguauacagagaucagacagaaagaggacuaaaaggccucuucugaaugaagggcuacaggaggguaaauuucacugagaaaaugugugccccaggcugaugagaggaagguagacaaagcagaggcuuaaagcguggauggcuuccaccuggacagaagugggcacaggccgaggagagaggaagcauucaaaacugccuccaaggugcugauuggauguugucgggggaaacuggaauuugaaucaguuuucaguagccuaagagauuccuagaaccccuaugaagguaugguccaacaucaagaaugauaaaccauaggaaauuccacugaagagcccaaggcuccagcuaagcaguguauccuccuacaaugccaacaccagcuucuguauccuagggagauggauggaaagcggggugagaguggggugucugaggcagcuguuccccgaguacacaccucucaucagugcacaccccauuucucacacuuccaggggucuuguucugaguccuggucagggauucggugcuucaggccuagcacccugcagucaucuggguagcaucucuacccagcucccuagaggaagggaguaaucaaaauaucugauacccuccauacccacuuguagcuccaguccccuugggaggggccaggagccggaaaucaagaaagaggaacccaaguuuccggcuucucagggacugaacagauaggggugucuuagaaccuucuauggaaggcccggcugcaguagcccugucucugacuagggauucuccacaugguguaaguaaucaggcuugggggagaaggcuggggcaggacucugaccacgcccugaggugggugcacagguuauaaggugggccagcaucacaggcccucagucagaauuccaaccuccuucuuagaucugccaggauccuaugcugcagugaggguccagagcuggcaccacagaaucugggcaacccccuccacucacccaugcccaccccacaugaggcugagaaacagguaggcaccacccauuucuuggguuccuggaccccuggggcucaagauauaaccuuggggacacaggcaguugggcagagacagagggcccagugaauucuagaguggagguugagacagcccucucuuccucagcacacagggccagaggaggcagacaggccucccucgauguccagccaugacgcagcccccucaggaccucccagucgcaaucccugcugcuuaugcuggugcugcugcuguagcugcuccugguauguggacccuggggauacagauugcccugggaagacgucaggguauuugggaaggggaacauggcucguggggagcaaagccagaguaugcaguccuggggguacaugguucaugaagcacagaacggguauguaguccugggagcagcucauauagagaaguacagaagccuggguggcauuuagggcucauuccuggucccguuccccagaccuccagaggcauccaacaaacuacugagccccugccacagcaucauccugcccagagguugcugggccuugugggcuggugguagcacccagauccucuagggugcuuugcauggcucuuccauguaugaauauuugccugaauaugucugugugcugcagacagaccuggugccugaagagccagaaaaaggugccgggacugaaauuacaaagaguugagagcuaauauguggguccugagaauccaaccaagggccuagggaagaucagccaaugcucuaagcggaucucuccagcccucuaacgggcagugugcugggggcauguuauacugcaagagcaagcaaguggcaaucauaugguguccaugcacucaccauaugccugcuuaugccacugagagcugcccagauccuagacugugugcaguagggacacauuugagaagagauuuagauaagggaacagcuggcccuaggcagaaagguauuugagaucugggaaugucugcuggcaggaauacagaagaugguagaaguuugaccaucuuacagcaaucuggcccugcauagacagagggacccaaagugggaucuguuaaacagcgagccgagccaccagggcuguguauaggcaagacacaaggaaugaugugaauggcagggcucgcugaacgcuugagcuguguugucgcugagagagaagccaggccuggugggaacugaauucucuccauaacuuugggaaugagauauacacugugccugcugagcacagacugacagggagaagcaucccuuggaagcaggguucaggauccaggaccacauggguacagacacccugggggggcucuuacaucagccagagccauuguugauauuaggugugcagucuggauuuuucaguggccgcaggagugagcuggaacuagguugaagaguauggguucuaccuacccaaagaaagggaggggugccaggagccugcagagucugacugcugaccaggaaagaggggcacauugguaaccagaacagcaaucugcauaagccacuucagugggggcgguagugggggaugggacaagaggaugugaagaagguucacucuaggagcuuccuuccuuguaacagacuuacuggugcuaggcacccacaugcaaaagcauacauauagcucagugguggguagagaacccaaaugcaaaagguagagccacuuuacuuugcacuaggaaccaagaacggcaacgagcuuggcagguuucucgggaaagcaagcugcaaccccuccccagcugugaagucuggugaguauggccaccauuguguaggcaugcauguauguguacuugugugcaugucucaggccugauauggucuggcccuaaugccugcagcacuccaccaagcccuaaggaaguacagagcugggcacaguccuuugacaaguugaugcauagccccacgggccgcaguguauuccgggcauuccugcgcacagaauacagcgaagagaacaugcucuucuggcuggcuugugaggaguugaaagcagaggccaaccaacaugugguggacgagaaggcgcgacuuaucuaugaggacuacguguccauccugucccccaaggaggugggccagaugcagggaugagugggggugaccuggggagggcaccgccccuccccccugaccuuggugccugccacacagguaagccuggacucccgugugcgagaaggcaucaauaggaagaugcaagagccaucgccacacacauuugaugaugcacagcugcagaucuacacccucaugcaccgggacucguacccucgauuccuuaccucccccaccuaccgcucucuauuacuccagggggccccacaguccucugaggccuaggucauuugucacacagaucuucuacucccaugggcagccuaggggcuggcccuguccaacuuggcuggaaauagacucagucccaguggcaacugcaggguucuaagcuguccuacccugcuccuacugcccaggaaauguucucauggagaacaacacccuuuaggcccacagguuuauagcaggagaacuguuacucccugagaaccagauguaggaccucagagucagacucauauaaagagcccauuuauauuuuauauauuaauuaacuuuaaaguuggaaauauguccuuacuguuuuaucaaaaaagagaccuuucacauucauguguacuccucuacauuccaaagacaugaaauuguauucuguauuuuuuaaaaacagaagccucuguuuaucccacaacugggguaggaggcugaagaaaaggaucaccuaccacaccuacagugugcagacucuacagugugcagacucuacagugugccacagguacuacugcaggcccugcucaagguaugacucuaggaaccagccucaacucuacagugugucagcauccaacaaaggcuucagaugcaaguaaagauuaugggagcaaagcuguuguuauggucuuuccaaagaaacuagucacagugucaucuuaaucuuacugauccaauaaaaccaaagcaccuacuac

SEQ ID NO: 1347 - RNA, 2903 nt, Mus musculus
uggggucuugauacaacuucagaacgguuuccgugucguuauucguacaagacccucgucucucucuaccccccauuugguucuuaggaggagguccccucgagauccucgaauaacuggaccugcuggacgggucaaguggcgcccgacguggagcacgagguacgacugcccuccggacaacggauuaaggauuaaagagguaccgcgcagacagagaaacagugggacaguccacugacacuucacucgagugucgaguacggacgucgggagguaagccuaggcauucaguuguugucccauuaaccauggggcauuuagugaagagauaaaggguucucuuaaggagagagggauaagaguuuuuaaaaaaagggggaauuuaauaauauauuuuuguuuuguggacaagagauguccauggcugguauuaaaugguucugaaacuuagaauaaaguaggcaaagaaaucaauaguuugauaaaacaaggagaagaugucccugaauccuuuuuuaguuauuggggaaucaucagagaucuccuugagcaggcagaaaagggcggaaaaggugcucgccuccuagcccuuacugaagauuuuuuagaaagcucccaaucgccaucucacaaaagcaaaacuaagcugccggcgcacaguaucucuauuagaagguuuagcagaaggcuacuugguacccaauaaauaaaauaaaguuauucagucuguccucacuagaggccaauauuuaacuugaaagucagaguuuguggaagacagccuccuggacugcuuacaaaaucugugguuaaggcaauuucacugcagacauaaaacaauuaggacucuccccuguuguccucgcucagacagcacaagcggcccugagaccuuggcgcgcugucccugcagcaagggcgcuaacuaugccccuaaccaagauuauacaagggccccaagaguccuaugcgcaguucguugccagauugcaggaagcagccgagagaauuuugagaacugaagaaagugagggucuguuaguccgacaacuuacucuugaaaacgccaauucagcauguagggcugcccugagagguaaaaccaagaguuuagauauaaaugguaugaucaagcuuuguaaugaaguagauguguuuucucaacaaguuucuaagucuauuaaccuggccauuggggcugcucuaacuccagcuccaagauuggugccgagcgccauuggcccaaguuagaaguagacaucuguguccucacauugggugcagaugccaccuggggcaccccugauuauuauaugccucaauuaacagcaguuaacacagguaaauuugggcccccuccccaaaagauguuuuuucucaucauuggccgaguguccagacuuuuacaaggccuaauggugacuccuacagugguugacaccgacuaccaugaggagauaaaaaucuuagucuccgccaugcagggacaacuuacucuuagggcuagagagcgcauagcccaagccuuaccacucccacuacucggccauuucccuuauaugaaagaggagagaggaccuuccucccugggauccucagaagucuacugggcacagaaaauaacugauucauggcccaugccaacuuuguuucuagaggacaaacaguuucaagggcuccuggauaccggggcagaugcgacaguaauuuccucaacacauuggccugcagccuggcccuuacagcccacuaaaggaugguguaauccacugaucauaaaauuuacugcuaagaggagaaacuuaggggcuugagaaaguucucgcccucucaccuggggccuaagauuguaucaagauaacuaugacaauggccugaccuuuaagguuccgcuucuaacaaucauaaagcauccauaggacuuccagguaccugccccccuguuccugccccagggugugcuacgacccuguuucaucccacucucccugcguggaggccccccucuuccacugauuuacuguggucuauauuaaaugcuucugcuuuagccuuguuguauaagacacaaagagauaaugcgucagaaucugaagauuguuggaugugcuuuucugcuuccccgcccuuuuaugagggcauagccuuauuugaaaauuuuacccugcuuucagacgcuaggcagcuuccccuugagucaguucagcuuaccuugacagaacucucugggguaagaaguuguguguugggcccaggcaugcuucgaggcccuugcuagagauuugcaauaacacauuuagaguaauuaaaaauggguuuuaaagagacuucguaaaggucaaaaaauucauagauuagguuuuauuggaaguuaagaaaucauuuccuaaaacauauauaauucauuuuaucaaugguguuuuuguugguugcaaaaaauagagagcguuuuuacagauggcuuuaaaauauuuaacuaaguguggacugauaaugacuucaaaaaagauuuagcaugguaaacuuuuaggcuauuugagacauuuagcguauagagauuguguguuuucucaaaaauucgcucucagauuaaauaaauuaaaaguuuuagaugauugccagaaacuguuagaaaauuuuggauuuuaaucuugguuugacaagcuaccucuucuuacaagcaggaaaggaaagaaaggaauaaaagaaaauggauuuuagaauucucccagggacagagagaaaucgggggacgcccuguuuuauucucucuggccccuacaggagaagcucucuacccucuuuugcaccaaucacgucaauucauguauguuuuuugucucguugucuaaaugauuguuucguugucugaaugacuggcuguuuuauguuucaugcua

SEQ ID NO: 1348 - RNA, 497 nt, Mus musculus
ccauuuuuuuuuuaugcuuaccaugcaacaaaaccuuuauuaacauuuuuaacagagguucagcuauuauugaaacuuguaauuucuaaacuuaaauuggggcaaguggcuagagugcagaguaaugccaucacugcccacugggaaugcagaccgaauaauuaauagccaccccucagacggaggaccaggugcagggucgacucuuucuggauguuguaaucagagagggugcggccaucuuccagcugcuugccggcaaagaucagccucugcuggucaggggggaugcccucuuuauccuggaucuuggccuucacguucucaauggugucacugggcuccaccucuagggugauggucuugccggucagggucuucacgaagaucugcauuuugaccuguuaacaaaugugaugaaagcacaaaccgcccagcgcgucgaaacacccucacagaaagaccgccgaaccggacaaagccucucgucacucugu

SEQ ID NO: 1349 - RNA, 483 nt, Mus musculus
uaugcuuaccaugcaacaaaaccuuuauuaacauuuuuaacagagguucagcuauuauugaaacuuguaauuucuaaacuuaaauuggggcaaguggcuagagugcagaguaaugccaucacugcccacugggaaugcagaccgaauaauuaauagccaccccucagacggaggaccaggugcagggucgacucuuucuggauguuguaaucagagagggugcggccaucuuccagcugcuugccggcaaagaucagccucugcuggucaggggggaugcccucuuuauccuggaucuuggccuucacguucucaauggugucacugggcuccaccucuagggugauggucuugccggucagggucuucacgaagaucugcauuuugaccuguuaacaaaugugaugaaagcacaaaccgcccagcgcgucgaaacacccucacagaaagaccgccgaaccggacaaagccucucgucacucu

SEQ ID NO: 1350 - RNA, 52255 nt, Mus musculus
caccauuggccgaucaauauuuaaugcuuggagauucucacucugcgggagucaugucaggggacccugagagccaaucugcuugagcuucugcgugauaauuauucaugggcuccugccucuugcucuuucucuagcacggucccacucugcagacucagugccuuacucagacuccucucucgcucucuccgcggcuacagcuggacccuucuccuuugccuucgccaccacuccgugcgugcacaucccuacaauggcuaaaacagcaauggguaagaaucgcguuuugcuccccacgggcucuaucuggagccaaucucucccuuucucucucggaucucuaaagacauuaaaagauauuuuauaaagggaaagacauucaugacaggaaccgggaaagguuggagggagcucuaagagaccaaagggggaagggugucuuugaaaaacuaaaguaaaugguuucuuuuuaaaagauagaagcagguaaguuuuccuccaauggguaggaauuuuauucugcuuccauauuuaaaacuaaaguguccaucagaggggagggggcuaccuuaacgauuugccuuuagugaggugaagggacauuucggaaagugguuuugaacguccuauauuuauucuguaguuuaaaaagauaauagggacaggaagggagugauguuggaauaaaagagaaaaugcaaagucaaagcggucccauccuggagguuugagagaggagugggaacgggggaggggagugggcacauuuaaugguauugucuaucuuggaaaaaccacuagucuuggggcgcggugcggggagguaaggcggccggaggggugggguaggaccuuagcuccuuuguuuuaggaagagggaggggaaacaggaggagggcguggagggcgcgggugggcagcugcaggggcgggagagcgugcgcggcagggagggguaaagggaccuggcuucccaaggcgccggggugggguuucuuugugugugaagcaauggugggagugugggggggggcaccugcagcgcugggcauacuaugcggacagccccacccugugcagagucaagcuguccccacccggacccagcuccacacccucaguagaaugggggccuaauggggagcucagcacaacacugaaaaacccaacccugcgggaacggcagagccccgccacgccccacucacucauuagcagccugcgugccugaccugaccgcuaaccucagccgcuccacccuggccucauuguucuucguuaacauauuuuucagaaccacauuaaauaggauauuuaaacauaguggcaaaaaaaaaaucaaaaaagggaaagaagcagggggugggggagcuauucugaacuccuugggucauuucggggggaggggagggggcaauuagggaaccuagaaggguauacagaaaauaauacagauaaagauguguaagggugacauaaagcaaaagaggucaaggucuuuaagaugagccucgugcaauuucaauuuugugggucagacggagccaaaucuguaaaaccgcaauagaguccagucuagauccagugccaucguuccgaaaagguccugugcuuguuucccuaggguagacagccugggaggggccugcacuggggaagcggcuagaaccacacacacacacacacacacacacacacacacacacacacacacacuagaucgagcuacugaugcagagcaggaaaaaggauauggacuggcuccacccugcccugccccacccugucugcggagcccugaagacucaggcuccaggcuggcucccacgaacuuggguggggcugcugaacagucugcaguccgggcaccccucuuucuagccccgccuuccagaacagccccaaaccccucagggugugcacacaucugcccaggcucagggucgcaggacuaagccccucccagcggauagaggcugugcagaaaggcgagccaagccuggccgcacaaagacgcagccgcgcccugcugggccccuggaccacagaggugacccccuucccugugguucgggaagguguccuugcccaugcagaauccaaggaccuuuuucccaagcccaagcccauggccuuguguucugggauagagaccccacugaggguccuccaauggggcguggcucgaccccaccccucguugcuacaaccaaagccagugagcuuggggagcaagcacguggcgaucgcgcguggacccgggccagcccugcagcucucgccuuccucucggaacugggcucucgcccccacagaguaucccaggagaggguucugcgcaguguccugagcuacucucgguugccacaauuugcuaucaagucgcuuguccagaaggguucugaugggguuuggggagauuuuccugcucugucugucccacggagagguuucagcugcagacgacuggcuaguuacuccuugugaccagaauugugauuccuuagaaaucaucaugauuauuaguccaagacucacuuaucuccucuuaagucucauuuguucaaaaaguaugcuggucccuuuugguaccgauuaaccccuugccacuaaucuuccugaucaucuuugccaaccuccauccucuucccauacacaaccacaaaacaauucuaucugcuucuguccauuucaguuucuauaaagcagaugcauuuugacuucccguugcuguguuguauguucuugugggugggaugugugcgcugguacuugcuaaggacagccuaugcaccagaugaucgcugggaaauucuccacagagaauuguuuuuguuucaaugggcaaaaauuauauauaacugagauguuaugccccuccacaagaggauacaacacauacauacauacauacauacauacauacauacauacauacauacauacguuuaugcacgcauuuuuuauuguuuccccccaaaaauuccucuuccaagugcuuuuugauacagucucaauucuacccagaaaaacggaucguaaaauggugaccaccaaccaaugaaacucccaccccacagaugacaggugccaaggucccuucugccauaauuagaccgcacuugugaaagugagaagagacauuaccuccgcagugaaaagggugccguuuuggguuuuguuuuuuuuaaagcaucccauugcaaaggguaaucaauuaaucugcaaggacagugcuuuuucuccugauucauuaaacaaucuauguauucagcauguuugcucuaaguacauauuguaccgcccauuaucuucucaaaugggggcacaguauaaacuaaagcauaaacaauuagaaauaaaaaauagaagauuuuaccaggauuucaggggggaaauaaagaaauaaacggagcuugauaaucaauuacaaauaucuaagucauacucguagaguggguggcaguaagcaggguucugcccugugaagcacaucgucaggcucuggaacaaugaugucuaucauugaaucugugguguuugccugcacauguuaaaaaucuaugaggaaaagcauguuuuuaaaugaccguuaagauucgauucguuguagauugaaaaauuaaauucuagaccucuguuucaucaaaauuccuagcaguuuugcacugacuuacuuacaaacagauuuguggguuguuuauuuuuuaugagagccauugcuucuucauuagacauuuuuuuuucuauaggauuucacuucuggcauuuaaauguuaccauuacuuuuuauuuaaaauuuuaaucgcuuauggauaaauaguaauuuggaaaaauaaacauuaggucauuuggcacgauaugccuuucaucaaauaucugucaguuuaaaaaaaugcugcaagaaguuccauuuuauguagacucagaacaugcccucucgggaugcugguucacauaauaaaauaguuuccuuuuguaacuuagaaucaaaauaguuacuugguucugaguugauuuuauaucuaucaagcaagauuuuugcauaaaacccagaugacuaacuauaaaauagaagaugaauccauauugucuuuucaaugauaaauauaguacaucuuuagggaaauugcuguuauucuguccauggaugcuuuuauucccuuaacugagauaaaauguauguucgugucacuccaguagcuaguuguuugugaaaggcuaaauaaaauuggucucaaagcauguggcagcuagcugcacaaacccagaccuggguguggucagccccacagggauaguuaauccgaagcagcuucccaccagguuuuuuguuuguuugcuuguguuuguggaaaaacacgcacuguuguuacgauguaaucuguaacauuguaugaaugucugauccacagaaaacacucaaacccaaaugcuuccagaaccgaagcuauuugccuccuaguucuugcaauugggagaccauggagucugcacuaacuuuucacaccacuagagggcaaucaaugucucuaugauugauuuuaaccaggcuacaaacgcuaacugcuaaaaauaaauaaauaaaauaaaauaaaaaguuuucuuuuauuggaaucauucgauuguugauuuaauagaauaaugccaugcuuugcucuugugaaugagaagggcaugcacauaucuacagugggaugagagauugcaaucuacaaguuggcagagccccgauaauuagucccucaugaucuuuuuuccaguuccauuacagcauaauuauuauaucauuuauguuacuucugggguuguaugguacauaaaugguagaaaaugucaguaguaauagcaaaauuauuuagaaacagauguuuuaauuuguaaguaaagacauaaauuaaaaccauuguuuacugauucauuuauuuaaauaugccccaugcuaggaacagcucuaaugucagaagcuccacccuuaaaggaaacugcaaaaaacaaaacaaaaagugagugaagcaggcaggaaaacgugguccugaggagguguggccagccuggcagcagcugcucuccaucuucccuaaggauaccuuuucaaaccaaaucuaaugggauuuccauccaauuguugugcauguucaacaguuaugauuuauauaugacauauuuauaaauauauacaauuauacuugauaauuguugggaaaugacagaaaauggccuuaaaaccuucaggaguuuuacuaguauaguaaauaacugauaccaauuuuaaagaaaaagaaauauaugaguauaaauuaauuguaaugauuaucaaagaaaaucguuucaauguucaauagaagggaaauuauuuuuuauauacuuuacaaaacuauaauuuaccuuuaagguguuuaauacuaucauguaaauauguuucucaaacucuaguucaguucucauugcaguuuagauucucugagguaugacugagggaagaggcgccuucaacucugacaaccugcacccugaugccaauuccagccaucaaguuaccacuguuaaaauagagcgaugaugagcaugugccccucagaggaaguccacuguccugaugagcaugugccccucagaggaaguuccacugaugaugagcaugugccccucagaggaaguuccacuguccugacuuuuaaaucuguggcaauggauuacagaauauuucacuuccaaacucauaugcauagggauuugauuccucugaggauauguauucugugccaucacucucucuuaauuagauuguuuaaaauauauuuauauuacaggacucaacagaaggccuuugaggaaaauggugggagaaauaagccuggcucugugaauaugugugugggugggugggucugugacucaguuaagaaaaauaggggacuuucaggauagcauuugaaauguaaaugaagaaaauauccagaaaaaauuguuaaauaaaaaagaagggauaauauauaauaugauauuacugucacuuacaaaugauacacagaacagaaguuaaaaccagaaccuuuuagaugcaggauaaugcacaaauuacuagacacuuaacuccauauggggaagaaaggaaaacagguuaaaaucauacugaaguuaguguaugugcauagauaguacuuaccaaauuauuccaacagagcauuuaauccuagauguugcaugaaaaaauauuaagcauucacuggguuauaaggaauucacuagguaugacccuauuuuggaaaacagauuagguuugguauggugguggcucaugccugcaaaucccaucacucaagaccuaaagguaggaggguuuuagguucaaggucaaccggggcuauacugugagacucuaauuuaagccaaauaaguaaauaauuuugcuacuuucuuaagucaauaaagaaccuccauuauucaucauuacuccucuaaggauguuggucuagaaggggaauaaauaggucaucaaggaauaucauuaaaaagaucauguauccgucucccugugcagugaguggcagggcagagacaugauacacuucuggaaacucuguccugcagcaaugauacuaaacacacaaugucucaaagacagcguuaaaaccaggaucccaaauaacaauuggcccaggcgguugguagacuacagggacagcccagaacugcaguaagguuaucuuuuguuuguuguuuucaguggguuauuccaggacuuuccaggucucuggaagcuggaaacccuuagauugguaguucucaaccuuccuaaugcuaccaccuuuuaauacaguugugguaacuguacauugugguaaccccuaaucauaaaauuauuuuguugcuacuuuauaacuguaauuuugcuacuauuacuaaucauaauguaaauaucugcuaugcaagauguccgauaugcagccacccccuaaagggaaugguuacacauagguugagaacgucuauuuuacauuguuauaguugcuaaucucuuguuuuguuuggugguuguuguuuuuguuguuguuguuguuucuguuacuguuguugcuguuguuuuauuuuuaagaaagcaaugcuaagacagcauggcagagguugugugugaaugguuaauccuggaaguuuuagaaauaaaaauuagagauaauagaaauguaaacugaacacaugaacaagaauauguuaguucuguaauaacaauuuuacugcaguguugcuuuaagaaucauuguucuuagaugcagacaaacugcaucuuuuaauccuugcauccaccccagguauuuaauuuuaaucuuuaguuuaugaaagaaacuuaaaucuaaaagaaauacagccuaggcaucuacauuuaauaagacuauauauuauuucaagucuaucuuacuaguucaaaagcaaacgcgcaggagagagcugugggaaagcucugacucccuugugagaauuuuuuaauuaucuuuaauaaaagaaucuggcccugucauuugucaaggagacauuugcagcaguaaagccaguguuuauaauaacccauuuucauuagucaugauuaaagauaacauuuuguguacauuuguuauuaauugaugcaucucggcacuccuggcacuggucacccggacuacgcaugucugagauuugugccugagagaaggcacauggaugcuguaaaacagagcaaaauccuuagcaaaguuuuuuauuuacaauuuuguuuaccuuggggaaauuauaaguuccaaaaucugucuuugauauaaagcaggugaguaauagggcugauuuguuucagugauagacugucugaguuucccucuuugcugggucauuugcagagccuucagaaguucccacuuaacaaucguccuucugcaaccauuauacuuggggucuuaaagucugugcuauuuucucuguuguccaagaacuaaggaacaacaaaugguugacacugugagccaccgaauguccuucuaucaaaaugaacauaauugggugcaaucucuuuaaaucuuuucuccaaaauacauuuuacaacaaauauucugaagucuacacuaaauuuugauuaguaauuaccuuguuuuuaaaaauauuuuucuauauugacaucaguaacaaaguuucauuucuaucaaauaaaauugcucacaguuaaccuaguuguuuuccagcugaauuccuuaguaacagaaaccgaacuuccaugggagauggggugggggggcuaauugauaagauauguugacuuagaaaauugagaccaggauacaccaccucugguaucagggaguaccagacugguggcagccuccaggaacgcgccucgggacgcaguucaacaugcagcaauuuguuuuauuuccaauacaaauaucuauugccauucuguaacucugauagcaaggcugcagcugugguuauccccuccugauuaccacagugcaaacgugaaaauuacugcagucaauuaaaaucucuguggcagaucacaaaacccacacugcugucucucaaaaaauuguuucuccuuucuccuucaaucagaauucuucaauucuuccuuuuauaauuuuuuagaaaaaaaaaagcagauaagcccagaagauuagaaauuguuuggguucugcuuguuuuguuguguuguguuuuguuuuguuuuguuuuguuuuguuuuguuuuguuuuguuuuuuaacagaugucucagcaguuaagagcacugguugcauuccuaggggacccagguucaauucccagaacccacaggaaggcuaacaacuccaguacuagagggauccaauguccucuucuggccucuucaggcacuagacacacagguugaacacagacugacaugcauacaaaacacccauacacauaaaccaaguaucuuuuuuuuuuuaauuagacaguauaaccugucuacaugagaaaacauuucaaaaaacauucauuuguuccaaacguccuuuuuuuuaauguucuuuuuuuuaauuggguauuuauuucauuuacauuuccaaugcuauaccaaaagucccccacccacccacucccacuucuuggcccugucuuuccccuguacugaggcauauaaaguuugcacgaccaaugggcagcucuuuccacugauagccaacuaggccaucuucugauucauaugcagcuagagacacaagcuccgggggcggggggggggggggggguacugguuaguucauauuguuguuccaccuauaggauugcagaucccuuuagcuccuuggguacuuucucuagcuccuccauugggggcccugugauccaauagcugacugugagcauccacuucuguguuugcuaggccccggcauagucucacaagagacagcucuaucuggguccuuucagcaaaaccuugcuaguguaugcaauggugucagcguuuggaagcugauuaugggauggauucccggauauggcagucucuagaugguccauccuuucgucacagcuccaaacuuugucucuguaacuccuuucauggguaaaguuuuguucccaauucuaagaaggggcaaaguguccacacuuuggccuucauucuucuugaguuucaugcguuuagcaaauuguaucuuauaucuuggguauccuaaguuucugggcuaauauccacuuaucagugaguacauauugugugaguuccuuugugauuggguuaccucacucaggaugaugcccuccagguccauccauuugccuaggaauuucauaaauucauucuuuuuaauagcugaguaguacuccauuguguaaauguaccacauuuucuguauccauuccucuguugaggggcaucuggguucuuuccggcuucuggcuauuauaaauaaggcugcuaugaacauaguggagcauguguccuucuuaccaguuugaacaucuucuggauauaugcccaggagagguauugcgggauccuccgguaguacuauguaagauagagaauugacaaaugggaccucauaaaguugcaaagcuucugcaaggcaaaagacaccgucaauaagacaaaaagacgaccaacagauugggaaaggaucuuuaccuauccuaaaucagauaggggacuaauauccaauauauaaagaacucaagaagguggacccagaaaaucaaauaaccccauuaaaaaagcugcauauguaucaaaagauggccuagucggccaucacuggaaagagaggcccauuggacaugcaaacuuuauaugccccaguacaggggaaugccagggccaaaaagugggaauggguggguaggggagugagggggagggcaugggggacuuuugggcuagcauuggaaauguaauugaggaaaauauguaauaaaaaaaugagucucagagcuaaacaaagaauucucaccugaggaauaccaaauggcugagaagcaccuuaaaaaguguucaacauccuuaaucaucagggaaaugcaaaucaaaacaacccugagauuccaccucacagcagucagaauggcugagaucaaaaauucaggugacagcagaugcuggcggggauguggagaaagaggaacauuccuccauuguuggugggauugcaggcuuguacaaccacucuggaaaucagucaggugguuccucaaacauccuuuuuuuaaaaucuucauguaauaccugugcuuuggacauaguauagaagucaucuguuaaggacuuagaagaauuuacucagucaaguguagagaaagcaagcccagguagccaaggcagacauauagauuagauguggacacaaaacuaauuacaguuagcacuuaguccucuguccuaaaauccaacaugcaugaagauuaaaacuacaugcuagguauguuugccugcaguucaaaagcauugauagcuaacaccacuaagaaugacauuuaacagcccuuacacuaaaaauuaccuacuuuaaaugugugacuaccaacucuguucagaagccugagguuuguauucuaaggcuauaaaugagccugcuccucacucuacaguaauacgcuauguuaaagauaccaagaucuuauacauacuaacaaaauagaaaagcaauagcaagaguuacaccugcauagaaggcuucuccccuuucgcaguucuguuguaacacccaaacuaucugaccagcauaauaaaaacaucgaugagaaaggacugagucaccaagggcugcaagcugguuagaauccuuuggauaaaauguuucucaggucuuccugagcauuggaaagagucucuguucugagugucggaagcuggccccaugaauuuucauaccuaacaagcuacuuguuuguauugaaagugauuguaagcaaauacaagugugacuggugucuaucaaguaacugcauaaaugcaagaguuuguguucucuuaucauuagacauaauagcucgcucugugugucugucugugugucugucugucugucucuguucuguguguauauuucugucucugugucucucaccaagucucugugugucucucucuauguguaguguuuguguguguaguguugguuugugugugugguguugguuuuguguguguguguguguguguguauuucucauucuaaagcccagacugaccucgauaugccugucauucaagcugcugggauuacaugcguagacuaccacaccugguuaaggggauuggagagggaagggugugucauggguaaaugccaaugagcuuguauuuaaaauaaguaaggaaaacaagaagcacagucuaaaucugaagucauuugcuuuugaaagauacauucaaaauaaugaaaacugagcuaaaaugcuauugaacccuucagcaacagcagggacuacuuugagggcuggauaucagaacccugcugagcagccuugagccuucuucuugagaaguagcaaugaacucaccaacaggucccucuguauccugcugccuaaccuuucuaaaccuaagccuuuucagaagaaggaaggugguggggcacucagucaucugagacaaucucugggcccaauacagaaaccccaaggagcaggcaggaaauaugaaagggacgagaagaaacagauagaacuccacugcuucgucuucugucucaccguucccugcaggcaucaccucgcucuaccucggaggcagucagaucaaauccuaaucagagaaaauacccagguccaggcccauguguaccaaaagcuuccuuaaaaacugcuuucaagagagcuauuagaaauacaaagcuccaaguaguaagagagaacagaucagcacaccagacaucaagcccugcagaaaccaaaacagaagcacaacacuuggacagaaacacagcacuucaguuccccaaacaugcuggggcuggaccagguaggaaagagcugcugcaggguggugcacagguugcacggcgcugcuuugacccugcucugcucacagccugagaagcccugagcaaauugcucauugauucuacaguaguaauacagaccucaccauuacaaaauagggaaauaaugccuagucacgugcugcucacugagaacauuagguaagcaacugaauacuuagcauuuuacaguuuacaaagaaauuagucacauucucugacccccugagccacucaaggaaagacuaaauaaaaauaauuuuaagauuaaacaucucauuucuuauguuaauuuucacacauagugacaaccuauuggaaaguacuugcaacuguugaaauguucgcuacucaauaauuuuuuauaacagaagggaaauugcuauccuauacagcagcuggaguaguaaaaucuccaagacaaauucauaucaagcaaggccagaauuuaauaguaaaugcauuccaaucugggucaaaguauuauuacaagaaagauaauuaaaguaagaguguuuuuguaacauuuuuucugccacauuuuccuggcacuaauaucucauccuacuugaacaauguaggugacaucaguauaauugagucuucuuguagcaggaaagcuuaucaacaucagaugucaauuaacacacacacacacacacacacacacacacacacacacacacuucuuuuuuuuuuuuuuuuaagauuuauuuauuauauguaaguacacuguagcuguccucagacacuccagaagagggcgucagaucuuguuacagaugguugugagccaccaugugguugcugggauuugaacuccggaccuucggaagagcagucggguacucuuacccacugagccaucucaccagccccacacacuucuuaaaucacuauugauccaucgguuuccuuacaccccagcucucuuuccugcucagucaucccagccccuagucuccuugcgguuuaucaugcuuccccacuucaacuucuaaaauccuugcuauuucucaaaaaaaucaauauauaaaaacacaugguauuuaaacaagggguugauguaacucuagauacacugagaaaaucugcccucauauuuacaguauguuucagauuagauaguccuuauaacaaucuacucacaaucuacucaauacucugucaaccucacacauaggauauacuccuaccuucucauaaucaaggagucauuaaaaggaggagagucacaugggagcaacacuaugguucaaauccucucaaggucauaacuacugcaaaaagaacuccccguugcuuugaaaagauguagccauuuuuccugaguuugaaauccucaaggagagucugaaacuucacaggaugcuucauuugauagucaaacaaauaagaugaaauucuguauuuaggauaaauuaauuuuuccaaguugaagacugccauggagggauuaagcaauuuugaaaagaccuggauuacauuugucaaaaauucccuggaaaugagauauaaaaaaggagcaaaauacacaauugcagugugugcugucagcuguauuacagcuuacagaagguaaauucacacacagacaugcucacauccacacguacaugagugcacacacacaggcacacaggccacgugagaaagaacacugagcuccuguauccagcucucauggugguaacaaugucaaaacuccccauuuaaauagaucaaaccuggaagccauugcuucugaggaaacccauagcuacgaugcucuucugugagaucacuuuauaaacuuuaugaccaugaagacacagacugaagaucauuagcuaagauggcaaagaagauuucucacaguugcuguagcucucccugaacagacuguggcagcuuuccacgccacccccaagccagcuuuccuugaucuuuccuuccugugaacucaagaucaucuucugacaaauuugucaauucgccauaaagucuccuuauacguuuuuuuuuuuuuccuuuccucuucccuaucauuuaguguucaccaggaacagccucuccucugccuucugggcucugcaauguggaaugcuuuuccuuuuuauaucagcauaagacacuucuuucucuuguuuuccagucagccuggguguuaauuggagccaggcauguuucucuacuuuaucuucacuauagcagguauguucuuugcagaacuacuuaggucgaacaugcacagacccuuacuauguuuauuccugugacuguacuaagaaccuuacuaggaguaucaucuacauucuaacaggugagaagaggauaagcaaaaggggguaacuacagaauuuaaaauaaaugauguugauccagagcccauuuaguuagccucaaccuacagucuccuugaacaaaauguagguucugauuguauuugcuaguuuugugguaagagugaaauaaguuauagaagcauauagugagcuacaaacaaacaaaaauuaguuaugaaaugaggguguuguugggaagaaaacgugguuuauugaggaguucagugaaaggauuuagggaggaaacugucaaugcacacacacagauuuaauaaaguaaugaaagaauguuucuuaaagaagaggaauuguaagaauugaauuuccacauccuuaguauccucuuucuauugcuguaauaaaacaccucaguacaaacaaucuugaggaagaagugguuuguuccguuuguuuacagcucuacaucacagcgaccauugauggaugucaggaaaggaacauggaagcaggagcugaugaaggaccaugagugcuuaugugugugcgcucauguacauggcuuguucucauggcuugcucagccugccuucuuagaucaucagaaaccucccauccagggguuucacaacccauagugagaugacccacaucaauccuuaguugggaaaguacuccccaaggcuugcccacaaaccaaucugauagagacauuuucucaauugagguuuccucccaaaugauucuagcuuguggcaaauugacauaaaacuagccagcacauuuagguauaacccuuuaaagugucaaaaaauaaagaacaacuuguugaugauuaguuuuuauuaguaauaugucaacaguucacugucucaacacauugucucaccucauucacugcaauaauauucgacccccauuuguagacaaacucaaauucagaagguauaauguuaccuuagacugacaaacucaaguucagaagguauuuuguguuaccuaagauugacaaacucauuuuuagaagguauaguaugucaucuaagauugguuagauccagaacuggaacacaagucuugaguuccaguuaauauuuucuucauuacucuagaagacuauuugcuuaccucuaguuauuagugagggcagaagcaagagaacauauaaauaaauaagagaagaaauauuucuaugucucuuuuuuccuuggcacaaucagcugucugcucuaagaggaugucacaggaaagguuucagaaaacccaucuucuagcauuuuucaaagcuagugaacuucaaggguagaagccaaccccaccaugcuauuugugaccucuggacuguuaaccuccaacuaaacucaguuucuaggacaacugacaaacucagcaucuguugcuuacucaugaaugacagccccucccugcucagcaaccaaaggauaagcauuuguggacaucuguuaacugaacgaauguucagaggaauacguguaggggaauacagaauauacuacaggagagacacccucuccacucccaaaaaaugcaagguugagaaaaaaaauaaguaaacaaaauagaggaaaggggguaacuuggucaggagcaagccaggaaagggggucuuuccucgaaaagccaaagauacuacaaagccuuugaaauaggaagcgugauguuugaaugacauacacauacuuaguuuuggaggcuacaugacauauacaaauggucaccacauucuacuugauagaccuucugucuacuuaaccaauuauaacauagcuggauuucaaaacugugaacaauauuccaaugaaaacccuacuuuugagaaaaauauaaauaaauaaaucuagggugaauagaaucuaaagaacaaacauuguauccuuggguuuuugcaucaccaacuggugauauuuuuauaauagcacauuaccaugccaaauuucaauucacauuuauaugugcaaaucaaauguuuaauucuauuuuuauuguguuuuuaaccaaugaacagaguauuugcugccacaaauaaauuaaaauccauaggccaccccagucucuccaucuaguuacacuagcagggaaucuucauaucguaagagugacuaucagagaguuccagauggcaugcaaauggcuuauguuuuauggaucacuuucugccugugaggaagaauauuugaagccaaaaauagacuuuucaugaagcauuaggaaaagugggauaugcccugaaaauuuaacaacuugaaaucagagauauggguugcuucuugaaacauuuguugccuuagauaacauucacacuaucacacacacagcgauuaugaaacacaaagauccagaaagaagaaaacauuuuaagacauaaauaugaacauaaaacuuguaagauuuucuuuauuauaacaaguuuauuuauuauuaagauaaauguuaucuaccuuauguucgucuaacauaagguagauaaaggauguuuuuacuucagaaaacaaaguguauguaaaggaaagauuauuccauuuuaaaaucuauugaguauuuuaaaaccaacuauaaggucagccaguaguauguggagagguggcuuggucuguucaaguucugcagaccuuuagauguagucuaguggcagagcuugaucccgggagcaagacagggguagggagauaaggaaucuucagucaugaaaaucucccgaagcucaguuaagacacucuccaccucacagcuuauucuaccgaccuccaacaaggaguccauccauaccaacagaaaccgcacaagaguaggaacuccguucuacacauguacaacacuaaagagaaacgccacugucaggcaggcugugugacuggagaccguggagagaaaguguguguggacacggcagggaagaagcagcagugagcagggcaugccgggauccauccuccggagcucaugucaagggaggcucucaccuucaccucagagccucccuccccccacagagagacucccuugacagucugccccaaguucccucgagauuuauugacuacagguguagucaauggauguggaaaugugugauuuaaugugauacuuuaacauauuuagacgcugugaaaugguaaaacaacaacaacaacaaaagacuaaucagcauuucccugagcccaugcucaccuucuaugaauaugcuaagaacauuugcaaucuaccccagauuaccaaguguauaauacuuuauaauaaaaauuccuaaaaugguuuguaaaacaagauagcccuaaccuuugacugcaucaguguucucugcuuggguuuguucaugugugcauucaguguucucuugaaacacaaacuagcaauaaaguguaaguguaacuaacucauaggacuugcuuucuuuaagacaaaucuuuccugacugcugcuuaaacacgccuguuugcauaagcauaguauacguaauagauauagacacugccugcacacauagacauagcauaccugcagacacugaaugcacaccgucagugacugacuagcacuaacucugaugagugugcuuuggagauccagcugcuggacagcacugaguaagucuguguacagggcauuuuauacaguguccguagagacuuuagucuuucucuuauguuuggagaaacaggaaaugcggucuuucucuuauguuuggagaaacaggaaaugcggcuggaucucgcgugaagcuccuguggcucgugccuggcaugguuuugccuucugcuaaugacuaguaagcacaccugcugggauuacaauuuaaauacaacuaccccgacaagaagucucuuuggugcagguaucagggauguuauuuggcaauaacaccaaauuaaaauacuuucuauucacaguugauauuaacacuagcauccacuagcauggaucuguuuugauguuguugagacagaucuuacuauguugcuuagcuggcuuggaaccaggcuggccucaaacucucaaaagucuaccugccucugccuccagaacacuaggauuaaagugauguaccgccaucccuggaaacagcauggauuguguuuuccaaauaagcauuucaaauuauaaagacauauaaaaaucuguguauuaaaugcccaaaacugaagauaaucacaaagugguuuuuuuucuaucagguaaaaaaacaaacaaacaaacaaacaaaaaaaaaccagauaaguguuagucugucuucagcagauuugcuucugucugucuuuuucuuagugacuuugaagagcauaucucaaggcaaggauuuuuuuuuuuuuaagauauacucagaacuaaaauagguagcauaaagccauucagaugcggugacacuuuauaccaguucaaguggaggcuugcaugcaagcacuucuagaaagauggauugccucaccuuugggaaguucuuagaaugacagaggagaucuguugaaauggggcugcagacugcacagcugcugugaccuuuccuuuacuugacuguuucuucauauucaaacauggccaccauuuaucuagggacuaggaagggaagaaccuucagugcucacaauaagcaaaauaaagugcuucuaagauuucuuuaaaucaucguguaucuugaccuccguggaccuuaauaucuuuuaccgggggaguuuuaagggacaacuccccucacccugacugcagaacaaauuucucauuaaacagugcaggagcuguaaagggucaagagacacaguaugaguuucccaagugauauaauuuacugcugcugcaguuuggaucagaaccaauuuacagcagcccauuuccuucccuugucgcuauugcuggagccgagaauccacuaaauuaacauuuaaaggcuucagguaauuuuguaagacccaguaauggggucuacuucuuugacucucuuacaugcccccuuuguuugaugugagaguuuuaaccuacagagaauacuggaaugcgcugacugaucauaaugugccucuucacaaaccucuggcuuuggugaccguagucuccaugaguagggauagguaggaugaaaguggcaugaaucuaauuuuacacuaagcuuauuaacauuacgucauccuagcagaaauagcuagaaacauuaggucauaucagugcuuuucuaagguacuaaaauaaggcuuuagaucuagggguuacgugguuuucuuuuucagcaauaaauguucaguuauauguucaucgauaaaguauuuuaauugucccaauuuaaauuaguguuguauauagaacaaauacauacuaagcauggguaagcaaauucauacuagccuucuucuuuguguguguggcgucgugcgguagaugccccuguuuguuaggugugcaguaugcaugcacacgugugcgcaugcauguugaggccagcagucagcguugagcaucuucccuugauuccuuuccugacuuguuucugagacagagccacucagugaagcugaagcuuaucaacuggacuccgccccuggcugcaucggcuucagggaugcaccagucucugcuccuccgaacauccccgagugcuagaguuacaugugccagagcugaggcuccucaagcuugcguagcaggugcugcaguugcugggguauccucaagcccugucuacuucauuuuaaaacaccacaggaagcuucuaaguccucuuaauaagggacugcacauguagcucagcagcacagucuuugcguaucccaaauuaagguguggaucgcauccccaauaccacaaaaacuguccuugguggcacuugccuauaauccuggcauuugccuggcgacagaggcaagaggaugaaaggcucgcuauuaucguuggcuacaaagucaauucaagggaugccuaagaugaugaggcucucucugccuuaaaauauaaauaaauauaaauaaacaaguaauaaauaauaaguucugagacaaaauggcacaccugaguggaguaaauaaauaaauugaccuaaauuaaugugaagugguggaccacugugaaaagugcugaauacauaacuagcaugucaggguauagauaaaauaagcagcaggaguggaaauaugcaaacauuuuaaaagaaucaaaaauuacugccaaguagcugauuccuaccucugacaagaucugaguguggggaacggaacaggcuggcagaagcagggcuguggucuuucuuaacagucagggcuauuagucuagaucuuuccagaaucagcuagcagaggccagggcuugucacauugucuaucuuccagaggugguggcacacaccuuuaaucccagcacucuggaggcagaagaagguggaucucugaggccagcuugaucuacagagcgauucaggccagccagcuuuacauagugagaccucaccucaaagaaaauuaauaaaauaaaauaucuuuggaacaagcuacaaggacugcugggaaaacaggauuccuaguuaggcagucaagcuucauuugccuggaaaugacagaguccuucuuuuuuaaaagcaguguuuauuuaucacuguuuacacuaauuguaagucauggucaaaaaauguuguucuuucuauuagaaagaaaccaagacauccaauugcuauaaauugugugagagagaccuugacuuugcauucuguagugccuuguuuugucucuguccccagagaccuuccuaaagaaguacacguugacuccauaugggcauuuagaacuugccagcaaacucucccuacucaaccaacauguucacaccugaagcccacacaaggaagagccaggaaauaggcaggcugaccccaggcuggccccaggucugccccagggugacucaggguguucuccagccagccuagagcagccuagaggacagccagcccucuguauaacugugcccuuacugucaacaagaacagagugaagaucggggaauucagguucuggucucugacucucccuaacucaaagcucaguuuccuguuauuaaguuaugcuuucaacucuuauuaaauggcccgauagcuaccgugguuuugugaacugaauucuuagaaggcaagucgucuuuaaaaauaaaaugcuggccacccauauagugaugcuggaggcaucugugugcuccauaaucauugcaaaauagcuuaucaauaaaaugauaguuaugggguagggaauaaauaccagugugccaggacagacaaguaucccaaucagcaaaagcaaauaaacauuuuucucauuuguuguugaaaacauuuaaucucaaugggggugggggugcccuacuuuugaucauucauuuucuagaaaaaagacacacaacuuuuauuauuauaagaauccuuaaucagcacuagagcugggcagauaucuacccucuauacuacuagaaucuaucuccccacuaauaaccccauguuauaauuugccauguucuaccugggcagcauuuaacuagaauuagccagcucucaaggcuguuuucaggaugcaccuacgucauggcagcuuugucuuucucuauccaccuucucuuccucaugguccuccucagaacccaagccaggaaacucccaagcccaccuauaucaacucugcccaacuauaggcaucuuuuuucaucaauuagggauaacuggggagggggucagggucacauagcacaacuaggccuagaggccagauauuuagcauuaggauacauagcaaaaaaccaaaccucaaaacucauucuucuaagcauuuaucacaaauucugagcucuaagcucacacuuuuaaauacauuauauauguguauaugauauauauacauauaucauauauauauuauauguguguguauauauacacauguauguauuauauauacacacauaugucuauacauauauaugucucaguuaccugucugaauuggcuucguggauccacuugucuuugucccucugaaaacaacccugaguguuagaguuacaaguauaaaagcuuuuaaaaauaauauuuuaaaggagauaguuucugcuaaaguaguauguugacaugugacacuucuagaauguucuguucuggaacauaugaagauauguuaggaagaaguauaauacauauuacuccuuuucacguugaauauuagauaaaaguaaggacuaagaugagauuuugcccagaagauauuucuauaaggcugccaauuccaaauuaaauaacaacaaaaugagacauaugaaaugucauauuaaugguuacucccacauaagccaaaugaaguggaaaauugaaaaauuuuaagccauuuacuucuaauugucugagucuuuaaaaaauaauggaguauaacauuauuaauaauguauauuauuuucuacuuaaaacaagacauauauaguuaaaauguauuugaaagcuugagaaaagcucagagucugugguauauacauuuagaugaaugggagacaucuucauguguucaugcuguuuucuaaaguaaaccaaucuccacgaugcuuuaaucuaaaauaaacucuugacugauuauuaaauccauauauucuuuugaggaaugguccugaaguuuccacuauuuuauaucaguauuuauuauccauagacaauuuacaaaucaaaaaguguuguauuuucuuucugcaaaaucauccaaucauccauagaugauuggcauccacagauucaaucacaaauugaaaauauucaaaaagucuuuguauuaaacauaugcauacuuacuucauauagauauuuccugaacaauagcaaauaacaaauauuaacuaacauaucauaauuguuaaauuacuagauauguaaauaguugagacaugguuucaaguauauaaaaauacacacacacacguaaguaagagcagauagacuauauauacauauaugcaugcaauaauaauuagugaaaaagaagcuaugauuuugacagagcaaagccaguuuugugggaaagauugcagggaagagaagaagaaagaaaugucaucauauuauaaacucaaaagcaagauaaacuuuagaacuuauccaggagaaagacucacaaaaaaaaaaaaaaugaagcuaaacacagguaauuggcaaauacuacacccuuucuuuaaggggcuugagaauccacagauucugaugucuccggaagguuccaaagcuugucccccaugcauacugaagaaugaccuuaucuguaccuguguaaucaaugacuuguguaugggaaguaagggaggaaaugucagaaaccaacaguuuaugaguuuugcuuccuuaguuucuuguuggaaacauguagacagugaaauuagagcaaaucacauaacaacuugcugggaaggugacggggugaaacucaguggugaaguucuugccuugcaugcacagaguugguucaacaccagcauggguaugugugugugugugugugugugugugugugagagagagagagagagagagagagagagagagagagagacagaccugcgaaacaaucgacaagaaggugaauccaacauuaaaggaugggagagagucagaccuauaugaaaacuaaauaugccacuuuagcaaccaucaaaacugcagaaugcauuccacaccucugagccucuucuucccuuauaaacuuggaccuuucacagcacuauugagauaguuaagcaagaaaugucuaccaaugcuuuccucaguucauuguuugugcucaacagagagcaacuaguaccauuauucacaauuuauuguggccauuuggaaaaaauaaaguucauuuaguguucauacaucacuaggcuaagagacuauuacuauauaauuguuauacucucuguggguugaauuuuaaaugaauucacuagacaaaugcaccuauuuguaaacauuaguaguuaauaauguuuaccaacccaucacuguaaaggaauauaagaaaucaccuauuaacucccacauucuugcaaagaugcauucaacucuaccuggucuuaggauaugguaaaaauauuaacauacauugauuccaaaaugcaagaaaagacaugauugugaauggauguaauacuaacagaaaauaagcacauuucucaugguacuucauauuugcugggaaguccuuuguugcuacuuuuaaaaccauaaaauuauuuguacuccaguauaucaaaccacaccuaauucuccuaucaaacccaccccaugagccucagcuuggucacauuuuacaugaaaaaucuccccuuuaaaacccuauucagagagaccuuuuaccuuuccuucugugguauuggaaaccuuugucccaaacacaguuauuuucuagcaauucauucauaagguuuuguuugcccucuuuguuuccuuugcacuacacacuuucuaagucaugccacaccacaucaccuccugaacuuccaguaucuguuucuugaugucuccuucacaaaaaaaaaaaaauaaauaaggaaguauuggcagagacaguccuagagaaaugacuuaguagauaaauguguuuguugugcagguucaaggaccugaguucaaauucccauagucccuaguagcacacuucuauaaccccaguucuccuuuggaacaauaggggauucacaggaaucucacauaaauucagacgagcucuccuggcauagucagugggaaaauaacuaagaaaucccgucucaaacaaggaccaacacaagagacugucuucugacuccaugucuacaucuugauaugugcacacuggcauucacacaaaacaagagcacaaagaaggaaggaaggaagggagggagggagggagggagggagggagggagggagggagggaggggaagaagggagggagagagagggaguuacaaaauaacucuguccaguauguuuaguggcuuccuacuucuaaauugauaaugaaagcuaaccugggagguuuuuaacacugaaaagggcccuuaccaauuggcauauacuggagcuauggaugcaaaguaggacuuauggccaagacacauuaucacccuauacacuucucuaagucuuuuuuuuuuuuuuuuuuuuuuuuugcacaugaguuaauuauuuuuuuuuuuacuguuguuuuuuuuuuuuuuuuaauuagguauuuagcucauuuacauuuccaaugcuauaccaaaagucccccuuacccacccacccccacuccccuacccacccacucccccccuuuggcccuggcguuccccuguaccggggcacacaaagucugcguguccaaugggccucucuuuccagugauggccgacuaggccaucuuuugauacauaugcagcuagagucaagagcucagggguacugguuaguucauaauguuguuccaccuauaggguugaagaucccuuuagcuccuuggguacuuucucuagcuccuccauugggagcccugugauccauccauuagcugacugugagcauccacuucuguguuugcuaggccccggcauagucucacaagagacagcuacaucuggguccuuucaguaaaaucuugcuaguguaugcaauggugucagcauuuggaagcugauuaugggguggaucccuggauauggcagucucuacaugguccauccuuucaucucagcuccauacuuuguuucuguaacuccuuccauggguguuuuguucccacuucuaaggaggggcauaguguccacacuucagucuucauuuuucuugaguuucauguguuuaggaaauuguaucuuauaucguggguauccuagguuuugggcuaguauccacuuaucagugaguacauauugugugaguuccuuugugauuguguuaccucacucaggaugaugcucuccagguccauccauuuggcuaggaauuucauaaauucauucuuuuuaauagcugaguaguacuccauuguguagauguaccacauuuucuguauccauuccucuguugaggggcaucuggguucuuuccaguuucuggcuauuauaaauaaggcugcuaugaacauaguggagcauguguccuucuuaccaguuggggcuucuucuggauauaugcccaggagagguauugcuggauccuccaguaguacuauguccaauuuucugaggaaccgccagacugauuuccagagugguuguacaagccugcaaucccaccaacaauggaggaguguuccucuuucuccacauccucgccagcaucugcugucaccugauuuuuugaucuuagccauucucacuggugugagguggaaucucaggguuguuuugauuugcauuucccugaugauuaaggauguugaacauuuuuucaggugcuucucugccauucgguauuccucaggugagaauucuuuguucaguucugagccccauuuuuuaaggggguuauuugauuuucugagguccaccuucuugaguucuuuauauauguuggauauuaguccccuaucugauuuaggauagguaaagauccuuucccagucuguugguggucuuuuugucuuauagacagugucuuuugccuugcagaaacuuuggaguuucauuaggucccauuugucaauucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacaugauaacaaccaguugugccagcaccaauuguugaaaaugcugucuuucuuccacuggaugguuuuggcucccuugucgaagaucaagugaccauagguguguggguucauuucugggucuucaauucuauuccauugguccacuugucugucucuauaccaguaccaugcaguuuuuaucacaauugcucuguaguaaagcuuuaggucaggcauggugauuccaccagagguucuuuuauccuugagaagaguuuuugcuauccucgguuuuuuguuauuccagaugaauuugcaaauugcuccuucuaauucguugaagaauugaguuggaauuuuaauggggauugcauugaaucuguagauugcuuuuggcaagauagccauuuuuacaauguugguccugccaauccaugagcaugggagaucuuuccaucuucugagaucuucuuuaauuucuuucuucagggacuugaaguuuuuaucauacagaucuuucacuuccuucguuagagucacgccgagauauuuuauauuauuuguggcuauugagaaggguguuguuucccuaauuucuuucucagccuguuuauucuuuguguagagaaaggccauugacuuguuugaguuaauuuuauauccagcuacuucaccgaagcuguuuaucagguuuaggaguucucuguuggaauuuuuagggucacuuauauauacuaucauaucaucugcaaaaagugauauuuugacuuccucuuuuccaauuuguauccccuugaucuccuuuuguuucucuaagucuuucacaagggcuagaguuggcuuagugauuaaggacgcucacugaucuucucagugcccacaucagcuggcucacgacugucuagaacuccaggggauccgauacuucuggccuccucagccaccugcacucacauguacauaugagaggauguacauccacauauaauuaaaaauaauuauuuuaaaaucuaucacgaagauuccaaagacccaggcuuaaaauucuuucaguuugccugcuuacucgugaucuuuugaugcucuggcacaauauucauaauguucuucauauaagcauaaugcagaaagggaucaaaaguccaaauucuaaccaaauaccuaugagcagaauuaauacccaggaagacguucucgcagaagucuuaaagcccaauugagucuaccuauaaaaaggcuuacccuagagcucagagaccacccuucaaagugcaagaggagagagaaugucaguucucguguacucccacacacaaauggucccauauugucucuuuagaagcaagucccaugucaacaaaaauaaacacauccucucugcuuuguucucuuaaacacuacucagucacuuuuagcagaaaggggagaugguugagaccaagugucacaggcaggccucaaacacacugccauccuccuacaucaggcuccugagagcuaagauaaaggcaugagcaacuacagcugauuagcacugcucagucuuuguaggccaugugcauuguuucugguugccuauuaaauccaagacacacacuuaaagaggaauuucagaaaaaacacagaguacacacugggugaugucuuauuugaaccuuaacuuauuggccuguguuuuuauugucugaaguuugacuacccuggcugagaagcucuucccauugacccaccucacugccucaaguccuucacagcuucucuacaucacaucugugcccaugugauguuuccuguuucugccugucuuagucgacuuucuauccacacccugccucucugacugagaaacagcaauguucucuuguauuugcgcacuucgauaaugccucacagaaacaccugcccauacauggugaucccacauacuuguaauggaaacugaguucaagucacugaccaaagacaacuaguuaauuaggccaccacuuuaugaucuuuccagaacuauucugcaauuuguuuugucgaugaguaaaauaguguuuaccuucaaagaaugcauaguuuaacaaaaauuauauauauauauauauauaugugugugugugugugugugugugugugugugugugugugugugugugugugugaauauacuguauauauauaaacaguaucaaagacuccaaacaaauuaaaaguuagaguucccuucuggauuuugggacagaggauuaaaacuguucaguuauuagcguaaauuuagggcuccucccaaugugucagccucagguaaucugcauaccuuucucuaaacuagcuuggagaccuuacuuaaaauuauuaaagcccauuaccaagucacuagugacagauaugaaggguggucaguagaaaucuacguucuucuauagcuuuaacuuuguaucucuuuauggguuauauuuauacuuguguguuuauucuacuucuuaguaaacuuuuaaccuacuuuaaucuaauguuuguauggugugcagucauccuucagagugcagguaaauugcuuccaugguccccugggaauauaaaauuugcagauguccaagucccuuauuuuaaaggauauaguauuugcacauaaccuaugcgugcccuguccuauggaagucaucuauugauuacucaagacuaugaaaugauguaaauggccauuguacuauaucuuuaaggagcaagauauauauauauauauauauauauauauauauauauauauauauauacauagagagagagagagagagagagagauacuguacaaaacaauuuuggguaaugcuggucuaguauugauuucauuuuaaauauguuugaccugaggucuguuggauucacagacuuagaaccugaagauguggagagaguacaucauuuaacaaaauauucuguguguccuaccguagucacuuaccaaaaaaauuaacaguccuaacaugcaaagccuucuuacauuguuuucaggauguuuguggaauuaaauguauuaaaccaucaaauacacuguccucugauagaaacuaugauccacacugaacauacauggaaaacuuucuucgcuauaccuaaguuacuagucaaguaaagaaacaagccaaagaaaaauggcucugccuucuacaauugaaaauuuaauauaauuucucaugacaagcauuguuaaaaaaugucuguugcacagagaagccacugggcuuuucauuuuuaggaaacaagcaggugucccuucagcucaugugcaugugcuaagcuaaacuccaugaaacugacaauauugcucuuugcaugugguugaucacauucucagacacucaacccuguggccacugacuuuaaauuagggcaggaggacccuuggcaguuuugaauagauugucuuccugcuuucuuacccagaggccuuguucuugucaucagucauaugugacuuuggccucgguggcacuguuuccucacuuauaaaauuaguaauugaguacggugacuguagauauuaaaaucucuuagaaacgucuuaguuuagcauuccugucaaccucuugacauuaugccaugucaccugcaaaagucgggcuuaggaacacacuauugaguuacgauaagguauaaaucucaugcaguuuuaaguacauuuacaauuuugugcugggcuauguucauagcuauccucagcuacguaugacccacagucuguguuaaacaugauaaaacaucuguuggaucuguuacccugcuaaccaccaccaccaacaacaacaacaaaucugucaauaauguccaaauucaucuuuucccaaggucuacacugucccuuggguuacagaggugauucggauccugccagcacacaacuguuacauugcuaggccguagguaucuguuuccuaucacaaguuacuauauaauauacucaucauuuucuucaacuuucuuuaauuaaucucacuaauuaaaugaccaacaaaagugaaagcgucuccucgcccuuucuucucaauccuguugucuggagacauuuguccugguggccacggugagaugcucaccaggucuaccuggguaagcauauuagaagaggaagaaaaacaugcaguaaagaggagggaaggguuggaaccagcacagucugaucuauagcuucucuguuugcugguacccagacuaugugucaaagagagggagauccugaucagcuggcccccucucagugcagugugugcgggaaagaaggugagaugagauaagaaaaugcacucccgggauuaagggaaaacagcaacaaaguucccuggaggggacagcugcuuaacaacccuccugauagcucugugacuauccccaaaugaauagcagugauccaccaugugcuccugagaaucuuuuuuguuugguugguuuugguuuuuuguuuguuuggguuuguuuuuuuuucgagacaggauuucucuguguagcccuggcuguccuggaacucacucuguagaccaggcuggccccgaacugaugugcagacuccucaggacucauagggacaguaauuagaaugcgcaugcgcauacuucugcucauguccuccauuuccuuuaucacuguuuucccuguuuuccucuuucuuccuacuggaucuuaaggccuuuuugcuuuaaucuaacucacuuucacuuuuuacuuaaccuaugcaguuccugucccccugcaagcaugaauaugucucucauucauuggaaaaccaagccaagcagccugccuucugcaaaaugcuauaauuauuguucgaauucgcauaggcaucaaagaggaaauucugaaaacaaaagcacccuaaucuugaaucuucccuuucagccuacaaggaaaaaaugaaggagcugucuaugcugucacugaucugcuccugcuucuacccggagccgcgcaacaucaacaucuacaccuacgacggugaguccccugcagcaccgacgcuucuagcuacauaaucugcaggaguuggauauaugugcuccccuuucagagcuccuaauguaacuagaugaguguucucuagaucucaggguuggucauuugugcccagccauuaggccuuacugaugaccgacugcucacagcagugugguugugauuagacugauuaaucaguuggugcugauuaacagcucauaaaugccuuguaagaagcacgcaggcuuguuaugagcauccucaccagcacgucaauccacagaaugucuacgguuuuucuuuucaaaucaugagacacacuacacuacauucuaauuugcaugaaguuauuuuucuaccuagaccacuaaaggaagagaaaaucuaccaccaucgcuguuugucuucguagagucucacauuuuguggguaaauguaagcaagcuaauaagaauaaucaaauucauaaaguugugacugaggucacaagcaaagagggauuaagaagaaaauagcaauacugcccauguugguucagacuuaaaauuccagcacucagaagucugaaagcaagaggauugcaaguucaagguuaacuuagagaccauauugaagaaagcuaaguaagucuccucauuugcaacaaguguugacuuuauuugcuguuuuuguuuguuuuguuugcuguucuuuuuguuguuauuguuuuguuuuguuuuugagacaggaucucucucuauaauccugucuguccuggaacucacuguauacaacaggcuggccucaaauucaggagaugcucaggccuuugccuccaaugugcuaggauuaaaggcaugcaucacugugccaggcugcaaguugacuuuacugaaguucuagguuugggguuugcuuuaucccaauuguggugacuagguuaguuugguuugguuucuggaucuuccccuguguugggggccucaggcaagaggguccauaggcucccggaacaucauuuacucucuccuccuagggauguuggggagagaauaacacaugucuuagccugaugccuaagagguacccaguuauggcucugucuuuaucaacacuauuaguaucaaccucaucuaagucagccaauguaaucaaaagagagccacuaacuguaccaacuguaccugaggcauuuggaugcaugauaggcucacaguuauucugccuucccacauguguaaagauccuguaaaagauggcaaagagcaagcucucagccuuccaugucuuaaugccugcuucagaacuuagagcuacucuuccuccagcucuguucauaugacacaagcauuacaagggcugauuaucuuuucaggagcacuuaguuagcucuguguacaguuaagcaaucugccugcaaccaaacuuccaccggagugcacacagcaugcccacuuccuggaaguucacugagcuaacaagucaacucucugucagauuaugcuauuaguaggaaucuggcuguuucuuaagagacucuaaaaucugugcugucacugagacccacugaugaauucagcaugguccuugccuuccugggacucagagcucgguagaugagucuuaaaacacaaaugauuuccaaggagaacccuaaaugccugggacgcaagggauaggaaggcuucugaugcuuugggacuaggcagaaaagcacaucugugggagcuguuugaagcugaagaggcaacuccacaucacggccggcacuucgaaaaacucaguagagacacucagauuucgaacguguucacuuggccuuguauuucuaucuggauaguaauuaucugagcaauguacagacaaugggaaggacucuuuccagagcucaaauaaaaaaucaccauguauuagaguaagagauucggccaugaguguuugggaaucuccuggggaucuuggaaccacccuggacgguaccaggagacauccacacuugaaauauuaguaacauguagcaguaucuuaauccuaagaaguuuuugguugcaaaaaaagaccagagggcaugagggucacaccaaagcacucagugauaacugaagacugaccaaugaaguuuuaaagaaaucaguaccuuuuccuacauaugagcuaugaaguuauaaauguccuccaaguuacuaccuaucuaucacuuuuuauuuuauaaauuauuuuagauuauaaaugauagcacaggauuaaaacacgaaagucugacaaucaacuuauuaaucauacaauguaugauuaaacugugaaggucuggugaucuccuuauggucaguagaugauaaacauaagccaaugauaaacauagcuagugauuuucuguuuauuguuuaauugacaauuaaaauugaaugugucuacaguaugcauguuuugaaauacaauauacauugauaauggcuaaaucaaguuaucuaacacaugcuuauuucauguguuaucauguauuuguggcaagaauccaaucagagaaaguagauuaaaaauguguagacugcugaugaaauggaguuuucauuuacauuaaaaaagugucauuugcaagaauugauggaacugaagaucacuuauuagcaugguaaaucagauucaaagagacacaugucucaucuccuuucacaugguuauauauauauauauauauauauauauauauauauauauauauauauauuuauacauacacacaugaugugaauauaggaggaggaacaacguuugggaagaaggagacuaggaggaaggagguagagaaagucaaaggagggaaauggagugugaacacaaacaaagcacuagauaggaaaguuggaaaauuucauaaccacauccaacauuuuguacaaugagcacauucuaauaauuuuuaaacauaaacauaacacaauauaucaucacuauaaaucacauugaacugguuggauguuuugucagcuugacacaauccacagucacuugggaagaaggagccucgguuggagauugaccccaccacacgggcaugugcacgugucuaugggcauucuccugacugaugugggaggguccagccaacgguagguggugcuacccuuaaucuuggauuguaugugaaagcaagcugggcaaagcacagaaaggaggccgggaagcaacgugccuccaugggcucugcuucacucucagccuccagguuucugcugaagucugagcccuggcuucccucagugguggauugugucguggaaguguaagccaaaugcacccuuuccucccaaguugguuuuugucaugguguuuugucacagugacagaaagcgaacuagaagacucaugaacguauuuuaauugccuagaugaaauuuuguacuaucuagccagcaucugcgcagacuccaucagacuuggcagacauuuuacacucugcucuaugaggacaggaauucugucuuucuguuucugacuuucucucacuacaaugcacuccagguuuaucuacauagcugcaaaugacaauuuccuaaauuuaugaucaaaagcauuuaugcagaugcugcacuccaugacauuaaagcaguugcaugauucagcugccgacuuaacacucugcuguuccuuccacagacauggaggugaagcagaucaacaagcgggccucuggccaggcuuuugagcugaucuugaagccaccaucucccaucucagaagcuccacgaacucuagcuucuccaaagaagaaagaccugucucuggaggagauucagaaaaagcuggaggcugcagaggagcgaagaaagguaacuuucuccagggggguugucgucaucguaguucuuguuguuguucuuguucuuauuuuguuuggccugguuuggcuggucuggccuggucucgucuggucuggauugguuugguuugguuugguuuaauuugguuugguuuggcuucuuuuguuuucuugagacaggguuccucuauguaguauaggcuguccuggaacuugcucuguagaccagguggccucaaagucacagguuuuuaaagucucucuuuucuuccuccccucugcucccuuccuuucuuuuucacagauacacacacacacacacacacacacacacacgggggaggggggggagaaagagagagagagguucaaucagagauuccaagagacaaugguaccugagugagccugcacgaucugaacaccuucaauucucuacaguaggauacuaaaagacuauggacauuaagacuggagggcagagguuggaaagcccaguaaagagcacuucccaaguuccauuccaagcauccauuucaagggacucucaccucuggcuuccacaggaagcuacacucccaagugcacagaccacucucaagugcacauacacucccaagugcacauuccacuccugauccccacccccaccacacacacauacaauuaaaaauaaauauuuugaaaaauaugagagcaguaagauaugcuggcaaaucugugaauuaaagauguucugucuagauguaccugcuccaaugggcuguauuuuccugucaggcaucuuugauauaaagcaucuuugaacuguauuuuccauuugcuuuaucaugauguauuuuagacucaugaggucacuauggauauccugcacauacacacaguucaauuauguaaauuauauaaauuauaucauuuuaucaugugaauuauauaaauauaaauuauauuuauuacaugaaugaaacucuuaauguugucuacaaaaaaucuaucaauauauuaaacacuauaaucuauuaauauuguuauaaauucagauuuaagauggagaaaguaagcuauuaacccaggcaauaacuuaacuuuuucauugcuucuugugguauuacuuacagacauaaucaacuaucuugucuaaagcccugcagugccuauugcacccugggcaauuuaaguucuuacucacuaggcagaggcaccuucuauauaaugggcacagcacagcccuggaagcucuacacaaggagcacacacacacacacacacacacacacacacacacacacagagagagagagagagagagagagagagagagagagagagagagagaggagagagagagcgcuuaaaauauaaaaucagugucuggcccaaaauuaaaauucagaaagcagaguucagcuucaaggauuaguacacugauggcguuuccagcuacuguaccuaauuaacagaaaauggccaaagaaaaaagaacacagagauaauaaaaauuaacuggguguuaauuuauaaaacuuauaaaagucccugaggcaaguaauuaauaguucuuguaaaacuccuacauccugacagcaguaaacuauuaacaauuauuuaaacaauuaaaucaaacuagaaauugacuguguagcuaauggacacugaccaaaagaaucagccaauauuuugauacucagaaaaaaauauuuuggaaccuuuuuuaaaugguguaucucauuaaauuuauugugcaauuuggaaauuuuucaguggagaaaucaccuugugaauuauguucugguaguagaguuuuaauuaggagaaaggacaucuaauuaagagaaaguacuaacuuaaacauucagccauugauuuuguuuuucuauuggauuguacugacuuaauuagcacucgugugaaaaacuguccauucuccuuaaacagucuucagcaagugacguaucccagagacuguccggcaaggacaugcaggucaccgucauccagcugcucagacugcucuaaguauacaacguggcuuaccccucuggugacuuucaguccguacggccccucuguggccaguagccacucaagugagcagccccaugggcuaguaggucaaacaacuucuauaaggaauggaaaacuuaacaucugcuuuuuuaauugauuccaaguaauuacugagcuucaacauuuugaaauauaucuauagaaguuaccucugcauaggaguuuggaaaauagagauugucccuugcugugauuuccucauuguguuaucagaaccagcacaggacacauuuaggaccuauggccccacacucucuuccuggcuucuuguagucucuguucacaucccguuccugugacuuaggccugagcucucuaacgcucugcuguaccagaaguucccagcucucccuucccagaacuuggcaugauuaguaagaauauaauuauuugcauuacuacuuauuuaaccaucuccuccauuagacuucaugaagguagauauguguguuaacaguauacuauauugcuacaaauuuuacuuuuaagugaacaacaaaauuaaaauguaaaaaauuaaaauucccauguuaaggaaacaguauguaagcuauauuaacaguguauuccauacuaccaucccaaagaaaaauuauaggcaauaaguuuccaaacaacaucugcugaaauagaaaucacacaaaugacagguuuuaucuaggaccugcuacucacccuaacucuaacucuaggaaauaaguuaaagagguuuccucucgcuaagggacagaccguagcauauaacacaaaaucaggcaugagcgagggaacaaaucacaaggguagaauguucgaguaguaagaguggcaggugcagaggcccuggagucagaagguucugggguguuugagaaacaucacgaaggccagggaggcaagagcagugagcacgggaggcaaggggaaccgcggguacagcagcacagcuuuaaaggaccucggcuuugaguucaaggaacggacaacagaggaaaaagaaaaaaaaaaaaaagaaaagaaaaaaaccaaaacaaaaaaaaaaaaaccuucuucaguuccuaguguuaaccagugcacaguuuugaagaaaauucuauuuuuaaagggguaaauuagagccaggugguggcggcggcaguggcggacgccuuuaaucccagcacucaggagacagagacaagaggaucucugugaguuugaagccagccugguguacaaagaaaguuccaagacagacagccagaacuacauagagaaacccuaucuggaaaacaacacacaaacaaaaaaggcaaacuagaaaaaaaugguguuagagguguuagauagauagggaagacuggagauugugauagacuaaaaaaaaaaaaaaaucaagcaaaugguuucagaacuaaggauacucagaagcaaacauaaaacauguguuuugaaggcugugguuucaaacuaguggauagacgaguggggaggaaagcuaggccagacucuauuauguaagccauaaagagauaguaaaaaaaaauucgcauagaauaaaugcuucuagaucuuaaaaauaaauaaauaaaaguuuuaaaaaggugcugaaauaggauucagccauagucacacgucucaaugcccugggccuauuuccuuucccauaucuuacaaacuuuuaaagcuucugcccagaaaucgcacaacauuuacauguguguuaauauuuugcuauuguuauaaacaaagucaguuguuacugcuaaucaauaucccuaauuaucguaagguaguaagcauuuucucacuaaacugccguaauccuaauuccaaguaagcacggagguggaacaugugauuuuuguuaggacuuuguaaacacaaacccauuuauuaggguauuuagagccuggcgcugggaauccaaaagcccucagugaccuggggucccaaguugugcagacagggcucucugaagucagggcuggaaggcugcugaacaaguauguccacgggggaucagguaugcugugaauuagauagcguggcaaguucccagcaucccucggccacuugcgcacacugccacagcgcugaccaucuggaggagagcuuggcaccuugcagacucccuccagccagaacuaacgcucuauaaaaacgcugauaaaauguaacuuuuucuuacuucgucuccuuuauuaaauaaaggaccucugguaaucagugucuauuuuuugaaauuaaacucuuccuaaugcaacugaccacauuugggaaaugacauggacacuuuggccagccaggcgugaugcccauucauucaucauccacacagcgagaagcuucagaaugaggcuugcacacguccccagugugccugcgcacauccccagugcgcgccuccaacacucugcugugccagccucaugacuaauggcuucucuuuucuucacgacccagugcaggcaaccuguggucucauuaucugcagacuacagaguuuaaaggugccuuucaaaucauccaagaacacaugauuauuacaaugucagcagcugaaccuaucucuccacauaguaacugaugccuuugggcaagucaucuaaacucugucuucucuuacccaaacuuccuuauacagcccaggcccaucugccccaagguggugccaccacaguggucugggcccuuucuacaugagucacuagucaggaaaaggcccacaaagaugcucacagccaaucuaguaggggaaauucuucaauggagauguccucuucccaagcugauaaaaaugaaccagaacacucaccuauacaaaggacuaguaaaauguccugugucacacaauggggacauaacccucugcagacagaugaggagcagcauaagggguuggcuauuccuggcuuaaaaugcacccagcucuggccuugccaggauuauggugcagcaaaugguuuuacaaaggaaagaguucugucacuuaguacacuuuauaaauauuugaaauauaaauuagucuuuaucauaaugcagauaauaaacaaguugaugaauaauagaugucuaaguagguuaggccaacuaaaacuggcuuaaaacauuaauauuaugaaaaaugguguaaauuuaaugauacguauaagcuugacaaaacuauauacuaaaaucaauugaauugaaaggcuccccacuuaauccuuguauuaacaucacugcacaaugaguucuaaugaccuaugagccucuuuuucucugaaagagaagagagucccugcucuaacugaaacacugugaaagggacucauuagcauccaaaccuggucaccucagcaucuccaucuguaccuuuaaagcuuuagcguggccacucucauuccuuccccuuaagaaguugugcauuugucaagccaugaccucuguagggucagaacugggugcaguuuacacagucgcccacccucucgagaggcuggaucuccgccguuauggggaggagccucuacuuccuacaauaacucuagauacauggucuucucucccagugucacguugucgccacacagaagcauaaaucucuccuaaaaguggagguagugaggguuuaaccucgagucaacuaugagcaacuauggcuggguacauaguucugauuucuucugaaaccaggucaaaauaugguaacaguuuccuuacgauucauauuagcaaagcaaacagaaucauaaaccaagacacucuucagauauacugguggcaggucacagaaaagcagagaaaacuguuauaggccucacugcccggugaggucacacacaacaaaggauaauaacuguucaaaggcccaaaagagccugagauaacuuuuaauuagguucuggcuuugcaauacuccaacguuucauacugacauuccuccaaucagucuauuuggauggucauacaaguuuguauucuuuugggaauugucaucagcaacuggcaucauaacuuguaaauggcacuugagauggaauauaagggaaagaggguaguuuuuauauagucacaguugaguauuuaggaagccuaugugcuucguggucauaaaaucuuccaauuggucuucuuggcagggaugaucacccagacugccccuguaagggaaucacagcaaacccaucugaggcauacgaugaguuucuucugugucucuuucugugcuccuggcuuuucagcauguagugagugcuucaugcgauuucacacagcuacacucuacugucauguuucagcguauuucugugccuucaccaggucaaugaugcucugucagcauuagcagaaagccggaagcucacagaggccgcauccagccuacuuguggaaaggcaucuuggaacuaagagaguugguguuugaugaauaguucugaguauugaguaauaugcccuaaaugaugagugggggcaagaugaaggggcaccacgagaauguguauuucaaaagccauggagaaccaguguaucuaaaguguagucuuaaaucucuuacguguauguaaaggaaagugaguuuuauagaccaauuaacucagauuuaucauucaauucauuugugugguaauuaaacccuuagacucagugguguaagagacacuaauuaaccucuuugcaaaauguucaaguguuccuacauggacaauaacucuucucccugucucaucucugggccuucaugagcuucucacagacucauuacaguggugcucaguucguuaugagaauguucaaaagagguguccaccagcaaugugccgcaguuucucaaaccgugagcuagagugacaucucccgggaugccaccugugagugacucuaucuuccuuaacuuccuucuauagccuaucagcuggccacuaucuugcccaagguuccguuuccauccucagagacucugugucagaaacgugcucucagccagguccuugaggccaaacacucaccuuugaacaauucauaugcagcagccuuuaccaauuuccauccagcaaacuaacacagcccaccaccuuccuucuaaucugcccagccacaacacacaguaggagcacuguuugagcacacggugagagcuuuacuccaggugaagguagaagcaugcuuccacuuauuuagaucaugugcugacacuguucaacuucucacucacuuuaugccaagucuuuguagaauuuucugaacuuacugcuuauuugugcacugacauaaauacuggacucaaaaccagucuucuuccuggguaguacaagaucaagaauaagccauuuucgggaaagaauugauuuuucuccaaggaaugacaccagagcugcuauaagcagaaggagcuugucagcaagccgcaguaaguaggcacuaaggcugacuuucagcacuagcagaguuauggagagagagcuccagaguccugagccguguucuagugaagaaugaggaguuuaaauguugagcuccauggcugggaagauuacccagugaguaggaugcuuauugcacaagucaaauacccagcauccaugcaaauauuuaggcacuuguugaucaccucauugcucugaggucagagacaaauggguggauccugggguucacuagccagcgagucuacaaagugacaaucucuggguucaacaagagagcacaucucgaaaauaaaugaguaaauaaaacagagaaacaguguuggguuacauuucaacaguaaucucuaaccuccacagacaccugcagagggagggcacguguucuugagcuuggguggacggggcgggguuggggggagggaagagagagagagagagagagagagagagagagagagagagagagagagagagagagaguuuaaugcugcaagguauggcagcucacuccuuuaauccuggcacuaaaggaugcagggagacaggcaaugugucuuguaaagaguagacuguguccuaccagcaauagacucuggaauuacuaauaaaaaguauagauuccuuggccccacuaaagaacuuuggaaaugguucucagcagguagauacuauaaucucuaccauuaucaagccccuagugaugacacuugaagagagccauacaucuuacugagguuaagaagagagagcaugcacaagacacagccaacugcaaugucucuguucucacuccugaaggaccacagugaggaguggcagcaacgaccaaggcuuucuucuuuuuuggccaagaggucauuaaauuuggauaaguguuuucaauucucuacagagaauguauuuuauguguggggugcuuugucugcaugucugucuguauaccgcgugcaugccuggcauccaaggagccagaggacuucgauggauuuccugaacugcaguugaggacaauuguaugcugccaugugggugcuggguaucaaaccucaguccccuucaggagcagcaagugccccuuaccucagagcuacaucuccagcaccugggacaaagggaggacaggugucuaaaacaagaaaaggugaauuugaugaaaauaaguugagcaguuccuauagaacccacccuauacuuagucagaaauguuagggcaggaaaaagggcagaagagaaagaaaacucaggccccaggccauucccaucuucuucaggcucccacagaaagcuauggucagcugguucauucuaacacugcauguugcauaaauccuuagcaauaucuuauuuuuuaaaaaaggaaaggaaagacuggccagauagucuacagaaugguuccucuaugagagcuaauauuauuccuaagacgcucuguccaaaaccuccacagugaucacuucagggagcggugucccaccaacauauucugauggaagcgcugaggucuccagaaugcacaggguggacagcgcugcucacagcugcagcagcaucugguccagcacugaguaaguggcauccggagauggguaaaggaugaaaugauguguuuccuccccagucucaagaggcucaggugcugaagcaguuggcagagaagagggagcacgagcgagaggugcuccagaaggcgcuggaggagaacaacaacuucagcaagauggcggaggagaagcugauccugaagauggaacagauuaaggaaaaccgugaggcuaaucuagcugcuaucauugaacgucugcaggaaaagguaagagcagcagagggcgaagcaggggacauuccugugcagcagagcuuggggagccaugguugggcuggggaccacggcaggacagccagccucagguugcucagcgcccgguggccuggcccuguaguggaguaaaggagcccuacaugagcaccggagcccuugucaaacacuccgccacaugacucaggaaggcugguuucaaaugcgcaggacgucgguacaaaucguuguguuggaaaaaguaaccguacauauuuaauauguaccuuguuauauuuuuugauguuuuacuugaucuuaauauaaaauuaacaaacauuucuuuaaaguaauauauauauauauuuaauacaaaaacuaaauuuaaaauauauguugaucauaggcccauuuucuccauguaacacaaucuacagggaaauccggagcauggcaagaacagcagagggacuauuauuucaucauguucuagaguccucaggccuuccuuauuaacccucuguauaugugugcaugugacacaugugagcacgcaugagcacacacacuacacacacacacacugacauuccauguccccaaagauugccuuugaaaaaaugcacauuguagcuguucaugguuuugcuuuguccauuuccagaaauuggauuaggcuugaagaauaggaacucugaaaagaugcaccuauacaucucgccucccugcccgcccuugaggcucuuuuacaucaagcucugcagguucgagagauacugcuauugucuucuaaguacugagaguugacacucaaacucauaauccuccugccucagacucagaguucagauuacaggcauguaccacauuacccagcuacagucuuuuaaaaauaguauuuaccagaggucuuuuaggugagauguguucuuccuagguuuuuugagaucucugcccaaaaaaugcucuuggcuccaacacagaaauuaaaacauggaggcccucgaagaugugagauuugggcagaaaccagaagagccaacuuugaauugacuuuuuaaacauauaaacagguguggcccuugcucuucagagcaacauccugucucucccaacaucucaagucagaccuuggcucuucacugagaucuaggacagccaugcucccuuuaucauuguccccucuccucuuccucaguggacaaguccugucuggggagcuccuagccuucacuuuguaucauaggcccuggaaaaaucccaguacaguugccagggacacaauaugcugauaucacucuaagccagccuugccuugacuagccacaucuucacuagccauccaggagugccccugguuuugacauaugcauggaaaccuacagcuugucccucuucacguaauuuguaaacuaguuuguaaaauuugcauaccucauaacagcaaaacaaaaaucaaaggaguguccagcaaaguucacaccaucagguuuaccuaccaaguagaaguguagaacuuaagaaugaagagaccugaucucugcacagugagcaauuuuguaucuaauaacccaaccagcaucaaggaaaugcgucauagccauuacuuuagugacaacagcaguauacuauaugaucuagcuuaaagugaaaauaucuucccuugaaaaaacaagauuccuuuccuaugaggcaauuucgauaauauauagccaucaauuuuaaucauuauaaagucacauguguugucaccuuacauucuucucuucugacuuacauucauuuucuuguuguucugauuugcaagugccauuggugugagcaguuacuacugagugugucugaugaauaacuaaugaaaggggaaggaauuauacccagccauuauugauuacucaauauaggccaagcacuuuugcauguguuaucacauuuaauccaaacagccagucuaccaaaacaauauuguuauuccauuccacaucuaaagaaccuuagagagccuacugcauuuggccaagauuauaaagcaagcagagagaagaauguagagaugagugcaagccuuucccagaccaaaguguguccucagcugaauuugaucguccuuuacagucccugaacacugaccauaggcauuagaggcaaugcuccaugcuucccuuggucccgugaccaccagcaucuugaugcaugacagcagaauuuuuacuggcucuuccaacuuauuucugaccuuuuguuuauaccauuugcucauaaccauuaauaagaagaaaggacccugauagugccaacaucaucuugcauuuaaauaaacuuagaaaaugagauuugauagaauuauuaccagaggucaucuaguuacuguuuuuaugauauuuuauaccuacagccacuaaagaggaacuaagagauaaaggaaaaaaaagaaauagccucacauuucuuggcuucaauaagaaaucuguaugucacauauugcagaggaccagaaguuuuucuaaagccaucuuucaaagaugucuucuuuuaaaaguacuguuuacaguaucaaaauacuacuacauuucccuugaggagugguggcaggagacauugaagagguucuuuuuacaaauuuagauaugcaugggccuagcuacuauagauuugggauuucuaaguauaacugaaaaauuaaguaugagauucauaaugaaauagacauuacuaaagaagaaaguccuuagagaacuucauagauauuguccuuagugaauuucauagacauuauccuuaugaacuuauagacaauauccuuagugaacucuauagacaauguccuaugaacuccaaagacauuguccuuagugaacuugguagacaguuucuguagaaguuucuguaguaaacuucauagccaaagacucacagcuauguucacagcucucagcuggaauuuucuagucacugagaaauucucugaccaggaccacaggcuggugacaucacuagcuuccccaacauuuucauuuaaagucacauaacacaucaggaguguucauuucacauuguggcuguaaaguuuccaaacaguaggucaaccaaacuuccugaaaaucuguucuuagaaauggagguuuaucuaaauuucccuuuaaaguuaucugaaacucagaugaagucuuuaguugcuguggcaagccuguagcuuuacuaauucgaguaagaagaggaauaagcuaacagggcgaguuguagugcucacucuugcugaguugccacuccuacuugaagcucuguugucuuccagugcagggaagaugucuccaucuucccaguuuucuacaagcucagcuuuuacuaauggcucacuaucuuagugagaaagggacacugauacaguuuugccucguaauaacuggacaaaagaaaauuggcugcaccuguucaaauuuccucacauuuccaaacaaaacuugauuucucuacaauguguguuaaaggcucauuuaaaccaauuaaauuacaauacuucagggccaagaugugggaguggguggguaagggagcagggugggggaaggguauagggaacuuucaggauagcauuugaaauguaaauaaagaaaauaucuaguaaaaaaacauaacuggaaaaaaaaagaaaaucuuucucuagagucaacuuccugcuuccucaacucuuuuagcuuuggaggaaggacaggucugugacacuuucucccauuccuacccccuaaacgugagaggcuggaucauucccacauucauauauaacuaauguugaaucuaaccaccugcuaguuguaugaacuugguaaaguuucucagccuuccuaugccuugguuucuuccucugugaaauggguauaacagaaucucuacuaugauacugugagaauuaagaaaauuaaucucaucaaaaucuauaugguuauaguuguaguaaacauagguggaaaauauuagguuauagcauaaagaacccuguaagaaugggcacuuugaccuugauagagcuuaaugauaagauuuacuuuauagcuggucaagauuauugagaaaugaaucuaagaagcuaucugaggagaaaagcaauuuuaaaauguucuaaguagaaaauaaauaauauuacuaauaauuagcauuucaaaauucaguuuaacagccauuuaugcaaaucuauauuucuuuggucauccaauguagaagaauaaaguaaaaacacuagacccacuuuuuccccaucaucacccuccuuagaaaguuuaugucccagccaagacuaguaacuuuguuaguaaaguuuccucauggaaauaaauaugcaccaaccauaugcaauguucacagaaugaaaugacacaguugagaccuuguagucaacacagccaaggagacaagaauaggauuucuccuguuuagaaccaugggacugccccauagaagggaagagcuugguucugcaagugcuuagaugcagaaggcagcuguaucggucuguggacucaugagaagccuuuauacagaagggaugcccuuaacagaccuuagagcacagguuuacagcuuuaaucaucugagagacaaggcugggaacuccaagcauucaaaguauccugaaaacaugauucugcuggacugacuaagccagcaugugcccgagaguacacuccagcacuguugacucaaguucagaaggucacgcacaagguguuuagaaguagugccauugucuccuuccuggaucucaguuucccaaagugcccauaggcaggcacagauuccuuaaaauaguccaaaaauauaaaggaaaaaauuuaagaucaguguuauauguuagugcccgucucugaauuuauacagaagucaauauagucaauauuuucuuuggaucuuuucucauuuuucauuugaccuuuugaucauaguuugaaaagaacauaguguuguuguuguuguuguuguuguuguuguuguuguuguucgggauuaguuacaguuccauaguaaaaggcuugccuaucauuuacaaggcacuuggcgccaggguugaucaccagcaagggaggggucguauaagauaagacacuauaugucauguaauauucucuacugugauaucucuugggcccacauuuuccuuguaaagaaaauuccuuuaggaauucuuaucuuuaggaaaacaccaccuggguuauuucaggccgaacauguccagcaacagcuaagguggcucugugaguucuugggaccacaugcacugaccccucugcccuugcucuuucuaggagaggcaugcugcagagguucgcaggaacaaggaacugcagguugaacugucuggcugaagcaauggcggguauggcaagccccucccauaguaaaucccccugccuauauuauaauggaucaugcgauaucaguaugggaaguguaugacaugguuuaaaaagaacucauuaugaaaaacaaaacaaaaaacagaaucaaaaauaaaauaaaaaucaaugcggucucuuugcagaauguuuugcuugauguuuaaaaaaguaccuuggaucuuauuuuguaaauauuuacauuuuuguuaaaaaauacaaguauugcauuaugcaaguuauuucaugaucuuacauguccuguaacaggcuuuugacguugugucuuuccacucagauggauuugcuaggucuguucuuuuggaagccccacucagucccugcccuuuucauuccaaccgaaaaaugaggucaguagacagucuauggugcuagaaacccaccauugccuaaugaccuagaugacuccguaaucucugagcgugaccaagaccacaccuagaucguggguacuguguguccaugugaaccuccacauuugcucguaaucugcuuccugccuagaagcggcaaagccaggcuaagggaaucuaccagucauagcacuuaugucugcuccucauggauuacgcgcuacacauguguuuggguuuuagaaacaggugcaugugaagacaaaucugagcucagucaggguagaagcgaaaggcugaaccuuccaacgugcugaucacaaacgcaaagccagaggguucaagcagccaugggauuguucuucaugaagugggcuuauuucucucauuuuaguuauuaugaugggaugaauuaauugacaugucggguggcuuaucugugggugccaugggugaugauguucauuuuaagcuuuugccuguaguacaagcacauaaugcuacugaacguuuuuccacuuggagacugugagcugguugcugcauuaaaaacacaaacaaaaucacaagcacuguggacuuuuacucaagcuggucuuucuuccccaguguagggcaauccugccuauaaacaagaccaaaccacuccaucugugaugcugacgcagugaaggggccaggcagggcauuugugccaaguauaagaaucagcagacacccagcauacguaccuauugcaguuuugaaguuguuucucccuaacucccaacucccaacucccaaacugccugcauauuuacucuucgucagugcuaucuucuuguaugucauugugagcaagcugugaugaauaaagaauuggaguucugugaacuaauaac

SEQ ID NO: 1351 - RNA, 1541 nt, Mus musculus
cagccuggagaggguuaaguucagccagugguauugacacagcguuuucuuuccagaccacagagcugcgcgcugaugcuaucucuguaauucuucgugcagcauucucaaagccccuuuauucagauccucaaugcagaagguaggguugggccugaagaggugguuaagucccaggcagagguggaaacaugacccaggacuccugacgcacagccuuuguccuuucagcucuaccacgccagccaccuuccugucaggugucugguaagcagguuaacugaucugucgauuaggagccgccagccuacgugcagcgacuggggaacgcagcccuucccggugucugccuugccagcgcuaacugcaaaccagugacgcaaacugucucacggagaaccucaucaagcaccucgccgagaguagccuaggucggcuaagaagccaaacuuaggcugcgaccccguagugcuccucagagcucgcugacgacaagccucccggaaugcuuucgggcugguccaggagccagccaggggagagucggcuuuauucauuaauugagacagaaacggcauaucccuaugacauuaaacgcaaaauguugagguugggaaaggggaagagaaggaaaaaggaggcgaggaaagagggagagaggaggcgggggggaauaggaggaggagaaccagggaaaggaggcggggaugucugagccauugguuuucaauaagaguugcacagacaaggaaggagaagagagggggacggaggagggagaaaagagagagggaagagcagaaggggugagagaggagugggaggagaaaggaaagggagggugugugggggaggcccugaguuaugaugcacaugaacuuggccaaggcucuuucgcggccccccgcggcgggcuuucccacgcagucaaggugacccggugaucuauggggcugugguggucgucguuucgaggugggagggcugcccccuccgcaggggccccuggggcgccgcccgcgugacugucaccggucacgcggcaagacucaggcagggacaaugagaaaagccagcgggagccgcggggcuccgcugaggcugccgcugcucuuuugcagggccgggccccgcgggcucccuuccucccuccugggacccacuccaggagccuugccgccugucugguguaacuugucugaaacccaggagucaagacgaaguccugaagaaagcacuucagacuguuuccaggccucaagagauagcuaaacuuauuaaugcugucucccuuuuauuggaugugugccucaaagagcauuuuucucacccuauucaauuaguuacaagucucuucccuuacguuuauguaaucugagcuaggaccacuugggacuaguggccugacugccucucccugaacagggaccagagcauugcugccacuugccagcugaccccaggccacugcagucuagccucauucgcuugcuucuauccuucccagggagcuucauuucuagagaaaguuuccuuuucca

SEQ ID NO: 1352 - RNA, 2682 nt, Mus musculus
gagauucauagcaaaccauuuuaauuggaauuucuuuauacaguggauugugcucaucugagaagccauagguugucaauaaaaagccuaacaccagguuugggacaccuccccucaagcugauggucaggguuuuccuggagacaccuggcacaauacagacaacugucccugcacuuguuugcauaucaggacagggcaguaaaacucugcugaagacacuauacauucuggucacagacuaugaagaaaccaaguuggcccacaaaacuugguugguacucucaguguacuaggacaugcugugugggcugaaaucaucagcugugaacccugugaacucgaauaacaaccagcauggcagaagaugaccagggguacaguguuggcaugaaugcuaugagaguaagcaaacacuucuuggacuuuuaaggccuacuccacaggagauggaaccaauccaguuacugcagaucuggccaaaaacuaugauuuugcuaaacagauauacuaucaagcugcccuauaaauuccucucuacucacaggugagugcagcucgaaggccucaccagcaaaguuucuuugugcaguggaugguaguuaacacagaaacaacugguccaaguugcacagccuguggagagcuccaccacaaauggccacaaauccacaucaccacuccaucaucccaaggcucagggaccauccuggaggagcugguacaaagauuauuaagacccaguggucagagaggaccaaagcgcaagugcuuucugcaaugacaggaucccuacaaucaugaacucucagcagcuguguugccugagugggaccugccagaucaagacaaucgagcuucuaaauagacugggaaguagcucgugagccccacccaacugaaugguucaaaauccgauaaaugacagcacaaauuagaauggauuauuaaaguuuauugcuggggguagggagguagaagcagaucagggaaguaguuaagggggaaaguuagugcauaugauuaaaacauaugcaauccucaaagauacuuacuuuucaaacugaaguaacgaggagaugggaauuuugagcugggagucaaccugcacuaaguaaugagauccugucucaaaacagugugugguggggcaugcaugugaucccugucucuggcagauggagguaggauggucagggcuucaaggucacccuuugcuacauagcaagauggacagcuugaacugugugagacugccucagaaauaaauaaaugaaugaaugaacaaauggauaaauggaugaaugaaauaaaaccaagugagucaacaagagggaugagucugcaggacucuugccuacacaggcaccaaugggcaugggcucuauuggcaauacugcugcuccaugcaucuucccacuagcucuauuaaaauacuuccaaguuauuaauacccauuguaauagcaguuagcaagaaaacgaauaaaauauacuucaaagcccugauggcaucaaucgaccuggccucaucuaccaaguuguggcaucaacagcacuacacgcaccacaccccagcccacccccaagaacaccagugugcuaaagggugcuuccuaaaaccuccauagaaaggucuuagugguuugguugaggugacuuagaggugguuagaaauuuaugccucaggcugggauguggcucaaauaagucuggguucuacucccaccaccacuagaaagcuaugguucuuaacugcacaggaaagacuggaagaaagguccugagacauaggugagauauagugucacacuaaagacauucaucuuagccucagaaaaaggaccauuuuagaggucacagagauggcugaggagagcauuuugggaguugggauaauacuaaaaacuagucauauugaagaaaaaaauccuagaaauaaaggaaaaauaaaguaugugaaggcauguucaugugugugagggugugcgucagcacacauggaggccaucugauguugccugccuucuuucuaugaggauccaggucuuccugcuugcauggcaaauacuuuaccacugaaucaucugcccaguccugacgcugagacucuuaaaggucauauguaaacaagaaaauuguuuggcuauugcugugugguaggaaaaaaacaacuuaaaaucaucacacuaccaaccaaacucagcaacaucacaauuacacaaaggaguugguaggagcugagucaccaguccacuggagugugaagcccugguacaugcugagggcacacgggccuuaaauucaugcccuacaccagaauauggaaacugcagaauuaagaucugcugcuuuggggggacuggaugggguggggugcagaggggaaacuaggaagggggcauuugaaauguaaauaaaauaaccaauuaaaaaaaaucugcguuacuuaaaaguggcccuguuuuauauuaugugugcuuucuaucaucaauccaaaguagaaaacaaggacuaaucucuggucagaugucucuuugcuauggaaaaauccagccuuucagcuggucuuaagaacuauuuauccuuaaaaaggaucuggagagauggcucaucaguucaaaguccauaauauuacucuuagagaaugaaugcccagguucaguucccacaugcacaucug

SEQ ID NO: 1353 - RNA, 574 nt, Mus musculus
auuccacaagaaaagguauuacuuuucaguuugauuugagggggaaaauugcuuuuccuuuugccucacgcagauguugagugcagagcugcccgcucccccuacgcgagugcugaggugucugucagugagggcuuccucuuugccucaugcccugggccugggaacugcagagcuccucaggaaggaagggaugcugcugccggucuaagaggcuggcucugccccugagcaccugugggaaggugucaguccacgugagcagcuuccucagcagcccugcagcacacagaugaucuucccgugcgcacaugucaccaucuguggugacaaauguggcauuuaaagaaucacuuacuugccuuucgggucuuagcagaaggucaccauguuuggccacaaggauggugguuuuaucuuccuuccggcuucuggcaagucugguuuuccuuucgcuugaggcacaguuggugaagcacccacaugguggcuaacauccauugguaacuccaggucugggagugaagggugggggcuauguucucuucugacagccgcaggcaccugguacacu

SEQ ID NO: 1354 - RNA, 56433 nt, Mus musculus
cauggagaaugaugaagagaucuucaacagggggaaaggcgaggauagguacccacaguuguccucugauguucacauagugccauggcacacgcagacauucacauaugugcaugcgcuugcucucucucucucucucucucucucucucucucucucacacacacacacacacacacacacacacacacaaauaaaaauaaugaugauguaauucuaacagacaaauacacuuagcccagagaaacgcaagggaaugguggguauggaaguagagaaaggaggacaaaagauggcucagcagugaagagcacaggcugccuuuccagaggacccagguucaauuuccagcacccacaaggcaguucacaauugacucuuaaguccaguuccaugggauccagacacguaugcagagaaaauauccauacacauaaaauaauaaaguaaaaggaaugucuucaaaagagugguuagagaggaggauggguaugaagaaagcaugguuaugcacacauauggaaaugucacagugaggcccaggaaucaguauaacuaacaagcacuaguaauuauaauguaugugcauguguacaaguuacauaugauuuuaucgauuagacgggaaagaggagagagaacccaacagcaagaagacagaaggguggaggaagaagggagagggagggggagcgagggaaagauugauuuagcacaauucugaugauccucaaagugaaccauacaaauauaacaucgagcuaaccacagacuccacagcuuacagagggaugcggagaaaguggaagagauucgccagggagucacggagaugauuaaaggguuugagaaauaggagcuagagauuauuuagcccaaguuagaagacugcuagguuucuuaaugacaguauuggggcauaggaagagcuguuacaagagaaagaacaguugcuuuuucuucaaggcagaacagaaggagcgggcucagaaguaugggaggugacacucagguguaaaaagggacuuuugacaugauuaucagauguagaauuaccccagggguucucggcucaguuuuuccuuuugcaacucuaucucagauguuuaagcucucuguugacggguugggugguccuucaacuguagauugcuugccuaacaugcacaaggcccagcgucuaagcuccaguacugcagaagaaucaaggucuccgucucuuuccacucugcuuguuucccuuccuuuauucaucuccucugauuuuaaugaaccugcuauaaguuagucauuucuaaaauguguguugaaaaauccccagucugggcuggugagauggcucaguggguaagagcacccgacugcucuuccaaagguccggaguucaaaucccagcaaccacaugguggcucacaaccauccauaacaagaucugaugcccucuucuggagugucugaagacagcuacaguguacuuacauauaauaaauaaauaaauaaaucuuuaaaaaaagaaaaaaaaaaaagaaaaauccccagucuagcaugagacagagacccugucucaaaaaagaaaaagaaagagagagggagggagggagagagagaaagaaagagagagagggagagagggagagagagggaggaaagagaggggggagagagagggggagagagagagaaagaaagaaagaaagaaagaaagaaagaaagaaagaacgaaaggaagaaagaaagaacgaaaggaaggaaggaaggaaggaaggaaggaaggaaggaaggaagaaagagugcugaaugucuggcuuuuguuucuuacuuguucuacuaagaugacaucauaggugacacuuuccugucuucaaugucaccccccauuuauaugacggcuuggaguuucccagcuguuaugucgauuccuuguuuaaaaucucuguacaugcuccaauacucacuucucuucaauacucagccucugaauccagugccagugugucacuacaaauggggcuuguuccaagauacugucacguacuuggucacccucaggaucugauguuucuugccucuuuucuuuuucuucuuuucccuuccuuccucccuucccuucccuucccuucccuucccuucccuucccuucccuucccuucccuucccuucccuucccuucccuucccuucccuccuuucuuguguuuuguuuuguuuuguuuuguuuuguuuuguuuuguuuuguuuccuuguauagccuuggcuauccuggaacucacuguagaacaggcuggccuugaacucagagauacccaucuggcucugccuccugagugaugagauuaaaaguaugugccacuaugccacacgucucuuggcccuuucaaacugcuguugucuuucuagaaaauaccauuucaucugugguuaauucuaugcuuccucugaccuuaucaagauagaacaaugcucuucaauaaauguuugugaauuuauacaaagauaaaucuugaggaauaccauacuuuguuuugguaaguguuuccuuuucacauccaauaccuacccuuuuauaaaacauuuuuauuuuuuggacauagggguucuguuucuuuuucuuucuuucuuucuuucuuucuuucuuucuuucuuucuuucuuuuuuuuuuuuuuuuuuuuuuugguuuuucaagacaggguuucucuguguaguccugccuguccuggaacucacucuguagaccaggcuggccucaaacucagaaaucugccugccucugccucccaagugcugggauuacaggcgugugccaccacugcccggcuucuguuucuuauuaacagaauuuaagugccaaccaucaaaauuuuuauuaccagucugggaauagcggugcacauuuuuauucccagcagagauaaggguauuucugugagauuaagggccaucccagucuacauaaggaguugcaggauagcuaggccuagguacagagauccugccucgaaaaaccuucuaucacuauggguagaaauguuuaagugaaaauagcaguaggggcuaugggaagugagaggguaggaggcagagcuaacaaaguagagaauguacaguaaagccauacagaaaccuaugauuuuguaagcuuuaaaaaaauauaacuuuucaaaagagaguuugaaagcagauuucuugcaugggugaaaaacaccguucccagaagccauaaauuauaaagaaaaaaaucccaguuccuaguguggaauaucucuuuaugaguuguuggucagggaggcccagaggcaccccaaauauugcaugcuacuggcuuuguuuuggcuccucacuagaacuguaugauaagacccuuuuacugaagacacuacagguuggaagucagaggaaaccuccuucguguuggcuaccuuucauugggccagaaugagcuaugcccacugauggggaagaaaggcauuuccagucuuacccaucuaugaagccugugaacuccaaggccaaucugcaaggcaagaugcauuagugucauggcuguauggguuaaccaaaggguuuaugauuggacuguagacccacucacagguggaauccauauuugguacuguaaaaguggucaaaaguccauggcacgaggucgcaggcccuaggaaggaaucuacuacuacuauuuugcuaccuauacauuuuuguguucacucauagacuagugcugcucucagccuugaccaaagcaacuucugcuuguagugagcaaagguuaacuauucaaagugcugugaauaagugacuuuugaauguuuauccugacaaaggacaucaccaauacccucaccuccacacaaagcccagaaaaagggugagaagaaugcugugaaagacuguccccuggagagaugaccugguccuggcccucaugaauucuguccuuaccugcagaagaccaacaacauucuauuacggaucagggaggaguuccugggccucacccucuacugaggggcugucagcaguuaauggggcaaauagaguucuauuccccuugucuugcucaucugacuaacgugcugacccacaccuauacaagcaacacuaacuagaugaagugugauacucacacacacaaaagaugugaagguaagauggagaccaguuggaaagaagaaugcauuggugagaaggaaagagaguaagagaagaaaaugaggcagggaauacgaucuaaguguguaugaacagaauugagaaggaauacauuuagagauuaaaguguuuacaaaaaccauauaaguaaacaaacagaaaaaagccagacagugggcuuuuuuagucccaggacucaggaggcagagacaggcagaucucugaguuccaguccagccuggucuguagagcuagaucuaggcuagccaggucuaaacccuauuagaaaacccaaaaagaaaaaaagguuuaaaagugguguaagcagacuacguuuaugauacuuggcuaagccuuuugcucaccuguggucucaggugucuccuuauacccuuccucucacccuucuccuaccuccuaucagcucagcgccuuccacagaguauccaauuccuauuucagaugacaccuaguucaggugacagcucuauggagcaggauuaguauugucaucugagcauuuaguaaucucaccacuuguauguagacaaccuauauacauguauauauacugcacccagcacauguaguauauuauguauuguauguauauauuuccuauguauauguguacuucauguauauauuuccuaugaguaguagucuacauaucuuuuuaaacgucucacaaugacuuccaagucagauugccaaaugugagucuugaauuucacucauccccaagggcucaucuuuaggugcuaccugucucagagaccugagaauuauauacaaugccauuuuuuguuuuugucuuuuucuuaaauuuccacauccagauuugucaguucucucccuuuuuauauuuaucaaacuggucuaaguacuccucaccuaucuaacagccucuacagcucucagccugcaggucauggcccaugaccccucugggguugaaugacccuuucacaggggucgaauauauccugcaucagauacuuacauuaugauugauaacaguagcaaaauuauaccuaggaagaaguaauaacuauaauuuuaugguuggggucacuauaacaugaggaacugcauuaaaggguugcagcauuaggaagguugagaacuacuaaagguggcuuuugguccuuugaaggggaaacuuaaggguucuuugaaaagucaauuguguuggaugguguuuugcuguagcaaaauacgugaaggaguguuuuccuuacacuuaaggaauuccauuacacacaggugaaagacuaaggcagacucaugaagggacguuucccugaagcagacacaggagagagaauguucugcuaaagcaagcacaugaaaggacaugugaugaaggacucuuugcuaacaacucgcaugagucguucugccuuacauugcauaauugagcuccauuuguugggacuccauagaaagaaacgcaccagaaaacuucucuuggugugcugcaguuucuuacugcuuccgaggacucaggcuaauugccagagugaucucagcugagacagaccugaauuuuagaagaaguauaaacaggacuccagggaugaugauggaggcugagcuuggcuuguuuauauaguuaaaggcuuguacccaacuggacugcugguguauccguaagguguuugcgaauggaucgagcugcugcugcugcugcuagccuaugaagugaacugccuauuuccagacaacacagacaggaguugcuccaaaaaacuuuucuaaacagguccacuucccccauauccuuuuccacuaccucugaugagugguggacuacaagggagauuucauuuaagaaccaggauuaaaaguagguuuugaaaaaaauuaaaguuacaguccuugucuuaccuucuguguguguguugugugauguccucucucuccaucauacacacacacaugcacaagagagcgagagagagagagagagaaauaugcacugccuccugaguacccagauuucucaaacauuauuuguuggaaauaaacaugugaguuugagauccugaguuaaaaauucaaaggauaaauacgcauauuuacuucagcucucugugucaugggucccgcuuucuucaucucagauaguguucaccuccaaugcagccauuugggcccugcuuucugcccuacaagccucuaaaacccuagagacacuuuucuccucuucuucacaggauuaacagugaccauucuuccccuuaagguuuaugucccuagaaagucaucuugaugaccucagagaauuucauuccacuauuuucucuggugcauucuguucuagucuagucuagucuagucugauucucccaaaacuuucuuuaacuccucuuaggguuccuacugcuuugaugaaauaccacggccaaaaaacaaauuggggaagaaagaguuuauuuggcuuacacuuuuacauugcuguucaucacugaaggaagucaggacaggaacucaaguaaggcaggauccuaaagguaggagcugauguagaggccauggagaagugcuguuuacuggcuuucuucauuccuauggcuuacucagccugcuuucuuacagaacccaggauuuccaggccaggauggcaccauucaccacuggcugggcccucccucauugaucaguaauugaaaaaaugcccuacagcuggauuucauggaggcauuuccucaacugaggcuccuucuucucugaugacucaagcuuguaccaaguugacacaaaaccagccaggacuccuccuccuccuccuccuccuccuccuccuccuccuccuccuccuccucccaucuguucuggugaucaucaacacaucacauaaauuugguuuuguuuuuuguuuuugauuuuuuugcgaacaaagauuguauuauccuuuuauuaucuuuauaauuuuaacacauguuaauuauaaaaucuuugggguacagagugccguugcaagacaugugcauaaggucacaugucacaccauguaccucaucuggaucaugucuauucccacucaccauugaucuguaugugacagaagauuugacaaacuacuuagauauguggacuaaauaaauuaucuuacuuaccagacccugagcuaagugcuuuacccguauuaucucaugaaaucuucacaacgaacuuaggagcuugcucuuauucuauuauuagcccauuucacaaaugaagaagccaguauccagaguuacuaaauaacuugccccuaggcaccaaacugugugggugugacuugugccuaccuccuuugaagauguuaauuugacaacuaaagugacaucaaacaugagauuuccaaaucaugaccccaccacaugucuuuugagcaacgucuuuugagcaaaccugaaaaucaugauacggaagaaucaacaauagaaucuggggcuguugguugcaagaaggggagaccugaauuguacuugcuuagugagccugagcgauccacagacuggugaggcaagguaacuuugcauaacacaccuccaacugugacuggccugggcaaauagagcugggucaagaaaccuaguaagccaagagagagagagagagagagagagagagagagagagagagagagagagagagagagagagagagagagagagagagagagagagagagagagagagacuugcuuucuugcuuuucauuucaguagcaggaaaacucaugucugcgucucuucuucaguuggccaccccuguccacugggcuacugcuacugccccaagagaguacguagcacggcuacaguaaagcugaugaaggcuuuggucugaggucugcagcaguucagagugguuuauucaaaggugccugugaauggucuccguuuacucucuugccugcccaggugcagcucugccuuguuuuguuuuccuuucuaaacaggguuucgcugugcaggccgggcuacugacaaacuugagauucuacugccccagucuccugagugcugauagagugcaccacugugccaggcaguacauagaaguucacgucuugcugagagaggaaggucuaaauauuuugagaggaaccuuauguuagcuggccaugaagagugccaccuucauuuauggggguuggauuaggggcuguagauauuauuguuguucaguuaucauuaugcaugaaauuguuuaauuauacuuaaauagcuugcaaaauugcagguuucuguaugguucauauaccuccccuucagacagcacuugaacucucuguguagcuagaaugacuucgaacaucugauuguauugccucuaucuccuaaguguaccacauuaaggacuuuugaagugccauugccgucuuaugaaaucauuguuguuuugauuguugagauaauagcucaguggaaggggcuugucuagugugugugagucacuagguuaaauaguaacacacacacacagaguaaauaaaauaauagaaaagaagagacaggacuagagaauccucagugugcccaugaggugggaggcugguggagaaaccgaguaccacggugucucuagcuuuuuggguaggacucuaagagauggggguuagcuaucuuacuucucuaaggucucagauuugcagcucgggaauggcccucuaaagugggccuggugcuugcauuuugaaugugugagauucauagauacuauccaaaacaaagcaaauucagaagaaguguugcuucgauacuuuucacaucaacaaacaugucaaggcaacacaccuugugugcaaaggaucagccuucugguaugggaagcuacaccaaggccaaguuaagaaucgaacugaugggugaccguaugauuaguaugaaggagagagaugugagcaagggcugauguagccagccuuguauuuaaaagccuuucaucuuaccagggaaaaagagccaaagacuuuacuguugucuuuuuuucggacugaacacagggcuucggcacuugagcuaagcuuucugucacugaccuccaaugcuaacuccuaauuagucucuccguacuggucacucugccucuccguacuggucacucugccucuccguacuggucacucugccucuccguacuggucacucugccucaccuccaguuuuucuccaacacuccaaguacacugaccuccgaaacacaugcuuauguuggaaauaaacugcaucuugaugcauuccucuuguaucuaaaaacucaccuucaaggcuuucuuucugaucugggcgcaguaacucaugccuguaaucccagcaggaggauugcucugaauucaagcaugcuacauaguaaaguucaguuuggucagaguuacagaguaugccccuauacguacgcagcagauguguggcuuggucuucauguggcucccuaacaguuggagcaggggcuauaucugacucuguugagagccuuugcgucccuuuccuauaguugggcugccuuguuuggccuuagugggagaggaugugcuuaguccuacuauaccaggguggguugguaccugcccugaggaaggggggggggcagaguuggggaggaguguaagggacgagaggagggagagacacugccaucaggcuguaaagugaauaaacaaauuaauggaggaaaaaaaaagaguauuuuguuuuucaagccacuagcagcagcccauguuuccauagcaacauguacauaagucuauuaacauuuaaccuucauaauuauuuuuguugcuggagauggaacccagaaucucaaggauagguaagugcucuuaucacugagcuagcucugucauuacuaauuuggauguccucccucaguaaagcucaguuucuagaaagcuggagcagucuuauuuauuaaauccuuaaggacaacacuagcauuccuuuguuuaguguggaagggagcacacacaugcggagaagacggcuaguaggagcugguggguccggggauggaguucaggucaccagccauaaauccuaacuuuggaugcacaguugacagagcucagaagaugccuuaaagugacgacugagcgcacugcgcucugugcgagcaggcugguucuacuucucauucaguccagaacauuuuguuguauaaaccguuuuccuuagcugaacacaguggcacacgucuuuaaucccaguacuuagguggcacaggcagguagaucuuggugaguuugaaaccagcuuugucuacagagcaagaaaaaccaaucaagcaaccaaucaacuaaacacaacaacagaccuuguucugaggccaguguucuguugggguuuggaguuugugagcuuauaaguaaacaaaaaaauuaagcaaaggacaggggugugcccucaucugaugcuggcacuagagagauagagacaggaaaacuaggaauugaaagucucccuuggcuacauaguucaacaccagccuaggauauaugagacuuugucuaaaauaauaaacuaauaaauaaaaucaagugguuauuauagcuguguuugguuuuggggggccuuuuauucaauccuauuugucuuugugucuguuuugcguggcggccauacugggguuuuuaauuuauuuguuucauuauggaucugugagauggcuggagaagaggcacuggaaagcucuuucugcuuaggagcguggaaggcaggagcuuacuacaaagcuugagcucgccucuugccugagccucuggagaaaugggauuggagcuaugugcggucaaaccuugaucaguaugcuucugaaguguagaauuuccuuuuuauguguguguauguguguaguauuuuuuuuaaucuuaacauuaucucuaaauuuggggagauaggagcuaccucauuuacuaugaaagaccccuaggagcuacccuguuuacuaugaaagaccccuaggagccaccccguuuacuauaaaagaccccuaggagcuacccuguuuacuauaaaagaccccuaggagcuacccuguuuacuaugaaagaccccuaggagcuaccccauuuacaaugaaagaccccucucagguugcugaauuaacuugcguaggaagccugggcccaaggcaucuccugguucacuucacccugaaucaucgucccuucuuccaaguguucucaccugagcuuuaugaagguaagugcuucacacuuaagaauucaugagcaauuggugugacauacauucaugguuccugaagagaagcaagauaacuacccaggcaacugauggguuuggccacucagugaauagaaaccaauaauguagccaaacguggugguuuguuccugugaucgcagcacugggcagguugccgcaagaggaggaacaugaguuugaggcagcuuaagauccaggaugaguauauaaaaagcugcagugaggaucagcucagcaaaggcauaagcaucaagcagguucagagauucaggccauuccucauagguuaaacacaguggcuuacaggcagacacagugcugcacaaguaguugggaguucaacaucuggauccacaggcagcagggagacugacaccaggcuuggcuuggacuuuugaaaccucaaagcccucccccagugacacacuucuuccaacaaggccgugcuccuaagccuucuccauagggccacucucugaugacuaaacauucaaauauaugagccuagugggggccaugcuuauucacuguucucgucuggcuuauauaaaaauccacauuguaaucuacuuuuauauaauucauauacaguaaagcaguuuacccuuccuucaccccucugagacuacagggagcccugugguuaaauacaaagaaacugaaaucauguguuuagcucagcauuaauuuuuuaaaggauuuauuuguaucuuuuugucuggauauauguauguauaccgugugcgugucuauugccugugcaggccagagggugugugugucagaucucaugaaacuggagguaugcauggcugugagccaccaugugggugcugagaauugaucccagguccucuggagaagcagucagugcuuauaaccacugaaccaucucuccagugccaacauuaaguuacuuuuaauuuuuuaauuaaaaauuauuguguggccuugcagugguggcacacgucuuuaaucccagcauucgggaggcagaggcaggaggauuucugaguucgaggccagccuggucuacaaagugaguuccaggacagucagggcuacacagagaaacccugucucgaaaaaccaggaaaacaaaacaaaaaacaagcaaacaaaaaauuauugugugaucuggcagugguggugcaggucuuuaaucccagcauucgggaggcagagacaggcagaucuauggguuugaaaccagccuggucuacagguggguucuaggacagccagggcuacacagagaaacugucucaaaaaaaaaaaaaaaaaaaaaaaaaaaaaaaaaaaagaaaagaaaaagaaaagaaaagaaaagaaaaaaaaguguguguccagaggccuacuugucuccuaguccauguaugagaccugaggagagagcacuagggagcuggcuuucuccauccccuucacgugggcccugggaauugaacucaguucuugggccaucaaauuugcaauaagaggcuuuuauuuccucagccaucucuuugacccuuuuaauccuaacaauuuaaacugaaaacaugaauucacagauaaggaacugacuguguauauagaugcacagggcuccucuguugucuugaaacagggucauccccaguuggccaucuuucugccucacuucccaaaggcugcgauuacuaauaugugcuaccaugucuggcucuuuuaaaaaaacauuucgauaugugagccacgggaaauaaugaaagucuugugagguuuaacgcaugaggaguugaggguucugugggugggauguaggaucacgcgugcaucuugaagagauuacuagcuucugcagagagcggguuaaaaggccuggcuuagaagagaacauugugauguuuccuugaaagugugcaagcuaacgcaagcauucgcaagaugaguaaagcuuucagggaggaagaggucucgcagaagagagacacuauugcucuguaguuuugccuuuuuauguguccuuguaaaggggacaggguagagcugguuccuaacuacuggagaaagggaagacacaguaccuuuccccuaaaaaguccuugggaaaauuauugauuacugggguaacuguuaaccuccucucccaaagugaacgcauucagcuguaacauagccccauggcagagcauuugucugguucacucuguucaaccugucccagcccaaaguaucuaucucugucuauccauccuuccauacacuagacuacagaaaacucaacuucuaaauuggcuuaugccuggaaucccaccaccacuugggaagcugaggcagguggacugcugagaguuaaaaagucaaucaagguuauagauuaagacuauaaacaaaaugccgcaugaauaaaaaaaaccaaaugaauaugaaagacaaaaccaaaucugauguuagugucaucguccuggcacauggggaccuaaggcaggaggauaaauaucuuuguuuguguuuugguuuuuccagacaggguuucucuguguagccuuggccauccuagaacucacucuguaaaccaggcuggccucgaacucagaaauucaccugccucugccucccgugugcugggguuaaaggcgugcgccaccacacccggcugaggauaaauaucuugaagccugucugagauauacaguaagauccugacucuuaaacucccuucaugcuuggcuucauaaguggauuuguguccacguucuuccuaccaaggcaguuuggucacuucauauugcucaagaggcagaggcuccuaacuuuguuuuguuguuuuuguuuuuugagacagggccucacucuacugggacucucuaggagaccaagcuguccuacaacugaaagaaucaucugccuguggcucccaggugcagggacugaagacccgacucaccacagcuggccuaacuuauuuucuucuaauacugcaugucaucagguggcucuggcuuccuggcauucucuagguagagcaggcuuggauucacagagcgucuaaugccucugcuucuaggguuccccgauuaaagaaguguacugaccacaccggcucuaugcuauuuuuaugagauggccaugaacuuacagagauuugaggauuaaaggugugggacgccacugcccagcucuggucuccucuuugagguuucuuuccuggagauuuaaucucaucaaaaagacaccacuauuuuuuuuuuaaagaucuuuuguuaagauuuauuuuaauuuuguuuauguauuaaugugucucaccugaguacaggcggcccauuggcucucuuggagcuggaauugcaggcagcugugaggcacccaugaggguacuggggauugaagucuuguuuucuggaagcgcagcaauacagagccaccacuccugccucaugaagacuucuugaucuccugaccuuggaaugugcuauauuaauuuuggcacaaauguccagaccaugguacucauuuuucuuuuuuugauaacuuuccaauacaaucccuugcauguuuuuauucuauucuguuugugguuauuuacugaugaauuuugugaacuucuuccuacguccaguuuccaagugcuagguuuccaugccugugccaccacucccggcuuaauaguugugguuuauuuauuuauuuuuuguuuuuuugagacaggguuucucuguguagcccaggcuguccuggaacucacucuguagaccaggcuggccucaaacucagaaaucuugccugccucugccucccaagugcugggauuaaaggcgugcgccaccacugccuggcuaacaauuguguuuuuaaaacugauuuacaaugcuucuuuguaaaucagugaaccgacuuuugucauguauauacaagauuucucuuuuccugcuguuuaugauaaaaccacauuuuccuuuagggggcugugcagauagcuuguugguuuuuauggggcagaguguuuuccucuuguuuggagacagccuugguaaccucuacuggccuugagagcuuucagcaagucuccugucucagccucccuggugagguggcucacuagagcucacuuggaaaagucaaaugugguggucagggugugguaggguauguuagggugugcuugcaauugcugagcugaggcaggcaaaccccuggggcuuacugaucagcuagcuuacccuucuuugugaauuccuggccaguaaaacaaacaaaaacagcugggugugcuggugccuuuaaucccagcacuuccgaggcagaggcagguggauuucugaguucaaggccagccuggucuacagagugaguuucaggacagccagggcuacacagagaaacccugucuugaaaaauccaaaaacaaacaaacaaacaccucaaaacaaaaccagggccaccaagcccaagcucaaucauuugaugaaaagaacccacucucaacaggcccgaccuccacacacucccuguggcgcacacacacacacacacacacacacacacacacauauuaaauaaaaaauaggauguacauaugaacacacacacacacugugaggguagagguagagagggaacauguuugugcaugcaugugugugucaaaaauaauauaguaucuaauauuauauguauacacguauauuagauauauguauauaauguauauucuugagugacguuuuuagauaaaaggguaauaucaauacauauguguguguaugaauauauguuuauuuuuagcauuuaucuuaaggaagcagaacaggagcuuggggaugcagcucuuuugguugguagaaugggugcuauucccagcaccacaaaaauaaauauguaaauaaaacauuacacaguguuguucuugcaaggguguccauuaaaaagcuguuuaaaugaugacugggccugguggaacaagucuugggcuagcacuuggaagguauaggcuggaggaucaggacuucauggucuuccauggcuaaccugggcuacucgaggcccuacuucaaaaaaaauaauaauaaaaauaaaaaguuguuuauaaugggaaaauuggcaaaaguaaacaauaaaacaaugcccugguuaugucaaccaugcauauccacauaugguaagugacaaaugccacaggauagcuagugauauuaaaaugcaugaauugcuaaaaaugagauaggaccugacucacaaauaucaaaacuagagugcuaagcacagauacacuauuuucaugauauugauuaauuccggguacuggaaauaguggguaagacuuuucuuuuuuccuacaacuauauuugaacaauaaaguuuaauuuuaauguagcaauuaaaaacaauguaccuuauaauuuuagagauauaacauuguuuguguauaaaguuuagcuuugacaggaaagaauuacccuagcugaaaauauccucuagggucaggcacaccuuugaauguuugauccuccugccucugccuccuaagggguaggguuauacaaaugagccaccuuauuugacucuaauucaauuuuuuugaaagaauaacuucucuuuagauaagaaagauaaaagaaucaacagaaaaguuuaucaaggaagauugugaggaaagacaucauaaacucuuucugaaagucuuauucuuugcuugaguuugcgagaguaaaaugagccccaucuuucugggagaugaccuguaccauuucucagaagcagaucagacaaagggcugagcagcaaaggcccuccaagacacuacaggacaguguagucugaccaaggcucagcugagccaggucuaggugucacuuccuaucagucccccagggacagcaugaaccaucaccucuagaaguuuacaaaauuuaagugaaauuagggggcagacagcuugggauugccccguucuucagggguucccugguaagcauugggggauucccuuaaauauggcagaacccuaacacuaaguaugggggccacaggggaggacaggccccugcuuguuaguuggagacuggaaggggugggggaauuccuaaacacuccauuuacagagaaggagagccccuuguuagucacaguucccuuaguacagggcauuuggugguagauaucuguuucugauuccuucaagguuucugauuucuuguagguuuuagaggcagacaacugaaauaaacacacagagagacacacauucucucucuuuuucucucucucucacacacacauacauaaacacacacaccuacuccucucaccaauacuauuuggcuauuaauuaguucaauggucauagaauuuaauuuacauaaaucuaguauugcuauuuauuuuuuucuuuucaggcuggagcuccugaaugccaggcuggccucacacuuaauauagcuaaggaugaagucugguucucuuccucuccuuuccaagugauggagucacagguccaugcuagcaugccugguuucuacaguccuggggaucuaaccaaggaacgcuuuuauuuuuuuaugcuccagacuuuacucucccuccccucuaagcccacccugcauccacccucugacuguuucacaucccacaccuccucuucaccccugacuccacaaggauguccccaccucccacccaaccagaucucuaaacucccuggagccuccagucucuugaggguuaagugcaucuucucugacugaacccagaccuggcaguccucugcuauauguguuggggccucagaucagcugguguaugcugccagguuggugguccagcauuugagagaucucaggguccauguuaauguaucauucacucuuugagacaguuucucucuguauagcccuggcuguccugaaacucacucuguagaccagguuggccucgaacucagaaauccgccugccucugccucccaagugcuaggauuaaagaugugugccaccacacggcuccaucauucauucuuuaaaaguuacuuuuauguguguguugggggcggguugucuguggagaacagaagaggcaacuggauccccuggagaugggcuuccugggaguccugagccgcacaguggcuccccauccugagugucacucaauuagcucauguuuaaagauaauuucagaaagaagccauguggaaauuauuuaaauauuuguccauuaauucauuuuuugagacaagaucuuguguggcuuaggcuggucuaaagccuauagcagaggcuaguuugaaaugauccuccugccucagcuuccucauuucagggauuacaguaaugugcuaccauaccuaacaacaguguagaccuauaaaacauaaggaaggaugugcgugugaggaaaggcauuuacucauugugaaugccaaguagaacuugaacuguuuugguugacucgauugcuauaaaaauacauaggaagcagauucuagccuaacuuaauauaguuccuauucuacauuaauuagggauucaagcuugagaugagguaaguuuauuaguuuuugaauaaagcagaugauaugaauaaauacagaugacauuucucaaucuuaaucuuauaauugauugaugucaguaaccacuuuuuuuuuuuuaagggaaagaggcuggggugguuaaaauauaauguauuuauuugcaaaaugcuuagagucuuaaaaaaaaaaaacacauugaaaaccaagcaugucauugucacacuuuuccauacuacagcagccacagcaggcagguuuuccuucuuccuccaagguguauggcacagaacugucugaaaaaucaccaaccagaacucaccaacucacucugagggccuuuauccaaguacagggccuacggcaccugauggcagguggcaguacggguagaugauaggaagacaccccaagucaaagcuuuugguggcauggaaguccccucagucagcucaccgaaauuauguugucauaggugacaaguuuacacaaguaaacucaaacucacuuuagaauucaucaauuuuauuucauauacaaaacuucauuacaccagguaccaaaauuaaggcgaauuaagucaaaguggcuuugaaaaaucuaaaucgacacagcucaacacucgucuugggcuuaguucaaucagaaguguuaaggaaacugggcauggggcucucaccuuuaauccuagccuggacuaaggcaggauugcugugaauuacagguagccucaucuauacagugcuuucuaggacaaccagggacauagagugagaccuguauaaacaaaucaaaaguuccauugagguaaguugggcauggugacagacccaggcuggagaguucaaggccagcaggcuacauaauaaugcugucucaaaaaaaaguguuagcaaauauuaauuuauaacacugagaaaaugugcuuuaaaaacuugugugcaugggcauuguuccugcagguaugucugucugugcaccaugugugccugguaccugagcaaauccccuguugcugcuauuacaggcucugagccuccauacacuuacacaggcagucgccauacacaggcucugggaacuuaacucuugaguccucagacacaacagccaucaaucugaauuuuaaaacuugaaagaugagagaccaccauuuaucaacugcucucuucacuccacucccaccccaaaagggaaacuccagguggguggaugucuguggguucaaagccacucuugccuagugaguuccaggacagcuagggcuacauagucuuaaaaaaaaaaaaagaaagaaagaaagaaagaaagaaagaaagaaagaaagaaagaaagaaagaaagaaagaaagaaaauuagccgggugugguggcacacgccuuuaaucccagcacuugggaggcagaggcagguggauuucugaguucgaggccagccuggucuacagagugaguuccaagacagccagggcuacacagagaaacccugacucgaaaaacaaaaacaaaacaaaacaaaacaaaaaauuaagaaaggcagggggaaaaaaaacaggaaagaaagccugaaauaggcucaaacauacgaauuuuuaaauuaagcuugugcaacauggugguucacaccuguaauaccagaacucgagauacugaggcaggaucuuuguguguaucccuggcugaccuaaaauguagacuaggcuggccuugacccuguuucaaaaaucgcucccaauaaauaacagauaaaucgaccucacuuugugaauuaaugaguguaaacgugcuaauguuuuccaaauagagcauaguuaauggggagggugaguuuaaggguucuuaauuggcaaggccucuuucugaaaaacaaaaacaaaaaaguaaacuaauauaacuuagggagguucauuuccagcuuagaccgauguaaucacucuaaauuccauacgcgaugccaagagcuuuucucaaaauccuaaaaauuaauucucaucuacacacccugucuucggagcugcacucccuucgcggccgcacgcggcgcccgcagcagcugacuccuccccguucauggggaaaacccugccuaauauuuauaacgcuaugacauacuguaauacucacaaggugguuguagaaguauaaacacgacuggagauaucugauuggcugcuggugauguaacacccaugucaauacuucccacugaacgcacguguucgaccuuuuauuuaaauuuccauuucaucacagcaauaagacacucggggcggugcauuuucugcgaaacgaucgucgcccggggccagaggugcugcccggcguacacaaggagcccaaggagguguccucgcgagggaggcaccgccugguccagucuuuugugcaggaacaaaauaaguucacuuccucgggcacggccacccaccccucccccggcagaugacagggccgggcgcgcucccaccgcacuuacuccuggagucccaggugaagucguggcgagagccggggaccgugcgcacgggcgcgccgcggcgagccggccccugacacccgccagcuguuuguccuggccgagccggccccgccccgagaccccagcccgugccccgcccgcuuccuucccguggccgcacccccgcccgcgggcccgagcggccggccccuuucccgguccccgggcgcccccggcccagcccagcccggcccagcccgcccccucccccggccggcccccacccucucccccuccagcgguuacugcuaccccggugcauugugggcgcacgguccguuguucauuugccauucgaccuccgccagggccuggucggacggaaacgcuccgccggcuuuauugucggcucgcuauguggcggagccuggcggcuuagcgcgccucucgcguccgcgccucggcagccggcggcggcgacacgacuccccccgaggacggagaucuguuggcgggccggugugugcgcgcagcgcugaagcggggcagcggaggggcaaccgcacuccuccucaacuucgaaggccgcacgcgcccggcucgccgcuccgcugcccgcccaccgcuccgcgcgggacgcugcccggagcgcggcggggcgcggguggagaggacgcggcugggacggcggcggcaguagacgcgugcggcggcccgggagcgagcgcgagccggcgggagggugaggccgggccggcgggagcgcagcgcagagcggcgcagcgcagcgccgggggcgggggcgggggcgaagcguugggggagccgcggcgagcgcgcgggacgcggccggagcccgggcgcgagccgaggcaccgggcggcggcggcggcggcggugaccgcggcgcgcgccaugucguucagugagaugaaccgcaggacgcuggcguuccgaggaggcggguuggucaccggcggcggcggccccacgaacaauaacgcuggcggggaggccucuucuuggccuccgcagccgcaaccgcgacugcccgcgccgcccgcgccgcagcagccgaaugggcgcggggccgacgaggaaauggaauuggagggccuggagccccaggacucggaggccgccgccggcgcggccgccgccgaggacgucaaggaguugcugcugcucccucaggacacgggcggccccuccuugcugggcggcggcgcggggggcccccugcuagcggaaaggaaccgucggacucuggccuuccgcgggggaggcggcgggggucucggcaacaauggcagcagccgcggccgcccggagaccucggcguggccccucaggcauuucaaugggcgagggccggcggccguggauccggagcuggacgcgcuggaggggaaggaguggaugcaggacggggcgucccugagcuacagcaccgaggaggagggggcgagcccgggcgauggcaguggggcggaaggcggcagcugcagcagcagcaggcggucgggcggcgaugguggggacgaagcggagggcagcggugugggagcuggcgaaggagagacuguccagcacuucccgcucgcgaggcccaagucccucuugcagaagcuccagugcuccuuccagaccucuuggcucaaggacuucccuuggcugcgguacuccaaggauaccggccuuauguucugcggauggugccaaaagauccccgaggaugggggcggcguggaccuuacccagguggggcaugaugagcuuucgcgagggacccgcaacuacaagaaaacccugcuccuaaggcaccacgucuccaccgaacacaaacuccacgaagccaacgcccagguaccguagauccugccuuugcuuuucgaccacaucuuuugggaaagguuuaucaguggggaagacuaaaacuaaaguaaagaaggggggaaauuaagauccuccgggggaagacucacuucguuccgaucgagagagguucgcgagagcuuaugcguagggguuuagaaagccuggaaacaaaguuuuccaaaguuguggaucuauugggggaggagggguagaaggacaguuuucuaaugauaucgcuggguuuaucuucuuuuucgaguuaggguuugccugugagauugaauccgagagagaggcugggagagguuggagauuuuaaccuuugauugacuuucggucaaaaaggauuuuuuuuuuuaagucagaggagauuuuagaacugucccuucuuguguucguagacacuaaaguacuagaaguagccugaagaauggauuaaacaguuuccuuaagcuucggugcuacaggcuguccacucuuaaacucgugucaggucgagauaaugugaaauaugagaggcuuaugcaaauguacaggaaguuaguucaguaggguaaauaauuuuacgauguccgucucuguuaaacuuguuugguauaaucauuguacacuuuagcuaguuacuuacugauauuucucuucugaguguauuauccuuuucaaaaacauggucgugaauagcuuauaugaaggguguuaaucuuagcucuggaaauguuuaaugugaagugauuugggcuucauuugcucacuggaaaccuaguuacagagcaagccuaccuaugagcuuuagucccccuccccccuuuuuacaggagccugaccguuuugauagcccuuuucaagucaaauagcuguuggucagucuuccuuuuuaugacucagacaaccuguggugguggguggaauugauucuuuuguguugcugaccgacacucagguauuaguaccucaccaugguguuuaugggagccauccugcugcucagcacacuuacacuauaguuuauuagucacacaaguaacccagcuuagagaggcuuuaguuuuaaaagcauggguuauuuuguuugguuggguuuuuuuuuuuucccccagaaggcagggaaauggagcuuguuuggguugaguuuuuauuugcacaaaauuuccuaaaucuuagaaaggucucuccccuauccgccccccccuucuuucucuccucucuagggucucuggcuaccuuggagcucuuaaguauauagaccaggcugguuucaaacucaccgaucugccugccucuggagugcugggauuaaaggugugugcuaccacaccuucugaaggucacuuacuuuuaagauguaaagcccauuuaguaaauugccuuaaacccuggaugacagccugaggcuagugcuuauaaagacuuuuguaaugggggaaaaagugagcuuugagcaaaugcagguucugaucucaguuuucuuuaucacuaccuuuggaguuuguccuggaaguuugauaggccugacacuuuuguuuuagcuguaucagacucauuuacauuauccaggaaaguaaauuuguuuccuuuuauagaagaagcauuucagucauuaaaggguuaaggcuuuucagucuuuaagaguuaaguaauaaauaccuggaaguauuuaguaagaugauagaagcuguggcuugugaaaaauggaaggcugaauuuuccaaguauugguauguaaguauuuuagauuuuuuuaauuggaaugaguuuuuaaaucuaguauuuagaauauucuguucuguaggcaaacaugagugggacuaaaaauuagcugcucagugauccauaacucagaggggauuagguggauaaucuuaugguccacccuaguaaauggguguauccugcaggcguguaccuaggucuccagagcucaguucuagggaaaaaccuuuugucaacuugacucugaacuacccuuuccauuucccgacgacauggugguuuugugugagguaggagccaucccacuuuuuaagacuuggguuaacgccuuaaacuugaggaguuauguauugguuuccuugguugaauuuuagguguuaccacuucaucauuuaucuucacuugugacuaaccuuuguuugaggaauagcuuauucuuccaagaaacaccuguaaagucucuuucccuuguuaacagugaccgguuccuagcaggauuugaugggguggggguugugugguuguuguugcccuguagccuuugguuaccuuuaggaggcaguguaacauucuguaagaacauucuuggguccugguccucuaaccguuauuuuguaucaugcuuauuuuauuauagcuuacucuuagacaagcgugaagacagugucuuguccccugguuggccucaugccugcuuugacccucuuaccuauuucucaauguuuggacuccuggcccaccaggccccagugaggguuuaacuaguguuggguagcugaucugguaccuuacccuggguagacccaagcucucacugcugagcagcacuccccacgcccaagauugguuuauuuccuggucccucguucauaagugccagcguuuacauuuuuaucuuacuacaacagaaucuuggguagcaugguuugaccucagaaugucuuugugucauccauuuugaagccacuuuguaaugguauuauucuugaauggagagcagauuauuuccccauucauacuuuccaagacugaggcccauaagccugggcauuuugaguuuuucucacuauaaauguaauucaguuucauaguguccuguauuauuagcuuccucauuuuaaaaaugagauggaagcugcugaagagauggcucggugguuaagagugcuuguugcucuucacaaggugaggucugguugucaucacaugguagcucauagccauccauaauuccaguugccagggcauccagcaggcgcaaaugugaugcauguguguguggucauacauauaaagcucaugggaagugaaaauaugaaggucaucuucagguauauaccugagagacaguguaaaaauaaaauacuguaugugaguucugaaacucaggaagggcugaguuugaccugggcaugcugucaacauucucuuaaacccagugcugucuaaaacucaaggcaccaggagcucagcucuagagcagccaauagggcucuguaauguaaugagacccuguaggccggaaggguuuacucccuccuuuccucacacuucucuuuccuuugagacacagccucacuuuggggcagacugaguuugaauucaugaucaccuugccucuaccuccaguucauauggauaguucuaagacuuccuuuccccuagccccuaggauuucucuauguagcccuggcuguccuggaauuguguauccuagccugaccucccugcaugcugggauuaaaggugugugucaacacauccagcccucauucauuucaguuuuucuagagguaaggaucaaauuuaaggucucauuuaugcuaggaaaucacucugccgcugaucugcuccuuuuuuuuuuuuuuuuuaauuaaaagaccuuuugugaugucauaaauguuuaauuucccuuuuuauuauguguguguuguguauauagugggugugcacacuuggguugcaggugccugaggaagucagaggcaugggaucugcuggggaacuuaguuucugggcuugugaaucagucaccugaugugaguggucagaaugagaugccagcccuuggaagagcagcaagcgcugcacggucaucgcuucagucucugauugcuucagucucugcugcgcugcuuuuauuauuauuauuauuauuauuauuauuauuauuauuuugcuauugguuuuucgagacaggguuucucuguauagcccuggcugucuuggaacucacucuguagaccaggcuggucucucgaacucagaaauccaccugccucugccucccaagugcugggauuaaaggcgugcgccaccaggcccggcugcggugcugcuuuuaaagacaguauuuuacuuugcuucauagccuggcucaguauccaacagaagaccccaguacccuggucuuguaagugaugggacuucaagcuuguacaaugcuggguguucuugcucauuaguguuuugagacaggaucucuucauauaggccuggcuagucugaaacucacuuuguagaugagccuggccuugaacuccagagauuacugaccuaucucugccucaggaguuccuggggcuaaaagcauguguuggauuuuugaguuaauauguuguuauuaguacauuauuaaaguuuacuuuuauuucucauuuucuugggaggucagguacgggaauugaaaagcuaaggccucuugcacacugguccaagcuuuacuguugaacugugucuuuagugccccuuuuacacagaggcauggcuucuuuguguagcccugacugguccuccucugccucacugugcuggaauuaaagguugugugccgccuccaccaccaggcccccccuccccccauuuaagacaggaucuugucaggcauugccuaggcuggucugggacuccuaccugcaagcccugguaggccuugacacuugugaguguccugguucaggcuccugaguugcuggaccuacagacauguucuuugcccaggacuuguuucuuauucuuuauauaaaaguccuuucuuuuccuucucuucuuccucccucuccuccuccucuucuuacuuuguuuugguggugaccaaaaacaaacaacaaaacuuuuuggagcuagguuuuugcaagguuccacaggcucguuggagccuaacccucuggucauguccugccugcucccugguaauuggaaguccgagucuguccgugcacuuggguucagggccugucuuuuuacuuagaccuuaguuguuagggaccgaccccaaggagaaguggggcuuuggcuuugguggugggguuugggguuuuguuuuugaagcacaguuucucaugaccucaaacucuuacgauuauuuuaagacguguguguguguguguguguguguaggcuggagggcagcuugguggauguuacucuguaaguugugggcugccaagcaccauuagcugucagguuuaugugaugagcacucuuaaccagcuuggggaucucugggacuuuuacuucaaauugugccucuauugcugggucuacagauacauaucuguaggcuuggggaagaacuguguuguuugggggaggcguuuugauccuaggguucugugcaugcucgcuagucaagugccacugacuacauccucccugggaggaaucgaagauucuuguaagagaggacccuccauuggaaaguaagacacuuguuuggugcuggagaucucuauaguuuuuuuaaguauccucagagucaauuucaagaauuaucucauucagaauuuggccauuuggcccagaaagauuuuuaaauugcuuuaauuauagugauuaccacuguagcuugguucagaccacuuucuacccaauugugaaauucucagagcccagaucacucauucugucaacucuaugcagucugcuaggccuacagcguacacccaaauuauuauuauuguaagcuuaguuaaccuuuccagaaauuaaacaugaauucaacccagugaugugauugaaauuacuaguuggaauacguugaugucagguggaaaagagaaaggugaggcaggucugccagcccuugcuuuggaaacaggaaguuccaaagguuaguuguauacucuugcuuuuuuggcuaguuuuuaacaacuuagaaagaaaguguuuuuuuguugugaucuauguauacauacuuggcauguaugaauacaggagcaugugugcuauacagcauguguguguauggacacaaauggcuaacaacaugauuuuuaguaagagaaucaaaugucuaugugcuccuauuuagaaguaccagcauacugcauauguggguuuacaauuugaggagaaagcuuauaauaaagaucuauacuagccgggcagggguggcacaugccuuuaaucccagcacgugggagacagaggcagguggauuucugaguuccaggacagccagggcuacacagagaaacccugucucagaaaaacaacaacaacaaaaaagaucuauacuagaggccagguggugauggcaggacagguuuuuaauuccuguacuugggaggcagaggcaggggaaucucugaguuugaguuugaggccagcauagucuacaaagugaguuccagaacagcuagggcucuacauacauacauacauacauacauacauacauacacacacacacacacacacacacacucauucauauucauucucucucucucucucucucucucacacacacacacacacacacacacacacacacacacacacacacacauguaugcaaaaccaaggauuagaaucacuugaaacucagcuccucauucccaaaaagaauuagaauuuaugguggaugugguauuguauuguauugccuaccacauaggcagacagagguaggcugaucuucguguuggucugcauaguggauuccaggccagcuagggcuauguagucagacccugccuuaaaggaaaugaaacaacagaaguagaauuucuagggauaguguuugagccauaaaagagaauaacaucaacacacaaggcacuguaauagagaugauagacugcagaggagaacugaucuacuuuuuuuuuuaaaucggcaguuaaaugcguuagcaccaguagaagauugugauuauauuugcuaugaccuuguuugucuucacauucuagaaauugaauuuuauuuuuaaauuuggaaguagaaauuauuuucucucaauauacuguuccuagugaguuauugaaacaaagcaauacugauuuuuauguacuuuagguucauauacugauacuugugaaaaugucuuuucugcugauuaucguagacaaaauucugagcaagaaaggaaaacagccuuuuacacuaaguguuuuucuauuguuguuaaugggcugauaagcuguggucaagucuguaucaguuagcuuugcuccuucaccucaaaggggggcuugccuagugguuuacagguugcagugaaguucuccaagguagaauggggaaagaguaacugccaucucucccaggucucaucgccccuuaacaucgccuucccuaguuucaaggucuuugcuuccucuaauacauuacaucacacucucccccuuuguaaauaagccaagaggaaacaguaaagccuggcuggccuuaaauucgcucuuuucaguuuuguguguauuugucugcauguauuuauguguauaccacaugcauaucucauauuagcugagucuaagagagucuccugugagacaugacauggauaccaggaacucagcccaauucucugcaagagcaccaaauaauguucugagcucucuccagccccggaacucaaccuucuucacugaaugauuuugaacuaauggucuuugucuccauaaccccagugauugggcuacagcugcauauaucacuguaccuggucuuaggcagugcuguggaucaagcacaggacacaggacuuugugcaugccagacaagcacucuaccaauuaagcuacuaugcuagaacuauuaacaguagguucccagcuggucauagcauuugucuucauucucugguauugauuccucuucacauuucuuucuucagucugucagccaauccaauguaucuuuuguuaagccuggaccuacacccacacccacacacacacacacacacucacacacucacacacacucugucucucuacuugucucuuucucucacacuuacaauuaaaaguuccauaaggcauacauaacagcaguucuugcccuuuuugaaagauaagcuuuuauuuauuuguauggcacugggauuugagccuaggguuaucauaggcagccaucccagcucauuacguuuucauuuaaagucaggcauaguggcacaugccuuuagucccagcacuuaggcagaggcaggcuuaucuuugugaguuccaggacagccagagcugcacagagaaaccaaaaccgacaaagcuugaacuugagacccuccugcuuuagcuucccagucacugccaccguuaucagccuuugucuucaggcucagcucuaucaguuuauugugguccuucuguauauagcucagaauggccuggaccuuguuauuguccuguucauaucccagguguugggauuacaggcaugugucacuaggaauggaagugcugcuuguuuauaaaucugauggacgugggggguguuuacaugugggaacuguguuguuuauuugugcuuuauggacacuggguuacaccuugcaucucuuaugaaucuagacuuuuaaggaugcuacagagcaucuugguuaucuuuuuaaaaugguaucucauuuguuuaaaaugugcagccuccugccauauuaauuucuuaucuucaaagcaccucuguccccacagggaaauuggaauggacaccagcucuuagauagcauagaccugaauccuuuaacauuuuuuacucuaauacaaagauuugauuaaaggaauuucuuaauuuacuggauucagcaaauaaugucuuuauuugcugugucuacuuaguuguuuugcaaaaaaaaaaaaaucuucuaaucucuugggagagaagauaaauucaugacuuuuuuuuuuuaaagauuuauuucauuuuauguaucuggguacaccauaggugucuucagacacaccagaagagggcaucagaucccauuacagaugguugugagccaccaugugguugcugggauuugaacucaggaccucuggaagagcagucagugcucuuaacugcugagccaucucuccagccucucaugacauuauuuugaagaauuuuuuuucuuuaaaaaauauuuaucuuauguguauacuuguuuugccugcauguaguauaugaagaacauguauaccugguacccaaggcggccaggaagaggguguugaauacccugggacuauaggaauacauagugagacuucccauccagaaagggaagguaaaacccacauuaggaggggguuauaucuaauuauugcaaccaucuuaaagcuacgucauuagauccuacauuuucugaaguggucccaccaaauuauguaauuauguuacauuugucacacaaaauguccuuauuuuuaaaaauuacuugaaauugcuuuaaaaauuacagaagccuagccacaacauacccauauuauacaaaugaaauacuauguaaccaccauuguuuuauugccacuguagaccaccacccaccguuugcuuucacagagugacuccuuucccacaacucacggaaggauaagcuguguacaacagcuacuaagacagcccuuuaccaagcuggcagagcucagggugcuuagggacauuuguugcuauuagaggaggagggggacccagguucaccuuccccacacuuagagauuggcucaauuguauauuccagacaggccuacaaaaugaacuuccugccuuggcuuuccaaagucugauuauagggcuccugaucauacugcuuguuauuuaaacuuuaggugguuguuuacuuugaaaugcuaauucacugccccccacagacuucauagaaaugcugccauaguuugucagauuccuucuuccaagggaucuccccuuuucugcacuaucuacuagguagacucagaaccaaacaaauggaccugcuuguuagccaggucuacagcagcaugcaucacaauguuuagagcuaggucuguaccaaaaggaaaguugucuuucaugcuuccaacugucugaagagcaagguaacauucagauuguuuuaauuuaaacccggguucagcccggcgugguggcacacgccuuuaaucccaaaucccagcacccgggaggcagguggauuucugaguucgaggcuagcuuggucuacaaagugaauuccaggacagccagggcuguacagagacccagguuucaucaggucugugugauuggcucuuuucauagaaagauagaacuuuauuauggacauuuuuagaauugucauuuuauguaacucuuuugcuaaguaguuugaaauuuuguaacauggcuuguauaucagauuuauguuuuaaaaaauagccucuuagaacucggguaggucucaugcauauucuuugccagggauugaggagagaggagagagaagggaaggggaggggcuuauuagugaagcuaaagcauuucccucccagaauucacacuguaguacuggcugccucgccugccuuaggagugcugggauuaaaggcuuuauucuaccaugcgugcuccagcuauccccucauuuuugaagccucacuuuuuucaaagcaaaaaguuaagacuuacacuaaugaauagguuuguuucaccuacguuauucuuguagaguuuuugaagaucauugagucauuuuaguagaggaaaauggcuacuguagagcauggagcauucuguauaauaggaugggcuugggauguuugcuacagcacaauggcuucaugagacuuaaucuccacuaagauuaaggcugccaaaggcauagugcagcuagauuucuacuguguuucccauucuucagucuggagcagcucuuuacacugcagguccgcaggcgcuccguccugcuccgucgugcugcagcagcagugaguacuagagugccaacagucugugcugcugcuggucucuuacucgacaguuaacaaugggaaagagugcagaaauacugcgaaagcaguguugaaggugguggggauauacaaaacucugccugcaggacuugccugucuaguuacuagugaagacacguuaauaauaagaacgaauuuuaauaauauuacuaccacucaaggccucagggaagacugaguugccaaaggacacauucugaaauuagaucauacucuaauuuuuauagcauguaaaucuugaagauuaguuuuauuauuugggguggggguguaguugcuuugcaaccaaaagaugguacuagauccccuggaaauggaguuaacagaugguuuuucagccaaccauguucugcugggaauugaacugaacccacuccucuguaagggcagcuaaugaucugaaccauuaagucauuucuccagccaugucuuaguguuguauguuuuuucuugcagugcuggggauugugccagagggcacccuccuccccgacaccuccuuuaggcuggucucaaacacacuggaguuggggauggccuuggacucuuccccucucagcuucaccaguaugauuacagcuuugaacuacaugguagcuuaauugcuauauaggaaccuuauuuaaagggaugcuaaauagaauuagaaugaauacuugcauacccaaugaaaagcaaaauuuauauacaucaaagccucuugaauucaggaauuuuuaaucaccuuauagaugagauaguauuugugaccauaaagagaaggcauuuugaaaguugacuagaaaaauaacuggauaugcucauaguggaaagaaguuuccacuaguuuagauuuaauuaacaucauugaucugaaccauucuauuacaguguuugccugaacuuaaguuuaccuuucuacuuccuuuggcaucugcuuuccuggcugauagagcagagugauuugaucucaaguaaaugaucauuucuuucuuuuguggggggugggggagugguuucgagacacgguuucucuguguagcaccagcuguccuggaacucacucuguagaccaggcuggccuccaacucagaaauccgggugcugggauuaaaggcgugcaccaccacgcccggcgauaauuucuuaagaaaauaauuguuacuuuuaaguuuugaaauucauucuuagcuuauaugugaaaagaagccaaugaaaucaugcugauccuuggaugucuuucucuugcuugcccccuccuccccuucccccccucuuucucucucucucucuuucuuucuuucuuucuuucuuucuuucuuucuuucuuucuuucuuucuuucuuucuguaauagcgaguugcgccagccuugauagacuucuuuuggaguuuaauauggugaauauuuuuaucucaaaguguauaacuauucaugaauugucaugcuugaauaaugauuuaacaguuauauuuguuucccuuggacuuauaaaaauuuauuauaacauuuauauuauaaaauuuaauguuaauguuuuucuccaauuacaggagucagaaauaccaucagaggagggguacugugacuuuaauagcaggccaaaugagaacucuuauugcuaucaacuucuucgacaacuagaugaacagagaaagaaagauauucuuugugaugucagcauuguggugagcgggaaaaucuuuaaagcucauaagaacauccugguugcaggcagccguuucuuuaagacuuuauauuguguuucaaacaaagaaagcccuaaccaaaacaauacuacccacuuagauauugcugcaguucaagguuuuucagucaucuuggacuuccuguauucugggaaccuggugcucacaagccaaaacgccauugaagugaugacaguggcuagcuaccuucaaaugagugaagucguucaaacuugcaggaauuucauuaaagaugccuuaaauaucagcauuaaaucggaagcuccggagucugugguuguggacuauaacaauaggaagccaguuagcagggacagccugccuucauccucacgggaacagaagaucgccagcuucugggcaacgcggaaccugaccaacuuggcaaguaauauaaaaacugaaaacgaaggcugugaugucgacgagggccaaguagaaaacuaccagaugaaugacaguaacuggauccgggauggcucuccugaauuggcugaaaaugaaucucaagguaaaacaaaaguguuuauuuggaauaauaugaccucucaagagacuggcaaagcaaggaggaaaaaccaaacuacaaagagauuuguuuauaauauaccgccuaacagugagacaaagguagaagauugcucagugaugcagcccccugcugccuacccagaagaaagcaaggccuuacucaucaaggaagagccagguaagguugucaguccaguuuuguaccugcugaaguuuacuuuuaauuauuaauguauuagaacuaaggauacuuaguucuuaguuuugggucuuuugugugucuaugugaguuuaaguuuuagagugggugguaacuaaaguaccaccugccaaaagccuuauuaauaacuauguaacagacucuuucugacuuaggguaagguuguaucucuguaaacaccauaagaucacucacgcugucuuuaaucuuuaagucagaauuguuaauauccucagcccauuguauaucacaguuugaagagcuuucuuauaauaagugauaacuguguuauguaaauuuauuagaugcuaaccgaaacuaaaagugauuuuaggguuugccuuuucauaauuuggaaacauuuuaaauuggacucucaaaucccuucaucaguauugucaaggacaguaucaguauuauccuauuggcagccucugcacuacuuuaugacaguguuuaguuguaauguguaacuaaucacuuugucuccugaaauucaguuguaggaucuaguucacauuuaaacauuuauuguuacagaaguuugcugauuccaagaugacucuuuagcgugacucugccuauuacaggucuccagaagcaggaaugcuuuucuuauugucaccugacugucauugucauuugaacagcuuguggugggguggacuauuagccuguuuucuggggguggggcuguuucuguggaauugcaguuuuuccuuccaggccauggagcucuuauuuucaguauauuccuagacaguguauauacugugcaagagucguagcaugucauauuggugguaaagaccuuuuuaucuaucuaucuguuuguuuauuuuuuaaaugaaccgagugaaggacuucuagaaaauggaaaauguagacauuuaccuuauuuuaaacuggcuguuucuaacuuugaaacaucucagggauuugacauuuccuauccauauuuuagguuugugcaccauuaguuuagugauuuaaugccuguuuaucucaaggggcuugaguuggguacacuuacacuucagcauuuucaugacagaggcagguagaucucugcaacuuaauggccagccugguuggucaacagagcauguuccauuacagccagggcugucccaauagcaaacaaaaccaugccuguuuagugucuaugauaaugauggaguauuuuauguuaaauauucuuuuacuuauccauuuaucugcuguuucucucucccucucucuuucucucucucucuuuguguguguguguguguguguguguguguauguaagugaaccauaguacacacaugcaaaauucaaaggacugcuuuguggaauucucauguuaugaagguuccaggaauaaaacuuagguugcaaagcaccuuuccccauugcuguucuuuuuuccuuguauuuuaugucaguucuuaucggcaagucccuacugagacuuguguuagagacaggcucuaggacaggcuggccucuaauucacuauguggcugaggaucaccuuucuauccauccuuagacucuuggcuuuaccuuccaagaacagagaguagagggcugugucaacacuaacaguagaccccuuagcuagcacuuuguuuuuggcuuacuaauacagaagucuuaacaauucaaaacugguaacuaucaggacuuucugcugcauuuaguguuccacugugguaguuaacucugucaaguguuuaaacguauguguguaugugugcccacacacauacagauuuugagcaccuggaaauaugcauacaauaaaaauccuuuggaaaauuaagcagguauuuugagugguggcaggaccaaucagagcuaacacuguucuuaacaacuaccauauaauauuggagugacuuaaaacaauaauauugacccagauuggauacuuucagaagucuuuagcauuuacuuagcaauuauuuuagcaagcauuuucuuaccauccauaucaaugcaccaggucuaucaaaaauuguggauaguuuaaugagucaguuuaucccauccuaaaaaaagauaauuuuugaugcuuuuaaaucauugguugcacuuugguaccugaauucauaaauuugguuucaucaugacaagcugcauaucaacuggugacacuuuuauaauuugauagugucucuaaaggagaguuacagcaucauucaguggcagaaaaguggguuuucucucaccuaaacaguaugcaagauacaggaaaauaagaggucaagcuaguguuuguguaauucacauauagcucauagucuggccuugcuggugggcagcccugugagcaagucugcauuuugugauugcucacaaggcuguuccagagccaaagugcuccuaucaaagcucugccuauaguggagaauaagaauggacaguuguagggccacucguuuguucuguauguucaucuaguacaaagagaugaagcuggcuccuuuuuaagaauucccauaaaacauggagcagcacugagcaccugguuuuguuaguaagcggguggcacuagcuucucagaagcccucaugacuguucauucacauaacaccuuccagugcacuuuccccagaguaauacagacuuucacuuccaacauaguuuuaaagagagguagaaauauauuucuuguaacuuuuuuucaagucaguuucucuguguagcccuggcugaccuggaacuugcucuguagaccaggcuggccuuaaacucagagaccugccuuacaagugcuggguucaaaggcauguaugugccuuucuuguaacuuuuaagaauauaaugacacuaaucuuugguuaguuucuauaccuuuguuuauauaauaaaaaucaaaauaaauucuccaaaagaugugucuucuagaagacuugaguuaaauucucagcacccauauagugagucaccaccagcuguaaguccugggacuuaacacccucugagggcauaggcacaaaugugaaaaguagcgcgcauacaugcagguaaaaggaaacaggaaagaaaauagaccuuauuaagaacuugauggucagaaaauagugugagccauuuuucuuggagucucacuguguagcuuuggcugaucuggaccagcuccccauguagcccagguuggccucaaacucacaaagcugcuuugccuucccuguggugugauuaaagauguauauuaccaugcccagcugggcuuugaagcagcccugacaaaaaagcuauacuuuauguuugguaugguugaaaggccuguauauaaacagaaggaacuauuucuagcaaagcuuuguuuaguccuugucaaaaaaacugucuauuaaucuuagccauagauuggaaaccuugagcauuacaggucaggauaacuuuuagcuuagggauuccaguugaaguucuauguacggugagucuacaaaugguugaauccacugguggaauaaaagcccagguucaguuagcucuugaaaacugcuccucucuguauagacuaugauggguguaaguuaagcuggguacuguuuacaggguuauaugaaaauuaaaugacaaguuaugucugugcccuuaaaguuaaaaaagacuauugaaguuauuuauaacaguuuuccagugcuauguacuuucugccaaaugcuagauagauggucuuggcuugcugacaacgaugaccuuaagcagccuguguguauaaugacaguuauuagagguuaccuucaguuugagucaaaauuaacuucuauaaugcccccauucugccauuuauaguagaauuuggacauaguuuuaaucccucuaucuggauuagaaauauaaauaauaccucucugaauccauguuuuucuaauuuaagugcuauuucaucuauuauugaauauagagaacugacguuuaacuuugcagggaaguuugaccaauauaacaaguguaguguuuauuuaagguaugguugccuuucccaagauuagucuccugguaaaaguaggagccuucaaaaucaugucugcuguuaaaaccuuaaaaauguaguuaugaacuugaaaauauguuaacaucuauaucauuauuguguuuaauuuuucacuuaaaaguaaaaaaugagcgagacaugcuuuugcaugauuuuaaagcucucuuauaaacaucugaaaaguacuagugaauauuuugaaaucuaaauucaaugcuuggcauauuuagauuugugagcccuuaaaagggagugugacuuguauaguuuauaacgacagcucuaagaaugcacccuuugucccguuaugcugaaacggggguugcaccuuguaacauccucugcagguuugauugagacggcacauuuuggaucuguaagcaaucauaucuuguuggacuuaacugcuaggcuugauucuauccagacauggagggaaccggggagggguagcaugcuuguccuuugauaccgaguugauagauuuaaaaacugaacacuccuuaaucaaauaaagggaaaaaugaucuuaugauauuaaaaaauuuuaacuaucugaaaugaaaucugagauuugaacuuuaguuauuagggguuuuucagucuugguuuaaaugcagggccuuguuagugaggugugcacuuaauccuucauuuuuauuuauuuuuaaaaauucugacacagguugguacaauauauccuaccuuuugauaaauuuuguguauagcuuaggaaaaauuugaacuugugaugcuccugccucagcuucugaaacauuuugguaacucagggugcugccacaaccugucuuuugauuauuacauuuuuguuguuuugaaugugcacauuugcagaguuagugcagugcacauuuggaacucaggggacaauuuguaggagcugguucucuccuuguacuugauggcucccggggaccaacucaggacaguaaguguggcagugagggacuuuacagacucacaucucacuggcccuggccucaccuuuguaauugauguauuugccucccagggaaacugcauauaagcugguauuuagaacgcaguuuugaggaacccgggcucaagcugcaugccuuuuugggaagccuaauaaagcauauaucugaaauaauuaguaauucuaguuauagaacuuuuauuuuuaaaguuauaugcuaaccagcauuucuguucuccuauauuuauggugauaguuguucauuauuauuuauuaagaaauuaacacaucuauuuauuuguguguguguguguguguguguguguguuugugcuuugcaacuuauggagaauuaguucucuccuugccauauagcucacagggacugaacucaggucaugucuuuacccacugagauauagcucacuugccauuaaaauaauauuuuaugacuguuagacauuuuugauaucucacuauuuugaccuuguuguuauaaguuuguuaaaagcagagucuaaagccaugggguuuacuuugguugaggugugaguuuuacguguagcccugucacuggagaguccccagugugccucuaaugaucucucuaacaggaaaucacaaaaaucucuaaaaacccaagcucuuaaagaaaauuaauuuugagaauaaaaaguuuauuuuguguauuuucaauuuuuuucuugaaugugaauauaccuauuuugucauggagaagcauuucuguuguuaaggcagagucuggcuauguaccucagcuuagccccuugcugcaguuuccccagugcugcuuuuacacaucuagucugcauguugcacugacuauaacuauacuauaacuauaacuauacuauaacccaguaggguguuggauuaauaugcagucuccauuuaugggacuuggauucaauuccagauauuuagguaaaucuugguuuuguuuuuguuuuuuuguuuguuugguuguuuguuuugguuuuucgagauggguuuuucuguguagcccugugucagaauuuuuaaaaauaaauaaaaaugaaggauuaaaucuuucaggcaucuuuauuguagaguaugcugugaaaaguaagccaguuuuguuuuguuuuuuaaaaucacuuuuauuagaagcauggcuuacugcuuacuuuaaaaauugggccaugaaaucuuacugaacauacuuuuuuuuuuuuaagauuuauuuauauacuacugaauauuugguuucuggcagcaauauauuaguuggccagguuguuuuaaauuucucucucuuugaauuuuuguuuuguauguuauguuuuguaugaauuuuuguuuuguauguauggucacuacguguaugguuggugccgugggagcuagaagaggaggccgggauggugcuggggauuaauuagauccaggcccuggaagauaagcuggcgcucuuaaacccugaguguguguguagacaaugugccuuucuuguuuuuuuguuuuuaauaagguggggcuugcuugcuugcuugcuugguuccugcuuugcugacuaugcuucgcuggcuggccagaaagugucaggggucugccuauagagaaagcccagcauuggcgcuuauaagggugacacaaacaauugguaacugagcuaaucacucucuaaccacagcaguuugaaaauuuuuauucuuaaagcuguacucuuugaaaaagguuauaauauaacaaaugauauuuuccccuuuucacaucauaagaaaucuagaaacaaaaauuguaaaucucaagauaacaaacaaucacauuaaaagaacugagguaugcucagacuuaagacuacuaaucuuuguaugucaaaggcuaagcugugaucuuuguuuuaugacuuggcaaaggaguauuugaucucuaauuagauuugaguuauggaguguacugacuaggucuauuggcauaaauaugucuuugaauggugaggaaaagaaacuaugaugucuaguauaagcaagacagggcaguugcagucugucacuugaaucagugaguuugaguggaaaacaaguuucuagggugcuacaggaacuaguauuugcauuuggguuguaaaugaaauuacugaaugggaaagacuaaagagaaaaagauaccuaugccuguuuaugaagagggccugcuuuuaguucugcaacuaucugcagacauuuuuauaugcuaugauaauuuaugaaugcuguguuuauaugaaaaugaaauuuguguagaucauuuaucucgaguuuuauaugaguuucagcuauuuuuguuuuuuuccugccaucaauucacaugucauucacaugaguauugggauccugaagaagccaggcuagccugcgcugcacuuagaaauggcgaaugcugaggacccuaagcaaagccagcggacuccaccccagacagugucacacacaggcucuagaaugauuccuagccccccuuuucugugcuguuaccuugguacuaagauuacccucauuugaugguaguaccuuguuccauguguuuuauaacuugaaacacuauacuuuauaguauuucauuuauuucauuuuacuuaugguuucacacugcaguuuuguguaaauauuuuaaagacaguuuuaauaaaaugcccagacucgccuuggacuugaccaucuucccacagaguuuccugauuggcugggaucaugaacgugugccguguuucacagcaggggcaggggaacauggaucauuugggggcaaggagauuacuuguuggaauuaaucaucuccuuagaggcagauuugggguccucauaggcuuagggggaaaccugucccacaggauaccccuucaccucuuuugggggggguccgugaagcaggcagcaacuuacguagcuuaguugaccucaacuugauucuugcacucaguguugcaggguauuugaucacacuguggaaaaaccucgagauugugcuguguacuggaaaaaccuguuuuuaguuguaguguggcucagccuuagcauacauacacuuuuaauccaagagcuuucugcuugaauauuguaaauaaagucagccauaggucaagagccauuugauaggaaggguuauuaacaacaacaacaaaaaacuuaguaaggagucaagaggacuccugguagagauggcacaggaaggagagaaagaggcauuucugaugguuuuuuaaugcauagggguguuuugcuugcauguguaucuauguguaacuugcuugucuggaacagauggaagcuuggaugccagcuccccuagaacuggaguuucagacaguuuugagccaccacauggaugcugggagucaaauguagguccuuuuguagguagagcagccaguguucuuagcuuuccagcccaagaguaacugcuacucuccuaacaagacuaauuccuaaauaaagccacauacuugugaaagccuauuaacaacagcuagaaaauuggcccugagauguaguuuuggaaugaagaacaaaugaaguacuugguuccuucaagagucauuccuuagauuaacuguaucacaguguacuuuugauuuuguuuguuuggguuuuguuuguuuguuugguuuuuguuuuuguuugguuuuuugagacaggguuucucuggauaucccuggcuguccuggaacucacuuuguagaccaggcuggccucgaacucagaaauccgccugccucugcuucccgagugcugggauuaaaggcgugcgccaccacaccuggcuuuacuuuugauuuugaaggaaaacaacacagcugauuuuggggugaggaauuuccuaccuagaucuguaggauuaagauuacaccuggacguuaauuuuccuucaaugaugggcauugaauccaggggcucaugcaugguaggcagguguucacugauccccagccucacaaaaugacauguauaauacuuuaggauaggagauaggaagauuuaaagaacuaguugauacguauagaucaugaaugaggccagccuacuuaagugaccacccaaagaaccaaaaaagccagcugguugaggaaugcauguagcagaucacuuuaguagaauaauucaggaacagaacaagcauguaugucaaaccaucuugagagaauuaugauaaaagguugucugaacauuuaagaauaaugacuuccagcagggcauagugguagagcuuuuaauccuagcaauuauugcagcagcuccgugugcuuggggcuacuauuggguugcaaaggucaaaguauucuaccucguguuuaauacuaguguuugugaagaagagugagguacucuagcuaguuaucucaugucccacuguugcuuccuauugagaaaacagauacuaacauucuuaaaaugugccuaagcucugguuucagaucucuggugugugugucugugugucugucugucugucugucugagggggggagaggagggaagagagagauagagaugagagagauaugccugaggaggauauuuuauauccugcucugccauuugccaccuuauucccuugagauacaggcucugucacugaaccuugcuagcaaucccaagcgguccucuuucugugcgugaacagugcuaacauacagaagcauccaucaacacccuccccaugggucugcucuguguugaauacuccuuucucuguucagaugucaguaucuguaacaucuuuagggacuuaguuucuuauuguuucucucucuuccauccuauagucaaauuucugaaaacauucccccauucuucccaacacaagccauuucuuuuuuguacuugccauguuaaccuuccaaguauuauccuaagagcauucuagauacuuugugaaugggauaauucuaggguccuuuuauauacuuggcauuuuuugaguggccuuauucuuugcucccccuggcauuguuuaucauuaucugguaacucagaccauuuuuguuaucagcccaagcaccagaucugcaguccccuuuuuuuuuuuuuuuaagauuuauuuauuuauuuauuuuuguuuuuuucgagacaggguuucucuguauagcccugguuguccuggaacucacuuuguagaccagacuggccucgaacucagaaauccgccugccucugccucccaaguccugggauuacaggcgugcaccaccacgccuggccuaagauuuauuuuauguauguauuuuaugaguacaccauugcugucuucagacacaccagaagagggcaucagaucccauuacagaugguugugagccaccaugugguugcugggaauugaacucaggaccucuggaagagcagucugugcucuuaacuacugagccaucucuccagccccagaucuguagucuuauuuauuaaauuucuguucuuggaaacaaguggaauaauaaaauucacauuugguggcauuuauuuaauuugagcacuuuuacaaaaaagaaaaaaaguccccacagaaagucaguuuucaacguuuaguuagaauuacuuaguuggcuuaguugacuuauuacaauacagguugguuacugccaaccggcuaacgcuuuugacaaaggucccuauuagugcugguauauggucuuuaaaacccaguacauggaugaagagcagaaugaccuguuaggggaaagcaagcugcccuuuuaaccaucuaaacacuacuucuuagguguguuagacucaaugcucuagacuaaaugucacucuguacccucugucccaccucgaguuugcucugcugccaucggaagaugaccuagcuaaucuuuccacaauacuaauucugccaccaauccuugugcuugcuacacuacuguaccuaucagcccucagcuuugguuccugagaacugcuuuccgcccacccuuuccucucuucuuuucugcaccgcgaccccugcaaagggcaggcaggcauugggcagcaaaugcacagccuggggcucaggauugcuuuguaauuggucucugcaucuucucuaaguccuuucauucucauucaaugacaccaugaaguagauuuuuagaauucaaauagaagagcuguuucuuaucuaaacuacuuauauccuuuuaaaaaacaaaguauggaauucuuagcauaaccccucaaccacuguuuuauauaacuggcucacagucaaugauacuacuaguuccucgguauuugagugauugggguuguuauaauuguacaccggcgugugcuguaucacauuccauuguaugaaugaggccauagcaguuuauuuacauacuguaaauaccuucucagugaaaugucuacuucuuuacagaaguuguauuuacuuuaggggauccagagcagucaaggaugaugaugccaaagaugucuugaggcaaggagauaguugacaagggagggauuuuaaaguguuuucagauacuuaacucccaugaguggaggagggauuuagcgccguaggcaccagcuaguauuagaagcaggaaccugaguaguaaagucaggcuaaacuaaaaagcuuauuaaaucauauuaaaagcuauaauaaaccguugaaucuuaagauguuuuauuuuaagauuuguguuuucagaaagaucuuuauucuuaaacugcagacuguauuuggcaagcaaggagauaagagcucauuggcacaagaggagugaaugaagccagaauggaaaggguuuacauacagcaaauuacugauaacacugaaaagcacaccccaucgucauggcuuuaauagaaauacugccucucuaggucuguccaguaaaucaagucaacucuuagccaacaacaacaauaacugcucuuguuaaaucuccaccugaaauuuuaaccaggucuauuuuugaacuuagaacaacuccaaucugcuuuuuuagaacuugucguucauauuacacgcauuaacaguugaucaugauuauaacauuuuguuauucaacucaaauuccuauaucagauuccuauauaugcugaauauacaugagcuaacaaggcguguagucacauagccaguuagaaaacuaggguuaguaccugagacaccuggguucuucacagaccauuccuaacauuuggacaugucuauuuucaucauggguuaaaaauucaaauugugcuuaaaaagguggcuccuccucaggauccagguuugauuccuagcacacacauaguggcucacagccauccacacgucacguacaugcacucuggaaagacauugauacacaaagcaaguaaauguucacuguuuuagguauuuuugucugucacauaagcuaagggugguuacagcaugcuuacuuaccuaggcuguuuaguucagaguucuggguuugguucacagcaucacacaacauugcaaauaaaagcguuuaauuaaagguauuuuucacauaauagcacaguuuucacaauuauuaccaagucagaaauaccauggcaagugagauagcuuguaaaagggucugcuccacaggccuggcauuccaaguccuggaacccacacuggaaggacagacuggacucugcaagcucauacacuuacauaugugggaugcauacaguauuacauaguuaucgggcauuguguuuagacaacgagaaaaccaaagacaaguaaaguauuuuaugguggcuucaccuggaguuuacacgcucugugugugguguugaaaggcuucugaaccaggaagaaaggacuguucuuggguggcuggcucuggugcaguuuguaaaugaacucauugugugucauuuucagauuuggauggugcacuacucucagggccugauggugauaggaccaugaacacaaauuuauuggcugaagccugcaguggucaagaugcuggggaugcugguagguacaguaagaucuuugucaagaauguaucugagagguucugaagacuguagugugcucgugagccuacuuggcuagucguguguaaaugcuuccaauuggagagcauucuuagguuaguuauggcugugaugacuuuaggaacucgguaaauguaaacuguuaaguuugguuugguuuuggggguggugucugacacauggccucacauacaugcacacgugcacagucauaaaaaaaauuuaaaaacucauaaaaauaaauuuaagaaaacaagauggagucucucagaguuugcaguguuuacugauagaagcaagaagcagcaacuaaagguugucaucucucaucuaaaaaguuaaaaugcuccaaaaucagaaguuuuugagcagcaacauaauauucuuuaaaaaaacaaaauccuagauuugugagcuuucgagauuccagaauuuuagaauuagagauauccuaccugcauuacuauaugaauacguuuugugcaugccuauauuggaaaggaaugcugcaggcgagucagaguuaaaagugccuugcaaugggagcauaguuacuaccauggaaaaacuaaacagagguccuuauuguuggaaugcagcagcccaaaggggcaguuggagagaacgcuuucaucagguugucuuggcuuggcuauagaaagugcagacucacugugcguuacauggguaacccuguuccuugcagccugucaggcuuuguauuagccugguuuuguuuuguaccaguuuuuugaaacagggucuuacucuuccuugucugacuuuguuucaaccucccaguuugggguuuuuauuguuuuaaaaaaagaaucugugggagguguggugguacagguugguggugaggcaggggucccaaguuaaaggucauucucugcuaccauggcaaguucaaggccagccugggcugcauaaggccaugucucaaauuggaaaaaaaaugaaauggcuguggcugaaugcaaacugggaaauuauuugguggccacuaaaaaagaagccguacacuagaauugaugguugauuggaucaaguggcaaaaacuaaagauaaauguauauaucuauagaugucuguguauauaucuauauauccuuauacaggaaaaaucuuugacccaauaaauuauauauaaauuuuaaauaggauuaaauuaagaaagagguaauuccugacuguguucugguuuuaguuacuguagacuaggccuuuguugcuguuuucuguggcuuuucuuuuuuccauuaagcucagacuguuggagguucagguguuuauauccuuugagugugggaauugaauccaggagcucggguuuuuguucggguuuuggggggaagacagaugggaaggaguuggguaguuuugagauugggcuuccuugugacacauagcugacucugaauucagucuuccaaguaugagccagcacaugcagcuugauuuaguuuauguuaagauaacuuaucauuguucuuauaauuguauuuuauuuucucuggcucuaauuaagaguuuuucccaaccauuacuucaaaaucacuuuucaauuguacuaggagcaucacaugauuucaaguaugguuugaugccuggcacuucaagugauuucaaguauggguugcuaccaaguacuucaaaugacuucaaauucggauugcuaccgggugcuucaaaugauuucaaguauggauuauugccagaaucuuggcccacacaagaaacgugggaaaauggcaaguauuggucaacuaaacaacuacaaaauucuaaaauuccaugauuaagugcuucugagcuguguuaauaauuguuauuccuauaugguuaaauauaguauugauaggugcuuucucuuuaauaauauauuaaccaguacauuuuucccuuuaaggugacucaucucuaaucaugaacaaguugaaaugcccucauuguagcuauguagccaaauacaggcgaacacuaaaaaggcacuugcucauucauucuggaguaagaucauuuaagugugaaauuuguggaaagauguuuacuagaagagaacacguaaaaagacauucccugguaagugccuugaaacgcuguugaucauggaggugugugguuuuaugccagggauaugucugcagaucguggaggugccuggcauauacuuggcaaauuuaaggaaguaugcuaagcugcuuuaaacagaauuauuuuugaagugauauuguacuucauuuagaaauaguaacuauccuuucauuacuaauuguauggcuuaauuugaauggcucaaaugcuuucuuuaucuguacuacuguuauauugaguucuuccucuuucaauuagguacauaaaaaggauaaaaaauacaaaugcaugguguguaagaagaucuucauguuagcagccaguguuggaauaaaacaugguucucgacgcuacggaguaugcauggacuguguagauaagucacagccaggaggacaagaaguuguaaaucagggacaagauacagaguucccucgggaugaagaguacgaggaaaacgaagguggcgagcccgaugaggagcuggcugaagacggacaagaugaaaacgaugcaccucgaugggaugagucaggaggcguuuaugucucuggaugauuagcugaccuacuauguuccucaagaaugcugcauuggacauacuaugaaucgacaauucggauuguugaacuugaaggcuugcaaaauaugguacaugcuggaugguaguuuuguugcugugaaaaacuguaggguuaaagccuuauagcaaaaaagaauuuuuuuauauuugcacaggacuauacagcaaacaaccaugugguuggauacauggaguccucacauauuucagucaguugucaaaguaaacuauuuuuuauuuauaggauauacaguuaacuauuuggguuguaugaaaauauaguccuuguccuuuacagagcuugcuuacauucaugugccauuuaacaugaaugaggaaauccauuuauggaaguacaaugacagugacccaaucgcucugccaaucaaaccacucaggcuaguuuguacuaguagaguuuuguuucuauuuuuauuuuauuaauuuuauuuuuuuuaauacagauuuucagugaggggcuuuuucaaccccauugguucuauuuucuuguauuuuuuuuuucauuuuauuugcuucauaacuuaaaccaagucuccucuagucuuagauauuauuucuuaauuucgugcugauaggcaugcuuauaagaacuggagagguaauuuauuggaaugaacugacuggcuccccgcccucccuucccuuuuugacaugaauuuuacuacuucacagaugaagaaugauguuacaaaguuaccauggugacgcugacaaauaccacuaaacugauuaugacuuagaaguaacuuucuccugcugcucugaucugauagaugguugcucuaugauguguucugacauggggucugguuuuuggggaucuguuacuuuggcacuauucuuguuugccucuuaguguacuauaccucagccuuauuugaaauacagaagucuaauugaagaauaguccuaggaaaauacauaaaaugauuuguuuuauaauucaucccccauguccaguuugguuagcuuguuaugcaauauaagugaaguaucagguuuuuuuucuccugugcccauuuuuaucauuaaaaugaacacaaaaugugcauucucuuuuuguuucauacuuaccgggauguugaguguuuuuaaauuguagcugauaauauauuuuuccauuccuuaaagucaccacaccuugaugaaaucuuuauagucuccaugauucagcaaucuacaaaaaauacuacaaguaaaauguugagccuuuauuguuccauuaucuaaauuccucaggagucagaguucuucacacaguugagacuuaguuuauguagccaggugacggacgacugagcggacagcagcacgcucagcagcuugugacaggcuaacgugccgugugucaggagcagagcauauauauaaaaaacagagacaccauauuuucaacuuucuuuuaaauacaaauugaguauauuuuccuauuuuauaucaaguagcuaaauuaugacaguuguguggagaaaccacagagcugcuuugacagauacaaucuuuuuggugcuccaucuguucaaaguugaaaaguugauuuucuuuuugaaagagacaaacuucaucauugccucugauuucaguagaauaaugguuugauauuggacagugacuuccugcauggauaaaucagagaugaaguagucauguuacauguugagacccaccuauugcccucugacucguauggcagucucugcaucccuuggggauggcagaagaguuucauucugguuucuguuugaaaugaagagaaccccuuauucucuguguuugaaacaaaugagugaaguguaauucuagaaaaguccaaaguagacuaaguugggcagagauauuaugaugaaaaaguauuuuaaacguaagauguugugcuuugugaauauguaaguauaacauaaagauuucuuccaucccaccuauccccuuccuuuaaaauaaaccauaguuuacaauugguagaucugucuauauauaaauauauauuaaagagcaaauauauauauuuaaaaaaagaucaccuaaaucugcuuuauuagacaguaguucacuguugcguagaaacuggacguggcuuuacauucuuaaugugcuuuauuuuccucaagauaggaccuuaucuugaaacagaauuuccuuuauuacuuaaaucauuuauguauaucugguaaauuaugaccaaauuuuuguuagauugcacacaguaaauugaaauacacauuugguacacuacggaauuguugugcuuuuguuugguuucaguuggaaacagguucgauggagaugacuuuauuacuguuaauuuaaauagucuauaauuguccguugccuuuuaugucguguugugacagauuuggcuauauuuuuagucaucugaaauauacuuuaaaaaguuuguuuuuagguaauccaaaggaaaaauguuuauacucuugaauauauauuugccucagccuauauuaaaguuucuuugaaguaaacacuuuaccagaaacagaauugacagauuuuucuacuugcugacugccuaaguuauuuuguuucauggucuugagaauugccuuuucucuagaccuuuuuuuaaaaguaguuuuaguacuaagguauacuacuggacgcuccuauuuuuuuaaguauauuccuuuucugacaguacaacuucaggaaguugauaaaucucuaagaaguuuugauuggucucagaaagguaauggauugaauacucagaauuuugucugaaagucuggcagaguuguacauuuggugaaguuuuucauguaauuuauauuuuaaauaaaauauuuuuagaguuuuuaauuuuaaugaaggggaagaacauacacuuucauauuccacagugguaaugauacuaugucauagguucagaucauguguuauucucccagacaguuucuuccauauggucucucauuugucaagguucuugacucaauuuuuuuacuagacaaguugcuaaauuuuagcacccuacaagagcucuguguguguguguguguguguguguguguguguguguguguguagugcuggaagaggaaacuggacaauagcuaguagcugaauuugggggcaaaugcuauuuggcuuaaguagagccauccuaauaaagagugaguuaauucauugcagaaaaacucaagcacaguaaguacacagugcauauuaguuguuuaauaacaaaugugaaccaagagaagaaguaaaagcugguaggaagggauaaaucagggaagugaggggccgggacuugcaaagggccccaaggaugaggagugggugugggaggccugacaggaaggaagcucugggaaacauggaguaagagauguaguucuuugguuuaugacucaaacuuucugguaugcccacacuuuuguguugucugccuuacuuuaaccuauaagguaggugcuauucuauuuuacaaauaaggaaaggcucagagagauucagacacuugccuaaaugaccgcagcuuucuguggagcggggauuagucaggucugguucgaagcccugauuuccucccugugagaugcucuguuaggaguccuguucucuuuggaaguugcuuuugucacuuuugacucaagcacaccucacugccauccucugugaguggcugggauaguuucacuuaauuuuaaaaggaugguuuuacaauaugaagaaguagauagaagccccagcuugugugccguucacacccggauccuuaagcuuaacuaugguacccaaucuacacaguuagaacuaacagguguuuucuuaguuuaggauuuaaaguaggauuauuuauuuuguuucuucccuaucugcuguaucccagucuucaagugaaguugaacuagguaguuuaaaacauguuagggauaagcacacuuugaaagauguuuucuugcccugaauuugagggcacugggcaguaaauuuggaauacacuagcuauugagaacaaaauuuggggguuaagaaagggaugauugaggccauuaugaucugggagaagcagcauccuaaacacuguaaacaacucuucugccugcuguuuguaaaagcucucuggcaagaucuuuuacaaagaccaauuuucuuuuuuaaauguaauuuaccuaccuaauauuuaaauguccugagacauguauguaaacuuccaaaaccuguuugucuguguauuuagaaaauacacaagaaucuuuaucaaacauaaaauauaaacuugugagcacuaaac

SEQ ID NO: 1355 - RNA, 34227 nt, Mus musculus
uggcaauuuuauuuuuuaaauucauguggcuuuuuuaccacggaaaucaaggaaaacgggaaagagaugcugaucuuuuccuuuggauacuuaaaaggaaaacaaaacacuuacuucaagagaaaagagaaagcuuucucugauuucccuguagguugauaaccaacaucagcuauaccaccuguuccagaugcuuuuaccugcaaccaggaaacaacuuuuugcuuuuaaaguccagagcuagauuucuuuccccugggcauguccucuccuuaucuccuguagccucacucccugaaaugguguucuagcugcuccaagaggcccugagcaacguggagauugagacaucaacuguuuggucaaguucaccaugugcuuaaauaacagauggauccuaggcuagaggguuuucuccucagcaaagcucccuuaauuuuuaaaaucucagaugaagacuuuaaucaaaacauuaaagugaugugaaauucaauccaccuucucuugaagaacuuggaggugaaggaaugcugucgucugugugagagagagcaguccuuaggugcugagcugucgcccccagaaacacagccuaagggcaggucugagcccgcuuagcugcauauugucagcacaaucgugacaccaaaugcaccugaccugagucccucguuuucucagaaaccuccaucgugccagcucgugugcauccccagcccaccuagggcccucaucuccaggccagccuuaggcacugaacauuuccuuaucuggcuuccaaggugcaggcaaauccugagugcagcucuggacacaugcccauucccuguguggaaggguguaaugccagggaccggaagcucugaauugcaacauacaguuaacugauuauaugaguuacuuuuugugugaguuacauuucuuaaguaguuauuuuguuauuuggggacccaaacaaagugccaaaugaagccugacuuuucauuucaugccauguccaugaaacuaaguucuuuuugugucuucauuuuguggagaaacagaaagcaugagaguuggugagcuggcugcuagccugaggcucugugcaccccagggcuuccagcccugucugucaaaggagcagugauguaaugaauucuuguccauggaaaugucuaguucuucuucuuccaugaugaaaaagguuucucauuucucccggaaaaagcaugucacagugacuagcaggacauucuccagccagcuaggaagcaaugugugcaacaggcaauaguuuccagccuuagccuuccuggaauauggacacuuauuuugugaaaaucugugagauaacguggagaaacccccagguagcauaugugucaagggggcagugcgggagaccugcacaccccuaucuucugcucauguucuugggcugcucagcuaggacuccuccaugucugcuguagaugucugacacaagacaggagcugcuucggccaggaacuauccaucaggcucaccugccaccuuaugucugggaaguuagguucucuggauuagcaaaagcuagcgccaggaagaagacaguggguuuccaaaccagaguggaccucucgugcacguugauaguaccauguccaggaggcucccuuaugaaccucccaugaccaagcuauaaaggacgaucaucucuagagaaaagcauuacuguugagcucuccaaaaauuccuucagacuucauguauguuggaaaaauuauuugaagccaaauuguuccccauugcaauugaagaugacaagauuuggagucugccaucucugguauccaagaacaaguacgucacacuuugccagaagcccugggcuuaaagugaguagugagccccuauaaaagagucuguuucaucucucacuucagcugcccugcaagacaaagguggcauucaccggagaagguucugagaaaagaggugagaacuguacauacaagaaucuguugagcauagcagcagaauacuguaaauacuacucauuuccucagggagacaaggaugcugugggaagagaucuggagaaccccgagaccaggaggauuuuuaucuccucaagucuuuucuugucagaacaaguuuuucuuuauguaacucuccgugucauuucaaaacaaauccguguucagcuggacaggcagacgacuuccaugagguguggcagagggacugucuguucguagcugcccuaaagcugauugagguuugagccacaggugaagagccugcugggcauccauagacauggugaggcuuccucugaauguaauugggaacaaaaagccuugcuguuccuuguuguaguuccucagucuggaugcuguuuauuauacacagcauccucuaagggagggaaagcuggccacgacgugugguuugcuuuaguggcauguucaggagcacacugccauggacucugguggacaaggugcugucuuugcucuuguccguaggauuuccaccacccacaucagcuguggcauugaccugugugaauaugugcggaugaguggagccagcauggcccgucaguaugacagcguugggagcgugggucauuuugaagggcauguuaggcauaugagucaacugacaauucuauuucuguaagaaagaaaccuaccagcagcacacaggugccaccaauccucccacguggagggauuucuccauguuacgauuucauccuguauuuucugcauuguaaguagccacaggggaaguuaguaaauaagaugagguuagcacuuuuagguaccaguuguccugaguaacuguacuccaacagagcaaggacauaugaaauguacucaagacuugcuucuggugacagacuuggaaaaggcccauuuccaaugacacacaugcuuuaaagaguguaccuaucacaggaccaggaaucaaaacgggaauuuuaucuccuguccuguuuuguaaguagcuuuuuuuuccuaagacaaucucauguuuuauaacuuguugugugugucugagaaucauaaugguaauguguuaugguaaauguaaucuuaaauacaauaauaauuacaacuuaaauuuccaaaugaaagaaauacacugcuuaggcuucugcaagagacaugacacuuuuauaauaagcauuaguacuucucaaguuuaacagaacuggaaauauuuuacaagauaccgcguuuuguaaucacagagaacaugaacacuuugugggaaaugaccuugguuuuauacauuguagcuuauuuuuuaaaaugcaguauuuuaaccggcaggaaguguagauauggcacacaguuccugucccucaauccaagggcuaugccucuuuuaagcaaguguuuugaugcguaucuuuucaauuaacccucugagcaaggguagaaauggagaccagauagcaaggucauuugcaagagaaucaaugaagcagcaacuauucccucaugaccaguguguauucaaagcaucuuugugggggcagggggcaugucacaugaagauucaccuucuauauuuuaaacccaagaaaagaugcuagcacauaggcuucuaggccaaggaagaaauaucccuuuagugugguaugaguuuucuuaugaguuuucaccuaucagaacuacaugccugcauuuuauaagcaagcgucauuugguggcacugucuaaaacuguaguauauaugcccaaagaaccuuuaaacggucagcaguguuugugauuuuguuguucuuaccaccgccaacugagaaacuuccucaucaggaccguuugacuuuuguuuguuuuucacuauggaaaacucacaggcacagaagguugugagcagaaaaaugacagaauucccaugggacguaagaaaugggagccacauacacagugugagcacugccaaggcuauuuuaagcugucccacaucaacaagcccacucgcuguuaagaaaacaucuucccaagaguuuauugacucaaaaagcuaggccaguuagccacguaugcgacaguuucagaguagaagcugagguggggcagcuguguaccugccagguaacuguaccaguuacugagaggccauucuagcuuuucuagccguaucuuccauguacggcugacagucuguuagacgggaacuauaaaggcauuguaugagggaacaggggguugugcagccuugcacccagugccugagugggcuggcuugcagcuagcucgccauugccauccccuaggauaguaccacugauggauggcauucgggugcccagcagguuuucacugccacaugguuuugaacuaugugcgacuuacuccaccugugcguggaggcuuccuuccagagacugugugcgcauuuagacacuuuagaacagcuggaaaaggacugcagauguucagggcgugucaggaccaacaacgguguuggacuagacaacugacaucuaccgaacaggaaggacccucacucagcuuuugacaaucaggccagguugccagauccaaacuggagacauggcaccacccgacaauucaguguugaccacuaacauacguucucagccaauccugcagaccaagaaaagcugugugggggcagaggcauccuguggccacaguaucagcuauggcaaacuuccacacuugugagcuaacaggcccagauuccuccaugagcaucuuagacucaugugcugccacgaucugaacagcagacauuucaaaagagggaagacacuauuccucccuagaggauauccucauggaagacaaaaauagaaaugucaucucuucagcuuagcauugcuccugaucagaaugcacuaaguugucacccggcucuugcaagagcugccuccugccauacccaggccacaccccaaaguacugaauagcuguaacccugauacugugucugcuaccgugaccacugugaugaagggcagagggagggaggaaggaagggaaagagggaggcaggaaggaaggaaggaagggaggaaggaaggaaggaagggaggaagggggacaaaguaaucgggagccuuugauuuggcagccggguacccuggugcuuuacaguagcacauggccccucccaugccagcgcccucugccuacgcuuugugcucccuagcuuccuaggccaucucucuccuugucccacuauaaauguauauauaauuucaccucugaucugguaaggccccugcuucagaacuagcaggcacuuagguguuuucaggaguccauucaccuuaaaggaaguuuuuccacacaggcaaccucagucucuuucucgcagggugaaauaaaacugagaauaacuuugucacaugaguggagggcuacacacauuagacuuucauuguucugagaaaguacauuauuuuaaacucuugucuucuauugaagucuauugaaguucugaugucacagggagaguucuguaugguaaaguaugugucauucagacauuacuuccuuugaucuucauaugaaucuaguauagaaaacaaguccuaaggccacuaauagcuaugccaagacacuggcucaaaccuaugagucagcaccgucauuaccugcagagagagaccuggcccagcuggccuccgcugugacucagccguggauucccugggcccaccauguucucagcccagaaguaaagagcacccucauucaugucacuaagugcaaguuuaaucauccccaaguuccguccagugaaaugguaaaguguaggaggaguuuguuagcuaaagcaauauucugauaaaaauguugacuccuuaggaaaaaauagcuugcuucuggccucuggccuuucagacucuaacuuuaagcugaugcuggauggugguuaacaaccagcucagaauuaccauguguagagacgacucaaaacgaccugcaagcaugcugcagugccuaggucaguuaaguuguaugugucugaaugcaguuucugcuggcaagcuuugacauugcucccacuguggaugaugauaaggcuguccaguauaugaauacacuccauccaaggcuuccagggugucaggugagcauccugaguucagaggaaagcucucacaagaaauccugucauaagaccagaaggaacccccagacagcuagacuggccaguucccuagcugaugagcagggaggcaguuaguuugccccuuucuccucugacaaaaggcagugggcuguaugguuuggcugccugugcuuggcuggcagugcacagaaagggccuaguguuagcaagggaaaaaacaaagcgcauaccagauacugaaggauuggguuagagucaaauaguaguugguucuuuuuaaaaauguuccuuuucaguggggauugcugcacugugacccuccgaggagaacacccuuugaugugacaaggccaccugagcgaucccuaagacugauuaacuacuucacuuucuauuacaaucagucuucccaaaauguucauucagaaaauagccaaagcagagcauggcagccccuagaaaggacaagaaagggauuacuaaagaacggaaucgagccggacgugaugacgcacgccuuuaaucccaacacuugggaagcagaggccagccuggucuacaaagugaguuccaggacagccagggcuacacagagaaacccugucucaaaaaaccaaaaaaaaaaaagaaaaaaaagaacagaacuguuggggaaacacagcugucuccuguuuugucucuaucugugacuggaaacagaaaccaacacucuggagaagacauaacuuuaagugagggucugaaagaagacuccacaucuagugccaucugagcagauaguuggguagacacuuucucucccuucuugauccucaucuccuaacccagaagccaaauguguuuguugccagauccagagacagccauuauuguuacuugguuacugaaugcuugcucugaagucaacaccccaguacauggaugcuucccucuagacacucauucugcucagugaguggcuacccucccugcaagagaaagccguucucugucugagcagauguagucucugggcuaugaggacagggucugcauuggcaccacccugccacacucagcccacggcaaagcagcagcuacucccguccaugugccuuaagacacucaguguggucaccuagccagagcuagagucagcaagacaggaugcuguguuaggguggaagagaauccaagagggcucagacuaaauccuuccaggcucaaggauucaaggggaugggauuggccuucuccacguggcgauggaguuuaguugcuccuguuauauaucucuggaaagcaaacacugcuuccauuugcuuaccugucaaacauucauuccuuggcccaggacaggcucaucccucauuucaggcacagacagcaagacagaguggacagagggcucccugagggcuugugauuguuuguggguuugagcugccccucagggaucugucccugcaugggggaaggaugccuaauguggcagauugcacucagagagagggauaacuuuuaggcccuuacucuauauccuuacuggaaguauguggcugugacauggcauaacagcaggagcugaucacagggagaaagcuucaggugaaaccuagauguuugagaaaacacgucacacuccuaaagcaugcuauuuccauggcuuccaaaacuaaaagcaccuguggcucagcuagcgcaugaacaugccaguagucacgguuuccuaucgugcacccugaaaucccuauuuuuguaauuuaugauuagacuguggucagucacuuaaauaaacacucuuaugaauuaacuaguauacccuaguauaguuuccaaaauauaucauacuguauagcccuaugugcaugaagaucucagggggaggaaguacacgcuaggucccaaaggguccagacuaucaucaaaagcgcaugccaaguggccugaggccacugcucauacacgagggggcgggggaggggauaugggcugcagccccucagcugcccuuaguggugggaaucagcauggucgcuguuaaaggaaagccaucuuuugaauuuuucaacaccaaaucuuaaaguaucaaaaaaaguuaccgaauguuaaaaguggggucguuaguggaaauguugucuguaggaaguuuuucucauaguguuugauaaaaacaacaaaagccaaacugaagcccaagaaguguccucugggggacacuggcauuaggguggucgaugacugaaggauacagcagugcuguccuguacacagagcucuuuugagguacaaucuuuccaucguuucagggguaaguacuuccuuacaaagucuuuaauaaugaaugaauguauaaauuuauaaacuaugcauuuucagagagaaacauguauuuuguaucaaauccgaguacuuuuuuuuuucauagagauuuaucacaacuacagauuauucaaaauaaaugagaaugccaauccucauaaggguguggggugccuuuguuuuucacucugaugguuucaagaccaugcauccagacuuugaucugaaaagcuagccaguacaguaggcgaaggaugauucgccuucuccuggaggggaccacucgcacaccacccaguucuuagggauggauaauuuaguaacacuggguuagcggauagaagggccaggguguggcuuacagauagagcccuggccucacgugugugaaggccuggguucagucuccaguacccaaguaguaacaauaagcaggcaggcaacgcuguuaccauaguaacauuacauuaccauuguuaccauugcaucggcuaaagaugacccagcuuagguaguuguggcuaauugucgauccaacugugggugaggaagaguuuagguuauaguuuucaaagaacaaaauauaaaguuauugucugacaaggcaaauaauuguuuuuuuuuuuuucaaaauuacuuggaggugaucucuuauagaaaauguagacuauacccagauuucuccagccuugugcugauaggccuuuucacggagccuuucccacugguaauuguucuuuccuccuuggucaguacucaccucaucacuccagcagccuccccgcuaucugacaaggaggaagugaaccccauuucuuugcuguuccgguucucuuucuguaucugucgaggagguuucuaggcugucuauaaaauauggggaaacacauuucuaacccugguacuuauggucauacaagauauguuugcucccuaaguaggagcuagaggggagggcaaugugucuuuuuacaugauuuuuagccaaauccagcuguucugauacuauguuucugaauccuuuucugacuguaaauacugccugcagaggucccgguugacagccuuuucugagacugguccucagccaugcuccuugccagcuguuggcacauuguacauagaugcgucgaguguuucaaugauguugguuuucuaaaugcuauucucuaacacauuuuuugaaaaaaaaaaugucuuuguuguucuggacuuuguguguucguuuuacaaaaacauuuccuaagauuuaacaccaggaaaaaauauuuuaaaauacacuggugcuaauuggaaaagaagaaaauuuuuaacuucaagauuuacaaaagaaaaugaucacagcaguuaacugcacuuucccacggggauggcugcuguccacuuacaaugggcaucaagaggaccagcaaaaguuuacaguagugaugacccauugaugugucauagagcaaggaguccuugucccccagagaggaggauuugcuggguaguccucaaagcauguaguagagaagggauauagaguuaacucuuuagaaauagucuucugguccuuggacuuucauguucuguaaugcuuagcuguaacaaugaauaugguguugccaaucuagucugacuucauugucaaccuguacugacucuguguauggcucuguccuuggcuugcacuggcacaaaccaagccagaacacaagucuuucagaaagaccauucugauuucuaugauguucacacacaugaauuuagaugcacuuguaacugguuaauuaccaugaaguaagucuaacuuccacuuaauaaaaguuuuuuuguguaucugcuucuaucugggagccauucauuuauguaaagcuuaacauucauaucaaggguuguuguauuggugauuuguuuaguuuuccagaagaaugucuaaaacagccugaggggggggggguuauuuggcucauaguucauacaaaugcacacucccugugcucagccugcugucccacugaaccacugccugugacccugugcuaggaaaacaauaucuagugugcauucugguucuaagccagcuggucuuccucugcagagaccugcuauccacuagaacucacuauguccaccuucaaaaucacagaugcucuuccacuucuguucagcuguuaggucuccuguuacacauagacacacaccaaaccacaccaggaaagcuuggugcuacuuugguagccaacaaguagagguuucuuuguucugagccauagcauagugcaggcccacuuugaugccagcucuccuuugucauucaugcucaggccucaugcuccuggccuuugacuuagugccuguguuuuagccacaaggauacauaagaacauugguguuggugaacagugcucaaacuaccuauauggccuccagggccucccagggcuccaggaugcucuccagggcagauggcggcugcaggaggcuggaaagccuuaauguacaggaagcaggaaaaacuagggagggucuaagcuacaaguaaacaccuacaaagugguaugaaaucauacauccagcccuuuauagcuagggguucugcacaagaauucaaccaaccacaaguuggaaauuucugaagugggggagucauuuugguacugagcauacaaauuuuucuuguuauuucuccuuauaaacugaauaacuauucagauaccaucuacauuagauacuguagauaaucuugaggugguuggaaguauuccaggagauguguguaggucacgugaaauacuacaugacuuaaugaaaggacauaaggauaaggaucugugugcucagggggucccuagaaccagccccccccccagugagucagaggagcaguuguauuugcugucuccguggguacuguagggaacucauaggaacauaacaaauucugcuaaugcagacuuuaaagcagcugagcgucaagaaggcccaugccagccuuuucucgggggugcaggcuaacuccucgcuguggccaccauguugcugcauuacuaagugagcugcacaauuuuaaaugaauaaacagguugcauauucuuucaaucugccauucccuggcccaagccaaacgcacagaagugggcauuugaagacugacacagacaucuguuggcucucaggacuuugacuguucuuuagaauauguacauucucagaaucaccaaguaccaaugacuaucacuuacauagcaauuaucuaacacaugagacaaaacguagaauuacauacaccauuuuuauguagaaauguuuuguacauagaaaggauuuaauaaguggggaaaaugaaugcuucuaaaugaaauaaauuucagcauuggucaucugugcuauuaaaagagaguagagaggcuaggcuggcuuuaggauauaacacacuuucaagaguggagucuggguguccugguaaaugguccuccagcucuagcugcacagcauguagcuauaguuuuaaagcugaaggagagugagugagaugcugagaguaaaagcaggcccuucuaccuugaccccaucacccugucagccugcuggugcuuucaacccguguaacugcugcuugaguagauggcaucacuuucaauuuaauuccagguaaguauugcugggccagcaaacagcagccccuaagaaccuaacaguaucaaguauggggcccacaggcacagguagaauuggugaaugcccucugugagaaagggaccaucugcugcucugaacagcauagagugcuuuccaggcaucaagacacuggccuaauggcugacuccugagucuguucccccaaaggaugcuacuacacccugggaccugaaaacaaccagcuguucucaccaccaaguaaaaucccacacuagccacaaaaccuagaucaaauccuucaagcagccgcagucagcgggucuggccuuaacucuuaaugccacuacagccuguggggugcaguccauucauuucccuggccgacugcacugucaugccaaggccaucacaaggaaacaugccaagucaaguauuguaauacagcucauuucaggccucguuagcagugguuagagauguggggagccuacugcacgcaugcagcuggcaguguggaauaacccugcucagauacaauuaagcacacacaacuagugcguuggccagaaggaugaaugacuuuggaggaaccaaagucaggcacaugccuggaaccaaggguaagaugccuugggaaacagaugggcuuucagcacuaucuuccaugacuuugggcuuuccaaccuuauaggccuucagaucaggacaccauaaugccaagagacacgcuaaagaucuccugaacuccaaaugucuuuuuuuuuuuuuucaccucaucuggagaugcagaccaauuuuccgcagugaugagggccaaugcccugccguacuucuuucuuagccuguugacucuagggaccaagguggccagggugacgucuuagcuuccaaaccaguuggauguuuauugugucucuugccagaaacacuuccugcucugagucaaggcuucuaagccagccacaaguccauaagacaggaagccaaaauuuuugcuuaugggaacugggcauaguagcauuuaauuccacacucaggaggcagaagcaggccucuugaguuugaggccagccugaucugcauaguuccaggacagccugagcugcacagagaaacucugucuuaaaaaacuuauauuaacaacaacaguaauaauagcagcuaaugggucacuagaagugauagugaaugguaccauucuccucuugauuccuaaaccuucaaauccuggcuaccagagaagccauauucuacauugauucagagcacaucuagccuucugcagagcucugcccuagccugcaggcuguugccaccuaguuggcauagaaacugcauuauaaaaaggucacucgacuguucugucaaaccaacugcuucaggcuggugggaacguggcaagaccagugaauccaugagcgugaacucacugcuguccuucccuggcugagcggugaguuccuuugucagaagcaaugccguguagauuaccauagugauggaaaagacauuuaaugaguucaucgauggcaguccugguggaagcauugggucagaaaagcaaaucuauaaccaaaauaaguguuccaguaaggacaaagcauugaccuuuccacgauggaaagaaucugauguguucaguuuaccaugagucacuggcugguggcuccauagauaaugauguauuaggagcucuguguugguauuugccauuggcagaucugguacucagcaaccacaacagccagcccagccuugugcggaagucauuuauuuccuuuucucagauaaacaaauguuuuaacaaagaggucugugauggaugcuacauccucauuugguccaaucaucauaauauaaucagaccuguguuauaccuuguggaagaagcaggugaucaagaccccugaggacuaaguuaugauacuguaguagagaaauaauagaugucuuagguaggucaguagaguaaugugucuacaccacauccacccuccaugcccagccuggccagcacacucugcucuggcccagcuuggugaguccacccugggagcgauaagccugcucccuccuucauccuaacgcucagauggagcccgaaccccacacccagggcuggcucagucugaaggccuuugccugugguuucccaaccuccaugauacaaacaggcuaaaagaauucauauccaccaagccaguccuacagagaaaauuagaaacgauacaucagacagaagagagaagugaacauggccaagagacucuagaaagaaaaugaguggaacuauaauuacuaaaccauaggaugcaaacaccaacacucuacacacacuugucaauaauaacaaauauuagaggccccaauuguccaaucaaaagucaaaggcagauuaaacauuaacuuuaucuuacuguugucuacaagaaacucggcuuuaaagauuggcagcgucuuaauuuggcagcucuuaaccugugggucaugauuccuuuggaaguugaaugauguuuucacaggaaucgccuaagaccauuagaaagcacagauauuuccauuacaauucauaacagaagcaaaauuacagcuauauaguagcaacaaaaauaauuucacgguuggagguguuaggggauuguagcauuaggaagguuaagaaacacugucuuaagaaaagacaugcaaaaaaguauucuaagcaaauaggaacaugaaacaagcaggcacugcuauccuaacaaugacaagacagacuucaaacuaaaacuaagauauacauaggacacuucauucuaaucgagggaacaauuaacuaugaagacauuauaauccuagguguguguguguguguacauauguguccaauuuuauaaaaguacacuacuggaacuaaugauacagaugugcaucaacccaauaacauuaaauggaucuggcagauaggaacagaauauccauucaaacaccaaaaauuaucgauucuaccaauggccuagggaaaugucucugaaaacagacuacauccuggaacacaaaacaaaucuugccaaauucauaaaauuacagugauuccaugugaucacacagauccuuaccuccaaauugccuuccucccauuccucccuaucccagcccccaacucugucuggcauccccugggagcccacagcacaaggcagggaaacggaggcugacuucucccuuuacucccuccucuuuccuaacuuaauccucugcaucauccccagcucugggccuggcugggccucgccucauucucugcccccauccccaggggacuaagcagaucucgguagaacacccugcuuuccuucccccuguggaguccuucagucacccagacuccuagcccuuccccauuacugcaugucagcucccacuaucuagaaucauauuuuacccagaacuccuuuggccacacauaucagaauccuagaauuuccuaccaggccacauacacaucauucccuccuaagaagcagagagagcaacagaaaccuaggacccaaacauccacuuacccaacaaagacaagaccagacaucagcaccaggaauuacagucuucccaaacccagaugacuagauaccacuguaaacaugcaaucaauauaagccaggacaguauaucuccacuagagccuaacaacccuaccagagaguugcaacauagcugaaacacaaagcaaagaccuuaaaguagccuuuaugaauagcagaggaguccuuaaagaaaaaaaaaaucgcucaaagaaaucuaugaaaacacaaacauuggaagaaaaugaaugaaccgguucaaguccuaaaaguaaaaauagauucaauaaugaaaaccuaaacagauggaaaucuggaaaugaaaauuugaggaacuuaaacagggaccucagagacaagccucaccaacagauuauaagagacaaaagagagacucucagacguuaaagacgugauagaagauuuugaccaaaaauggauacuuuggacaaagaaaauacaaaaucugaaaaaaaaaaucugccccaaaacauccaggaaaucuggacaugauaaaaaaaaaaacaacaaaauauaagcacaugagacacccaagaaggaagagaaaccuguguccaacacagaaaauauuuuuaaguaaaaauggccuggguggccaggugugguggcucacgccuguaauuacagcacuugggaggcagaggcaggugaauuucugauuucaaggccagccuguucuacagagugaguuccagaacaaccaauacuacacagaaacccuguuucagaaaugaaugaaugaaugaaugaaugaaugaaugaaugaaugaauaaauaaauaaauaaauaaauggccuaaagaagauaacuaucaagaugcaagcacuauacuuaacagcaaacagacuagaucagaaaaauuucccuuggaacauaauaaucaaaauacuaagcauagaaaucuaaaacaccaucagauccuucuacaaaaggcuauacucaacaaaacuggaaaaccuggacgacauggacaaauuucuagacagauaccagguaccaaaguuaaaccaggaucaaguuaacgauauaaacagucccauauacccuaaagaaauagaagcagucauuaauagucucccaaccaaaauaagcucaggaccagauagguuuagugcagaguucuaucagaccuucaaagaauaucuaauuccaguucugcacaaacuauuccacaaaauagaaguagaagguacucuacccaacucauucuaugaagccacaauuacucugauaccuaaaccacagaaagauccaacaaagauagagaacuucagaccaauuucccuuaugaauaucgaugcaaaaauacugaauaaaauucucacuauccgaauccaagaacauauuaaaacaaucauccauccugaccaaguagguuuuaucccagggaugcagggaugguucaauauacggaaauccaucaacguaauccaguauauaaacaaacucaaagucaaaaaccacaugaucaucucguuagaugcggagaaagcauugcacaaaauccaacacccauucaugauaaaagucuuggaaagaucaggaauucaaggcccauaccuaaacaugauaaaagcaaucuacaguaaaccaguagccaacaucaaaguauauggugagaagcuggaagcaaucccccuaaaaucagggacuagacaaggcugcccacuuucucccuaccuauucaacauuguacuugaaguccuagccagagcaauuugacaacaaaaggagaucaaggggauacaaauuggaaaggaagaagucaaaauaucacuuuuugaagaugauaugauaguauauauaagugacccuaaaaauuccaccagagaacuccuaaaccugauaaacagcuucggugaaguagcuggauauaaaauuaacucaaacaagucaauggccuuucucuacacaaaggauaaacaggcugagaaagaaauuagggaaacaacacccuucucaauagucacaaauaauauaaaauaccuuggcaugacucuaacuaaggaagugaaagaucugugugauaagaacuucaagucucugaagaaagaaauuaaagaagaucucagaagauggaaagaucucccaugcucauggguuggcaggaucaacauuguaaaaauggcuaucuugcccaaagcaaucuacagauucaaugcaauccccaucaaaauuccaacucaauucuucaacgaauuaaaaagaacaaucugcaaauucaucuggaauaacaaaaaaccuaggauagcaaaaacucuucucagggauaaaagaaccuuugguggaaucaccaugccugaucuaaagcuuuacuacagagcaauugugauaaaaacggcaugguacugguauaacgacagacaaguaggccaauggaauagaauugaagacccagagaugaacccacacaugaaacuuauagaggagaacuuagggaaaagccucgaagauauuggcacagggggaaaauuccugaauagaacagcaauggcuugugcuguaagaucgagaauugacaaaugggaacucaugaaacugcaaagcuucuguaaggcaaaagacaccgucaauaagacaaaaaggccaccaacagauucggaaaggaucuuuaccuauccuaaaucauauagagggcuaauauucaauauauauaaagaacucaagaagguggacuccagaaaaucaaauaaccccauuaaaaaauggggcucagagcuaaacaaagaauucucacuugaggauuacugaauggcugagaaacaccuggaaaaauguucagcauccuuaaucaucagggaaaugcaaaucaaaacaacgcugagauuccaucucacaccagucagaauggcuaagauuaaaaauucaggugacagcagaugcuggcgaggauguggagaaagaggaacacuccuccacuguuggugggauugcaagcuuguacaaccauucuggaaaucagucuggcaguuucucagaaaauuggacaugguacuacuggaggaucccgcaauacuucuccugggcauauauccagaagauguuccaacuaguaagaaagaaacaugcuccauguacuggcuaguuuugugucaacuugacacagcuggaguuaucacagagaaaggagcuucaguugaggaaaugccuccaugagauccaacuguaaggcauuuccucaauuagugaucaagagggaaaggccccuugugggugguaccaucucugggcugguagucuuggguucuauaagagagcaggcugagcaagccaggggaagcaagccaguaaagaacaucccuccauggccucugcaucagcuccugcuuccugacuugcuugaguuccaguccugacuucuuuggugaugaacagcaauauggaaguguaagccaaauaaacccuuuccuccccaacuugcuucuuggucaugauguuugugcaggaauagaaacccugacuaagacaaauuggaaccaggagugggguauuccugugacaaccugaccauguuuuggggaggacuguggaaggacuuuggaacuuugggcuugaagauccauucgcuguuaagagcucugucagauguuguguaggagcuuagaagauaauguugaaaacagugcagaagauggaggccuggcuugugaaauuucagagggaagauuaaagacuuuucagggccauugcuguuuugauugugaagauucugugguucugguuagcuggggcugaagaaucagcugugauuaacaagauaccagaacuacuaaagcaaaaacuuggcauuacugggacgauugaugcugguuagcuggagcuaaggaauuaguggugauuaagaagagaccagcaucauugaggugacaccuuccaggaaguguuuucugaaagcacagaggcugugucccagagauagccaacguuguaccuugugcuguggcuggacuugguaauauguaagagucacccaggugguacugguuuugaaggcaugaaggggucacgcagagcagcugaggcuuuggcacugugagaggccauggaaggccauuggugaaggugcagccucaguugaaauugacagcccaggacugaaggggucaugcaguguuuuggagaugccaguaccaugagaugaucaccaagagcagcagcaguggaguacaggcaucuggagccuagaggaugacgugugugcuacaaagggcauggcuggagaagcaacccaaacccuuggaggagcccagaagaucauaauuuggaucccaggcauuggacuguuggagauugauuuuugcuuuugauugugacugugcccugauauuuucccucuugaaggaagaaacuauuuuaguggagcccacaguuaagagacuuuuaauuguaaaaaagacuuuggauuuuaaaagagauggacauuuuaaagagauugaaauuuuaagaauauguaaagacugugggacguuuaaaguuauuuauaucuugggaaugaauaagaaugcaagggcugaggcuuacuagugaugaguuugugugucaaguugacaaggggucaauuguacuggcuaguuuugugucaacuugacauagcuggaguuaucacagaaaaaggagcuucaguugaggaaaugccuccaugagauccaacuguaaggcauuuccucaauuagugaucaagggggaaaggccccuuguggguaggaccaucucugggcugguagucuuggguucuauaagagagcaggcugagcaagccaggggaagcaagccaguaaagaacaucccuucauggcuucugcaucagcuccugcuuucugaccugcuugaguuccaguccugacuuccuuuggugaugaacagcaguauggaaguguaagccgaauaaacccaacuugcuucuuggucaugauguuuguacaggaauagaaacccugacuaagacauggaccaaacacaagagcacccaaggagaaaaaaaaaaaaacaguauuauaguucaaauccuauauugauccuugcacacagauacauuaauaccccacucuuccaaauagacaggccauccagacaaaaacuaaacagaaaugccauugccgacguacauuacaaaccaaauggaccuaacagauauuuacagaacauuucauacacacacauacaugcacacacacacacacacacacacacacacacacacacaaucucauucucagcaccugaugaaaucuccaaaauugaccacauacuuggagaaaaagcaagucucaacugauauaggaaaagugaaauaacccccugcauccuaucagaacaccacagacaaaagcaaaaugccaguaacaacaggaagcauacacuuacagaauccaaacaacucacuacgaaaugaaaaaugggucaaggcagaaacuaagagaaaugaaagacuuucuagauaugagugaagaugaauacacagcauacccaaaccuaugggacacaaugaaaaugguucuaagaggcaacuucauagcaccaagugccuacauaagauagauagauagauagauagauagauagauagauagauagaugauagauagauagauagauagauagauagauagauagauagauagauagacagaaagacaaacaaaugauaaauacauggauggauagacagaagauagauacauggauggauagauugauagguagacagaaagacaaacagaugauagauacauggauggauggauagauagauagauagauagauagauagauagauagauagauagauagauagaugaaauggagcgauuccauacuagugacuuaauagcacaaaaaguacagaucacacccagaaagaauagauaauaaauaaucaaacugagggaugaaaucaauaaagagaacgauacaaacaauaaaacaaaaaguuugcaauuugagaaaaugaaagagauuggcgaccucuuauucauauuaacagaaggcagggggugugcacaugagcaguuuggaaugagucagggugacugacagcaggcacugaggaaaugcagacaauccuuacaccauacuuuaacagccuguucuccaccaaucuggagaaucuaaaagaaauggauaauuuucucacuugccaaaauuaaaucaagaacagauaagcacuuugaacagaccuuuacuccuagugaaauagaggcagucauuaagucuuuggacaaaaagcccggggugagagagauggcuuuaguacagauuucuaccagacuccaauacuucucaaauuauucgauaguuacucugauacccaaaccacauaaagcccccccccccaaaaaagagacuuacagaccuaauucuagauacaaaaauuuuaaauaaauuacuuggaaaccaaguccaagaacacaucagaaaagaucaugcaccuugaucaagugcgcuuugucucagagauucagagaugguucaacacacaacaaucaguaaacaaacugagugacaaaacccagucucauuagaugcagaaaaggcuuuaccaaaauccaaccccuuuguaacaaaaguccugaggagauuagggauaccaggggauaccugagcacaaugaauguacuuuacaucaagccuguagccaaccucaacuuaauuggagagaaauucaaagaauuccaguaaaaucagaaguaagacaaaguuggccacucucuucauagcuggagcaauaagacaacugacugaaggagauccagggaauucuaauuagaaaggaaggagucagagugucuuuaucuacagaugauaucauaauuuacauaaauggcccuaaaagcuccaccaggaaaccucugcagcuggugaaacccacacagcuccuggccuuccaguaaagagacuggagaaaacauugaccaaagcgcguagcccucggacauacaaauggcaagcagacuggaagacaucaggggucgucuucuuucacuauaguuucaaauaauauaaaauaucugggaucacucucaccaagcaagugaaacacuuguaugaugaaaacuuuaaagcauuaaaaaaagaaauugaaaaaagaucucaaaagauggaaagaucaccuaugcucauggaucacuaggauuaauauaguaaaauggccauccuaccuaaagcaaucuacaggcuuauuguaaucccauaaacauuccaacacaguucuucacagaucuugaaaggacaauaucagcuucauauggaaacacagaaaaccaaugauaauuaaaacaguccuaaacaauaaaggagcugugagaggucucaccaucccugguuucaaguuguacuacagagcuauaguauuuaaaacaaacaaacaaacaaacaaacaaacaaaaacacgugguauugguacaaaaacagauccauugaucaacggaguagaauugaaggccgagagauuccugagugugugaacaaaugugccucugccucagccucuguuacauacgccuuucccugacucccucccuucuguuuguuuccuuaguccuagucuaagauguuaggguuucuuuguuuuguuuugcuuucucauauuauuuuguuguuaugcugauuguugucuaaugagaggcagaaaaggaguggaacugggcgguagggaagggagaggaucugggagcagcggaggaaggggagaccauaaucaugauauguuacaugagggaaaauauauuuucaauuaaaaaaagaauaaacauuaggguuauuuuauugaagaagcagaacucuaaguauccuaucgaccauacauaauuugacaaaacuuagauugacagcaaacaaaucucuuaaauauacaugcucauggaaauuaaacaacucauugaugaauggcuccuuuagaucaggaaugugacaggcuugcccaucucuggcaaagaagucaaagcaucccucuuuacauauggugucuuaguccggguuucuauuccugcacaaaacaucaugaccuagaagcaagucggggaggaaaggguuuauucggcuuacacuuccauguugcugaucaucaccaaaggaagucaggacaggaacacgcacagggcaggaaguuggaggcaggaacugaugcagagacauggagggugcugcuuacuggacugcguccccuggccugcucagccugcuuucuuauagagcccagggauggcaccacccccuaguuucuccauccaaacuccccuggcccccagauccacugcccaccucuguguccccuuagaaaagagcaagccucccaggaguauuaaugaaaacagcauaacaagcuacaguaagacuagacacacaccaucacagacauacuuacaugcaaauggguaucugcucuaaagcaaaggaaucaugcugcaguccaggauccuugagaggcuaaguaacaaugaaagcuuaauggugggaaaggaucucccuggggagggagcuagaagagauuuuucagguggacugagguuggugggguuaggaacaggaggaaucagauggagagcuagagaaauuacugggagaaaugacugggagaaaugacuggaauuugggggagucauuuugggagugagguggaaaacuagugcaauggaaacuccauagaaucuaugagcauagcccuagcaaagacuccuaguaguggggagagggacccugaaucagcugucuucuauuaccaggcaaggccucaaguggagggauugggacaccaacccagacauaaaacuuucaaccuacaguaugaccugccuaguguaccaggacuggggccuagcagaauugucaucagaaaccagagaggcuuuaucuggcaaccacugggagcaaaugcagugucccacagccaaacguuagguggcggucagggagacuugcagaggaaggggagcacagacuggaggaaccagagggauccgggacaccaggaauacaugacccacagaaucaagugacugggacucauggggacucggagaucagggauccuggagggcucugaccuagguccucugcauauacguuauggcuguguaacuuggcauucuuguaggaauccuaacagugagagcgagggcucuuccugauccuuuuugccuacuguagggcccuuucuucuucuacuggguugccugauucagaugcaggcuuguaaacaaaugaaacaaaauagaagacccaaacaugaauaaguguaacuacagccacuugauauuugacaaaaaugccaaagaugauagauagauagauagauagauagauagauagauagauagauagauagauagauagguagguagguagguagauagaaaauuaauaaauaaaauaaacugccuggagaaaagauggcuucuggcuucuucgaucuuuaaugaaugaggcugggagagcugggugucugcauauagagaaaugaaaguagacuugcaucuaccacucugcacagacucaccuccagaagaggccucaugugaaaccugaaacacuuugcaaaacacaagaaaaucaagagagauaggcguggacuucugaaaucucaaagcucaccccaagugacacaccuccuucaacaaagacacaccuacuaauccuuccagaaacagcuccaucagcugggaaccaaacauucaaacauaugagccuaugagguuccaaccaccagagguucauuugaagaauaguuguacagugguuaacaguaaaacauguguggguucuuccugaaggagaccuggucuccccuuuaucugagggacacuggcuuuguaagcugggucaagcccagacguuguuugaagggcugugauccuguauuuaugauuccagguaggcucuuguucauuagccuacacggaucaagugagaguuuaguaaacuucugcaaacauagcaaggaaguaccaaagaaagucagagcauugugaccauugcuuugucuauucuguccauuaaaaauaaauauucucuccuugucugucucuugcuacucugagaucccaaucacacauacuauauuuaagguacccaauugagaagcugucacacugccgugaggucuggcauauaaaagacagugaccaggcucuucaagugugcugguuguuggaaaacccaggccuuucaggucaugagucucuaacagauagggcugugaugggguaggaacacagccagccacacuagcacccagguccaaggcagcuuuguuacagucacacauuaacuaaaauccuccccuacgaagcaucucugugaacccugucacaagugccugucugucuugcguguggccuguagcacagcucacauaaugacuaagccuguguuccuguaaggcagaauauccugcgccuuugugaauuucuaagagucgacuccauuuuucacuugcuuaccugaagacucugccgcuuauguuucuuuuaugccucccuuaucucuccccuccuccagaccucaugugaguauccucucacagcucuaugucuccugauauuagggaagggcaucucuucuguacucuuacacagugcacgaauaaguuugauggcaaaagcacuccgguguuccaucuucuuuuugggugucuucaucaacguuaagccagccuggucuacagagugaguuccaggacagccaggacugcacagagaaacccuaucuugaaaaacaaaacaaaacaaaacaaaacaaaacaaaacaaaacaaaaccauuaaguacagggauauuacgcagcuccagcuucacggcagcccaucgucugaccuguaugcacuuugguuaaucacucagguaagcauucaaugcaggagcccuaucuauaugcucagccuagccuaguuaugugccguccggcaucaucccaccccaugaacucauuccguguguauccacgucuaugaaugagaaagucaagacguuuuuaggcuagcaugugccucugugaacuucacuucuaacugcugagaccugaggcuggcuauauggucucuaggcaaaguucagugguaacggcagguccugggguguuaucuuuuuuaaucucuuaggaaagguccuugcugguuucauagaugauauaaaauugguuccuucuggcaggggaagagaggagugaguuuagggauacauccggcaccccuaaggugagcaaaguuuuucucaggugaaauaaacccaucagaauccaucaaggcccuccagaauaucuccaugucuuauagaaucacacucguccugauccaugucucacuuuaacuccagacagccuuaaaggcagagacuuagacuuauuuuuaagucauacgaugaguuuugugucagcaacuucagccauauggcugcaggagucacucuaucugaaggcacacucagaagccaugaugguacuauggguaucugagacugaaucucuggacucauacuuuuccuuguugcuuuuaucuagagaugcuaagaagcaaccauccugaucguuaugugcauucguuuuccagaaaugaucaaaggccuaaaugcuuugccucucacagugguguucucuucuuuaauggguuaguacaugcacagugcucacuauguuguauggcacuuacugggggccaccaagauccuuaugagucagcaccaguauuguuauuuaaauagcuuaaugaaaguaccuuaagcauuggagcagaagccauuagcuaaguuguagagagcuaaguauauauuccuuacaaaauuguuuuauuucccaauuuuguacuagagaaguaauuaaaaguaaaacaaaaacaaaaucacuaauaauuacaacauacaaacauauucacugaugauagguauauuauuuuuaacuauugccacgcguauuuaucacauagcugugaucacacuguauauauaauucagcauauugcuuuuagucacuuaacaugauagcauaugcauuuugccauaucauuaaauaucuucuaaugccuacaugugaauagcuguguacggcacacuguguagugguuucuuuaaguauuguauuuggaaaauguaugugauuuccaaguuuaauaaagaugacaaauagccaauugcugggugaaaaugaggaggcaggaggcgggaggcgggaggcagguuuuccgggcaauacaggaagaggcggggaggaggaggaacugaagagacuacgggagaaggacagagagagagaaguuggaagauggagcagaagcgcaugaccuggagaaacugcaaguagcagggauuucauagcuggggaagaaagugguguagaggcgcgucugcccaauacaggcacgcaguuuauaaauacauuacugaguugugucucucuugccugggcuuauugggguuggagauuuaccacaacaccucacagagcuauucuggagccaagauggccccucuucuggugugcacucugaauccugggccugugcuccucugcuucugcgggguuccuacuuccaagccugguaacccccaugguaagaccucaggggugcuuggcuuggggcuuggccuccugcaucucuagaauucuucuucuucucggucucccgacuagacucuuaaagaaccacaaacugugcaagaugugacaccuuugaugccacccucugcuucacaccuagugccacauuuacaggguucuacccacuaaagccucuaaaauaaaccagugcuucuggcaagcagaaaauggugggucuacaguggcaccuaccaggacucccccaauuccugcaguugcucuccuggggcaggaaauagcaaagccuuucccugaagacugagugacaggagagucagugucagagcugguuuacaaagaacuucaccaauaaauguggcuuuauguccuuuuugcuugcugggcaaguacuucuugcuguuuaacgccuccuugcuauauuuguauucacaaucaaacuggggaggagccggguaagcaguaaacaguuacuuaggagccuuuccuaugcauucuucaugcagagacugcagagccuucaagagcacuagucugcuuugggcccucagcaaauucccuucgcguuuagauuaagaccccaaaucccgcugagaccaucuucuggaggucuggcccacacgcuaugcugaugauguaacuccccuuuuucuaacugggggccuccaguucucaugcacguccugucuccugucagcacuucugcccugauuccagcacgcaccuucugcuuaucuuagucccuuuccucugcucccuuccaccuaaacuucucaucggccagcucaugcuuccagucuccuugcugcacuccugcccucaaagucccgccaccauaacuuccccacaaggaugggcagugcacuugaacugugagccaagcucaaaccguccucccuuaaguugucucaucggguguuguaagagcaggaaaaggaauugaugcgggugcugucuuacuccagacacaaaaggaaucaauucuaaacaaaugugcagagcaaagacccagcagggcaaauauagcaaagcauguguggcggcguuauuaagugagugagcugauugugcagugacagcccgcuuuagucacgugacucucgagcagggcacacguggggcuaggacugggagaagccccugcucugguagcuuccugucguagcagcagcacaccguuuccccuguuuguuuuuagguuuuuguucuugagaaaaccccaggaauaaaugucugagagacaggcuucagccacaggauuucuacagccuaauguuugaccagaaauccuggauuaugaacacagaacuugucauuauuugcacaagacggccucuucuuaagggcaagcauuuaucaacaucugcauacaccuaaguuugagcaucuucacgacacagagcuguauguggcaagaaccacggaucucagcacgcaguuguuucuuuguaaucauagguaaaggggguucucgguuuuauuauuuaauuuuauguagauguugccugcacguaugucuguacacccaguucggugccuggggaaaccagcagaaggccuccgaacccuggaacuggaguuacagauggucgggaguaggaacagaaucuagguccucugugggaguugcaagugcucuugacagcggaaccgucuuuccagccauggagauaauuuauguuuugaguaaaggaaccacacaucuggccggaaugccucuguucacuuguuuggauggcugccuggcaaacuguucuacacaggcugccgacuguucuucagugcaggucaaauacuuucuauuuaaaaguugauguuaugccuaaggcugagcuguagcuccuuuagacuuuucuucccuuugcuuuuuauagccaaauaaacaaggaaguugacucagaacuucuuguacuucguuaucugccacauggugaugaggccaucaaacugcuuccacgggccacauucgaaaccuagugucucaauuuuagagaaacauggacagacuuuggguccuuugucuuugaggagcaagagaacacucuucaaggaagaugggcuuuugguuuuuaggaaaacaucaaagaauguucccaguucucuuuuuauggaagggauggagacuucagguacugccugaagagcuaggcuuuugcaugauaaacugauggaaucuggacuguguuugcaugcacaugugaguuuaugguaugcauguggugugugugugucuguguguguguaugcuaugugguguauauguguguguuugugcacacacgcaugaggacggggcuagugacuaggaaggaaacagggagacuugaagagauuauaaugccaucccauagaacuuucuacaaugcugaagcauucuccaccuguccuggccaguacaguggccacuaggcauuuguggcuauucagugguugaaauguggcuaaaauaacugauaaauugaaauuucaaguuuauucauuuuaaucacacauagcuaguggcuacucuacuggacaguguagaacaauaguagaucuuucacagcaacccuguauccucaccccagacuggagcacagauauagaauagggaaagccuccagagggacacucucugcucugugaagacuaugaaggucaaugguaggggcuggggagccagcccacuugguaaagugcuugccuugcaaguaugagggucagaaucuaaccacuagaacccaugugagcaaaauccaagcauggcagcacacacuuguaaucacaggguggagacaggaggauuccuguguucacugcucagccagcucagccuauuuaacaguuccaggccagugagaccuuaucucaacaaaacggcuaucuaugccucccaucuucacccuauggcaugaaagaacgaccccagaacacauccuaaugcuauggugugcaaaguaaauguccacacaaagaaagauaaauauuuauuuuaaaaguggccaggcaugagaacauacaccuuuaauuccaggcuugggaggcaaaagcagauagaucucugcgaguucaaaucuaggcugugagcuccaggacaggaagggcuacauagcaaggcugaucucagggcgggggugggguggggaugggaauauccaaagucuuccacacauacauaugaaaauauacaugaguguguguguguguguguguguguguguguguguguuccacacauacaaaucaaguuguuuuuguuuuuuguuuuuuguuuuuuuuuuaaagcuguggucaacuccauguuucccuuccaguaacuuccaguaaaagucucauugcaugaccuucagcucagcuugcugacacugucauucugccagcuguccugaaauaauuacuaaaagucccugcuuugcuccgaagaaugucccauaggacaaaauagcacauggcccgccugccuaagcacccuaccucuuauugaaggugagugugaagcgggacagggacaugaagccaagcucagccaccgcccucccaugcccuucucguagcagagggaauggaagagcgaaacugugcggcccacacaggugacugccaaaacagaugagcaauggguggugcccugggagcaagucagacgacagugucagcugcagaggaccaggacagccccaagaccagaaauaagcuuccuuggaaucuugggacaauuccaagcaaaacuggacggcuuaaauagcuuucugcuuuccugugcuucauaaaauucaguguuuuuaaaaaucugcagaacauucucuuuuaagacguaaaguucaaaauaaaauuucuaagauuuuuccaaaagaaugaaauaaaauuaagcuugcacacauucacugaaguuaaaagaagucccauuugcagagucuuaacaggaauauguuagauauuaauuucuaaacuuggaucuaguagucuguuuauuaaugugcaucuuuaaaguccugugcaggaaagaacauuuuguaacuucuauauagcccauuuccaagugagacauauauuuguacaacaucugaccuaaauccacaguguauauaaaacauuugaagaauucaucuuauguccaggcagauacaggacucaguucauuaacuuuuuauggcucaggcauauaaaacccacagggcaccucaccuccacgcaaaugucaccagaguggcaggaggaagcagagcagugcaaagagugcaugcuggaggcagccaccaagguuugaauccuauugguccaaacucggcauuugcaucugcagaaugggggcaauuuugguaauuuaguaagauuaucuaaauaaaguguuuaugacaguucccagaaaauacuguaaacuaugauaauauugaccacgaugauaauggaagugauggcgaugaugauaauuacagaguaggcagaagaugagcugauuggagcauucgggcaugagcuuguggaaaaacaaauggacacuuuaucuaaaguggcccccaacagaaggcuuacuucugcuacucuaagaguaacuauccauucaccauuccccucccuuacaaaaugacaaaguccuaaggggucuccgucaaagcagaugcagauugcuugagggaaggguuagacugauguguaucugcccggauaacucacacgaggcuugaaauaagguaacugaguauugauaucagcuucccaauaguucuugacuaagcauaacacaccaucagacacuggcuguccuggaugcuaagggcauauguuggcuuauugguggggucaucacaucacaccaggauauugcugucuuuaacaaggacaaagaaaucuucacauuuuuguugguuuguuuguuugaucucuugccuacaauagagaaauaaucccaguauuuuucuucuuaccauauauacucuuaacaggcuuagucucagcuagaaagaucuuucagaauccaagacaccuugcccagugauagcuccccuggacaauguagaggaaauagcagaaagagucccagagaccaaggacucguuuucagagcuaagucaaaggucaagggugaggacuguagcaucagacuccuccugccacuaggaucccacagccagaacucccuggccucauccagggaagugcccaguggcaagucacugcacugagaaagcucgggguuaucauaucaguuauguuucuucauggccucccucaguuccuaugaggcuggccagucagucauaggucauucucucuauaagcccuguugccuggcaacacagcucacaucuauuucuaucagguuuccaggcaaacaggcuaguauacuaagccaagguccuuucauuuguuuucuuuaagaaggaaacacauuuuguucccccuuuccugacauaucccugguacaucuuaaagucaguacccaugagacuucaugguagccaguuccuuucucacugcccagccaccauauguugccugccuuguuaucauggucauucucacaaguuuuugcacagcuucuauccccagcuccagagcaugacaauuggauaacugucagaguuuauacacaguuugccuccaaucucuccuaaacacaucugcuuugcagacccagauaauugcucaucauuguuuguucagccccggagcauccuucuaaugaugguaucuaaccaaccacaggccuggaacuuaaaaggcaaaacagagcaaaaccaccuuuggaucucacuucugagaaauuacauauuaaccccuagaauuaacugaugggucccucuguuuaaugccguggugccguugaggauccugcugaaccucgagcugccccaugcccacagugccuacuuaccaugagcugccugccgcagagaagcaacaauguccuaucccagcuguuucuccagagccagagauauccaucuuaguuggcaauuagacccccaguugccagcucaaacaccaaugauuguacugggcugaguuucaagacccuagcaucacugagggaaacaaaggggaaggcucggaggcgguugcuggggacucagcuuuugcugacacacgagugccuggaggaagug

SEQ ID NO: 1356 - RNA, 183116 nt, Mus musculus
agagggggaggcggugaagacacgacacaaacagcucgcgcccaggacaccgcgguaggcccugagcgcgcgggcgcagggcccggagaggcgcgcgccggcccggccgccggccgcauggagcgcagcgcagcccgcggcucccgggaggcgcaggcggagguagcggcagcgggagcagcgcgcucgcucacacccacccccgcccgcggccggcgcgccgccccgccguagccgccggcguccccgcgggcccggccagcgaaggcggcguccgcgcgucugccagccagcagcggcggccagcccgggaggcggccccgcaagccccgcagccgcgcgucuccgggcccagccgcagcccgcgaggagcccggcgcuccggcccgcaagcccggcgcaggcaugcaggccaggcgccuggccaagcgccccagccugggcagccgccgcgggggcgcugcgcccgcucccgcccccgaggccgccgcucuggggcucccgccccccggccccagcccggccgccgcaccgggaagcuggaggccgccgcugccgccgccgcgcgggaccggccccucgcgcgcugccgccgccucgucgccgguccugcugcugcugggcgaggaggacgaggacgaggagggcgcgggccgaaggcgcaggacgcgcgggcggguaacggagaagccccgaggggucgcggaggaggaggacgacgacgaggaagaggacgaagaggugguugucgaggugguggacggcgacgaggacgacgaggacgcugaggagcgcuucgugccccucggacccggccgugcgcuucccaagggccccgcccgaggcgcggugaaggugcgugcgaggugccggggaucgguggggggcgcagcgggcucggcggggcgccggggcgccggggaggccgagcgcagcggcgcgggccgggaggggugugucaggcggcggugggcagcgcgcggaacugcggcucagcggcucagcggcucagcggcgcccggcggccugucggugcucagaggccgggcggaugcguggucccgcgugccgguaggcaaggaaggagcgcuucucugggcaggguggggaacuugggagcuggacgaggucggagccccgaucggccuggcauugauauuuuauucugcucuggggaggcaggagucuuccuucucuuguucaagcuucuggaaacuagccagcaaccugcaacaccuccuuucaccugagaacaguuguuggucgguuccaucacaggcacuugugaaggaguugggagccugugcagcaacaaccuagaccuugguuuccgcgagcuuuuugccccucccccauccccguguuucuccucgcccuccuuaaacuggacauccuaagcacuuacccuccgcccccuuaagauuacaaaagaggaaggcggggaagguguuuguguuguggggagagagagggguagcauuuaaaaugaaugugacuuucagcugaaaaauuucaccagguccucauccgcgcuaccgcaacgagcgaucuuuccguuuuuuuguaucuucagaagauaaaggguuuauuauuacacaacugucuggcugagcuucuaagcacgcuauuggacaaaacaaacugcguugagguucaugcaccguguauguugcuaagaaguuuugagggcagcgaguggcaagcaauggagaguguuugcuuuuucgccaguguuuuuuuuuuuuuuuuuuuuuucuguuuucuguuuuuucgagacaggguuucucuguguagcccuggcuguccuggaacucacuuuguagcccaggcuggccucgaacucagcaauccgccugccucugccuccugagugcugggauuaaaggcgcaguguuucuuaagauagcaggauaaccagaaauucuuggaguguucagaagaaaauauauguaaacaagugaacuugauagaggugguugauguuguuguuuuuguuuaauaucuccgugcccgcucucaagugucuggaagcuuguaauuauauuuaccaagaaaaguuaaacagcaguuagcguugccccgcaguagaugugggaauguuucuuuccuagaccacccugaaguaugacuggcucucucucggugugagacuugagcaaauggucauuuaggugauuguuuuugacagcugcuuguuggaaucuggacugugcccacacucauuacugcugccugcugaaaagcccgcuuuguguggcaacaggauauagcgggauuugaauuaaguuccauagcaucagugacacugaauaagacagagugcccccugagcaguguuguucauacacacucaaaaugugucuggggugauuauacaaguugagacagaaagauuaauauguuaugcucuguaauccaaguaggcccaguguaggaaagaaaucuguucuuuaaacuaggaauaucuagggugugauuguuagcauuagcagagauuuuucacaucuccaaauaaauucaaauuuuuucaaauuucuaacacauugcuuugcucacaaauuuuauaguacauugcauacaacuucuuagaaguuacaugcugaauauacugugguauaauuuaucuucuuuuuuuucaucaccuuagagauauccugacacuguaucccaagagauuuuuuuuaauggaacauaacaaauaaauuuacauuucuauaugucauguguucgacagauacuuauugagcaccuacuuugugccaggugcuaaucuagaacacaguagggcaugacuuuggaauucuuacacauaauucacugcgucacagcagcugacaaauggauaaaauaagcaugacacaggggccaugauuugugcaucucucaccggccuuccugaguggagccagugaccacaccagaguuguuuaaagcacagagagugaagggcaggcuuuaguggcugguucagcaggucucccuccuuuguccccucuuagcaagaacugaggcucuucugacucaaaaugggaagagucccccagauuaucagugagcagauauccuuucuuuaaaaaaauacuaaaaucacuuugugugugugugugugugugugugugugugugugugugugugugagagagagagagagagagagagagagagagagagcgagcgagcucgagcgcacgcuggagccauggaacacuuagggaagucgaagaacuuuauauagugccuguuguacacucaccuuucugcuuuccagaguucaaacucagguugccaugcuugcaugacaaauguccccacuuucuggaacaucucagcugguccuaucuaugaccugcaggaaaauaccuccaagaauucuguuucuucuuuccugccuuuuccuguguuugucugauguaggagcugucacagaaauugucagggagcuggugugugggacaugugcuauggguguauugccgugagagugucugaguguggagggcagccagguguggagauggcagccaaguccguuugagucugccugcuucuucuguccacugcaucugucuuacagauguaaaucaaguggacuuggugccugaacugaucuugcugaggugcuuggaguaaaggagugggggaugggaaaaagaaaagacaggaccgccuggcaggccuaggguaacaucaggagggaaauagugcuauuuuagauucuagaaagaaaagagaaggcuucuugggagggaccuuugaucuuccagcccaggaucagaaucaggccugggccaguaaaggaaaccaguaaaggcagcccuuaaagguggagucucugggagguuuucaucaggaaagccugccugcuccuuggucuuuuucaaagcccauaccgcgggggagaacagaggccagcagcgggagcugagaaagcagaggggacugcaguagacacaguucucaggggugggagaggugcucagcaggcaauacagaguggagcgccucaggguccgagaugcuggaugacgcaagggaagggagagagagauucagaggagcuacuggcacagaggaugaccuggugugccauuugcugagguuagggagauggccaaguuaagggcucuguuugaacacacuaggaaugaguugacugggccggcaggcuugggguguggaucagaaagggggaacuugaaaaccaccagcaugcugaggucagaggucaugcaguaccaggcucugaggcacaguggguucuaggagaagcugguggagauaguugaagcagcaucaaauauguacagauuguaaaggucagaaaccgagagaagaaauaacuccagcaauugaggaauaaugagcaggacaaggacugcggcuguucauuuaguaagagacauccaugugugcuggacagcaggggacuuagugcuggucuuuuuaacauucauuccuauuuuaaguguaugggugcuuugcuugcaugcauaugugugcaucgugugugcaaugccauggaggccagaaggugucagaccccagaugacugguguuacaggugguugugagcuucuguggcuucugggaauuaaaccaggauuucugaaagagcagccagugcucuuaaccacugagccaucucuccaccucacuccuauuauuauugauagaaguuuguguaguuaguuaaguggacugaacagugacgugaaggugagguuguuagggucuuccauuacagcucuuuuugcuaaguuuuguucaagggucuauuuugucuuuuccagaggagaugaaaugagcuuuggaauaguaaccagcauaugaggccuuuuccaaaagaggucauaccuguuaguuuaguuuucuauuacucuguaacagauuaccccucggagagacagcaaagucuucuaugaguucagaguaggguuuuagccuggacuuuugucuguugcugagacucacaaagccgaggguuagaugggucaauuucucaucuggaguuuggccgagaaagagcucucuccuagguucagaaugcgugggcggaauucagucucccuggauauggaagaccgaggaccucagcuucuugcugacuguaucucaugagugcuccagcauggccucuugcuuuaucaaacaaacaaggagaaucuuggggccaccaguugcguagggcuaucuuccaugggcagaaauggacuccaaugccuuagccauacugucuuggucagaaacaagauuauguguuccacccagucugaaaggcagcaauuguacaaggguggacgugugugaggguaugaggaucaccggguauuccuggguggccugggaaguacgaaaggaacagagagaagaagggguugccgcagacugcaggucccgucgugacugcagcccggguggaagagggcugcucuuugaacucuuuccagugaauuggcuaagguagagaagauggagaaagggaagccagcugagggccauuuucuguacguaugaugucaggugacauagugcaugcccaauauccucucuucucccgugcagcagaagaccaggcguggaugauggcaguuugcaagcgaguugaagaccugcccacaggugugaagugauugauguaugagagagcaggagagccagugugcuagggagacaaaguggaguugccagaccauagagagcccaucugggguuugugguucuguguuuauagagcaagaagccugcucggguaugugguuucccggcuucuugcucuugucuccggcacagaauggaauucauaaaaggaauccuaguuaguacacauggacugauucccauggccagugcaauugcaaggugcacaccuguuuuaaccuuuccacggcccccauagcuaacugugacauguaugucagauguugcccuuaguuuuauagaagggauaaacaguuagcuuuuaggacaaacagaucauucagcggcagaccagggacuggaguucuggccugugucccugcggagcucugccuguggggaagcaggauuaagcaggguuggauuucuguguggaaaggagagggacugguucuagcuggugcugucuggacucuggcugccaggagggaccaggagacccagaauaauaagggcgggagagggugggggagaaguagugaaaaaguuguggaggaaagaacuauaaacaaucuauaaagccaugacaauuggauuccaacauugaguguucacugcauucauuugaaacaggaguucuaaauauuucaucugaaggaggacuuucugagaauguaaggcuugaauuagugggggccccaucuccaucuguggaggagaucagcuuaggcacuguccuaccaggcaagugaaccggaagcuuggggaccccgagucccuagacgggaaguaaagccacaccuucaccagcaaugcaggcagcagcaggaccccuaccugcacugcgcugcacguauaccugacuucugauuggaagaaacggacuaggucucgcucucuuuagcaaguccuugguaauuccccuuucgggcuuaguuuccaggcaaacauguccuaguauauguacggacguucugggcauagggcccaguccaguuugaaccagucggacuacauguacagcaaggcaaacuauaucccccaaguuaacuuuucggggggauccccuguuuuuuccaccuuauaaugauuaaaagcagaugcauugugggaaaggauauacacacuaaagaaacacuuaguaucucaagccuguuaaucaaagcagaaaaucacuacacuccuccccuuagcaaccuagaacccauaaacacuuaguaucucaagccugucauucaaaacagaaaaucacuauacuccuccccuuagcaaccuagaacccauaaaaggaagcccagacaauaccugcucucuuggccacugugcugaacgagcuccugacuccucguaguggacuucucuguacauucucuggaguaaaacacccugggagagugagagggcccagugcgagaaagcccaaaggcccgagugugauacucaggaucaggguuuuaaaaaagaaacaagguggaugugacaugcuuauuacuugacagaaggcaaagacucuccuaucagccaguaggccagcuagcccggaucuccuaucagccaauaggccagcuagcccagaucuccuauaggccggcuagcccagaucuccuauaggccagcuagcccaggucuccuaucagccagcuagcccagaucuccuauaggccagcuagcccagaucuccuauaggccagcuagcccagaucuccuauaggccagcuagcccagaucuccuauaggccagcuaguccagaucuccuauaggccagcuagcccaggucuccuauaggccagcuagcccaggucuccuauaggccagcuaguccagaucuccuauaggccagcuagcccaggucuccuauaggccagcuagcccaggucuccuauaggccagcuaguccaggucuccuauaggccagcuagcccaggucuccuauaggccagcuagcccaggucuccuauaggccagcuagcccaggucuccuaucggccagcuagcccaggucuccuaucggccagcuagcccaggucuccuauaggccagcuagcccaggucuccuauaggccagcuagcccagaucuccuauaggccagcuaguccaggucuccuauaggccagcuagcccaggucuccuauaggccagcuagcccagaucuccuauaggucagcuagcccagaucuccuauaggccagcuagcccagaucuccuauaggccagcuagcccagaucuccuauaggccagcuagcccagaguacacagcauggcgcagacaagaaaccugccacaacaaagugaagaggaccaauaccccaaaguucaucucugacguccacagggacgcacaguaacauguaccuaugcgugugcacgugcacacaaacacacacacaccaacaccaccacuacacaucauaauacuuuuuaaauaaaugaaguaagacuucuugcuacuuuacuaccuaugugcauuuuuuccagcuauuugaauaugaugcuaagaaccuagauauagcagguccagucagaccacagggaacaggugugauuaaaagccugggcuauagccgggcagugguggcucacgccuuuaaucccaguacgugggaggcagagacaggcagauuucugaguucaaggccagccuggucuacagagugaguugccggacagccagggcuacccagagaaacccuaucucaaaacaaaacaaaacaaaacaaacaaaaacccaaaaccaaccaaccaaacaaacaaaaaacgaaaacaacccccccccccccaagccugggcuaagggugcaaagcccugccugcuccuguguuugcaaccauucugggcccccugcccagaacguccguacauauacuaggacauguuugccuggaaacuaagcccgaaaggggaauuaccaaggacuugcuaaagagagcgagaccuaguccguuucuuccaaucagaagucagguauacgugcagcgcagugcagguagggguccugcugcugccugcauugcuggugaagguguggcuuuacuucccgucuagggacucggggucccaagcuuccgguucacuuggcuguuccaguugaaaccuccuaaugugcaccuggacacuacaaggauauuuugugccggauuguugagaaggcagagaaacuggugcuacuguguuguaguccucuagugcuuuagugccccucccccaguucaguccuaaauugaaagaagagaaacuuuguauguauuacacaguguuuucaauuucccauuggucagaugcccuuguauauauggaacccuagcagugcuccugagagucugaaaaacuacuaagugacacagugagcaagucuucaacuaguguuuuacuaacaagcaguaaaagggcagugccaaacagagaaggcuuuacuaauaucuccauuuuuagcaaagacagaacagcugggagcuuagguaacaaggcccaggguggugcuuucuuuuuaaugcuguguagaaguuuaaccaagcagaaccuagcaaccuagaaagauugacaauccacugauuuaauacauucaagaggagccuggacacacaagauggcugcaaguccaccaagacuuucuguauugaauaacuggggcgagacccgcuuucaaaugagguaauguguaccagcauugcuguucucaguggccguggugugacuggcugugguguguggcugugcgccagcucuccaggggugguuagcucaucuugcagcuuaucucuugaccuucaggugaugcaaagggccuuuggcagggaucaugugucccaccuuacugccuucucguuuucuagcaacugcaugcuuugcaaauuguguuggcucacgcagaaagugugugcuaaagauacuacacaaaguugucauucacagacuuguagauggcugggguuggaaggacauggagauuaucuaguaaucuaacucccugucuugucucuggaggauacagaucuugcaagaagaaauagcuguccaacucuggcuucugcugcagucccucgggcugcccagcccugcccauuacccuccuucugggauuguuucuuaugcccaggaaugagguucacaccgcucuguuggaauuguggcuagaaaugucaguuuuccaaaguguauccaaaguaucuaacaacaucagacuuugaaaagguccgucuucugugcugcugcaggcggggccgccugguucuccauugguaugaaaggaggaguucuuugugaauccugcccgggccuguccuuguccccuuaggagaaugaugacaaacagaaaaugcacugugacuuuguacaguguaugcauggguaugugggugcaguguguuuccgguaaguacuuacuagccaugaacucaggucucuccuuuguuaacacuugaccaugguugcagagaauggcccacagcucaaguauuaacaaaaaaggggaagcaacacaacccaggaucuccugaacccacucaccuuuuaauggggagggagugagacacagccacugcacgugccugaacuuuuacccagcucagucagaugagcaugcgcccugggcucugaaggucacgagcagagcaggucucccugcccugcugcucguggaacauagaacuucaacucuguaugggacagucuugacccagugacgcaguacuguuugccuaauuuggaucuucagcugccucuugcagccucuucuugagacaugguuucugucuggcuuucugaagaauuucacaguacuugaaaccucucacaaccagccuuauuauggcuuagccaaaucugguugucaaucaggaugauugcugugccucugcuguugaugguugugcucguucucuaguuaggagaugcuugguguacacauggaaagaacagggcaucggccaccuuuacucccagggcgccugcagugcaacacaccgaccagaugacgugcagggaggcgugaagcccucugcucuuuuucuuuucuuuucuuucuuuuuuuuuuucuucuuuuucuuucuaauaagaucaugacuaguucuuccaagccaacuuacugagucacaacuuggcauguaauuuugauauauaccuuaaaacaauggcaaccaaacaauuuauguaaagaaaauuauauggucuggccaggagguaauuccuggacugaauuuggcaaguagccucaguugcucuuuaguggguaagaaggaacagaauauaacuuugaguaugggguaguacaguuagaaugauucacuauuuccacuucaccgaagguaauguuuuggaaaaccauguuagaauuugaucguagaagaugcauuuaugugugugugcguauucauguauaugcacaugcauguguguucuguguauggaggcuaauggucagguuagguguauuauucauuaugaaaucaauuaacuuuuaaaaacgaacuuauuuauuguguuuuuuuuuaaauuguguauauuuugggggagugcauguaugucuguguaccacauacaggggucuucgauccccuccaggacuggagugacaagccauuaugagcugccuucuggguccugggaaacaaacccagguugguucucggcaagagcaacagccagugcuaccuagcuccaaucccagcacuuucuuuuuuugaaacuauguacguuacuaaacauugagucagcuaaacugacuggcuggugagcccuagagauccugucucugccuccucagccccgagguuacacguauguacugucauguaggugcagcagaccugaguccaugagugugaagaaggggccuucugugcuugcccugugaggacuugguuccgugcgcuuuauugaccaggagacuucugggauguuccugcuucccuauggucuuggacagcacuggcuccauuuuaggagacugaguagccagucaaaauuaugcgaaugccagacuugacagcauuuuaagcuuauucacccuuccuuccuuccuccccuccucccucucucucucucucucucucucucuuucuacagauuguauaugguaacauuuuaucugcuaaaucuugcaguuaggguaacugcaucaguggcaccuucauuguccuuuucuuagacccucaggagcaggcuugaggccaugcagcgcacccugcacuacccccacuuugugguguugcagcgcacccugcaguacccccacugugugguguugcagucuucuguagacagcuagugaugucacuuccucuucuaguuguuauggcugagagucucuggaccucacugucuguucuuucucuguaaaucuggacacagugcaggacagacucuggcuucaagucuugccuuugcuacaugcuggggugugaccuugcccagugacauuacugcuccgugcuugagugcuaugguugaacauuuggggcaauguuaacguuguuaugggauguggcucaugagaccuccccaaagugggugugaauggaaguguuauuucuuucaugguguugcaaaggaucaauuugcaagcuguuuuuagagucccaaguccugcuccucuguacugugcuccucaagguggugaagcuacuuacccaccugagcaggguguggcaucugagcaggguguggcagugggcuugacuuucccuuccagcccagaaagcagccagccauuuaucuauggaucucuugucugucuaaauguauagcucuuaaaaaaaaaaagauuuauuuauuuauuuauuuauuuauguauaugaguacacuguagcuguacaggugguugugagccacuaugugguugcugggaauugaacucaggacuuucacucacucaggcccugcuugcuccgguccaaagauuuauuauguguaaguucacuguaccugucuucagacacaccagaagagggagucagaucucauuacagaugcuugugagccacaaugugguugcugggauuugaacucaggaccuuuggaagagcagucggugcucuuaaccauugagcuaucuuuccagccccaacgucuaggucuuguacugcagcuacccagcaggguggggauccccucuaucacuguguguucuugcagccuucuguagacgucagcaaugucacuuucucuucuaguugucauggcugagagucucuggacugugggcuugcccuuccuagguuucuguguuggugucuugggcuugguaaagguaaaauucuguguucauggagaagacagggaaaauuagccuaaaguuuacugguccugucucuuuuuuucucuuuugugggagcugcucgcagggaagaaaggacuaugagugaaucauuucuagaaaaucuaguaaaaaacagauaauagauuucuuuuccaguuacaaaauacuucaaaaauaauagugaauuagaagggcaauugaaaacugauauguaaacaccaaugugccuauaaaggagaaacugaacauguacagggcccuuuucaguuucugagguacauacaaggugggucauuuuuauauuacacauuuucuuuagacugcuugcuccuuccauucccagagcacuuuuccuuugaauggguuuugggaaauaacugauuuauaauuucccuuuucaauuggaaagccagaaguaagugcuuauuggcuuuagauaaagagcuaaacaccugggccagggagaugguucagcagguaaaaagggaugcuguguuaagucugaugcucagaguccaacucccagagcccacguuaaaaacaaaagucaguguguuggugcgcaucugugauccagcucucuaugacaagguaagagguagacacagaaaaaucacucggaagcuuauggagcagcuaaccugggguacacacagugcaguggcagacgcaagagagacccugcuguaaaacaaaccggaaggggagaaugacuuccagaaauuguucucugaccuccacacauuugccaugguguaugccucgucacgcagcacucaugcuuuaugauacacuaaacuuaaaguuucuugcugugagacgagcucucacuauagaaaccuggcaguccuggaacucacuguguagaccacacuuggcuuucaacucacagacaucugacugccucuaccuccccagggcugagauuaaagacaauguaccaccacacccugcaauuguguguguguguguguguguguguguguguguguguauaccacaugaaugaggguaccugcaaaggccacaaaaggaugucagauccccugaaacuggagucaccaguauuuguaaguauccugaccuggguuuuggaaacugaacucaaguccucugcaagagcagugcgugcuucuaacuaaugaauucuuucucugguccguuuuaaaaagaggaugaaaacuauuaucaucaucauuauuuagaggcaaggucucggucucauauauagcccuagcuagcuagaaacucauagagauccgccugccugugccuccugaauggugggauuuaagguauguacuccugcaaccugcuuaaacuguguuauuaggaaaauaaauugugaucaggcaugguggcacaucuguauaccuaccuacccaggaagacugggggaggaggcucccgugagccuuggcaaauauauuaagaucccccucacacauacuuaacaagcacaaagaaaucauuuguucuuagugggccugacagcugauucaguagagaguuucugucuuagucaggguuucuauuccugcacaaacaugaccaagaagcaaauuggggaggaaaggguuuauucagcuuacacuuccaucaccaaagaagucaggacuggaauucaagcaggucagggagcaggagcugaugcagaggccauggagggauguuccuuacuggcuugcuuccccuggcuugcucagccugcucucuuauagaacccaagacuaccagcccagagauggucccacccacaaggggccuuucccccuugaucacuaauugagaaaaugccuuacagcuggaucucauggaggcauuuccccaacugaagcuccuuucucugugauaacuccagcugugucaaguugacacaaaacuagccaguacaguuucuaagggaauuucuucaucugguacuuuuugacuuuuauaacuauaaccuccauccucauaacuuucuuggccagauggguucaaagauggaucuaggauuugagacagggagguuugaaaaguacaguuguaaggggaucuaaaauauggagagcaaaaccacagccauuuauaucuagcaagguauaauuauuaguuuguguucauaucaccaaagaaaaugauugaaauuccagggcagcauaaaugaagggacuucugcucacugagaugccgauugacgccacucugucagcacugagcgcugagcacccuggguacagacuccuuuccgcucucugauacucaauaguuacagcuccucguggcuagccucaguugacccuuuugauaaaugcagagcuugauaacauuuuucuuguuuuaugaauguggaaaacaagagaaauggcagcuucuguggaaagaaauacauaugagguaacuucauaucaaaugacacagauauuugucaaacauuucagaaaacaguugggaccaacagauuuaaaaaauaauuggaaucgguaccuaagcaacaauggaaauuuaaggagagaggagacuguuuuggaucgacuuacagauuaaaacaaugugagcugccuuguucguaaguugucagacgucauguagcaggugcugugcaaggcagcuccgagucacuuccugaacacucaguugcccgugcucuauuaauuugggucgagauccaaaguguaauuaagaacauguucuucaaaugcauguuuuggauagguuuuucaauuaguagauuaauguucuuccaacucagagaaaaucuaacaaaauauuagaaaacuaauaaaaaaugugaaugacagucuuaaaacuuaaaagacaguguggauugugucuauuagaaaagaaagcagucuuguuuuccauauagugcgugucccugucaggggcacaggggcagcuauguugguaggugcuugcuaugcaggugugaugacuauccauccgcagagcugcuggugcuuaugugggaaucagagacaggcggauccgaggcuggcgcucagcugccuuugccugaccugugaguaccagguccugguaaagagaccccacugugccaaaagugaggggcuggagaagugaggugguugcucacugaaugagagcaccugcaguucugcuagaaaacccaagugcaauccagccuuccacaugguuuuuuuuuuuuuuuaaaacaggacuuagauuuaaaacuguguuugcagguuccugaggaggccugaagagggcaccagauucaccuagaguuguccaguauaggugcugucaacugaauuugaguccucugcaguagaagcaagucuucuacuucugagccaucucucccgcacaaagaugacuucuguuuuaauuacauggacacauacauggcuauguaacucacuuucgugcuggugccuaugaaggggacaguggguccucuggagugggaauaccggggaccuaagagaacuguggguccucuggagugggaguaccagggacuuaagagaacaguggguccucuggagugggaguaccagggacuuaagagaacaguggguccucuggagugggaguaccggggaccuaagagaacuguggguccucuggagugggaguaccggggacuuaaguccuguaaagcagcagugcuucuuguuguuuugagacaucugcccuggcacucccagagauccaccugucucugccucccaugugcugguauuaaaggcaucgcaucaccuugccuggccuagcaguaagcacuuuaacugcugagcuguucguccagcccuuacauuuuuugagaugaaguggcucacugggaacugggaccugcagguuagguuaggcaagcuggccuugaguccuuggauccuccugucuucccagcauugggauugaugaaugccaccuugacucacuguuuacgugggugcuagggauagaucaaacucagguucuuaaacucaauagucagaccugcaccaacugagccauguccucagcccucagcugucaugaggauauaguccuggccucuuaauccgagguugcagcucugaagugugucacucacugcgcagaaaccaguacccaucugcagucacacgcaggguucccuguagccaccaucuagugauuccuuuuguuuucagugccacuaagucuuuauuuguucauugugauuucuuccggagaaagauggagcgaggaggagaguuaggguguuagaaagcuuuagggaccaaggggaaagaagccuggguaacaaagcaaaccguucaguaagugugcucaagaguuacguucaccgugacucaagggggugaguguugaggaccugagagaaggguccccauuuuucuucucaacucaacucuuccuuguaaauuccagaccaaguuuugguguugagugguaacuguagaggugacuuacaucaaagcugcauugcuuucugauauuacugucuagcuuuaggcuggccucaaacccucacugccugccuuagucaccagagugcugggauggcuuguaagcaccaugaugccugccuggcuuguuggauaaucuuguggccauggggauaugaauuucuucuguguggaucagguuuccauguggacgaccgauccauucacucuucauuuuccauccuggaggauuugggguaaugagaucuaacggacuaaugccauggagacagucaagaauugacuuuccccagagggcaauggauugggaacaagagaagagaauucuaacuuccugucggguuuuacagaagaacuuugggcuguagauauauaugcaggaguuacauauauaugcguaccuuguugcuguuuuggcuaaaggagaggcaggagcuuugugagggguggggacaguccuucccuggugaagagugcaccagccuuauuucaggugcuuugccauacauaggauuuccugacaaaauugguuuuuuuuuguuuuguuuuuuuuuuuaaauuggggcuggagaaaaggcgcaguggcugaggagcacuggagggagcacuggcugcucuggcagaggagccucagcguccacgaaguggcucacaacugucuguagcucugacucgggggagcuagugcauaguuacaugugggcaaaacauuccuauacacaauaaaaauaaacacaucuuuuaaaaugcucuuuaguucacugcaagaagagguuuguaaaaccaaagcaaacgcccuaaaacaugaaaaagagcacugucacuaugguacacugacaccaacuugacugcauaguggucaccacaucccuuugugauguaaaaggcucaguuuaggcaaaucacaaaacuacaguacaaaaggcaaagucuggggaggacugaggcaaggucugggaggacugaacaaugggauuaguacgcagccgugagugcauuugguaaaugcuuguccuauuucagcauuuggauguggucaacaaggcaugugugcacugaucaaacauagucaccucuuuacuagccacccagaaaggggcccuggcaucccaagaaaauugucauuuacacuuuaagccacaugaaacuuaaaauuagguuuugcuugcaaaaagaaaguccuaagcagcaugggcauaaggaaauuccauucugagccgggcgugguggugcacgccuuuaauuccagcaucccagcacuugggaggcagaggcaggaggauuucugaauuccaggccagccuggucuacagagugaguucuaggacagccagggcuauacagagaaacccugucucgaaacaccccccuccccccgcaaaaaagaaaauuucauucuuagacacuugcuuuacccaugguuccuugagauuuuuauaugaacaaguuuauaugcauguaugugcauaugcuagacuuagugugacagugucccacaauugaacuguuuaguaaggaauccuuaccaucaucuuuuaaaaacauugauugauugauuggugaguguaggcuauugaaaggcuugcaaguaaaggucagaggacagccuccaagagccaagaggauaaaaacacuaaagauagcagugaguaaaaucaagcuguguaaaacauugcgcuauuuuaugacuggcuucuuuuuuuucuccuuuaggaguguaaaguuaguuaaauauuuaaaagucagucagugaaauuuacaauauuagcagauugaaagggaguauaagcauucauccaugcuauacaaaauacuuggcaaaugguagaaguucucuaagcugaaacauguauuagaaaccuguagcugccauaauacaugugacaaaacaccauucaguaaaugucaagaguaacuuaaagaugucuuauguaacccauucagcuaacauugucauggaggucuugagccaucgugauugauaagaaggaagaaaagaaaaagcaugaagauuggagaagaugaaaacuuuguuugcuugugguauaugcacagaaaauccuaaggaaguagcagaaacuguuaaaaugagauuuaaaaaaaaagcuacacugacaauugauacuaacaacuucuuaaaaaaaaaaacaaccuauggaaacccaccaccguaguagcuucuuaaaauacacacguauagaaaguuuaaguggaguucuacuguaacagugccaggaauggguucccucuuuuugaauguuaccaugguuccuggauacccuccagaauugacaguaagcaucuauuagugaagacagagcacacuucgucauaaauauggagacaucgagcagguccugaccugggaggcucuucccugcugccuagcucucacuguguuugaugugcauauuacccuggaggacaaauguuaucaggcucaggcucacccaaccaugaacccuaaaagcuacacugaugacugaccuggccggacacauccacaggugcaauauggcaugaccauugugggcaguaacuaaccacuuuauuacuggagguacagccaacaccacagauggaacuuauaccuggcacugcuagagaccaagaacuaguuagagcauggcuagauacagcacaggcccugagggagugcaggaguguuuugcuaaauguacaaaguauuaaaauaacuccugaugacuuaacugcuauacccaaagaugaguacauuuuucagugcucaucaaggcugcuuuaugcaauagauagcagauaacacagaggccugacacuggucagcgugcagagaacucacacccuucuccucaagucuuagggauauuuagaggagggaaaagagauuguaagaguaacagugcugggugacacaccaggaaacagugcuuuggauagacagcagauguauguacaaacccacagugauugacagcaauacacacaaccuggguaagcucaagccaaauaaaguccagcaaacagcggcugggccucugucccaccccuagcugaggaacucuuggcauuugguugccucugggagagggagggucuuucuuuaauggcauaauccuucgcaugucaaccgcauuucaccacuccaggcccuacuccugagaguaauuggaugauacaaacuagaccugaccuggguuggggaagaaaagaguaaacgucaggucggguggguaaggauggcgggggaggagcugagggugaauaugauaaaaauguaugauagccacaaaaauucauaaaacguuuagaaaauuuacacucaugaauuuaauaaaguccuuuaaaauguuuuauauugcuggaccuucuuuacccacuaggugccuaaguaaugacacggagacauuuuauuaauuaugaaagcuuggucuuagcugguuuguucccuacuaguuuguauaaucuaaauuauacucauuuacguucagcuguguguccccuuuccaugucucaugccaugccuuuauagauuuucccguugauaucuuucaggauaacuuuuucccuucguugugugugcagucaugucugacaccuaugacaccuuuccuggugacucccaggccauccccucaugcuguugacacugacugguuccugcccagcagauguccuugcauagagaggauccucacagaggugggaggggcagcguguccucgugcauugauugccauuuauuaccaaguccugcuuuucuccagugcuuuccuuccuuagcauuuauucuuaauuccagcgguuuccucggugccucccuccccacaguccucuccuuauuuaaggcuguucugcagcacugcuaaaaucaucugggcuuuauguaacuuuuucuuauuauagaagcaguauuuguagcacacuccaagguccugguaagaguaaaggagcuaagaauaauaauaagggauuucgcuccucuuccaguccugcucugucuuccggagcagugacuucacagggagaucacuucuuugcuagccacuacucugugacucaucuuauagcaaagaaggcgagcuaacaguagugcuugagcaaccaaaacagaagucaaagccuggcacuugccuaauucaaaucagggugcuuuuguuuguugcuacguuaugcaaaacuauaaaaaucuauaaaaaagugcacacuauacaguuguacucguauuucuuggcuuguaggaauuuguauuuauuucuguugcugugaugaagugaucugacaaagaacauaaagggggaaagggcuuuugguuuacaguucuauaaggauggagugcaucaugguugaaaagacaugccagcaagguagggaggcaugguggcaggaguuggucagguugcgucugcauuccucgaguacagagaccaguagucaggccuggcuguacuucagagcccaaccacucucaccucuucuagcaaggcuccaccucccagaaauucaugguuuuuccaaacaucaccuccauguguggaccaagcauucagacgcaugagccuacagacaauaguucauauucaaaccacauaguagaucucagccuauuagaaacaccagugcauucuccuggucucuuacugggaacucacuucuagcauauaauguaugcuuuuuggcccauaacacaugcaaaguuggacauuuucagggaggaaacuagaguucuuuacuuaggaucagcauccuaagaguaacaagcaugaaauggguguugauggaaacugugcaacacacacacacacacacacacacacacacagguccauuuuauguagcuugcuacuucgaggguuggagugagacaggucucauguagccauguuggcccuaaacuugcuguguggcaagacugacuugaaccucauccuuugucuccugagugcugggaugagaggagguuaugugcuaugcuaccauaucuggcuauggcauuauuaaagacuuauuucuauuuuuauuuacuugagcaucauugacauggucuucuaacagcagccuuaaauguacgcugggcauauaaucuggaguacucuuuucaggggauagaugcugcuggugaugggcccugcuuuccauucucaauguugcugucucuguacgauuucugucagugacucugcaaaguuaagucucacugcuguguggcugcugacacguaagauccugaaugagcucagcuguccuuagguguuucucuugaaagggaagaggggucuguuuuagggugacuaugggggaggaggaacuggucuagcuuuuguuguuggccuacaagcaugagucacagcugccaucuuugugaacucuuaugaaaugugugcauguugugcaaaugcucugccaucagauuagacuccgcuccuuuuaauucuguauuuugaaacaggaccucacuagguuuccugcguuggcauugagcuugucuuccuuuaccacggccuccugagcugugggguuauaggugugcaccgccgugccuggcuacguguaacauuccccucgggcagcauagcuucuuugacuucugaggcucauuuguuuauuacuaugauauggguaugucgcagucugugccaccaucccauaaaggacaucuggagugcuuccuguuugaucuuauaaagaacugcccugggcauucauguucugugugaauuuaaguuuucauuucugucaagcaauauccaugacugauuguuaggcuuuaugguaaguguaagugauguggugguuugaauguaguuggcccagggaguggcacuguuaggagguguggccuuguuggaauaggcuuagccuucuuggaggaagugugucauugugggggugggcagugagauuuccuccucaccaugugggagccaguucucuccuagcagccuucagaugaagauguagaacucuuagcuccucuugcaccaugccugccucaacauugccaugcuccggccucgaugauaaaggacugaaccucugaaccuguaagccagccccaauuaaguguugaccuuuuaagaguugcuuuggucauggugucugcucacagcaguaaaacucugacuaagacagcagguuuacauuuuguaagaaauugccacaguugguaacaugguagcuauacauuucaucuucauaccagcugugugucuuggguuaauuuuuauaaaacgugugaggguuauguuccugucuguugaugauuaguaagcagugccacuuggugaacugauguuuuacuaucgaugaauccccuuccuaccuuugacagagcucaguuggcuauugcuguguggcuuuguucuggaucuucuuccauugaccgauucggcccaggcuuugguaugcucgcuuuguaguaaaccuccuguaggguggagugacucugauagcuuuauugucucaguuauuuugcucuuauaccucuccauauacauuuuagaauaagcuauuaaagugcuacagaaauccuuuuauugcuuuguucucggagacaggguuucucuguguagcccugaguguccuggagcucucucucuguacaacaggcuggccucagacucacagagauccaccugcuauauuuuuaaucaaccuauuuuucaauuuuuuuauuagauauuuucuucauuuauauuucaaaugcuaucccgaaaguccccuauacccucucccugcccugcuccccuacccacccacucccacuucuuggcccuggcguuccccuguacuggggcauauaaaguuugcaagaccaaggggccucucuucccagugauggccaacuaggucaucuucugcuacauaugcaguuagagacacuagcucugggguggggguacugguuaguucauauuguuguuucaccuauaggguugcagaccccuucagcuccuuggguacuuucucuagcuccuccauugggggcccuguguuucauccaauagcugacugugagcauccacuucuguauuugccagacacuggcauagccucacaagagacagcuauaucaggguccuuucagcaaaaucuugcugacauaugcaauagugucuguguuuggugacugauuaugggauggauccccagguggggcagucucugcaugguccauagcuccaaacuuugucucuguaacuccuuccauggguauuuugaucucuauucucaaccuauauuuuuaauaccugcucaagaacugaauaaccacuccaggaaacugccugggagaugcaaugcaaaucagcugcugcagaugguggaggggcuggggaugcagcucagcugacagaaugcuucccugacacaagaccucagggccgauuucuccccacaccaguuggacauggcggccacaccuaucaccccagcacuucagguagaggcaggagaaucacaauugaucauccccgacuucuuaagacaauuggagagcagugacuagccuguguagaaauucuucuuaaaacaaaauaaacccagagccacuggaagcaagcaucuggagucagugguauuugaguggucaguauggccuggacuaccuggacagagaugcagauaguugcaaaaggagaaggcucacauggccccacguggccgaugagcaacagucccuggaaagaaacaagguauugugcucagguguguggcucggcaugaaugaaguucuggcuuugacacacuauauccguaacuacaugguccaucauucaaaaacuugaacaauauacguggcacucaguaauaucaugacuaagaaguauuuuauuuaguaagucuuguuugaaacuuauaaaguucaauagugauauagcagauauuuggggcauaccgcuucuuguagcauuuguacuggccagugccgcaugcuuuccugacuccuggagguuagugaacacaguugcuuagagcacccaauuucaccaugcuuuaaugucauucugagccauucgcaccugaauaaacuacuccacagaacuucgauucuguuuuuccuuugcuuucuugguuucuaaguuuuuccuuuuggaauuuuaacauuccuagcaagucuuucuucaugguucuguggauugcuagcuccacuuuacuuaugcuggguucuucaugaguucugcagcgcuuccagagccuuggugguaacugugugugguauuccuacccuuagagggggaugcacugugccugcccuccucuuuaugggcuccaagccaggcaaauagagggagaggggagaggagagcagagagcaggccagagcaucaccccucagcuggaugcuggagcucccuaagcugcugagacuuagcagcaaggucagcuucugcccugagaaaauccaagugugaacacaggaaguggucugcauagagcuggccuuagcagagccccaccaaucacccagugcauucaugaaccacuauagaggcagagucuguccaggaguggagugagggaauguggccuagauucugcagccuuuggaauaccuguuucucugugucuuagugaugguucuauaggaaaggcuaacaguuguagaagggaacagaaauaauaaaagcagaauagaauagguccucuauaaugugcucagggcuuuucauaguaaacauaccaaacccugaagacuuguguguggugugugugugguguaguauaugugcauuuguauguaugcucucaucacauguacucacagggcauccugcuaaaucacgucuuaccuugacacaggccucacugaaucuggaggaagguugcuggccagugagccugcaggguccuccugccuugggucucccaccacugggguugcaaguugucuuaguugggguuacuguugcuguaacaccauguaacauguaacaccaugaccaaaaguagcuuuggggaagaaagcucacucacaauuccauguaacagcuuauuauuaaaagcagagagagaaggaacugaagcagggcaggagccuguagacagaagcugaggccauggagggggcugcuuacuggcuugcuucccauggcuugcucagucugcuuuaucucaagcccaccagcccagggauggucccacccacaaugggcugggcccuaauuaaucucuaauuuuaaaaagugcccuaccagcucuucuacaguacaggguuuggaggcauuuuccuaaucgagacucccuccucuccagugaccucagcuucaaguuggcacaaagcuauucagcacacaggugcaagcccaguccuaucgggcuuuuuguaugggcacuacagguuugaaaccagucuuucugcuuguuuauaaagcaccgugcucuuagccgucaucucagcuguuuuacacuuuccaguuuuauuccaauugauugucugcgugugcacauuuaauagcagauuguguauguauacaugcacauacuuguguacauguguguaugcuuguguauggaggccagaagucaaccucugaugucauuccugcccacuuuguuguuguaacaagcacaccuggcuuuuuacauguaugcuugggauggagaucaagucuucaugccuguguggcaaguacgucacugaccaagcugaaucgccagcucuccauagcaaaccuuuaaaacguaaaaucuccaaaaugagauauaauggcuaauuuuauuugaaaaacguguuggcucuugccuuaggguuuucaauaacgguuguauccugauacaacaguaaauucauuacuaucucugcuggaaagggcuauggguaaauauuuauaacgcugacaaguuuguauguugaaauggggggguggggaguaggacuuuuaaccaacacagaggggagucuggcagggggagaggagagaaagggcgaagaagagagagagagggagaaagggugagcaaaaacaauuucucugagauugaaacauucuauccuauagggaagcuccuucagcagguagauaaagaacuccaaauaguuucaggaaguuccugaaacugaccauuuucacuagacccuuccugccagagugagcaaucaaagcugaguccuucucauaaaagccaagcugcacagaagacuccgggaagccagcugagcuuccugcaggagguuagaccagacuuauuugggaaggacaguucaguguguugagcugcuugcaggcuguguggugugcuccagguucccagcauugagagcuggagugggcuuucagugagcagcugucugugaguuacugcugcuccuguauguaaccccaguaacgcucauugauucaccuagggcuuuggugguaugcauacuuggucugucacgggcugccuaucuggaauggguagaugugugguguuguaucuccccaggaaaaguuuuguuacacuguuacacaacaacaaccauuauacucuauugccgacaauacccacugaaaauacuuauugaauggauaacuuuucaagugaacacuuuuuucaaaggcuuauaaaaaaaucuuuauucuuauuaucucucggaaaaggaaacugguguguguguggguuggaauaaauauucaagcuuuagaacuuuuaccuucuuugaaaucuucuuuauaauuucauugauggagaauccauugaaaaugaucuuuaaauaagaaaauugagggccuggagagauggcucaccagguaagagcacugacugcucuuccaaagguccugaguucaaaucccagcaaccacaugguggcucacaaccuucuguagugagauaugacccccucuucugggguguacacagcuacagugcacuuagauauaguaauaaauaaaaucuuuuuaaaaacaaaagaaaauugagaguuguuuuaggugugaaugaauguauuacugggaagucauguguugcacaaagacgcagaagguguuuaugcagagucugucacuugucuguugaccuggaagaauggacaugcuuccggcuguaaauaacuuaguugccuuugaagccagacaguaaaguguagcguaugcauaguuuacuucuucuaguagaauaucuuucagacagcuaaugcauuuguaaaaggcuucaacuuguuuuaaaccaguuucauggccuuuaacauaaauaaacacauuaaucauuugcucuguagaggauaugugauacauauuaggcaggcagccaagugucauugaaaugcuugcacuaucaagaguccuguguuucugcuuuugaguagagugcugcuguagaaagucuguacaguuacccaagaacucccauuuccagcaacuucggaaggaaccggagcccuccuggacucuuagugcuuucugcgcuacuuagagauugccacagauggaucgcgugcagugaaaugaaauguauuucuuuuaucucugagaagcacaugucugagggacacauguggcgagagccucuugcugugucauaguguggguggcagugacaaaaccaaccaguuccagagagaggggcuuuccucacccacaauccggucauucacuacacaguaccgucacagggaccaucaaguuagaggaacauucaaccauagccugaugcuauguuuuuaaaaacuacaugucgagucacaugauaggucaaacauacgagcaguaccugggaaaucaacucugcauugucuguggaugcacgggggaagguguauuucugaggcucuggcauccaaaggucuuuguuuuuuuguuuuuuuguuuuuuguuuuuguuuuguuuuguuuuucaagacaggguuucucuguauagcccuggcuguccuggaacucacuuuguagaccaggcuggccagaauccacgcccggcaggucuuugguucuugaguugagaugaaagcaggacuucacccgugcaaacggaaacacugcuuucgagcugguuguuuguccucucuggagaacaccgacaugugggcccagggauuugaugguggugauaaacauaggggcaggggaacaagcuuucuccugguucugcucagauccguucccacuguagagccugguuccugaguguagcuagaacucgggcagucgcuagaacucgggcagucgggggaugaaugguggccgagaccccuguggccucuguuggguuuccucuaggcaaaagcguuuaugacagugaggugaguucuuuucucucaucugugugaguucucauucaucuuccucucucuccccuacaagccaaaugcuacucuucuuucguuuuguuuugguuuuguuuguuuuauuuuguuuuuuuuuuuguuuguuuguuuuguuuuuuguuuuuuguuuuuuuuuuccagacaggaucucacucuguagcuuuggcuuuuauuacuguuucugcccagucagggcucauucccagguucucggaggccuuaccuaccguuagcuacuacugaugguguacacuguguaugucuucuaagcugagcccuugcucugugugagauucuugugaccuuugagccugugugaaauuguacccucccuucuucacuaguccucauugucacagagucauucuugguaauuuauugaguguuccugcuuacugagugccauuccguccuuuagcuuauuuaccaugccuguggaguccagagauaauaaaacaacagaggaacccuuccagguccagccaggauuugacuccagcccuuauaugcagcaaauagacuccuuucccugagauauuuauugcuuagccaggcugcuggguuaaugguauaauaccaccacugaaguuucuggagucauccuagaccaugggguauauaguucuccuuaggcucuuuccauuaccuuacauucuuaucaggggucucaugccacaacuuaaauuguguguuuaagaguuuuaguacuuauaaccaagaacaauaguuuugagcaacaauauucacuucaguaucuaaaaaguccuuuuucuuugauugucucaguagcauuuggcuuguugggauugaaguggguggauuagccaggggcucuagcaacagguggaguaggagagucugauggcaacagacgugagccaucgggagaggugggaaagugcacagacgaaaaucaguccagaucagauacagccgcuuggucacucagcacugcucuugguugccucuucuguaguacauucccucauugcuguggcuagaauuuccuagcauaccuugcagcuagaauuguuugguaacuuagguucucccaaggugguguacuucaugaagccugggacaggaugcacagggaaggcagugaaggcuuaguggugugcagaggaaaucugcuucugucccugucuaagucuuagcuuuugguuccuguugucaugggaacugaguggcaggagguuuagauuugugguggguccagacuuugcuccugguuggugcaguucuguugagcacccaugacacgcucucucaguuucuaguaggagcuagcugccagggcucuuuaugguuaaacuggagaggugauuguguugucugcaaacaggaauuggaacgggcauugcuauuacagagccaaggaaaugacgcuucauggaagcuaacuguguuuaauacugacgagaacagagacugagguguuuacuauuaagcuauuaauaaugaaaguauuacuauaagugacucaugacucuagcaaaaauacacuuggugguguguuauuuugcuuuggaagaagcaggaauugaaguauuucaaagaggaaauaguggagaaaagacagcuugagaugacgacucugaauagcuugaucaugacggggacuggggggccaguaccugaucagaaccaagucaaagaagucuuaauaaacugugggcacauguuuguuugcuugccgaugagaagaguccaaaaggcagacccuaaagagagcacaaggugacagaucugaaacccgagcuucugucaccaagcugccuuguaccuugaaggucuccuuagugguggcauuuguggagaaugcaccucuuaggaauucugggacugcuguuaaugauguguggaagcaaacuuuaaugcagugucuuugacuuaaagacuucgucacaguagccagacaacuguccuacccuccgaguucuucagggcacuguaaauguaggcuuguaaucacucuuaaccugcuuuuaacaggucuuucuuuuuagccccguuguuauaguacuguaauuuagugacauuaagccaauguuuccaaacuagugugugcuagauaaaaauagaugauaagccucggauguagcucugaggaaaacuuauucucuugucaccaaguuuuuaggacacugagggaagaaagggaaaaauaaauacaucuuuaucucggcuuucuuaugguaccagucagauuacagacaguggagcagagcuguagagagcuguguguugguuuguauucguucauuuacaccuccaugcacacacauauggacacacacauuugcauauuuacuaugguuuagcaccucaagguccacaggaggaggagggcaaaaccucgcuugcauuuuucucuuuucuuuccuuuggcccaguuagggauugcagcaggcucuccugaguuagggaucgcagcauacucuccuuuaugcccagccucuggccuaccacagagcucugcuuuuguccugaggccuguguccacccagucagcccagaggaggugggcuguucagguuuuaggucuuucucuucaugaagucuguguuaacaagauguuuccugcucaguuuccuauccguucuguucuacucggucagacccauccauaucagagcauuauacccaucaugaucagacauacaaauuuauucuaauguguauuguucaauucucugaguacucuagcugcauugauuaacagguuuuauuuagucaucugugcagugaguaaagcacucaacgaacugggaauuaagcacacucuaagcugaaaugugaauucauuaauuuucaauuuguuuuaaauuucauuugcuguuuacugcccaaagagaugauaaguuuuauuuaaaaugaaguguguauugaaagaggaaacuuuagaaacccacauucucuuuuacuuaauuuugcuucuaaugugguuuuaaacugguuuaaacagguuuuaaacugguaugugacgggcugagacuuauggauguaucugagucuauuucuaguucugugugggaauggagaucgaagccagaguacauggguacuagggaaauuacuacugaacaggguggccuguucucuuaauuuugauugauugauugauugauugggauaggggcucacuguguaggcugacagguauggaauacucuguagaccggaugggaccaaacuggcugggaucaggcagccucuacauuuugagugcuaaggucagagaugugacaucuagauacucgggccucuuuaaaaauaaaacaagcagacaaacaaaaaacuuauuuugagaaauggucuucugaaguuacucaggaaggucuugaacauccaguuuuccuuucuaagccugggauuuacggaccugugccaccaggcccaucuuauuaccaauuaggcaaccuccuccaaaucgacacagcugucaggucaccuggagucaccugggaagaggaaaccucaguuaaauuauugccaaggucauauugaccuguggccaucucugucaggaauuuucuuaguugcuaauuaauacaggaggguguguucuauugugggcagugccuuccuuaagcaggcaggcugggcuguguaagagagguaccugggcgauccaguaaaaaguguuucuccauuguguggcgucuuucaguuccuguccugggcuccugccuugguuucccuccaugauggaugaugaccuaaaugugugagccgagcaaacccuuucuucccuuccuugcuuugguccugguguuccucaccagcagaaagcaagcuaggacgccuucguccuucaaagccccuccugccgccuccuuuuccugacacucuguuuugcuggggaguuuuggucugucuuccauuuguauguaauuaagauuggagucuggaucucuccuuucccuuggagcuguuuguaaccagaaaaacuuuacuguguucuuagcaagccugaggccccaggugagggcuugguuugaccuuuuauuuauaugaaucagaaguagauuugucccaggugagguggugcauuuaaucccagcacuugggagccagagacaaggggaucucucugaguuugaggccagccuggucuacagagcuaguucaaggacagccacaacuacacagagaaaccuugacucauguggugccccccaccccccaaaaaagcaaaaaauaaaaauaaaacccaaacaaaacaaaagaaguaguauauuugucagcguguagucuaaccgcugcucugaaaugugcguuuugguuaggaaaagcucaugucuaaaggugagucuuguucuaugcucagcugcaagugcuuuuggcuuuugaaacuggcuccucccucaguucucacacauuuucucucugucuguauucauggccaggauugaacugaccccacagaggaguucagagacuggcagccagugaguagaaaguacccuggggagacagugauucucccaggggcuguguaagcuugugguccacagauaguucugcaggcucugagagaagaaaugacugggucccagcuccuuagaaauggccugucugccagcaaagcucuauauagucuguggacaguucuuuguagacuagcugccccucaguaaaacaguggccucucuuucuucagaaagacaucuacacaaaaucuaaaccuucagguagggcauaaaguagcccuaucuuacaaauauaaacauacagguggcuuucauuaucauuaacuuuauugauugcaaauguuggaacacauuuggggaauggauggguccgauuuacuguuaaccccagacaggugggcagaagaggcggggaucagaccugugacccagcugguccuugugcaucugagcaucgcacacuggacggugggaucauuaccuccagggcuuugaaguuuuuauuaucuuaacugugacucguucugaaauucugccuuaauaauucccuaaagguuuguucuggacuaaccugcugggacuuguggaaagaagguugagaauacuguaguuuaacaaccaaaaaccuguacuuuauauagcucuuauuuuaaaaaagggcugcagccccaaagaugagcccuccauaaaaugaagcuacagaagaugguggccaucugacucucaugugaugcacagagcgcacucuuucacacuaggcagccucggauguugcuuugagauggaagaguucugggaccuuacacuugucagcugcaugaacucggaaucugccuguuguggccuuuuauaggugggcuucugugugacacugcagucacccggaacccugugugcuuaucccguagcaacgauggcccugcuucagacauucuucuaguucuaggauagcauccgccccuaaagcuaaguauaccuacuguccuccgcacagagcuaguguucugacagcagcagcucagaccccaggcugcuaccugugaaaccacgauaguccacaggacagagcggaauuggguauguaacugagaacggaggauugcaauuuuaaacaggcaucagggcugauauccccuggggagauguaaggacagaggaccaggaagcagccugccguaaguuccaaguccacgcaguucuguggcuuuguggucaggcugguggcgauggcacagucuguuggccaacuuaccauuacuguaacagagcgccucaagagagucaggcuccuuucuuuaaaacagcucucuugcuguguuauccagcuuugccuagaacucgaguuuuccugccauagccuccaggcugcgagcuuuccgggcugagggaggagauuugcuuccagcuguggugauaucaucaguccauccucuuguuugaaacacuguggcauguauggcagaggagccuuuucauaucaggcaggaaugggcaagaggcagcaggaaacagacccagggaccaguuugaccaucagaggcuugccuccagugaaggccuuucaugacaccccaucuccgcagcgccuuuuagguaugggccuuugugugaccguauagcuccuaacuacagcagcgguggggguggggagauggaagguuggauaaguuaguuucacaggacugaaacugggauaggcguggagggagggaggugguagcagcgagugcucugagcaaggagaacggugacaggggacagcauguguaaccaggcaggacacuggcugcaggacugagugcugacugcggcagugaugggagguaacuacauucuagaccuguucugaaggccaagugcauaaggcuaccacacgagugccuguggcugguccauuuaaacagcacguuaaggcaagcagaacaucuguuuaauguggcaaagucaaauuugugcauucuagagucaaacaggguuggccucuaagaccaauuucuccuuuguccuuacaguugccugggaaagugaaacagaucaagguggcugagcuugaauggacuuuacugaauuaauucauucuuucuuucuuucuuucuuucuuucuuccuuucuuccuuucuuccuuucuuccuuucuuccuuucuuccuucaaggcuuuucuaaaaggaacuuaaaaaaaaaaaaacccaaaaaaccaaguuguguguuuucacuuacauaauguuaauagaaggccugaaacuuagccaagaauucugcacuagaaagcggugugauagcuucccguccuaaguauguugcugacuaaucucugagagagcaagccaagucaugcuuugcuggguaguaaacugucgggauaguaaagugagcccacgugauaggaaacugggaacuugcaacacuaauuaaggagagaguggaguauaugacuccagaccagaccaggcuuccggccccaccccucaauuugauuucuaacccuguggacgcuggaccaaaccagacugguugucauaagucaguuaugcugucuccaugugcagcacacaacagaauucagagggccaaacaauuacuugaaguaagagcuaguuuggaagcaguugguuuuaaagugguuuuucugcagauauucauuagaacuggguagauuugcaaucugacuuauuuuucuguguaugcagcauaaaauuaaaagaauuuaaaguaagagaauagaggacuguuaacuauuuuuagaaguagcuuuuauccauucuuucaagacugauaacuugagcugggaagauggcuuagcgguuaaaagcacugacugcauuucugaagguccugaguucaaaucccagcaaccacaugguggcucacaaccaccgauaaugagagaucugacacccugcccuccucuucuggugcaucugaagucagcuacaguguacuuacauauaauaaauaaaucuuaaaaaaaaagacugauaagucuuagagucuuauguguuuuccucccccucccucuccgcuccccccccccccccucguguguaugaguguuuuugcuugaauguuguaugaugaaugucuggagccugugaagaacagaaggaggaaguggaguuaaagacaguuguuaacuucuaugcuggcauggggcuccaagccugggucuacugcaggagcaguuaagugcucuuaacugcugagccaucucccuggccaggcaguaauauuuuuaaaacaacagacuccacuguuccuauuguuaguggaagccuuuugugacacauuuuucaaucuuuaggcugauaacggcugccacacagugugugauauaucaucuuuagauaccaaacauauaaacugcguguguuaggaaagaaaguuuuagaaauaaauccaaauguauaaccuguaauuggagauaggcagagcucucuguaagaaguuugaaagaguccuuguggcguucuggagcaagaugaggaccuaaaggcuugcuaggggacccacucaggugccuucauugccuggucucagccguguuuuccuuguggccuauccugcaugccauguaucagaauuccuguaauacauuuuauuauucagaaagccucagaaggcaacuagcuuucuucaaauuauuccuggaaaucacuugcucucgagccagcgccucccaucugacugggugggugaguaauaucacuucaaggcaguguugacacacacuucuugccuucucaguucuauaaauuucgggggaacgugucucagaaugggugggucaaggacgugggcaauguuggcagcguccuccuuggugacucguguggguaucauugcuccagaauccagguguuuuuuuuuuuuuuuuuaaauuaaggaagacugaugugccaaccugaggacauuauuauaggcaucuaacacuuaaacagaugcugugaaguuuuguuuaaaaaguugcgauuucuccaaaugcauucuauuauacaugugcugauuauuuucuuuagaacaacagaagcugcucauuggaguaaagagccugaguuuuauuugucaguugguaauugguaauuggcaguauuuucauagaacugaagcuuuguucccuugcaagaaauuacccuggguaauaugugugauguguauggaggaacucaggaaggaggggccggaggaccagauaacuaagggaugcuaauggccagugggccucacacugccagugggcucauuauuugaaguaauuuauuguuccuuuaagaaguacauauacauuaaucauggaaaacuaguagaaaaaagauauuguguaaauguuagagucuuaguaaauauaaaaauguguuuuuuucauuguagguuaguacaaguuuuaaaauaccacauuguguguugauacugaaaacuguaaacaagauagaaaacuuggccuguacaagcauguuaccaaugagcacauuguuaacauuuaaagaguccuuucaaaaugauuuccaucgcugccuauacacacuccucuccucuaagcauacauaaaaucaccuguaauccuuuucauggucgguauauuguuuuucucccugcauuuacuugucauguuugacugauaaucuauugauaacuauuuacauaacuuuuaaaaagauuauaagcauuucugugguuaacauuuuuguguguuuuuauuuguuuacuuaaauguagacuugcuguauuuauuauacacagauuuugcuucaugauuccagguuaaccuucuaaacuuugcuccuaucaaugguauuuaagaauucuacuuaaccucucauguuagaaagcauaaagaagagcuggggauguggcuugggugguagugugcucagucuuccacacucaaggccauggguucgaguccuagcagcacagaaacuaggugugguggugcagacacgaaguucuagcacuugggaggugggggcagggaaaugggaggugggggcagggaaaugggagguaagggcagggaaaugggaggugggggcagggaaaugggaggugggggcagggaaaugggaggugggggcagggaaaugggaggugggggcagggaaaugggaggugggggcagggaaaugggaaguucaaggucaucccgagugacauuacaagcucuaggccagccugggccaaauguuagacaccuuaucucaaaauaccaagccacacaaacuaaaaccaacgugccacccgcagaccaaagugaaacaauccaaagagcagaaagaauuacuaucauuuuugugaaucgcauaagcaaaaaagccaacuuuauuauuugaauuuuccuguuuuuaaaguaaaaaaaaacuuaugauauuauuacuuaaauuguaugugucucuuuguauauguguguacuuuguuauauaugaaauaaaugagcccucuaggcccaugcaucuucgagcuuuggacauacuguuuugaucuuuaaagucguaggacugaugcccauggagggccguacaguacccuacaugugucugacuaggaggagagcaaauguguuccuuuuauuaagagugugauacauggugaugcccacagugugaggauauucucugcuuguccacugccaaaacuagguuguuugauucagcaauucucuucagaaaauuuuccuauaaaauuuauaaauacauaaagauacuugcacagccaugcucuuuacuuuuaauaaugaaagaaaaaaguacauggacagucuggaauuaauaaggggccuuggggggggagggggaagggaaaacccacaccccaccagagguuuaccuauucucuggucugucaggugugggagggcugcuauuuaccuuccacucaucccugggugggcauucaagccucugacccacucaggggguggccaaggggcagcccuaucugcuaaagcccccgggguuauaggagagagggagagggaagagguucccaacacugaccagagugugcagcggaucuugaugagcagagacucucuaugguuuuagagcuuuauuauagaaaggcagggggaaagagagaagguaggggggagagagagagagagagagagagagagagagagagagagagagaagacuagagagaaagaguaagagggagagaggagaggagagaagacaaaggggagagagagggcgagagugaggaguaagagguaagagcagugagaagugagagagugagguggggcugaacagcccuuuuuaugauguucacuguugcuagguaacugcggaggaguuuagccugaaggucagaagcuugggccauugcuuaugugacuucuagccaugcuucucuuguggggguugugggagugguaacuuaggcaggagucagaguucggagcaugagggagcgccuaccaugucauguaggugaauuauuacccuucaggguucagaccucagcucaacuggagaccagccugcaauuccccacaacagacaaaaagguauuguaugaaauaugauguugaaaauacagagauauaauggauccguuacuugugcagaaauacccacaauagcuugcgcagcuggcccgucugccgaauacauguagccugacugugcucacgucucaguucuucuguagccugacuguguucacgucucaguuguccaugugaugagguggacacacagguagauaagcacucuaagcagauuccguuuugugggcaaugugaggaggacugaagcuugagaaccgcccccuucugcauugcaguggaaaccuuuauaagugugugugugugugugugugugaaacagucaauggaaggugcacuucagugcuauggaaacuuugggaaguaaaauguuucaguguggcaagaggcugcuggcauucccucugcuuaauaagcuuaggccuuccuaaaacugcaguugaaugccaagauuuacuguaaauacagaaugcuuuauucacgaugugaaaauacaguaggaagaggaaaaaauaaggaggaagcaguugucaagagggggaggcucaggugggcaucacagauccuggcucgcucugaaggaaccagggugcugcagucaagccgcccaggccaccuguucucaccacuauccgguaccugccuuccaggcaggcccuuugccagacugucuccuccuuuuccaguucauuagugacauuuuaagauggugcagccugaauccaauacuccaggucgguugucacucgucugaaaggaaggcucggggcuacaggaguuucagauuuggacugugagggguuucuaguauuuguauauacauaaugagcuauuacaagcagcucucaaguccagacacauagcucauuuacaguuuaugccuguuuuuuugugcacguagcccgagggugaacagcuucuaccuguaacaccaugccagugcugaacgacuuugagaaguggaacuuuuuggguuggauucuaggcugcagacacugucuguucuucucugcucccaccuccucccugugcagcagccuggagccuucuuuugugcaggagaaacuguccuuaaauucugcaugacaguuucccacaagucucugcucuggcuggccguuuccccacacuuccugucucgccacagggucucagcuuggcagcuuuaccugaaggucucucccuucauccucagaugcugaguuaauacugugguugcaggucagcgauggcuugccagggaaguucuugcccaucucgcacgguuucugcugcaagcaguguaucugucugaguagcuagucagauugcccguguugccagucggagcacaugacaccuuccuuugccuuucaacuuuucauaugcuaaagggaagaaagaaauaaugcugacagcuuaguuuuuccuggaugaguauuuaaggcuacucgggugauuguuaaugcauuuccuguaguuauccauucagagauggugguggugcggaaccaggaggcuuggggaaucuuaggcucagcaagauagacaggcacaugccuuugaggggcuacagcuggauccugcuaauuagcacccuuucgggaagcagcugcccuuucuacccauuguggucacuacuggauauguaagagacucuucuagcccaccauucuucgucacaugcauguggacucacauacaagcaugcacacgugcgcguacacacccccacacccacacacaccauugaugcucuucugguuucucugcacucacauucuuaguuacuauuguuucuagcuguugucugccaaauauuugccuguuuagagccauagcauacaguaaucucucagacggugccauugagagaauacuggcuuguauuuaugaguuacuuaacugaccauaaauacaucagcuucgaagaauggaacagccuagaccuugcaggucuccaggaacacuaggcugagaaaacacaauggggaaaugugccuuugaacagaugaaguacaaaaaguuccuuucugggugaaugaacuggaaaaacggucuucgugcccacaagaggacgcuuggggacgugguuuuaauggggacuagaucuuagcccuauuuuaccuaugcaggaccaaccaugccacuguuuggagcaguguuuuaaaauaugcauagcagaugccuguauuaaauuuaugccuacaucuuggccucacaauuucgaaaccuggucuaggaguucuugggcguguccugcacaacaggucauugcugguuuguucuccauggcaccuucgagucagauugauaccauuguaagaguacaguggauuucgauacauuuacugcugagcagaugcugacgucggcugugguagaacguucccaccagcuccuggcggucccucacccacuccagcucccgguggucccucacccacuugcagucagcaagugcccacuccaagccccacacagcuaucacuuguccccuggccauugccgguuuacuccacgggcaccuuaugaaugggauccaucuuuuugcuucuugucuuagcagaaagaccugucaguguuccugugcaguagcugagagugacagugccucuuccaaucagugauucaacaucucuuacucacucuugugguuaaguuuggucuuuugaucauuucuagucauuuuaaaacgaggacucagcugucccugagguugauuccauugcugaaaugucuguguacagugaguguugaguuucuguugaggaaauguuuuagcuccugaucuuguguuguagcuuuauuacccucuguuucacuaugugugcuucaucaagagcacagcacauggcuauuucaucauuuccuuagcagacuuacuccauuuguaccuuauuugccccaggugugucucuaaaugugugcagcccaaacugcauuucuucagcuuuaacauuucaaugggagcuguuuaaacgguccgguuggcccagggaggcaugaucaucaauuacuguuucaacucaauacuguugacuacagacuuccuuaauauuuaguucauguaguaccuacuaugcguuuaggagacaccacaccaaggccucugcuucauuuucauugccuggagucuaaagucuccuguugcaaguuggaaacaggccucacagagugaaaauagcaccuucuugucaccgcuucauggugaagcaaaaagaguuauauggaguauuagcuagugacaucuuuuuagagagugucuucccuuuggaaauguguucauucugucuccugcuguaugagaaugucuucagaacuuuaaaucaacacucuaggacccuugcuaaacaucacuaaaucaugugaaaaccuguggugacuuguugcaaguagaccagaagugacuggccugcuccucuggagcuggguguggaccugcgcagauccagucuuuaucagugggaaggcugaggagaggauggagcccuuuggagcucugcugaucccaugagaucuggaaaggcccugagacuguaauauauacauuuagcugagguuucauuuggccugggaaccaacauauuuuuauuuucuaugaaauguguuaugcucauggcuuucaauucuauaaauagaaauuuugacuaaauucuuuuuaauuuuugucuaaaccugauagaaaugagcaagcaaggcuugcauuucagguaaaaacugcuaaccacucacugaagccacagagaggacgacuuaguuuaugugucugcgaaauguuuuccuggugaaguuauuuuaaaaugugcucuauugaguggugaaauuccggauuacuggauagucugacccuucuugcuguacucuagaccuaaguuaauuugcuacugaguugauuuguaaauaguaauuaccuuauagaauuuuucuuuacuuuuuccagugucuccagaguuggggauaaugggauuuacuucgcugagcuuuggcuucauaucugucuuauaccuuauucauuaaaucuaagaucagcauuaauagucaaaaauagugugccuuuguauguuagcucucuucuauuaaacgugcucauggcuuuaaaauauaaaacuacagagaccuaaugcuuucaaguguugaaaaaaaauuucuugaguuggugauauuuuuacuguuuugagacagggucuuucuauguaaccguugcuguccuggaacauuccauguagaccaggcuggccuugaacuagcuuugcaaugcuacuguuuauuucuggguuacaucucucccaguuaaacaauaagaacaugaacaggaggagugaguagucucucuucaccacagcccugcagaaagaaacguaagauuuuuguguuguacuuugcagguggggaguuuuaagcgggagaugaccuucacguuucaaucagaggacuucagacgugacuccaguaagaagccgucucaucaccuguucccacuggccauggaggaagacgugagaacagcagacaccaaaaaaaccagucggguccuugaccaagaaaaagaaacucggucuguuugucuucuugagcagaagcggaaaguaguuucuuccaauaucgaugucccuccugcaagguaaggggguaucgcauuuguaggagacagguagagagcaggcccgcucuauccugucuguuucacagggucuagacuuagcaagagcugucugucaaguuuucuccguuccuucugugaaguagaaccaauuuuggagcugcugugguuaaaacuguuguagcuguagaaaaaaaaugccuggaucuuugacagaagaaaaugugaaaauacgaacagagcagaccauucuguuuaagguugauggugcuugaagguagcuaugcucauauccuagguuggcaaauuacaacucgaggcugauuuagccucggccucuuacguguggacuaugagaugaauuuaccaauucaaaugauauagaaagaaagugauugugacacagcccauuggugaccuguaaagccuucaguguguaaaaguguuuggugaugucuaguugaugucauucauaaggugaugucauuuuuaaggcuuaucuggacaagggagauggcugagugggauagagugcuugcccugaaagcauaagaaccugcguucaaauccuagaggccaauaaaguuggaugcagugcugugcacaucugugaugcuggcucucuuacagugcaguugagaacauguguaaaguuggaugcagugcugugcacaucugugaugcuggcucucuuacagugcaguugagaacagguguaaaguuggaugcagugcugugcacaucuguaaugauggcucucuuacagugcaauugagaacauguguaaaguuggaugcagugcugugcacaucuguaaugauggcucucuuacagugcaauugagaacauguguaaaguuggaugcagugcugugcauaucugugaugcuggcucucuuacagugcaguugagaacagguguaaaguuggaugcagugcugugcacaucuguaaugauggcucucuuacagugcaauugagaacagguguaaaguuggaugcagugcugugcacaucuguuaugauggcucucuuacaguguuguacacauccacucuguggcacacacauguacacguacacuuacaugauagauuuauauuagaacacaauggagagaguuuaucauguaauucucuuucagcauuuuuaaaauuguucucucauacaguacauccuaaccucaguuucuuguccuggucuccuacucccuuuauuucaacucuuaucuagcacuacuggaggguauugucauggcgcagcggaagcagagcagacacaaacauugcucguccuccauccggcccuccugcuccagccuccgcgcccuuguucacacucugucuccagccuagaacaaugcccugugcccuuccugagggucugugagcacaugucagcugaggagggaauggggggcucugucugcacgacagcuugauuauuuuauguguacuccauuuuaaugccagaaaugauuaucaugagacuuuauaagcaguugauugagaagucuugcauuuauucaaguguuucugacggcucaugaagacauguccuauaggccaggaaggaacccuucuacaccugcucaccguuaguaaaucagcauuuucauuguuuucucuucuaaauagagggacuaucuucuucagaaaauuacauguuacucuauccggcugccaaauugucaggcuuucuacaauuauaggccucuguuuucuuuaaccucuagcugccaauuuuguauaucuuuuauuucuguucaacuauuugucacuauuugcucuucuaugauuucuguauuaaauacuuaguuaaauuauuaaggauuaguuuuuacuguggccucauugugaaauguuuuaaagugcccugaagcagacagacacauccguucauauguguaguuuggcugacucauaggucgagugucacgcuugcgacuuggaaugagaagagcugugcuguuauguucuuccugggccugucagauggacucugucugagacagcagagccggcuuggaguucugugggaccuacuggacacaccauuuccauggagucuuucguguguaacagaaguccugcaauuacgucauacucuaaguuguugcagguuguaucuuugguuugguuuuacccaggcuggccuaaagcucacugaguauccaaacaugaacuugagcuuugaucauccugccuucccuccugcgcauagauuauaggucugcgccaccaugcccagcuuacgccauggugggaguagaaccuaggcucuguguguacugacaagcacacuacacacugggcuuuguaucagcucuguauauucuguucuuuagcaugacuucaccuccgaaaacagugaaaaugaagggcaggaaaauaucuuugcuuuuuuuuuccugaugcuggucuaaagaaugaaaauucuuugcaaucguuagguauacacggaagcacacugcucaagcugguauuauugugagcuuuuaaaugguagagagaaauuaauuggguuugaaaucaucaauauguagaagaaaauucccuacugacgagguauaauuuagaugaauuaacgugcuaugaguggggcuaccuaaagugccauuguuaggcucugcacuaacacacucaucgucauugucacaguuaaaauguaaucaucauaaacaugcuaucacuuggagaaacaaauugcuuuuuuaauuaaauagacacgaaggaaucaagugaugcagaaugaucuaauuucuaacauuuucuucuguuugcagucguuagguuauuuaguaaaugccaacuuuugacuaucuaagucgauugagauucuguuguaaggaaacuuucaaucgcgugauaggaaggaacacgauuuuucuuucugcuuacuaaaaagaaauauaauuauagcugucaucaaaaacugcuguugaugucugaguaaaucuggaguguagugaaauguauuagaauaaagaagucuagauauguuauuaaguaugaccuauaauuaaagcgucuauguguguguaaucuacacaugaacaucuauccacaccguuuccuguaacuuacucuaauuccagacuugguacuuuggguacuccucagaggcaggagggugcuuuaggcuggcauugucagugugcagagcuccugggcaaguuaaaugcccccaggacuucuuaguuacccuuccccuuacucugucguuugugaagccugccguucauuuccgagaguucauacaguaaagaaguguguguguuagccgcuuucccaugucugcccugucugaucccucugauccacuguuggcuuuccugacgucguaccuucuccaucaccaggugucuauugggugcuugcugcuggugaccuugagcuuguuaaaaaacaccagugggaggugcuccccuccacgagcuugcaugcagccagacagauggaugcguaaguggcuaaguccaagaaacuacuuaguauugcucgccuucucaucagggcucggugagucuguaacuaaaggaaaggcuuaaauauuaggagaguggucaguuugaugcaccuacuuaaaggccugcuuuccuguuauuagugucgcauugaagguacagaagcauggaauagggaaggaaaauuuucaaaccugagggucuauuuuaaaaacuuuuacaaaaugccaguuuucuggggccuguuugaaaguugcugguuucaggaagggucauuguauuacccaagaugugcuaagcuugaccaucucagaagcaagagccaagacagaauuaagcauacaagcaauuuauuggggaaauuccuugugcaaagguaggagcccagugcaguacaaggaagaggagugaaccagggaaggaaggaaaaugagaggguggaugaagugugccagcagucucauagcccaugaggaggaccaccucauguccaugaggaggacugccuuauguccaugaggaggacugccuuauguccaugaggaggaucaccuuauacccaugaggaggacugccuuauguccaugaggaggaccgccuuauguccaugaggaggacugccuuggacugccuauguccaugaggaggaccgccuuauguucaugaggaggaccgccuuauguccaugaggaggaccgccuuauguccaugaggaggaccgccuuauguccaugaggaggaccgccuuaugcccaugaggaggacugccuuauguccaugaggaggacugccuuacgccucuguugugugcugaucuuggcugggagaagcuugugagacuugggaucuaggcaaguaugguagaugcucuugaguccuagcucugguucuggucagcacuuuucuuauggacgccucuccugccuggaacacagcucugaguguuuucugccgugaggcuggagcaggggcuggacucuguuagcaggccccuuauguuagagaaccaagcuuccuauggcuguugcuucaagcaucccaagaaccaugcuuuugagucauuagaugaaaggccuuuugagcccccugcaugggaaaaggugauguugguuuaggagaguucccuuacuguggaaccuuaccaguguggcugauuggucucgggaggaagcuguguuucuuugggaggacuuggaggguuagacccucggaguauuuguuaguauuuuucaguccugagaccgugaggguagguggagcacaugcuuaguaugauggcuugcaucaagagcgucauguaaugugguaaggcagcuugugcagaggucaggcagccucugagggacuaaugucuguaacgcucccgucagugcgugcguucucauuacaaacacaagaccaggccucuucuagagcagugacaugacaacagcgauuagcuaagugugcacucuuagauggcuuaaggugucucgaagggaaaggacaagcuucauugaucuuuauggagaguugaagaaaacaaggggcgggagagauggcucagugguuaagagcacugacuucucauccagagguccugaguucaguucccaacaaccacauagugacuuacaaccaucuguaaugagaucucacgcccucuucuggugugucugaagacagguacaguauacucaauauacaugaaaugaauacaucuuaaaaaaauugcagccgggugugguggcgcacgccuuuaguccuagcacucgggaggcagaggcagaggcagaggcagaggcaggcagauaucugagaucgaggccagccuggucugcauagugagaguuccaggacagccaggguacacagagaaacccugucuugaaaaaccaaaaaaaaaaaaaaaaaaaaaaagcaaaaauaauuagacuauagacaggacuuuagccaugcuuuuggauuuaaucuauacuguagcuguggcaaugcuuuauauuuugagcaugaggugacuuucuguccaauggauguaguccauuuucuuugguccucagcaguugaugaauacuugaggcuggagagucaggaacuaggucauauuggguuauaguaguugugcuacauuuuaaacauauauuuuuaaguguucaaaaagauuuuauagugggcauuguuaggcacucuuuagcaaagggcacuuuaguuguguaggauagguuaggggggacaagaacagacaggaggccuggucaggacaguguugcuuaggacaguaggcagcugggaauuagaacugaaauggaaagagaguugacaugaugcaggaggaaggccucugggcugcgagcuggagaacauggcucuggcccagucuacuagaaugggccuuauuuuauuuuucuuuuaaaaacuaccaguucauuuucagagucacagaggggacuggagauuagacaguagacaauagacagcuaagucagcggagcagcauccacaaagcaggcuccggggcuucuaaagugagaaaugcauguaagacguaugucugucuguaagaugaugucugucugucuguaagaugaugucugucugucuguaagaugucugucugucuguaagaugaugucugucugucugucuguaagaugaugucugucuguauguaugucuguggacacaggcgcaaacccagccacuugcuuaagagugaaaugaccgaugcugugcuuagucaccgugauugccacuucauaaaugaguggaaagacacaggaugucagacaacauguaggaggagcauguuggaaaauacauggaagguucuggccaauggagauguuguucuuuaucauugucaccaguguuuaugggagaauauuaauaauuuauuguccuugucaacugugaugccauaaaacacauaauagcaguagcuccgucaccugcaaccccaaugucugucaggcagacacuguuugaucguuuagaccagugguucucaaccuuccuaacacugcggccauguaauaguucuucauguugugguaacucauccauaaaauuauuccauaacuaauuuucuacuguuagaauaauaaugugaauaucugcugugcaggaagucugacauucagccccugugaaaugguccuucaacccccaaaggggucaugacccccagguuuggaaccucugaucuagauuguuggaacauggguguuuguuauucuguucuuugucagaaauugcuuuuucugagguacuguuggacuucacccaaacagcaauuacaauuugcuuaugcagaguaauagcuaacuucuuauuauaacuccaaugccaaagaacuugauuuccaagccaguuaguuauacuaaggaaaggagaaauaacugaccccaaauacugguagaccuaaaggccgugcuucagcaugcgacagauaauuagcugccguugugguagugauugcucuguggaguucuaaaagccagcuauuuaacacuugcuggauaaaaugaaguaacgaccagaugccagucugaaaaccgucugcagaaacucauuagccuuugaagauauaguucaguauuugacaagugccguguguguguguguguguguguguguguguguguguguaucuaucuaucagucugugugucuguuucugugacagugugugaauguauguguuuguguauguuugucucugugugugugcaugugugugcauguuguccuucucugaguguguguguguauguguguaucucuguguaugaauaugaguguguguguuuguguauguuugucucucugugugcauguuguccuucucugaguguguguuugucuguguguuguuugugucugucucugagaguguguguguauguauguauguauguguguguguauguauguauguaugugugugugcauguauguaugugugugugcauguauguauauccuucuaaaagugucucauuauguggaccaggguggccucagacuccagagagcuuucugcuucugccucaggaaaagaugcaucaaaggcauggacugucauauccaucuucuggaacccuugaguucuaagucggaaaguaaccucaucuguaaaccacauuccaugcgcacaguaaaaacccagugcuacuuuggcuacuuccuauccagugucccuuagagcaugguccccuguggcaagcuuggaaguaaaugaaguaaaacguuccgucacauauuuauuauuugagauauggucuugcucugcagcccaggcuggucuugaaaguggacuguuccuuccaccacagcguccccaguacucacgcgagccauaauaccugccuucaaaauugcugucuuuuauuuccugaagcucaguuaagcccaccagcuccuggguaaaagauguaauauuucauacacaucaggagcuucucagguucccagcuugguagccaauacgagaccacugagaaaggccgcuuugacauuuuaaauuguuuuuaaacacauuuucuuuaaaacacauacauaagaauaauacaaauauacucacucauguuagagaaacacuaagacuaugauuuguggcucuccuaggucauugacagaaugucaauaaagagaaaacuaucuuuucuaagaaacuccuuccugccuacucucuuguccuacugucucagaaacucuagucugugaguaccugcugccucucuaagcugcacaaagucagaaagcuccuggaaucugcacacaccugccucuuugugcugagauuuguuuuuugguuggacacaggguuucucuguauagcccuggcuguccuggaacucacuuuguagaccaggcuggccucgaacucagaaauccaccugccucugccuccugagugcugggauuaaaggcauggugcugagauuuguacucuaaagccagugagcaggucaagcacagagaggcacaugugcuuucuaagugucuucagucacccggagucaaccuuccagggaacuagagaucugaaaccacccugcgaagggaagucauucacugcucucuucuucagcaggaacaaauccaggaacuagaaugcugggcuuucuguuuguuuuaaguaucucuuccugucagaugcucguaggugauuucugagauuuaaguguagaccugcugcccucucucagcuccucccacgcucccagcagagccauggaagcugaggcagaggcagaggaaccguccugcucgcacugcccuuugucuuacuaacagugaugguacugauauggccuucauuucguaauguaagaaagccugugcuuugugacccaaauugccuuaugaauuuuugggcaagaggaaagaguggguagauacuaguggguguguuuuaaaaagagcuuuauacuguccuuauugcugauuuuaaauaauaacuauuugccaauagcuguauacuguaaccauuuacucuugaauacagauugcuaccacauuaaaauuugcaccugcugagaauugcgcuuugaauggagagcauuaggcucuucucucuggaucaaacugaauaguuaugaagcaaaauucugagggauggaacucuugcaggcaucguuucuaucauguguaacuaguggagccuucugugggauguccuuggcaguaacuuuaaccauccaagccuaguggaugaagaacacggggacaagguggggccuuggccuuuaccuuggcgcucauacucccucucccucccuccuccuccucucccucccccuccccuccuccuccucuccugccccuccccucccccuuccccuccuucuucucuccucucccuccuuccucccucgguccugcuccugcucucauacacacacacacacacacacacacacacacacacacacacucacucacucacucacucacucacucuuaguuuuuuuccucacacuugaagaacuggugcuauaacugagugguaucaugguugcccugguaucagccucucaaaaaggaaaacauaggacucaguaacgcuggccagaagaaaucucacugucagacacagucuguagucacaacauaaacacagggagaaaagaucagcuaaaauaaauauaaguacuaaauuuaguaaaacauaucucaagagcuggagagauggcucagugguuaagagcacugacuguucuuccagagguccugaguucaauucccagcaaccacaugguggcucacaaccaucuguaaugggaucugaugcccucuucuggugugucugaagacagcuacaguguacucauauacauaaaguaaauaaauaaaucauaaaaaauaucucaaguaguuucucaccagguaaugagguucucagugguguuuuguacugucgguugcgugcugugccuuaagaagcugcccugugucuuacaggaggcaucagcuauugggcauggguauggcugcuggugacuggcagcagucagccugacgggcagcgugggcaagauuggcaucacagccugucuuaucuugucaaggcaccaguuucucucuucauuucuucuccuuucucauacaugaagaaaacgucucaccuacuauuaggaguagacuucucucuuggugucagugugugaggccugguagguacggagaacaaguguguaggguuagggggugagggcacauacaauuaaauagcuucuguuggaaaucuucagcuggcucugguguggccccuaacagguuauauuuuguaucuuguuacaaggcuguuuaaauuccauccgagucagaugguuaagcaggugucagucccaauuuuaguucuuuaaaaacacagaaacagcuuccuuuccagggcuugagagaacuuaccucaguuaccaugcacccugcuguccccacaguggugacccuuacagaaggaguuauacuucccguuaaauuuaaggcacacaccauguguauauuuaugcuuuuucuucauguacugcaugcaguaagaagaguuaguuacugcguauaacuuuagagcugggaaaugcaaccaauauaucauauauuuucuuaaggaccugagcucaggguuucauuugguuacuggcuucaguuguuacuguaccuuuaaauguuagcucuccccuuaauuagggaggcuccuuuccucuagcauucuggggaauuaagggacacaaggcuggagaauuaacauuaacuugggauacuuagagaauuugauuaucuuuagguagugacacacuuuaggggauauguuugauuggugucuuguagggaugagaagguaggaggaagaacaaguguauauugaccugaaaacuaugucaguucuuaaauaguugggaaacacugauagaaauccaggagacauaauuaugaaacucaagaggaaggugggacgaagcugguacccagggugcccugugaggaugcugcggugcucagaauggcucuaggaacucuagcucaagcaucucgugggaaaaagaaaucugcuagcagcccagaagaaaguagguguggcagauugcaacaaggcuuagggauauguaguguuucagugucucuuaacaaaaacagaauucggugauagguuuuccaccaaggcuuaaggacuuucuguaaaaaucaaaugggcaguugguguguuuacagagaacaguaugcagaccaccuuaaguagucaaaucguaauguauguaauguaaaugauuguacuuagaagagcuugcuauuguaauguauuuuguuguacgguaaauaucuaccugucuggagguccgaguucauguguuugcuugucuucaagugagcuuacacuucuaccgccaucucuacacagugagaagauaugccuuguuccuucacacaggguuugguuuuaacuguguugggcaaacauuugcauccugaauggagauugugacaucaucuuuuaaaauuuccccaccucaaauaaaauucaccucauaauagauuugguuuguucugcugccccuuucuaagaaagcacagcuuguaagaucauaugcuuuuuccuacauccguuuugcuguuguauuuaaaacacagaaagaguagcuuugucugcggaaugugagaguccaucaggugccucuggaaacuuguaucuggggcauacugcaccaggaucuucagugguacugaguacugucauguuuaccugaguucuucugagguugcuggauaaaacacagacuggauucuacauccugguaauugcacccuguucuuucuggcccugguugguaagcacauuaacuccacggcugucaagaugucacacacgcacacacgcgcgcgcgcgcacacacacacacacacacacacacacguucccuguacaugcguauaguuucacagggcaaguggugauaaugauccucagaaucucucuaggcugagagugcuaggcagcuccgcacauccaucaggauggacaggccuaggugcauauggcgagccccugcugucuccugacguaaugagcagcagcaucgcccacuguccuuaagaaccuguccucccuccugcuuaucucucaaguuuacaugguuuuccuuuugguucacuccugacaaacagugcaguuguauuuuccacaugccugcagauguuccaaccugaaagagucauauuuggaauucauccuacuauguuuccauugcucugauaaauagagugaccaaaagcagccgagaggaggggauuccuuuggcuugcacaucugucauugaggaaagccagguaggagcucaagcaggguaggaacugaugcagaagccauagagacugcugccuaaucacuggcuugccacugcuuguccugccggcugucuuguauaaccccgaacugucuguccaaggauggcaccacccagagugggcuggacccuccacuucagucauugaucaagacguugcuucacugagcugugcagaccagucugauggaggcuuucucuccaccgagaugacuccagcuugggucaaguuaacaggaagcugauacagagcugaagggagcgagcgcugcuguccaucaggaagagcugcacuugcaguucagcaccaguggguuggaccucagagcugccuccuguccaguuaauggcugugccuuccucugcauacaguguaaacaaaguacagcccacaguggagacgucuacuugcaguugcagagggacgccauugcaaagcggaagagcaugugaagugugucuaccccugagaaaagguagcauaggaaacagaacccauggucaggagaggcucagugccuggcucugcugcucucuggccucggagucugccuuugugucagcucacaccuguaugagcaagcaaggcccuucucauguccuacagugugaaaacaaugucagcuacgccuaucugugcucuaggucacuaccaagccuucuuucccacaguucugugacacuaaagccagugguuucccucucagaaucaggcucgagcuuaaaaaaagauuaaaaggcaaaagggaggugaggggccacacacgggagaugacucagugacuaaggacacacuccacaagugugagccaccaagaguuugaaucuuagcacuuggauaaaggcuggauacauauacagauacgccccucugaccuuagcuggugagagagggagguaggaagaucacuguagagugcugucugccagccuagcuucagguucagugagagaccccuuuguaagggagcagaguauagagaacugauggauaccuaacagcuuccucugcccuccacauguguaugcaggugugugcacacugugcaauacaccacacccucacaugcagacaggcagacaggcaggcaggcaggcagacagacagacacaaaagcaaaagccuuuuuuguuuuuaaaaacauucaccuguuuucuugguguuugcuccuuaaauuacaaaguuaguauauaugguuaguaccucuacguaggagacauaagaagagguugucucucaucaguaauuaggaguguuguacuucagcuacucugagaaugaaaauacacaaaucaggacugaccgcuuauagcuaaacuagcucauguauuuucugcucuaaauguugguguaucagcaggccaggucuuuuuauugcaugauuaauuggagauauagaaguaacaguuguacugggcugcccauggccucuauauuuaaaaucuguguuuccuucucauuguuuuguuuguuuguuuguuuguuuuuaauaaaguaaaaccuggcaucccucacuggagaaguguugccuuacaugaugaaccaaguucuuggcugacacaagagacuuugagggauuucugucucauucaucuuuuguaugacaaaccacacagcacuggcaaacuaguugauaaaccaccagagugugacaccuggguuguccucugcucucugggcaggaggaaaccaggccaaugcaucacuaaggaacggguuucauggcuugucacuggcauguguagugucuugggcucagagcucagcacuagucucccuuguguugccaucucugagaguggaggaauguuucuauguuggcauuccagugcuugcuguguggaugagcccaguugggcugagcagauaugacuuccuuugcucucgagugaaacauaccaguuugaaagugugcuugauugcuuagcaaagcuguagcauucgguuucucaguucuugauguucggggaccugugcaaagcugagaaaccauugcuuuguguauacacgguguccaacagaugccacaccuacagugacccaguaucugcagugaaggauguuccugucagcccuauucuguaucaggccagucagcgucaggcagaguccuuuccuucuccuguguugguaguugggcaugggguuuucucuucacauuauuaaaacucccaucugcuuuuacuuagccucggaagacccagucuuccugggagagggaagggugcauuuuccuaaaaacagaagugguaaacauuugauguucaaauguuuguugucuuuuuacuucccaagcccugagcuauuuaacgauauuaaucuuauugcuuguaauuaaccuacauaagaaaacaacacaaauguucucaguuccucugcaguaggcuucaagaacaguaggacucuucaguuucucugaugccuacgaggugcauccuggagaugcugugugcccuggcagagcuaagugugcugcuugcaguacugaccaaagucaacccuagaucccagagaaaagagcuuuuugagcauauuaaaugucaucuucuucauccccuuuauuuaaaagaugggaaaaccuggugugaaugaaggcuaaauuuagauuagaauaauagacucaaauguuuuuucaaauguuaccacacugugcaugacuuccugugcugauaugcacagagcuucccuucuuguuaggacggaaaagcugcugcucugugccucugcccaggaaaccugccaccuaucaccuaacuuguggucuuucuccacugaggaggacacuucucuguagucagaaugcaacagugcuguuugaugguggcagugaugauggcaaagucaagcaaagguggacggagucacaggcugaagccuagugugguaagcggccacauguaggugccugcgagcugggugaauccucuggcagggcugaacaguuacaaaugaaagcaagccuguugccaugucugucuggccgugaggaaaacccagcacuguugcucuugucagauuuaaauuuguguuuuggaaugugugaugcuuaaucuaaagaaugaccuccucacccccggaaaaacaggaaguuugauguaagauugcaucuccuuaaagugucugagaugcugcuauacccaugaagucucucugacauggccgucuaaacaugaauugaacaagacacuaccacuagacaugcuaacguaaguggggaaggggucgcucuugaggccucgaaaggacuaugggcaacuaaggaaacugugagugggggaaauggucugacucagggacgagcacuccgguccauaccaaacggucaucccugagcacacauguacaagugauguuauacggacugagcaaguugagcuuauauauuuaaaacauggacacauauauguguaauuaacaaagaaaaagacuccacgagcauucaggaaaaaacaaaacagugagaaagauggggucaagucuugacucuccaggacuuguuuuuuuuucuguaaagucaaaucucuacagauaauguuucccaugacuuacaucgugucaggcuuggcgucucugugacggccucagugccuuggcaccugcagcggaauuguggcagggggcuccugacugcugaaggcugcagugcaguaucauugggagcgggcccuuugucacuccgccuuacauugcuucauaacuuucugguauguugagggccuugaaacccuaacaguuagacauuagaggcaaagacagacccuccaauaaaaagauggguuaagcucuacuuauuauauauuauugguaaaaccagaaagacauccuccauuucuguuccuuauuuuguguuuaucacuuagaacaguuaggcuuguguacaaaugagacaccagaauuugucccuagcuccagucuggagagaaagcagcauucauuugaaagucuagauuuguaaaguaaauuuagcucugaaauggcucagcauuuaaaacugcagcauagcacaguguugaaauuauuucuugugcuaggcgugguggugcacgccuuuaaucccagcacuugggaggcagaggcaggaggauuucugaguucgaggccagccuggucuacaaagugagcuccaggacagccagggcuacacagagaaacccugucucgggagggggaaaaaaaaagaaauuauuccuugaaacuuuuugauaggaauuacuagauagcaucugacaauuggaaaggucccagcauacacuaauuagcuuucucauuguugugacaaaauacucggaaugaauaaucuuggcgagaaaagaagugacuuaacucgugcuuugggauggcucagucccacugcacacugggacagagcuugcugguggaagacgagugucuucgucguggcuugacgcagauggaaagggggaggaggagccgggacaaggcaggguuuccaagccccucuguauagugacucacucacgacaggcucccaucuccaaauguuuccaggaugucccaaaguaauaccauuaguuaguaggccauucaauaaacccugucucgacccccccucccaaaaaaaaagauuucaagcugcagucuuuuuucaaggagcguggugaugcagcuuuccacuuaaagagcacacauuguagagcagccacaaugaauuguucucagugaauacuaaguguugacacgaccacuacacccugcccguccauaacaggcauuuggaaguguuugggggccacaugcuuccacucaaguccaggguacccucacugagaacaacuggcuaacuuccuguuuguuuuuaaguagugggguagccauuggauauuaacugcagacauuuaucuuagagcucgcaggcagcaugguucuucucgauggcccuaacugugaagcagacauccaucuguggcggugcauuucaucuguaggauagcuugauauaacguuguauuucaacguuccagucagugcuagauguaugugacuaguaccucgaagacaaaacccuccugcaggcuccagugauuaacguugaaccagccacccacucaucuuacuguagucugcccaguguuucugagugucagucuaaguauuuuaauugagauccagcugauuuauaaccccuuguuuuauguuucucuuuuauaucuaaaauuuacaagcuaugguggcauuuuuauccagugccacuaacgcaguacagacagcacuugaaacaaaaccaggcucuguucagaaacgcguucagucguguggugugcuuacuguuagaugccaggaugucuugucuguccuucagaggcuuuucauguaagcucucuuuggagugcaguagaguauggugggggaguaucaggaagcagccugucacucaucuccugucuggaacagaguccuauuaucguguccuuugacccccaucgagugauguaacuugaaugugaugugcuugcuguugacguacagguugaaggcuuaguccggagaguugaugcuuugcuucugugaaaaaguuuuccacgguuccacucaugggacccuagaaagaagaugaggaaaagaauucuugguuuucucuccagcacgcacuucagcucaagucugguugcauguucaucuuuuuacauuccaccauggcuugcuuucuucccgggcauuugggcgugucuaaacaaacugaacagcagugagcuggcuuguaugcaaaggccuguuacuguugggugcucuccucagaggggcuguaaucacgccacacaacuuccucccuggagacaagucagccccgcggagcagcugagaccacucuuuagcuugcugcccacaagggguuugaggguucuucuucuaaagaguuguguacagggggaggggaggggagggaaggggaaggaaggggaggggaggggcuguauuugauuccaggagaggaaucugacauguuagcuacaggaugagcugcaguuucucuggucauccauugaucaauuguucuguucacccaaccgucacuaaagccaaacuguaaaugaucaguccaggguuguguuuccacacagagccagagagcucaagucuggacucuuuucuucuuuuccuuuuuguguguauaugauguguaugcauauauuugcauguggauaggcacaggugugugcacaugcuugcauguguaugcacgagccauuguaaacuuuagguguggucuguaaguauuugcuacagugucuuaaaacagucuguuuauuuauaucggaugugaucugauacuuuuuuugcagguaggaacaaaucacccccccuuggaucccagccccccaccccacacccccacccccaugaagagacagugugcuguguuagguaaccagugacucuuccugauagaucacuucagguaucucuuccugucuuuucuuucucucccccagcacacaggaggcgagcaagaacuggcaggaguaagauuugcuuaaccugugcugccacucugugcugugggcaucccacucuuuguuuccaucaugcauuuaauuuuucaccaaaauggacuacucuuacuuuaaacaauuggugaauucugauaagcaaaugaacaguaacaaaaugagccagaucaugacaguugccauaaugccacaaucucaauuauucauuuauauuugcauguacagagcauucuuaauccaaaugaucaguuacauggcauaugcuuugagauuuuaaaagugaaaucaguguauuaugaguguaugcuguguuuauucaaacucuaggauauaauuuaauguauaaagauuuauaucauauguguguaucacuguguauguaacaaauaucccagaagacuuuucuauuucuguuccuauuguuacuacauauagcacucuggcuauauguaauauaaaguaagucaugugugugugugugagugugugugagugugugugugugagugugugugugugugugugugugugugugugagugugugugugugugugugugugugugugugugugugugaaugccuccauaccuauugcauuaaagcaaucauaucagugucugauggaguagucuggguauggcgucaucuggugcugugcgguucaggacgucucucaaguguaugauugcagggcugaccggguuaaguucuucaucagagagcccagcuaggaauggaucugcuucuaaacuugugcuugcuacagaaucuucuaccuaaagaguugcuaaaugugcggccuccguuuagaggauguuggcuucagguagcucucagugccuugccauuuggccuuucagugugccauuuuguuucagcaaagccagcaaggaaucuucuagaguugauguguuuaugcugccaaggaaaaaguauacuagguagauggaaauuacauuccucuguaucaugggcagguccccacucacguguguguguguguguguguguguguguguguguguguguaggggggcgcgggggcggcacuaugccugccaggaagcaggagccacugagaguccuucucaaugcacugucccuggaacauguuguagcugacacucacgaacauccuuuucuauuuccagaacuuaagucuacauuugcauuacuuagacugccccgcaguucagagaaacugcugcguuucccuuuguugugguuuaaaguccuuaaucuaauaggugaagugagaccacccgagucugucccuuucauggcgcugaucccguuauuuucagggucuuuguucccacuggagaugcgguccggaugucugccuacuauuuucuuucucaccaugagcuugcaggcucuuaagggucagccauuuaaggaugucugagagcugauugccaagauuuaccuggcauggcaucugucuguaggcucaccacaguccagccaccuguacgugucuggggaggagucuuagaaucucgccaguuucuuguuucucuuuauauguguguacacacauaugugugcaugugcauguguguacauguauguuucagaguauccuccagucuuucagccuauccucuacucugccuaguguggcugccuccagaccauguccuucacuucugccaggacagcuaccauguaccuuugagguaacauccuauuuuuaaccuucuggacuccucacaugggcuucugcaugucuacauuccccgguugguggugucuuaagccagaggugaugaugcagcaccuacuaucccaggacucagaagaaccauaacuuugagacccuaucucuagaauaaaaacaggauuggcgagauagcuuagucagcacuuagcaugaacaaugaagugaguuugauccuaaaaacucaaauaauaaaagaaaagcugggugcagugguauacacuugcagucgagugcuggggaagaggaggucagaucuccagggccuccugaccgagaaaccuggccuauaucuauccaaacauuucacaguaccugaaaggcugaguugaguuucaggacaggcagaucuacagagugagcuccugucucagaaaguuaaauaaaaauaacagcagcaacauggcauacuucuauuccagagcuggagaaggggagacaggaguaucgcuggggcucaggccagccagguuagcuaaucggugagccaaggcuucaaugagggcacuugucucaaaaacuacgguggggccagugagcuggcucacuucuguaaucucuccccuuaggaggcagaagcagguggcucucugagauugagguuagccuggucuauuaacgacuuccaugggggaaaggguuaguggacuuccaugcuggucaacagcgaaggaaguuaggacaggaaccuggagcgaggagcgacgcucacuugaugauccccauggcuugcucucacccugcucucuuaaaauacccaggacaccagcccaggagugucaccagcacagugagcugagcccucucucaucucuaauuaggaagaugcuggacagacuugcguacagccagauuuuauaagcguuuucucaauugaggcucccuccccucagaagacuagaacauauugucaaguugucauaaaaucagccagcacagagccacccagccuacgugugagagugccucaaaaauaaagcagagcagagcagagcaaaaccaaacccauagcagcagcagcagcagcagcagcaguagcaacagcugcugcuagaacaaagcauuaaggcgggcagugacagaggagaaaacccaauauggcccucugcccuccacacacuggaagguacacauguagucucucaccauggagacguacacacacaugcagaguuuaaaauuccuaaugauuucauccugcauagucuguaaacuccaggugcaggucgaaaaugcagucccauacucaugacgaacaacugugcaugguuuuagaaagcaauguuuuauuaugugcacauagguguauuuguuggguggauaucaguguucauguggagaucagaggacagcuuuauacucuccaccauauaagguucucauggauugaacucugggggauugucagguuuacguagccaacgccuuuacuggugagccagugggucagugaccagcccugcuuauacauuguagauaguacagguggcccucuuacuuuauauuuauggugagguuugugcaguuuucugaguaaggaccccaugaccugagugggccacauguugggguggaguggagcgcagauggguacaguuaugcuuggacacucauggauacucccugugugcagagcucaugugcugcuucugugcacaagauuggaggucagugggaggugccagaaagcuuuacucugccugcaguuguuacagugauucaaauauuugccauaauuuuagcaccuaggguguacauuauucaccucaccuccagucaacacuuucacuaaaaccaagcgucuucuguuccuggcuauguuuuauucuuguauuuuauuacuugugguggcuuucugaagacgugcucuuuuucuacgauaauaaucaggagucuuacucauuucuugguaacaaauccugccccauagggcugugugcauauuuacaaagugacaacuguuacaggccaggaccauggcuuagacauuacuggaauaagagaguccagugugcuaauuuguaucacaacccaggcugggcagguagcagucccaucucuguguguacuugcugauuagauagagcuuauugugaguguuacagaccaccccauucuuuuuuucuaauaaaguucugauuuuuaguuauuuuucuuuaacuucaaaucaucuugcugguucaacuuacucagguguucaagugcaacugucauauaguuccugaauguccucuucagccugcgcaucccugggaagcugaagaaaugaggaacagugugugagugugugcagcaggucgugggcugcaggaagacaucaaagguugcucagggggagcugugugcacauugacccgcaggaguuugcauucaaaagggauuucaaugcagaucacugaccuccagugcaugugcaacauggagugucccauggugcuuugcucgucacucuuuaaucuucaaaacaugguuuucacucauuucuggguacuuguuccaggcagugcuuagagcuccagguccuguagauaaucuugguagaacucauguuccuuuuuuuucuuuuuucuuucuuuucuuuuuuuuuuuuuuuuguuuuguuuuguuuuuccgagacaggguuucucuguauagcccuggcuguccuggaacucacuuuguagaccaggcuggccucaaacucagaaauccgccugccccugccucccaagugcugggauuaaaggcgugcgccaccacguccggcuagaacucauguucccaguggagcauagugcacaggugacucaggaaacagacaggaggaucucaaguucacaugcugccugggccaccuagugagaugccaucucaaaacuaaaacgaaccgguauggugccauccgccugaaagcagcauucugggaaggcagagacgaggaucccaauggccugaaccagugaacuuaggcaguugagugagaaaccuugucucaaacgauaaaguaggguauaauggaagaacacucgugacgucuacggcuggccuccacgugcaccccuuccacguguguguauaugaacaagagcagagcguguucccacacacuaagguaaacagcgccuggcugagcucacuaguggauuacuugccuagcaugcagaggcucuggguucaguuuccuguaccuuuccucagccccucaggaaggaaaacuuuuuggguucuuucuuacccugauuuuucccuacucuccaccccauaaacaacaacaacaacaacaaagugaacaauucuuuucuagccucuuuuuuacugacccuccucuuccaccuacauucucacuagaaaguaccauuugugugucuuacuuuaacaacauaaugcccaggcuuguguauacagcuuuccuggaaaagaaugcuauggauuguggccggugcaauggugucgaaguucuuccugggcuucugcuccccagcagaguggagccugcagccgaggcuccccgaggccuucagucugugaccugcugccucucacaugcagcugccagagaagccuccuaugcuucccacuugugaguuuagucugucucuuugaauguaaaugcagacaauacauuugcccuauaaaauuucaucgccauuuugagccuuccagcuuguugccaucuuucuguuguggccuucugugguugcccacguggaagugucuucaugccagaggaggcuguuaaggacauauugauugaauuggaaacuacagcugucacuccucucuucugcgucagaaaaggcugugacucaucuggaccagaagcuuauuaauaugugugccccuugcuguccuugguuugcuguaaguguacagugugcccagagagccccgcucacuucagugaaacccucagugugcugggcaggugcgcugggcaggugugcugggcaggugugcugggcaggugcgcugggcaggugagcugggcaggugcgcugggcaggugagcugggcaggugcgcugggcaggugugcugggcaggugugcugggcagguguacugggcaggugcgcugggcaggugcacugggcaggugcgcugggcaggugcgcuggagguuauccugagccucagcugcuugcuuccuucuuacucuuucuucugcuggcucauacacaccacugguguaaaaaaagccuacuucuccauuggaagcugugauuuguaagcagcaucucaaguugacaaacuggccuguggcccaaagcuggcuuuauccccuauuuucuaaauuguuuguguuuggcuuugagacagucucacuauguagauauagcccuggcuggccuggaacucucaguguaggccaggcuggccuugaauuuagagagauucccugccucuuccuccugacugaugagauuaaagaugauuaucaccaugcuuagcucucuuaauuguugaaagccugggagggggcagggggguaagaaucaacaaaagaugacuacuacugguauaugaaaaauauaugaaauucaaauuuuagagugugucaauaaaaugccauugaaaccaagccuuucccuuccuguggugucaaggccaguagcccuaagaaauacuuccugccuaaguuuuuagagaaagagcuggccuguuggagcaucaccuacugaagcaugugugggcaccccuggguuccugaacccuacccuaaaguacacauuucuaguuucuuuggagacucaguugugucaugugauuuuuuuuucuuuucuuuuaagauuuauuuauuauuauauguaaguacacuguagcugucuucagacacacuagaagagggcaucagaucucauuauggaugguugugagccaccaugugguugcugggauuugaacucaggaccucuagaagagcagucacugcucuuaacugcugagccaucucuccagccccugaugguuuucuggaaacugucaggagaggauuuuuugcugagagcagacacaugguaguuuucuggaagcugucuugggagacagcauguaacacuuugcugaaacagacacuugagggcgugcgauguuuaggaagagugaccccaccgugaggggaugcucuuguauugguugccguuggucuucuucauuguugccguuggcugacaacaaacacucaaugguugauuugccuugcuaagcuuggcugaucucuccuaaugaugcucuugcaagcuggucuucacuggucuuugucgugacucuauggagaaaaacaaggcagagaacuucuuguauucuguuugcuucuugccgcuuccguggacacaugcuaauucgguggagccuugugguuucuucuggaacaagccagggcuacugauucauguuaauauuuuaaacugggcuguugauauucugacgaugaagauuagaauugccccaaagaacuauuucuaaacaugucuacaccccaccuuguccuauuaaccaucuuucuccccuaccuuuggucggugggcuagaagggaaguuaaaguguuuaagaauccaauuagaguagguuuugaaaaaaucuaagccagaugguacugucagaaucuuugaaacuaugcuucaagaauacgcagacucuugaaacucacacccagaugcgcacuaaggauccaccuuggugacccaaggaccugugaaaggcaaagcugcucuauauguccccgccaccugcuugccucuuaacucguacauguaguaacuugucuacccacuguaugguuggucagauucuaagcucuguucugcauauuguggggagaaggccacauuaguuucuuuggcccacuguuaacauaauaugaaauacugucaggauaaacagggauuuguucuucuacaauucugaaaucaggaguccaaaguccuccagggcuguuuaccuuccugcccaggcaugccuccagcacucugacucugucucagcaacauacuguagccccaugccucuuauaccucuuuaaggaugcuucucacuagguuaauaauccaagaugacuuccucaagaagcuuaagaguuacaacagcagaaacccuuuuccaaauaagguuauuacagguguggggauuaggaugugcccauagcuuuggggccaccauucagcuugaaacuaaugccauuaaucuuuaucccaauaacccgccuaguuccaaguuguaaggauucucugucuccaucucuaggcccgcuugugccauuuugguuucauucugccaugaaaaucccuuauuuacacauuuaugaugguuucccacuugggaagcuuuagagugugugucuaugucaggaauugugcucucugcaguaaugucgccuccacacugucauuuccagccccucuucgucccucuggccacacugcuguauguguccuuacagcucuggccguccgccugagccugcaaacaccacccuuccuucuggaagacaggcugugccuacaucuucauuuccugcuccuacgagugcagucuccugacgcauacauacuugucagagcugguuuaacaaugaccuucccaugagaccucugaugcuucuuuguguugugugugagucucugugcuuucugcauacucuucugucucugaaugcauuauucuggcuccaagugcccgacaucuguaagucagggacugagagagacagugucagauuaagagccucuaaauccaaccccaggacuuuaagugacacuaaguaaauguguguauuuacuauacuaacuuguaacuaccuauacuguauuuauuuauuucaaaccugagaccacaaaguggccacaaagaauuuuucuguuccgauacuguauuuagaaguuccaauacuuaagucaccaguaagcauggauguaaaucaaccaaccuuucucauggaugucgguauuguuagcaauccaguuuuguugguuuugauuauauuccuuuucaucaagcaaugaauugaugauuaugaacuggcucuauauuuacugcuuacugucauacaaguuagcuacagccaaagagucaccuaccugaggucaccacugagugcagacuuucugaagcccauuaaggggagcagaccagugcuccugccggaugauaguaguauuuacccaggagauuuacccugugauaaaugccuuaugaaggaucauuuccugugacuuguguucuaacaagugcugcugugggguuggcguuucugaacacauagauggcuugccaugaugaaagcaugugcgcaguuccguaaggcucaggauggagcagcugaggagguggguacccuugggaugcuaagccaguguuucuaaagaugauuuggaaugcaucuuucaaaacaugugauccuaggcuucauggagggaagucacauguuaugugagcuuucaagucaucgggucuacguauccugaaagagucagugagcagagcucaggacgagaaucagucugggauccucucaggagcugcugcccugugucacgaagcaaggacuggcucuagugcugagaccacgcugcugauaaucucauucuggcuuucucccuugaggugcaggcuguguuuuaaauguccguuggcauuuuuaauaugcacaaacccacagcuaacacgugacuucuguuuguucuucacuuucuaccuuggcucccaugugcgcugucccaugauguuagccuccaaggaguuuagcuuguaauauaguccacccccacacacugcauuaucaauaaaaacaauuuuaaagacacaguugucuuuaaaauuagucuuguuucaucccagcuauccacugccucacaaaaacugggguuugcugaguagauuguuuuccugucucccuaaccuuccgucugcugcaggcucugaggaccugcuggcugaaagccgcugcugucuggauuuagggacuaugugauggagacuucuuuagaaguggccaaagcugugucccagugucugguauaugacauuguuuguucaucugauaugggaccacccaugcugaaacaacaacagcuaacucuauguugccacaugcacauuuccaauugagcuuguucccugccucuguuucucugacucucuuucuuaccuguuauaagcuaguaauuguuuugcuuuuuauuuuaaguuuaaacaagacuuuccccuuuaccauuuguggucaucuuacuaaacacuggaauuacuucuguugguuccugucauuuucuuaauuccucuagguagguguuacagucagcugaacauaacaaugucuauacagaguuuuugcuccucuuuuuuuuuuuuuuuuuuuuuuuuuugguuuuucuagacaggguuucucuguauaguccuggcuguccuggaacucacuuuguagaccaggcuggccucgaacucagaaauccgccugccucugccucccgagugcugggauuaaaggcgugcgccaccacguccggcuuuugcuccucuuuuuaaaaggagccagcucuguguuccuugucuugacugcagcucuagcauuaggacagccgcuccugcuggugccaugugguucuaaccgggccauaggcccaggaguuuauacuucuuguuuguauauaauuuccagagauacucuuucugagucuggcuaaugacugugaggaaaugcugcugcuacuacgugauucaaaggaaagauaguuuugauguauuuuuauuauuuuaaauuuucuauccaucuaucuuauuugguuuuucuuuaaaaguuuaauuauauauuuauccauucauuuguuuguuauauaaggauguauugagacaaggucuugcuacauaacccaggaagcauucaaucuugucacccccugacguagcucuggauuacagacucuggaauauaccaccccaguuuucuuugccugaacugugccucugcaguacuucuguuuuagccacugcauguguaaugcaaacuccuaugugcugugauauagaucagggcgcuggggaacaucuguggggugggggauugaaagggaggagcuagggcuugggaaacaucagggcaaaaggagccgcccugugaagggugacaguuacaucagguuccaauuugagcuagggccacacaaagaccaguaauagacuaagcaauggaauggcaggugauacccagcccgagaaggggauacauguacagcuuuguuuccuaaagauaaaaauauggcauauaggagucacccacaggaaagaaugaaugacuggggcuacacagcuugguuugaacccuggcuccugcuugcuuacuaccugucauagaugcuuuacuguuuugacugcuuuaucuacagaugacacauucaauuagugauucccaauuaguucuuuuuuuuaaagcuaggaagugaauguugggaaucuaaauguugcuacugauuuggaugguaguauagaauaugaugaugcuaucacagucaggggaaaaaaaggccuagaaaauauaaaaagaaaaaaaaaacagaaucaaggcuuugaugaauuauuucaugagauuaugguaaguuaaacagaccacaaaaaaaucaaaguauuuaaccauauaaaauuauaacauauuauuagcagauauuaauauacugauuuggaaucaauuuucugaaaauccccacaucccagagaggaagugggcaacagucaagagcaggcaacucaucagagaaauagagaaauguggguaaagccucugcaaauuaccagugcugauuugcucccgagcucaggcuucagcugugggaggcuuaaagaguguaacacgucuaaggauacaucauagugaucacugacucuagcacucugccuuauagacugagcuccaaguagguguaggugaaaaauguuguacuaaagacuugacaauuauguuauuaaugagagagaaacauuguaauaaugggcuacuuagaaaauugugacaugaugacccuuccaaaggacugucaugcacccauuaaugaugaugaugacccuggagauagaaaaucuaggaaagagaucaggagucauagacgcaagcauagccaacagaauacaagagauagaagagagaauuucagaugcagaagauaccauagaaaacauugacacaacagucaaagaaaaugcaaaagguaaaaagcuucuagcccaaaacauccaggaauuccaggacacaaugagaagaccaaaccuaaggauaauagguauagaggagaauauucccaacuuaaagggccaguaaauaucuucaacaaaauuauagaagaaaacuucccuaaccuaaagaaagagaugccaaugaacauacaagaagccuacagaacuccaaauggacugucccagaaaagaaaguacucccguuacauaauaaucaaaacaccaaaugcacaaaacuaagaaagaauauuaagagcaggaagggaaaaaggucagauaacauauaaaggcagaccuaucagaauuacaccagacuucucaccagagacuaugaaaaccagaagauccuggacagauguuauacagacacuuaagagaccacaaaugccagcccaggcuacuaaacccagaaaagcucucaauuaucauagauggaaaaaacaagauauuccaugacaaaaccaaauuuacacaauaucuuuccguaaauccagcucuacaaaggauaauagauggaaaacacuaacacaaagaggggaacaacauccuagaaaaagcaagagaguaaucuuucagcaaaccuaagggaagauagccauacaaacauaauuccaccuccaacaacaaaaauaacaggaagcaacaaucacuuuuccuuaauaucaauggacucaauuccccaauaaaaagacauagacuaacagacuggacauguaaacaggacccgacauuuugcugcuugcaggaaacccaccucagugacaaagacagacacuaccucagaguaaaaggcuggaaaacaauuuuccaagcaaauggucccaagaaacaagcuggaguagccauucuaauauugaauaaauucaacuuucaaccaaaaguuaucaaaaagauaaggaaagauacucauacuggucaaaggaaaaaucuaccaagaugaacucucaauucugaauaucuaugcuccaaaaaccgcacauucauaaaagaaacuuuacuaaagcucaaagcauacaucgcaccccacacauuaauagugggagacuucaacaccccacucucagcaauggacagauccuggaaacagaaacuaagcagagacccagugaaacuaagagagguuaugaagcaaauggaucuaagauauuuauagaccauuucacccuaaagcaaaaggauauaccuucuucucagcaucuaauggaaccuucuccaaaauugaccguugacaaaacaggccucaacagauacaagaagauugaaauaauccugugcacccuaucagaucaccacggacuaagguugguuuuaaauaccaacaaaaacaguggaaaacacaacacacuacucaaugauaacuuggucaagaaagaaagaaagagagagagagagagagagagagagagagagagagagagagagagagagagaggaaggggaaaggaaaagaagaaaaaaaagaaagaagagaaaagagagagagagagagagagagagaaaagaaagaaaagcaagaaauuaaaggcuuuuuagaauuuaaugaaaaugaaggcacaucauaccaaaaugggacacaaugaaagcagugguaagaggaaaacucauagcucugagucccuccaaaaggaaacaggcaguuacuucacuggcagcuuaacagcacaccggaaagcucuugaacaaaaagaagcaaauacacccaagaggaguagacgguagaaaauaaucaaacucaaggcuauaauccaccaaguagaaacaaaaagaacuauaugaagaaucaaccaaacuaggagcugguucuuugagaaaaucaauaagauagagaaucccuuagcuagacuaaccagagggcacagagacaguguccaaauuaauaaaaucagaaaugaaaagggagauauaacaacaaaauauaucuuaaaauaauuacucuguuuguugaauauuaacaauugaaaauauuaaauucauguucuacaagcaucaaaaaaagaaaaaauauggaaaauaaaugcauauaauaauacaaaugauaaagauuuuuaaaaacuuuuuccuuuuuuuuuuuuuuuuuuuuuuugguuuuuggagauaggguuucucuguauagcccuggcuguccuggaacucacuuuguaaaccaggcuggccucgaauucagaaauccaccugccucugccucccaauuuuuuauuagauauuuucuuucuuuacauuucaaaugcuaucccgaaaguccccuauacccccccuccccuacccacccacucccacuucuuggcccuggcguuacccuguacugaggcauauaaaguuugcaagaucaaugcaaugggccucuuuucccacugauggacgacuaggccaucuucugauacauaugcagcuagagacaagagcuccgggguacugguuaguucauauuauuguuccaccuauaggauugcagaucccuuuagcuccuugaguacuuucucuagcuccuccauuaggggcccugugaccuauccaauagcugacugugaucauccacuucuguguuugccaggcacuggcauagccucacaagagauagcuauaucaguguucugucagcaaaaucuugcugacauaugcaauagugccuggguuugguggcucaaaacuuagaauacucaagauacaauuugcaaaacacaugauaaagauuuuaaaaccaaaguuucaaauuacucuuugucaucuacucagauucccccccucccccauuuguugauuugcgccuguuaucgucuugagaagcuggcgcagaagauugcuguacauguaaggggcuggccugugcuacuuauacucagcaagccacuguuucaaguuaacaauaguuucaguuuaaugaauagucaaguaauaaaugcaguaucuuuaauacucuuucagcuugcugaaguccaccuucuguauuauguucccaaguccaggaggaaagaugguuagcugcagcuucccuucuuaggcaguaccugugaauucugcauuucucuguagaguuguucacaaagucgaaagaguguuucuuguuuuugugaaagcagucuucuuuccucauguuuccacuuugucauuauuaccacacucugagcacaccucgaagacagugacaggaagcaacuucauucgggauauuugguggcugcucugaaauuguugccuaccuuaauaugcccccuuuuaauuacagugugcacagguuugcaagucucaguucagugaagaguagcuugcugacaguacuuuacucugcgcuuggccuucaagcccucugcagaguucucaaugcucaccauuacagauacagccggucuggccagugagauggacagccauuagcauccgugcugcuacccagcugcguguggaaagcuauugcauaucuucauguaacuagaaaaggaaucaaaaaucacaaaauucacaaucuuacuuauauacuuucucaaaauucuuugcuguugauguaggcugaauuuuuuuuaaagcaagauauuuuaugcuucauaacuauagcaagaauauaaacugcuguuuuuuccucccucccucccucccucccucccucccucccuccuucccucccucccucccuccccucccucccuccccucuuccuuuucuuuuuuucuuccuuguuaucucucagaugacaagaccauuccauucggggagacuguguagagcaguguucucuauaguucuacuaaucuagcgcuaaagucucuagagagugugcauaaccaugcuaaugagguguggagaagacaaaagacuggccagaauucuugggucacaaguuuccuuucggaaugguaaauuccuggguguucauuuuguuaugucgucuaagcugaagaagcuugccagcugaaacugccaagcuccaggaaagucugucuuugccagaggugaauccuagcgaggcaaacucuuacacggcaucuacuauguugaacagcacagaguauguguggguccauccugccugugccagaagaaagugugggagccuagaugucugcucucugaagccaugaggaaaccuuccagcacuccagaaguaaagcuucguguuuccucccugcugggaaguacggauuccauggaccucacauaaaacucaagucggccucccugccuacuguuggcaagccuaaggggaccugggcuugugcccaaccuggcagcuacaaggcaguauucuccacucccaagacagcuaguucccauuccugccuuacuuuucuauugcugugauaagguagauugccacagccaaggcaacuuagggaagaaagagcuuauuuggaguuuacaguuucagaggguuguggucuauaccaucacggcagcaggcuggcaggcaugguacuggagcacuagcugacagcucacaucuugaucugugugcacaggcagagagugauaacugggaauggcaugggcuuuugacaccucacagccccuucccaccccuaucccaacaaggccacaccuccuaaucuuucccaaacaguuccacccacagggaagcaaguauuuaaaaauaugacucugaauauaucaaucaccgcagugcccaucaaaagauaaacggugguguguguauacacagugaaauugucaaagaagaauaaaaucauguaauuuguaggaaaguggauuaagcaaaauaaaacaaccagaaagacaaauacauguuuucucucauauauagaaucuaaauuaagggaaaaauagugagagaauggugagccauuugggaacaaaaaguagaccagugggaaggagaggggaggcgagagaugaggaaauauguacaaaagcacacauauauaugaaaacuuaugaaacucaugaucuuguacaauuaagaggcacuagugaaaagcccaaauaaagaguuuucaauaacauuuagucucacaacuuugugcaaaaaauggcuuuaaauaaaaaucacucauaauacaaaaagccaggaugaucucagacugcacaguuuugaucaggcaaaccaacacuaaagugucagagauaugugaauuauccaguguguuuuaaaggugcuagaaggguuucuguuaacaacuaggaacauacuugaagcaaaggaaagauggcucagcaagaaaauaacuucuacugagaaaccucagagucaggaaagagcaaacuauuucucaugugcucaaagaagugucaaucuguccuccauagccagagagcaugcgcuucaguaauaagucgcaagucagagcauccucagauggaggaaugugucccacuagaucuaucugaagguaacgucugaaagcuauccuagaagaaacguuggcaugucaggaaagauagguuguguggcaugcaaaaaaaaauguguguaaauaaaauaggucuccuucucuuaaauguacuaaauuauguuugguugaaacagaagauaugguaucugguauacuaggcugcauggggaaaacaucuuaaauaauugaagaaaaggaaagaaagauguaagccaagacuucauauuucauuugaacuaggaguaagacccagguucuaauaagguagcauacaguuaauguaauauccacaucagcaaaaaucuguacaaacuauggauaacuaacaauaagauucauagcuagaaggugaaggcacagaccuuuaaucccagcccuugagaggcagaggcagguggauuuccaaguuccacaccagcuuguucuacagaucaaguuucaugacagccagaaacaaaaaaccaaaaugaaaaaacaguaguaguaguaguagcaguagcaguagcaguagcagcagcagcagcagcagcagcaguagcagcagcagcagcagcagcagcagcagcagcagcaguagcagcagcagcaguagcaguagcaguagcagcagcagcaguagcaguagcaguagcaguagcagcagcagcaguagcaguagcaguagcagcagcagcaguagcaguagcagcagcagcaguagcaguagcaguagcagcagcagcaguagcagcagcagcaguaguaguagcaguagcaguagcaguagcaguagcagcagcagcaguagcaguagcaguagcagcagcagcaguagcaguagcagcagcagcaguaguaguagcaguagcaguagcaguagcagcagcagcaguagcaguagcaguagcaguagcaguagcagcagcagcaguagcaguagcaguagcagcaguagcaguagcaguagcagcagcagcaguagcaguagcagcagcagcaguaguaguagcaguagcaguagcaguagcagcagcagcaguagcaguagcagcagcagcaguagcagcagcagcaguagcaguagcaguaguagcaguagcaguagcagcagcagcagcagcaguagcagcagcagcaguagcaguagcagcaguagcaguagcagcagcagcagcagcagcagcagcagcaguagcagcagcagcaguagcaguagcagcaguagcaguagcaguagcaguagcagcagcagcagcagcagcagcagcagcaguagcagcaguagcaguagcaguaguaguaguacacuauauucuaauucauaaagcaaaccucaaaauauucuaaagacuaaaaucauauaaaguauguuucaugaccauaguaaaaauugauuauaaaaaaagcuagugugugcugcuggggucaggguggggcucuagcacacaagccuagcgugugguuagcauguagagacuaugcauuucaaucuccaacaaaauaaaaacaagaaguuccacuuauuugauuucacagaacuugcuggaaucucuuaagguuucuaguuucaucacaggcaucuuaucuugcugggaaagaaauagauucaaggugguugauuggcucacauguuuuagagaacugauuuuuuuuuuuuuaacauggacuguauguuguucauguaguuguagggcuuaucauaacauccagcuaguagauguuagauuuugauagacuuuaggugguagcaugaauggaugggauagucgugucgugugcccauguggaaauggguagauguuuaacagcucauuacccagaagaaaacccgaaaccgcccguuggauacacuguaugugucucuuagccaauuagcccacuaugcaguuggaaugaggugguagcaauugccugggaggagccagcaugagcuggucgccaucagcugaggauggaacugauuuaaguagucauuagcucaagucuuuauuuucugaugccagacuuguguagucuauuucaaacuacaaugaaaacgugggccuuggguuacugcucagucccuuucgcguuauaucagugcagagaucuggugagaaucaggaguuggcauaaaauaagcucacagcuuuacuagaaaggaaacuaacgacuaauaugguuuauugcugugcaauggcauagaugacaguagcuuacugcugucugacucaggguaagcugguugacuuuccuugaucaguuguuuucuuuccucuugaugaugauugcuuuugagagauguacuccaaaggccaccaugucuaaaggaagccuuacuuuuguaaggaaugggggaaaguugccaggguuuuugcaccauggccuuauuucucaauguagccaugucauuugguccugaggacacagaaagcauuuuucccucacucugucuacagcugcuacaaaaccagccccaaagcggugccucagugcgugcccucgggccgcagucuccucuugcuuuggcaggguuuauuccauccaaggauugcugugcaguuuuguugccauagagacuucaggugagcuaaccuguacaagaaaaccucaggggauccagucuagugucuucuaaagcugcccaugaucaggcguuccacauauccuuacacucugcucagugugucgaggagaccuggcagugguggccugaugugccuggcuccagaguaucuugagaccauaguguagaaaacaggucgagggcugcauggaggagguagccggucuggaacauuaguuaacccacgaaggauuguuuacuuuggggcauucaaucguaacugcucagugacacuaacaaguuuacaaaaagcagacgacaaauugcuaaaugagggcgucauugacucccgucucagacaugaaggaugaccgcuuuccgucuccggguuccgucgagucuuuggaaugcaaugucacuuucacgacuaggagucacacaggaguggggaaaaugaagcaguuuuguagauuuaaaaaaaaauuuuuuuuaauuuaaucacuuuuauauguauagcaaauacuguguagucuagaacuuacauugaaccacaguacaauagugucaguaaauaaacacagcccccauaaaugaaacucaccuaacaguggugaccauguguuuuaguguggcaauguugagagcagacagacauuucuauguguuaaauuaacuaggcuuaacuacuaugaauuauuagucaaccaaguuaauuacaggucuuugagaaaugaaagguuugugagaaaucuuaaaauaguggucaaauucucuaagccucugggauguucuggaaccucaggguaccaguauauuacaguggucacuggaaggaaucugaaaggccagguuucagggaauccuggugucaaucuucguccuggaaaaggacuucccucugugguacaguucccucacaagugacauucaggccucaccauccaggccucaccaucccugggcucugaguuucagcagucagcugaaggugguauaauuuaguaauuaaauggucauuuaaaaauaaagggccuagacaggguuucucuguauagcccuggcuguccuggaauucacuuuguagaccaggcuggccucgaacucagaaauccaccugccucugccuccccagugcugggauuaaaggagugcgccaccacgcccggcuaaguuucuuucuucaauuccaaagguaagacauagcaaggcuguaugaccccauaguugugcccuugaaugggggcauauggaaauuccacaacacaucaaaaaucuguaaggcugagaaccacuccucgguauguaccugagaacuccagguuagcacgcaccaauuuccuugcuuccuagguagucagcccuggaguccaucaguggaggggucagugaagcagacuagucuauguacauacaggaguguuauugggccagaagaacaaaaccggaacuuuugcacgaauguggucuggaguguagacuauguuggguaaaguaagcaaaauuuauauagcaaaauuuauauagacaaacaucacguuuccccucaugugaaaaucugcgcuuaaaggagaacagaccagugggaagaaggaaacuagagaauaaugacaggucuggggcaggaaguaugaucaaaguaaagaaauacauggaagaaaguauagcaguugcuuuauacaauuacuguauaucaauaaaagcugaagaaagucagcacagcugagcaucugguuucuuggguacccaaggccccuagugagcugguucuaacgucuuugaugcccagcaugccagguugugaugacucgcuguuaauggaugccaaguacuggauggaugagagcuugucugucucguuaaacuguaucagaccaucuucuagccagaggaaugcagagucacacacuugcugggggcuuggaccuguguuaaccaugacuaaggcuaaggcaccauugcauuacaauggcacuguuguccauugacucacagagaggaacuagcugauaaacgugcaggaaguugauugguuauaagaugugccugauuuuaagcagaucaagacugugccuugugugauggggaauagaugacgucugaggaugaccugccuagcugauuuuuauuugaaauccaagugagauggcauucccacgguauucgguacacaguaccuuucacacaacaagaaccgagaaaagacgagcuauguugugauugucaguuaauagaugucauccucaaguuccuaaaaugagcuauaauguuuugggguuuuuauuuuuuguuucuguuuuguuuugguuuuguuuuuuugauauuugaaacuggauuuguggaauggauguacaaggcuacugucagucuuuguaaaggacuggguuaucagcaaaaugacuguaucaagcaugauauauaaugaccugcaguucuaucugaaaugcuugaugagugugacacuugacaaaggcccuuugguggaacauggcuucccacucuccaucucucaagugaagguagaauaaaggcacaaauuaugcuuaguggucgggcagguucagaggcgcuuugaauacagcucuguucagcuugccugugccugugauaacugauaauuuggugacuggcugacaauuucucugcagcgaacugaaggaaggccuuuauucaugagcaugaggcuggcaauacuucaaagggcagagaagaaguauuugaagcaacaugauaccaaugcaguugcugcuguaaaacucgguuagaauagagcacuguaguaagccagagccuggccagcgaggauagcugcuaaccggcugcaaagccuggugcgccucagcguaagcaaggccagcuggccacucauggagaccugagggcugugaaaacaccauccugucuuccucaucgcacacccacccuuacugcaguguuguuguguaggcagccuugugacucagaaacuagugcuugagaaggaagucccggacuccucacugaucagcuagaugaauacuguuuaaccuuugacagagcaguagagcacugccaaacucgaaauguuuuagcaaaaauuaaccuguuuugcacuugucaaaacuaagccccaugguccauuaugaauacggcagguucuucugggugguugaguugauuuccagguccgguggcauacguuacuagagacagggaaguuguccgagcuaggugucuuaguuuugcuucacaccuggggcaggguggggcuucuuuacucuuagcucuuucacaugcauaagcacgggaaggaggccagccuauuacccagccuguaaaguggagacagcagcaaugcuuccuggugaaauuggugcucggcuaagaggagacuguaucuuugcaauaccucaugauguuccggugccuaaugacugguaauagugccguuaaugagaaauucauggguucaucugccacggugcagagagacaugaugugaugcucuuaggugugauguucacugucaaugaaccuuucuuucugguacaugaaagauuugcguuucugauacagguuguguguccuucaaggggcccccagggcacuguagauauucagcuacguuuugcuacauggccuugcugauuaaggauacuguuaugcgugcauuucuucuuugccuaagauauuuuauguucugggacagcauuuugaaagaaaguaaccccauuauaugaaggcaugguucucagagcugcacacugacugcaucacugagggggacaggaagcagcuggacaccugcguuccucugucagagucggacugugugaacacucggugucaagagccacaggcuuggagaaguuagcugugugucucucgucucuuggcagucuugucuguccuuccucagaccuguucuguucuggguuagucugaaguggucugugugaccugaguuucaggagaggugcugagaagaauugucuguggaagucgaguagaugaaaaucucagaccugcagugacucacccaaacuucugauggaauacuuaugguuugcuaauuauuacuaauugauuuuauuuuuaauuaacauucaaucucggcagcuuauacugaguuugcaugcuugaacaacagaggugugcuccugccauuugcuuuguauccacugagagcucgggacagugagggaagauaaguuagcaccaacaacagagagcgagcaguuuccccucacaccucacggacugcugcgcaccgucuggccauaacugacuuuagcagagcucaguugacaguccuaccuuagaucugggugccaguuucuguugcucuaacacaauaacccgaguuaauuuguaaagaaaaaaggucagugcagggucagcuggcuccaugcuuugggcuguggguggagggugggguggagcagcucagaucaccagccaggaagcagaaagggaaaaggcaagauagauagauagauagauagauagauagauagauagauagauagauagauagggucagcaucucauaauucugucuggggcagucugugaagcggucuagcacucauccaugggcucugugugggcggcaccucccaguagugccaccccgagcaaccaaggacugaaggccucugugcauggauuccaggaacaguuacaccagagcagccaugagggagggaaccugugagcaguuuuaagucuggagcaccaaggauauuuuuauuaagugcuuuuguauuggucaauguacaaaauccaaugcaggaaagaaguauuguacagacuucccuggagcucucagaguucauauuucaugucagaugaagucacuucacauuuauacauacuaguuaguauuuucaaguuuaagaagauuuuuaaaaauaaguagucaaguuaauuuuuuguuacaaucuuaucauggaaagcaugacagcagcgcuguagauccauuuguucuuuccuuuugcguauuucuuacacugguuaaagugacucugccuuaguguggaggaagugcccagaucacuaacuacccacccugcuuggucccaccuucaugggcagccucaccugggcagacguuggguggggaguggucaggagacauuugauuuguuuguuucugauaauacagugugguguuggaguguuuggagccggcaagggagaccugcagcaguuugcucuaggcugcaugccucugugccuuuguaugccauuucucuuccuugugguggaccugcaucaugcuggagagcaagggccugcccugggaggggugcagaggcucugcgggucuucacagcuuuucccaucagcucuguagcaaguuuggggcuuaacuguucucugggguuacucugccugggaaaguugacagcccuagcaugaauuguauuuuuuuguuuguuuguuuuuucaagacaggguuucucuguguaguccuggcuguccuggaacuuaccaggcuggccucgaacucagaaauucgccugccucugccucccaagugcugggauuaaaggcgugcgccacagcugguguuauuuuuuaaaauucuaaaacauuguggccucuguuucauugcuuccuucuuuagcaaaugcucccuuagagagugaaauauauuuuccucuuuagagugggggagggaaaaccuucuucauagcuacauccgucccugcugcuuuugcggaaagauugauauuugacacagaaaggcaucaacaaugaaagcuacauuuaacuucgguuguuuggacugagcccuggaacaagaccaaaccgguuucucugucaguguguguguguguguguguguguguguguugucugaguggcacuaagcccagaaacauguuugcauugccaagagauggcucucaauacagugugugguggggaagacugcuuccucgcgccggcaguuggugugcucugugcucugugcucgccgcccuccaggaggagguuuggcugggcugcaggcugcacugaggaaaguagaaacaggagcccgggcagguuggcuuugcacacgcggcggcuccagccaaagaaugcagaucaaccuugcuggcuguuuugauuuuuucagauuuaggaguguaauuaaacacacagcaguggccagcuuugagggacugggaaagaagcacuguacgggugguguuuaaacacagacuguuuauaaaggugugaaaacaccccugcgaugcuuuguguuagcucgccucccagccagcugugaaaucugagcccgucucaccuguccugcagacagcggccugcucuuuaccaguuuaaaucuucuccaaguugaacagcaaggggccgguggggccuguggggccuguuugagagcacugaauuuaaagauugcuuucgccagaagcagagccgggagccacaaagaaggagguucaaacccccugcugugcucuugccuuuagcaauuaaguaaaguagacucugaaaccucagcuccuaaacccgacugccccgaggggagggacggagggagcugcuuugauuguuguuuuggucgagguuuuugguauagguuugccuuaucucaguuuguuucuucuuuuuaucuuuuuuccuuggcagugaaaguaaagugacacguuugcagauuaauguuguuuugauuuuuaugauaaaagcuuccuaugccucagaaaauacugcaaaguagccaggccacauuccauaaugaaaucaucugugcuggauguauuacugaggagcaguuaaacucagcauggaguugguucuaaaccuccaggcuucauaacaagagacuauaacuuaggaacaaagcugcauugcaguccagaaacaaacagugacgugugaugguugagcaaaaacuuacaguucugaccucaaagggagaaagcuuauucuguagacaaauaugaaugagcguggcccgaggacacauuuagguuaccucaaauuacuuguucucacacggaagcaguuuaacaaagccuuuguacuaacagaacaaagccauaaaucaagacaccuuucacagacauugcuggggacauuaggugggcagguugaagcagaguggagguacuucugcuggaggccucccaccuuacguaaugacacuguuagccuuuugguuggugucuuaguugggguuucuagugcugugaagagacaccaugaccacagcaacucuuauaaaggaaaccauuuacuugggucuggcucacaguucagaguuagcccauuaucaucacagggguaagcacgguggcgccaaggcacacaugguguuggagaaauagauagccgaagauacaccuggaucagcaggcagcaagaaagcccacccuggugucauacuuccucuaacaaggccacaccuacuccagagagagcacaccuccuaacaggaccacgcccugugagucuuuggggccauuuucauccaguuaacucucuuugcagcauguuucguggagaugcagcuucuuuucgagaaccuucuuucacaugcugcaugaagcagcauauuugagcaucagugucaggggucuucauguauacuacuacuaucuucaagacauacuucgaaaacaauagaaauacauuaaaggcccuuucuccauaaugauugugugauuuauuuuauuuguucuuuggaucuauggauauacuuauauugacaagucauccuguauccuuuuaauguuuuaaauucaguuuguaaauauuuuuauuggugugugugugugugugugugugugugcgugcacgcguguagcucacaggacaauuugggggagugguuucuuggagaaugagcauauuggggaucaaguucaagccauuagauguuugauaguaagcgccuuuagccccuguacuggcccuaccuacagucccucaguuugcuagugagugccuuuagccccuguacuggcccugcagucccucaguuugauaguaaacgccuuuaaccccuguacuggcccuacaaucccuugguuugcucacauuuguugaggacuuuuguauuugagugcaucaaggaaauugaacuauuaauuuccauacugguuuucauguuaguguaacacuggcuuuggaaagagagugucuaagccuuccuguuugauaaagcauuuuaagaacuaugucuuccaguuuuuaaucuagagucuguauuacuuucaugccucuugacaugggcugaauaauacucccuucuguuccuaacuuugucuuccagaagauucuggggagcuggaaaagauguuuucaaacuccccagccuccuuccuuccuccucucuuuucuuccuuccagaguuccacgucuuucccaacuaacacauguugcccuugggacucaguguuuaucuggaacuuucuccagcucuuucucuagccaagcaagcuuguuuccucccuugcugcuucugacagucacucuccaugcccuagccauuuccagucguccaaagauguacauuuuacacagcgguuucaaauauugcugaugaaguggugugcaugcacuggaccucaggaaaaccuuccagagcccaguuagcacuccgaagucaaauggcccgcugcuuacauuggugccgggguugaagacaccagugccuuguugaucugucuguucagggaauccaaaagcccauugaucucuuuucacuagacauuuccuugcacagacggggcuacuggguguguaugugaguuuccacucugcccuacaaggggucacguuuauacagcugugaccuuguccuaaggacagacacauugugauuuugggaagggucaucucucuauuauauccugcuuucugacaauccaggaaauaccacuggcaucuugcuguaacugggaugcuucugaaaauggaaagugagauucacauaagcuuuugcaguuuauaggcgugcucuauugaccacuuagacagccccuacaagugaugaaagcuuuaaacauccucucccaccgccaaguuauucugaucugggacaaggucuggaagagcucuugcuguugaaggauuuccaucagccugaguaguucuccaaugacaucuggaucucuguucauuuuaaugacauauaugggaaaagucauuuuuaacccuuugccuacuccacacuuguucuacuccacacuuagacugugucagaagucuuaaggcauguaaaauaaaauggcagggucccgccggguagcucagcaggcaaaggugcuuguuaccaacaagaugccagcuugauaaacuugagcuucagccucagaggcuacguaagugcagaaagagaaaguuuauccacagaguuguccucugaccucuacauaccugcuauguaugauauccauauugugaggguugaguacacacacacaccaaaccuuuuaacaaauucuaauuaaugugaacugaguuauuuuacaugcuauuuguacuagaaucucuauuuaagucucacaaauagaacuuuucaauuaaacugaagacaaaauauuaugaaggcuuuggcgugacccagaguagcagacaucuugguuccuuugggaggucugguucgugcucugaggccaguguggccuaccacggggcuaggccauaaaauggauuuagcaagccccaaaacuugacuagacgucagaauuggccccaggugacuaaaagcaauucagucaauuacccgauuucuucaggcagaaccuuggaaggacuggcaucgaggaaacagauguggaaagcccaaagcgagcauauguguuaggaagucagcauauugucaaauaguguaaacuagaucuaagauuucacaacaguuuuccaacuuaacuugcuugccccuaaagugaagcaagcacugcuucauggcacagaagccuccaugggcugcaggcuaccuucucagcaauagucucacuucccagucccagggauguggauucugguacacugauuccugugccagaugcagcgccaagcucuuccuucaggaagcccucccucccucccucccucccucccucccucccucccucccucccucccucccucccucccucccucccucccucccucccucccucccucccucccgugaccaucccugcuaccuuggacaugagagcaguguguacccaguguuacucagagugugucacaagugcagagcugaauagaguggcacaggcagagccagguucugagucuucagcaucuugcuaaaggcucuaaacugcucaagagugaagauggggugcucaaacccagcgcagcauuuccagcguuagaagagugcuuagcucagcagagcuuucagaaagguugacucgggaaggaguaaugagaguuuacuguagagucaggacauaaaccaggacucaccugggcgauggcucacugguaaagugcucgccaugcaacuauggugucccaagaguuuggggaauuuuguaagaaaaaacuggguguggcagcucagugccuugggggaauaaacaggguggucccugggaccugcuggucagccagucuagcagaaacgguaaauccuagguucagugacucugucucaaaauacugagguagagauuaauuaaggaaaauaacuaaugccuaccuguuguacacacaguugugugcuuguguacacacaccgacaccccaccauguauguacuuuugaaaucccguggucuaucaugcuuuacuuaacaugaaagacaaucacauuucacuucccucuuccugagugcacagcuccugcaagccacugucauguuccaggauccugcugaaucaucaugaccaucguggagcacacguauggguuacauuccuccugagugaaagccuaagaguguagggucggucggucuucucggagugauaagaggcugccaagcuguguaucccagcguuccugccccauguacaccaggccuaagaaagcucaaguuaggaaagugagcuauaaagagauuaaaucugcuuucccucugcauuugaucagcuaagaguccuugagaagauuuugcuguuuucugucucuuuccagagggcucgcugagugcucgucaguggggagccucucuugaagcacagugggacugcagucucagcacuugaacuugcccauguucuugcauguugaccagaauccaggugcaaaagcacaaguuacagaaagagaucugcagaguggguuuuuuggugggcacgcucucauuuagguucccaugugaccugcacacuugcugacaaaauuaauuaugaaguuuauguguguuuuuuuuaaaaacagucuuaugauagauccuuuauuuaaaacauuauuggagauagacggccaaucuguugauccuggauguucucagccucuaaaauuacuucagcaagacuccaagucucucuacagaguucuuucuagagcuaggguucagcugugugauuggccuagugccucuaauccaaacuaaggaguuuuucucugugccuggcauuucucuuucuuaccaccccccccccccauaucuugacugucuuuauacaguagaaaauaacacaagagaagcaggagcugccaucaaaacuauauuuuaacauggcuugaaaaccuagcacucaggagaacaaggcaagaggauuaugaguucaaggccagccuggguuauauaccaagaccccugucucaaagaaacaaaaguauauaauaaaguuuaagauuacauuuaaaaaaauagagcuaacuccauacaagucccaaaauguaaaacuaauuuaguuccuaacuuguaaaauuuggaauaucaagcuuuuaugucauguauauuggauuuugcuauacauauuacagcuauauguauauauauguauacacacacacacacacacacacacacauauacacaaauacgucaaaguaagaguagaaaaggaaugugacagaaaugaaaaagagugcccucuuaacacugaaguuuaucagcacaugcaacuguuuauuuucauuuauuuguuuguuuauucaguuuguuugaaauaggguuucucuguaaaagaacccuggcuaucuuggcacuugcucuauaggccugggcagccuuaaacucauagauccaccagccucugccucucugccucugccucgauucauacugggaauaaaaggcaugggcuuuuuacuuauuuuuuuauaauuuagauuuuuuuuuaaaguagaaauuugcuauugcuauguaauaaauggaaauuuagaagcuaccagcucagaagacuguaaggaacuaaggaaacaucugugugucucccaguuuaaacaaaacaucuaauuagcuacuugaguauucaguacugguuaguuaguuucugggugucuccucguugcuguugaacuugccccuggccagugggauaauccauuaguuaagcacacugggaguuaagauugcucuuuuccccagcgcugugaauaaguaagggcauuugugccagcugacugcauucuugaauugugagagaaacaccaagcauuacacugcacccagauuagaucaugacagauuuggcagggaugagaagauuccuugaaugguguuugcaguuuacccaaaguccuugggcccuuugcuuucauaaaggauuacaaucgacauccagggagaccguccuuaaugaugcgauuagcaguuugcaacauguuuuccuuuguguucucaugugauugaauacucccaguagcaccuuggggaaauacguuagcucucacagagcccggagacggaauucagugaaguaauugucuuccacuucagcacucuacaaaaguaaagucucaaaaauaucgugagacucacauaacuacauuuccuaguagccauacuuuaaagagcaaaagcacacugguaaugcugauuuccuguauaugguacuggggacuaaacuaaggguguccuacaugcuugcuaaugcucgccguugaggugcacccccagcccugguaguaguaacaguuuauuuaacucauuucugaaaaaaucauuucagaaugaucaguauuuuaaaauacuaaugauuuauuuuauauucccuuuuaaauaaaucuugcaaaucucuaaaaccuacccuucagaacaucucaguuucuauucagauacagaaagagccucuuggugacauucuggaagucacgcacugggcuggggaagcuugguuauggaggccagcacucccugaccaccucaugugacuuucucacaugugagcagagcuggcuggcagacugagcugaagaucucauggguggcaaaugacacaugacacuaaacccaaguuugcuggacacacccagcaugcucagugaaacaugucuuuacucagaguuagacacuuuuuaaaaacuuuugagucuuugugaauuucauaucgugagccccaaucccuucaucucugcucuccacccuugcaacucccuccuucaaaagaaaacaaaaaacaaaaaugaaagaugaaaaaaaaaaaagcucucacagcaugucgugguguguguaucacacaguagggccucugccugaacagcuugacuuguaaauguucacugcacugagaucaguuccaggccucuggcugucugcugcagugucaauacuggcuccucacuagacuccucugagauauccuguuguugcccugugucacggagacccugcagcuuuggauccagaggacuggcccauuaacacgccccagcaggucauggauggggaagaugcuggaguggaccuggaucuugggcaucaacauggccucagguguuaguccagaccauggacuuccccauggccuuugcuguagggucgcagacccagacauggcccuagauggcagcauggacagaacauccccaugaccucagauggcacaggccucucacgucagacggucgucaccacccucgacucuuaggucugccucucuucauagagcucaagccauucugcuucucuuuuuccccugucucuccaccacacacuccuagugguccacccacgagauucuggcuuucuucugccagccaucacugcagagcggcaggugggccucccucgacacaagugugugcgcgagcaugcgugugcaggugugccccugugugcccaaguguaugugugguuugugaggaaacucugaagguguggcuagccuagcaguaugaggcauuguggcuaagggaggaguacuguagaaugcucugaggcuuuguggcuaagggaagaguacuguagaaugcucuguggacuuggaguaaacuuaaacguuaagaaacgagugacuuccaacucaauucuucauagacuuagaaauaucaacucucaaauucauuaggaauaacaaacccaagauaucaaaaacuauucucaauaauaaaagaaauucuggaggaaucaccaucccugaccucaagcuacacuuuagagcaauugugacaaaaacaaaacaaaacaaaacaaaacaaaacaaaacaaaacaaaacugcaugguauugguacagagacaggcaaguaugucaauggaauagaauugaagacccaaaaaugaauccacacaccuauggucacuugaucuuuaauaaaggagcugaaaccauccaguggaaaaaagacagcauuuucaacaaauggugcugguucaacuggcggucaacauauagaagaaugcaaauugauccauucuuaucucccuguacaaagcucaagaccaagugaaucaaggacugccacauaaaaccagauacacugaaucuaguagaagagaaaauggggaagagccucgagcacaugggcacaggggaaaauuuaugcucuaagaucaggaauugacaaaugggaccucauaaaauugcaaagcuucuguaaggcaaaggacacugucaauagaacaaaaaggccaccaacagauugggaaaagaucuuuaccaauccuacauccgauagagggcuaguauccaauauauacaaagaacucaggaaguuagacuccagaaaaccaaacccuauucaaaaaugggauacagaauuaaacaacgacuucucaacugaggaaacuagaaugacugagaagcaccuaaagaaacauucaacauccuuagucaucagggaaaugcaaaucaaagugaaccugaguuuccaccucacagcaguaagaauggcuaagaucaaaaauucaggugacagcagaugcuggcaaggauguggagaaggaggaacacuccuccauuguuggugggauugcaagcuuguacaaccacucuggaagucaguuuggcaguuccucagaaaauuggacauaauacuaccagaagauccagcaauaccuguccugggcauauacccagaagaugcuccaacauguaauagggauacaugcuccauuauguucauagcagccuuauuuauaauagccagaagauggaaagaacccagaugucccucaacagaggaauguauacagaaaaugugguacauuuacacaauggaauacuacucagcauuaaaaacaaugaauucaugaaauucuuaggcaaauggauggaaguagaaaauaucauccugagugagguagcccaaucacaaagaacacacacccaaugauaaguggauauuagcccaaaaguucagaauacccaagauacaauucacaggccauaugaagcucaagaagaaggaagaccaaaguguggaugcuucagugcuucuuagaagggggaacaaaauacaggaggaaauauggagacaaaguguggaauucagacacugccccaccuauggauccauccuauauacaguugccaaaccaggaugcuauugugaaugcugggaaguguuugcugauggaaaccugauauggcugucucuugagagacucugccagagccuaucaaauacagagggggaugcucacagccaaccauuggacugaaggagcugaggggguuugcagcuucaugggagaagcaacagugucaaccagccagauccccuagagcucccagggacuggaccaccaaccaaagaguccaauggagggacccaugacucaggcugcauauguggcggaggacagcuuuguuggaaucagugggaggagaggcccuugagcaugagcggauucaaugccccacuggagggugaugccaaggcuggaaggugggagugaguggaugggcgggugagcacccucauagaagcagggggagggagcaugggauggggguuuccagaggggagaccuggaaaguguauaacauuugaaauguaagaaaacauccaauaaagggggggagggggaaggaguaacaagcaugaaucagaggagaugugauaguggucauaguguguggucauuugcccuuaacaauugaguucuuguauaacuugguuagguaagcagaaagaaauccauggaagccaggagggaaccaaaaccuggaugugaaaagcagcugugcucgugcugugacugagugacgugaagugaggcgcuuugaggaccaauggaaagggacgcuaggaccagguaccuugaaagccaggggaaaaaccccucgccaucgaaaauuaucaagcaaaccaagauggcugcuguuuguugaggggaggaugggaggaacgcacugcuuucagggugguuuggaaagaggagacguugacguuggagaaauggacaaaucuacgacaugcagggaaacucagaaaaauagacaccccugccaugcccauagcuuagcugagggccacucuggguggggugguggugcacauacaaccaggacauaacuaauuuuaaauauuuacacccccaaauugaaaaauaaaaaauuuuaaaaugaacgauaauuucuguaaaaucuaugcuuugaauagaguacauaagaaaaccuaccaaggcauugugacaaauugcucauuuuccuaacuuagaugaucuacccacauugccaugggacuaaaguguuugugacacauuuaaaauauucacuuuaaaaccaugcugucaaauugagugacuuguuuccuucauuuuuaaaaacauguaaucauuuuuaucuuauguguguaaguggcauuuuugcccauguauauguuuguguaccaugugaaugcagugccuguugaggucgugagaggguaccguauccccuggagcuggagaugauucugagccugugucagugcugugaacuugguuccgcuggaagaauggcacgugcucuuaacugccgagccaucucuccagcccugauugcuucauuuuguaauuuaagauaccuggaagcuugaauucuagcuaauuuuguucaguauuacacuauacauuuagauuuuauuacucaucuuuauuauuacuaacuccaagguaacauuuccugaucuguaugaaaucucucucccauucuucuggcugaguaacuagccuuugaguugguguuugggaguaaugguaguauuagugaguucaggaaguguuggaaaauauucuccgugaccugcgcaccuuucuauaggauauguuugagugcccucacaacauagaaucuaguuucccacggagcuaagccccaccuguuuucuaaagucugacgaugagaagcagcacucugacauggugggcuugcaaauucgacauucuccguagaaaguauuuguuucugcacauacaggguuuugacauucugcugugagaagcuaaaguaaugauauuuugaguagauuggccgaucuuuguuacuucauuuuaaaaauaaagguuucuaccuggguaugguggcacgcaccuguaauacaaggacuuaggagcagaaggaucaggaguucaaggccauccuaagcuacauacugaguuuaaggccauccugaacuauaugagacccuggcuuuauaaauagacaccaaacaaauaaaaauauugaucauuccucuauuaugggagugguuuuguaguaacaaugagaucagacucuuagcagauggucuucuguauuuauucucugaggugacuaauuccacauuagcuaauaaaacaauaggacuucuuggaaaggucacagguuagaccaaacgucccaccaggaauauuaaagacuggaugaaguaugaggcuuaaaggcauuagauagcaauacaaccacauuaugcgacacaugggccacuucccuuagaauauguaauaccuaggccaaggaacuugauaggacuuucaacagcccugggaaccaagagaaaccaacuuacagccccaaauacagcagagucagggagaagacagcaaacaguccacacuguggcugaggugaugcuggauggcuaccguggcugaggugaugcuggugguuaccguggcugaggugaugcuggguggcuaccguggcugaggugaugcuggguggcuaccauggcugaggugaugcuggguggcugcuguggcugaggugaugcuggugguuacuguggcugaggugaugcuggguggcugcuguggcugaggugaugcuggguggcuaccguggcugaggugaugcuggugguuacuguggcugaggugaugcuggugguuacuguggcugaggugaugcuggguggcuaccguggcugaggugaugcuggguggcuaccauggcugaggugaugcuggguggcugcuguggcugaggugaugcugguggcuacaguggcugaggugaugcuggguggcuacaguggcugaggugaugcuggguggcugcuguggcagagaugaugcugggugccuaucaccggugagagaaugagcucuugccacggacaggccucaguugggccucucucaaucugcgggagaacucuggguucuggacaggugggcaguggaguuggugaugaaaagggggugacaaacagacacgacacaaaggaguguggaucugaauguaauuugucucaaagcuagcaccagucuuauaagugacuuuuuuacaaaaccgaggaaugcauacuaaaagcuaacaggaaucaacugggauaaaaaucaauguuaacaacugggauuaaagcagccccaccuaaggucaguuuaaucuuagaagucaggggcaagggcauuaugcccuugcuauaguuccaauucuagucuaucuaguccaccuucccccuaggccauuguaaauuccugugucuggguauaacucugcuaucuauaguucaaauaucugcucugguuccuucuuagaccacaacaauucuucuucuuagauaaugguaaauuccugcguaugggaguagcuugcccugagauuucugacucuuaaugguagaugguaaugccugauuucuuuaacuaucucucuuacaauacuagaggcaaaucugaaugucacugaauaggcaacauucuuacugaauucaaagcccauggucagcucaaggacugccuaggacugcugaggaauguaacuuagccauaugucaaaaucaaucccuuagaggcauuuauaauaaagcaauauuaagggaaagcacacagauccauuuaccaacuaaaacaaggacagauuuggagcauucauuauuacaggaugccacaguuccaggagacuaaguuucugugaacuuuuugccucgggaccacguccaggcuuuucagccugucacacgggucacuacuggaguagauguagcaagcucucaguagccaugguagccuggaguucaacuucaagucaucuuuaacacacaguagccaucuagcaucaucucagccauauuaaaacccuggaccacuggauuuuaaaccugucaguucaagaaagagcaagucaucagaauuucaauuuuuuguuucuuuuugagauuaaaauguaauuacaucauuuuucccaucccuuuccuaccuccagacccucccacccaacccuccuuacucucuuucaaguccauagccucuccucuuuaauuaauuguuguuacaugcauauaucucaaucuauaaguuaccuauauguaucuuuucaaggcuaaccauuuggugugcuuuucccugggaagccuaguucuucucucucagaauuccuaguugccuggaguuuuuguuaguauugaggcauugugggcauaauuauuuuaaagauuuccacauucaugaucuauacccagcuaauaaccaagaucacgaagaaaacagaauaaaauggaaggggguguugggaauuauagguaauaggaauauaacuuucuauauuagaaaaauugaguuucauaucauauaugaggcagauguuuuaaaaauuaguacuuacucuaagauauuuuggaagacuggacauuuacaagugaauuggcagcuguuagaaugagcucccuagaagcuaaagaacagagaggaaaccuuacugggagaggcagggcgcugcaucuuccuguggcagaugacccgccacaguuaccaucccacacacccauguccccuugagucaggaaaucacauguuugguguguuucguuccuucuggaggucucucuaagcuucagucacagcugagcagaagacagcuagcaaaaggaagccccugcauggaugucaggcugguuccuggcaguggcagcuucucagggacgcuggcacaggcuugcauccuggugccaccucagcacaggcccaguguaaugaggcuaagcaacaugagcugcagccuuccacagagauguuugcucucuaugagcugauugucgucaggauuguauuguaaugacucaaagacuaacuggccucgugaaaauauuuuaagggucuuaaaagucccuucuagucgucaaauuauggugcuuuuuguuucuucagaguuuacucagaacuugagcaugugagauacugaugucacacuuuguuucccaaucuguaacaaauguuacagauuugcuggagucggcaucaauggccuuuggaggaugugcagccugguaaaguggagaaggagcuauucucacuguuagaggaacucagccgugucacugcuggugguggucucuguugcaucccaggcacuaaguccauggccauuugcuaagauuguucagcuuagcagcaugaggggagacggagcugugcggcuuacaaaccacauuuucuggaugcucaucugccucugccuuuaacaauaagaagaaaucauuucacaggaauuauaccuuuuaaucuaguuccuugccaugugacuggaguuuggcacuucuuucuugguaccacuauagccuaucuucugguguagucugcaccuaaccuagcauuugugucuugucaguuuguuuggugcgugugagaacuggguauguaagcuggacauggggacaugcuauaaucucagcacucuagcucaagggcagccagaccuuugugacaggacucucuugaaaaacacggagagcuggaugggaucaagauguuuccuagguuaagagccauacuauccuuacagaaaaacugaggccgguccccagcaccuguaucaaguggcucagaaucacccauaacuccaaagccacaggauucaaugugucuauggguaccuaaaugccccauacacauaaagacacauaauuuaaaaaauucucaaaaaugguuagaaaaaggaaaacaauugagacugagaauauagcuuagccauagggcauuugccuaccgugugacucucuggacuugaucgccauuauugaaaauauauaaacugaaccuuuuauugagagauagcaagcacuggaacuauaaugauucuauucuccugcauguucccaucacaggaugagaaguaagagaaccaagcaaucuuggacuacauaucuagccucagccugucccugucugggggcuucucuguggugaggccaaucaaaaaucuggucuugacugggcgccagccuuuguggcgcacgccuuuaaucccagcacucgggaggcaaaggcagguggaucucugagaguaugaggccaaccuguucuacaaagugaguuccaggacagccagagcuacacagagaaacccugucucaaugaaugagugaaugaaugaugaggucugucccugguucaugaggguuccagaagcaaucaaauacuauucuccauggguaagauuuuauuauaccagacaccuuuaaugaaaucucacauguggaggacagucugucuccaaaugguauuccucagagccuggaucaugcacuucugaccauaaacaccagagcugagucguuggaaagggcucagcugcuuauaccacacuguacaccccuagcuuguuaccaggacuguaucuaacaugcuccagagagaggcucaggagagcgcggcugugcugggcagucuucaggauaaacagagcguuggcuccuacuggcuacagugagucugcuguauccugugugaguugggggugcuagguucagaggcaggcaagaguuugaggccccaguuccugcuccauccaggcuccccaugcagcacacacuaggucagaacuguucacucucugaagugucucggggugucaugaggauguaucauccaucacccauuugccugaagcugcccgacuucugagcuugugcccacuacuuacuuguguccauccuuucuuucccuuuguucagucucucucuccuuuucguaaaagcccuggucccagagcugaguuugacaaaggccauuugaaacuauagggcgagaauguuggaaacugcgggcaguucauuuuggccccuugucuuucuucaaguguaucacaaggugguuucuguucaugcaaaggaggaugaaggaaggucuuacuccguagugggccgugggccugcuauguuuguaugcucucauugacuaaugucuguaucccuuuguuauuucuacuucuuugaugagaacgcugagauuccagaugauuaauaccaucuccaacauuauaaaguagucauagggcuaagcagguauaguggcacaugccuguaucagccaugggguggaucuggaggcaaaguucagcuaaauagugagaugcuguuucaaaaaaccagggcugaggauauaggucacuaacauaacauuugucugguauuuguagaacccucaguucauugcccaguaucaaaagaaaaaaaauacccuaaacuuagaaacaugacaacuccagaccuguuguuucccaaagcucugcauacuuuaccacagcaagcugcuucagagauaagcugccuugggggcagaccggacuccccaggcagccugggccuuuuaggcaguuacuucuuugauuuuuguuuuguuuuaagacaaggucccacuauguauucuguucugauauggaacucaaagagauccaccugccucugacucccaauaguggaguuaaaacuguauaccaccaugcucagcuugguugauucugucuguaagcuaggguaauugguaacuacauuuauccugucaaaugguugcagcguacagcaucccuggcucauagucagccuuaggaacugugcucucacccuuacgcacccauucucccuggcacggggagacacaccaggcgcaaaguguucucacuuucaugaucagauggcucuuuuuuguauuuuauuugugagacaggaucuucuuacucuauagccaagauggccuccaauuugaagcaaugcuccugccucaagcuccuccaauguuggaauaacugacaaaugccacuauaucuagcuucauuccuguuauuuggguugucaauaaacagagccauguggcccacagaagacugugauauacugguccacagcugugagcugucagcaagggagacuggcuuugugcuagugucccgucuguaagguaugggcagguauggaaaggcccgcgcuacagugucccgucuguaagauaugggcagguauggaaagacccgugcuacagugucccgucuguaagguaugggcagguauggaaaggcccgugcuacagugucccgucuguaagguaugggcagguauggaaagacccgugcuacaguguccugucuguaagguaugggcaguuauggaaaggcccgugcuacagugucccgucuguaagguaugggcagguauggaaaggcccgugcuacagugucccgucuguaagguaugggcagguauggaaagacccgugcuacaguguccugucuguaagguaugggcaguuauggaaaggcccgugcuacagugucccgucuguaagguaugggcagguauggaaaggcccgugcuacagugucccgucuguaagguaugggcagguauggaaagacccgugcuacagugucccgucuguaagguaugggcaguuauggaaagacccgugcuacagugucccgucuguaagguaugggcagguauggaaagacccgugcuacaguguccugucuguaagguaugggcaguuauggaaaggcccgugcuacagugucccgucuguaagguaugggcagguauggaaaggcccgugcuacagugucccgucuguaagguaugggcagguauggaaagacccgugcuacagugucccgucuguaagguaugggcaguuauggaaagacccgugcuacagugucccgucuguaagguaugggcagguauggaaagacccgugcuacaguguccugucuguaagguaugggcagguauggaaaggcccgugcuacagugucccgucuguaagguaugggcagguauggaaaggcccgugcuacagugucccgucuguaagguaugggcagguauggaaaggcccgugcuacagugucccaucuguaagguaugggcagguauggaaaggcccgugcuacagugucccgucuguaagguaugggcaguuauggaaaggcccgugcuacagugucccgucuguaagguaugggcaguuauggaaaggcccgugcuacagugucccgucuguaagguauggacagguauggaaaggcccguucuccuucuuugccuaagcaaaggauuaaguuagauaauagauguuuagcauuucgcacagcucccagcuuaaagcaaaugcuacaugagcgccauggacgacuuccguccccagaacacuagaaacugggaacacuaaagagguggaggcaggaggauuucaaggucaucugcugccacauagaaaguuugaagccggcauuggguucacagagaccccuguccccacacagaggagauguacguaaauaaugaucaguacugguucuugauacuauggugugguaauguuuuauacucuuggcauaaaagucuuugaagaacacuguacuuggacuuuuuagccuguaaguacagcauuugugaguugcuuacugauaggcugggagcugauaguaaggcaggcgauguauuaugcaucccacagcacacugaaauaaaaugccauuuccuuaggaacagcuagaaauacuggugcuaauuuuuccugugcucaggaaaagcaagcacgcugugcgcagcugcaguaggcuagagagcccuccagaaacaugaugucauccuaaucugugccgccaagggaugagcucauccaggcggggccucucggggcugcagcugugccagcuccugacuugugaugcuccucuuacaggcuugcucacccucccuccccuacccuccccuacaccaccccugccugcugugccaaagagacacugaaggaugaauuauuuaagacccaaggugaacuccugccaaagauaaccaggcuucagaaagcacucaaaaaggaaaauagaacugcaugggcuuuuuuuuuuaauuagauauuuucuuuauuuacauuucaaauguuauccccuuuccuaguuuccccucugaaaaucccguuccccccucccccuucuccccaacccacccacucgguuccugguccuggcauuccccuauauugggguauagagccuucgcaggacaaagggccacucacuccucucauugauggucuuauaaaggaaagaacuaagcaguuuguagaacugucgucagugagaggacaaugguguugguucucucugccucugcuugcucuaggagcagucugucccucuucuacuuaaauaauggcugaaucugugaccgaguucagugcuggaacugagcccgcacagaccugacccugagccccauggcuguggcagugacagccaagcagcuuccuacacuuuucccauuguacacugcggugaccuugauuuaugcgccagucguccuacaugucagcaguguaggucaccaugggagcagguacucuaugugaccauggaaacugucaccucugcagaccuuaguuucucuaucuauaaaguaggguaaugcagccaagccuagaucuggaggugacugagcaggaagugaagacuggguggcugucacugagcauggugcccggcccacacccuguccugaagcaaccagugcucauuaauccaauacccauauucucaacugcugggggcgggugggggagggcauuaaaaggaguguguaaagcugucauauuguauauuucugagaaaauuauuuacacauaauguugaauguuuaggauggcgucauaucauucuguggcacacagggucauucagaagccagccuuucugauagagcuuucugguuccucuccugacagugucuccuguaacaacaguucccccuccccauaaaaaagucuguuuuguuuuagauuucguggaaauguugaguagccgcagagggaacucccacaccuaccgucccucugcagcagcagcagcagcuucuggcagauuuucaucugcuucccuuuuuuaagugcaguauuuuaagagcagauuccagacauuauaucauuguucucauaauacuugaguguguucuaccaaaggaaaagcaggcuuagccacggcugugaugauccccccugcacuggaauaggugccuaguuuuugguuuuuuuguuuuguuuugcuuucauuuuuauuucuguacuuuuccaagacaggguuucucuguuuagcccuggcugucccagagcucccuuguauaccaggcuggccucaaacuuacagaaauccuccugucuuugccucugcccucugcccuccgcacccccgagugccgagauugaagguguggacuaccauugccugcucaguauuuucuguucugaugauucucuagcaccgaaaugaaucuacacugucaccuuuuaugauaagccauugaaauggguuccuacuaucauccaauaacuccacagauacuaaaauggggucaaauuauuaucuacuguuuucuuccaucuucaaacauuuccaguugcucgaacugucuuuuaaugacuuuuuucaaaauaaucacagaaaauauuccucggugcuuaaacuuuuaucauuugaauuuuuguuuuuuucagagcugauugucaaacugauuaaaauaugcuuuuauuuauauaaaauugcuaauuugcuuuugucauugcuuauuugaaugauuguuuuaaagcaaaaagcuugaauaagcaauaaugauguucauuuuuaaccaguaguuuuauaucuauacuuuagacggcugguauuuaauguucuuuuuguacgaacauaaguuuaaaaucuuauuuaaaucaacagauuuuauauaaacaagaugauaauucauugacuuguuucuugguauauuuguuaacuuauuuuuaucuuacacuuacagauugaaaaaucacaauuuuggaacuuuuucuagaaaaaaugauuacuaugucauugccaagaguuaucuuuguuuaaguguaaacacuuaauuuaauuuuuagaaauauauuucuuuauucuuaaagggauacuucuguaaggcuccagauguagccacaacugcuaugaucagaauuaacagcaagcucccagaaagacagguguuagugcuaugaaacuguauucacacccucugcaaaugacacugccucuuuaauuguugaauguuuaggauggcgucauagcauuguguggcacacagggucauucagaaggcagccuuucugauagagcuuucugguuccucuccugacagugucuccuguaacgacagcccccuccccaugcaccugccccuucugccccuuggcgccuuguucuugucuuccagcuguucuguacacuuaaagugcuguugcuaaauuuguaaauaaaauugcagaaggcauccaggcauggcgccacauaucucuaaucucggggcuugggagguagagggaggggcaucaggagcucagcacaccugugcauaugugugcacauacacacacacacacacacacacacacacacacacacacaugacaggguuauguaugaauuucccauaaacagugacucugacuuggcucaaugguuaucuuuaaagcccuuggcuuucuucccaccauuccuguaaaaacgguauaugaacugcauggacuaucacguaagcucugcguccaucaaccccaggucuuuccauuucagguaaguuacgugauguccugagguuauaccguuaguuaugugagaccagaccacagauggcgagcagaugcagguuggaguggacccucuucuuucucauugcuuaguaacuugccagccacaacucccaacucgucuccuaagaacccauugacaaacccuguuaaacaacaacuaaguagcugagauccgcgguagcaacgcagaaaauacucuuuagaaagauaggugggaacaggaaucccccgacccugcgugacaagccccaacccugcuguucaccagaagaaaacacuuuuguccuagcuccuuuugguuaauugaccugugucacauuugaaaagcauagccugccauuaucagccuagugacuaauaguuauuugcgcaguacuccaugguuauuguuacuuugauuuuccuggaagcuuuucaggaagcuugucagcccacgucgaggcccuggcaggaagcacaggaaguagacguggauaaucaugccaucacugacuaaugacucccacuggggauuuuacaccucagucaauuauuaccuaauuacaaccagcaaaaauacauacuguguucaugccaugcaagaagguacugaguuacugcaggacaaagauguaaacagugugucucuacccaccaguaacuuacaguuggcgaagcaaacuagucaugugcaagggaagcccuggaagcuccagcacaaaacugcacgagcuuccacugguuagccgugugcacaguagugcucggacucaacgccccaaacuuagugaauuaaaacaagacuuguguguccccuucauucucaugcaggcuagcuauaggucagcugaucuaggcuggaccuggcaggucuauaggaggcuggguucagguuucugucauaugaguggcaugugccugggaucaagugaguguguguucucucauaaugguacagaaaugcaggacagacaaacacaacugcuguguuccccacggccugaacugaacacagaacagcugcugccugguggcagauaccuagguucagugauuagaucaauuuaaacugucaagggcaauggcugcaugguaagaaugauccucagacgcugaaauuccaacugaugauggucauggacacagagcgagacgcuagugauaucaccagaccuccaaguguugggagguguaauauagacauucauccuuucugaugggacaaucugguagcuuguggggaacaugggauuugagauaaccuugaaugaccaaaauaaaacaagcugagguuuuguuuccauuagagcaaaugguacuuucaugagguaauggaagguccccuuaggguuugagugacugagggccucaaacuagggaucuuuggaagaugaaagcaaaggccaggaaggaccaugcuagcaguuugagaguuuguccaaugcuuugacacuaucauagaaaauguacauacacacaaaaccccacuggcaaaugagaggaaacaguuugugaacaccuuuguaugcuacacucaggguuagacuucauuucuuugguaauauagagucaucgaagacuucuggcuuagaaaugaugaaaauggagucuuagcacugucucagaagagacagcuugaaggguuaagagguaaaacauuaggaagcaaaaaggugucuaggcaaccauuagcuauugcaguaggaaggccucacugaaaaaaggaccacaggaagcagggaaaauguaaaagacaguucagguuagcaaagaggaaagaggagagcacagggaaacugaguacguugucaggcgaugauggccaaagaagugggcaucccuguuuucaguuauaguugauaaaguugaguuauagcacaagugggaagccuaaaccuuacuccagccuugugcagugugaacauucuguucccuucacccugcucaggagaacucucacaagugggacccuguucacugugcccuuggugccuaggagaaaucuuucacacuagacauaaauguguagagaaaucuugugagacuugcacguguguguguguguguauuccuccugugucauaaagcagccuugcagagcugagcgaguucucgcaacaacugcagaaugguacauagaugucauugaacucuaaacaguuccggcacaggcuucccugcuaagaaccuucuccauuagcuaaugugucagaaaggcuuuaaauaccggcacgauuuuaggaguccagaguguccuugcaguucagaaacggaguacuuugugugauaacguuuaagcaguauauucauuggccuuucuuaguuuucacuaaggcagaugaaccaaaugagcagaugcugcugauggagagcuaguaacugaucuugccaguugucacuuagggacaguucugccgucacacaucuuccauguggaagcuaaaauuaagccacucugguacauuaaggcugauaaacacagcgugaacagauuccugaguuguuauuucagacucugggaauauucuguaucccaaggauagaaaauagagaccagugccccaaaucuggcuguuugguuugaaauugcuagacuaugaauaaaugagcaaauaucuccaaucacuuuggaagaugucucuggggcauauguuugacauguaugcaaacacucugcccauuggucguaucugaaccugagaccauagguuccugggcacucugcuguaaguuuuaggaaagaagggggucuuccuggauguugccugcacuaugugcagcucaaggaagaugucuuuuugagugacuaagguuccuuuccuaggcauccauuucuuugcaugguuccugcugccuugaacccucauaaugagaaaaaggugcauuugagcacaggcacuugagagagagagagggagagcgagaggaagagcgagagcgagagggagagcgaucucugcucaggagagcaccaggaccuuaaagcccuucuuucuguacuuagacuuacaccagguggcaugacauggccuaauacuccucaccacagcagcaauagugaagcauggaaguggaccucacagagagccccuucccagucuggucagggucacuuagaguaguuccagucagaaacucuggggagcuuuuaaaaccucaaugacccagcucagucccaaagacucauacuuaacgggucucaccugguaggugucuugccauacagaugauagcuuugacuagugauaaagacucaacaaucuuacaggccagacacuggaugguagaucugggagcaccuggucccacacuucugugggccucacuccccucuguuacuccaugucauuaaagcagaaauggcaaaguacaguccggggagguucaaagcacgcacucagauucuaacagcaaguuaacccgugugugcagucauugcugagaaugcugccucagaacaucucauucgaaggcuccugucuuagucaggguuucuauuccugcacaaacaucaugaccaagaagcaaguuggggaggaaaggguuuauucagcuuacacuuccauacugcuguucaucaccaaggaaggaagucaggacuggaacucaagcaggucagaaagcaggagcugaugcagaggccauggagggauguucuuuacuggcuugcuuccccuggcuugcucagccugcucucuuauagaauccaagacuaccagcccagggauggucccacccacaaggggccuuuccgccuugaucacuaauugagaaaaugccuuacagcuguaucucauggaggcauuuccccaacugaagcuccuuucucugugauaacuccagcugugucaaguugacacaaaacuaggcaguacagcucccaucacaagucagucuugagugagaaaaagaauaagauggugacuuucgggaacugugaaaacauccaccccagguccucuagcugggaacaagggagagaagaguguuaauacucaucuuguguaggcuuaagacauuacuagugaucccagagugugugagcugauucaguaguaagguacuuguugcucagccugaugaccugaguuugagucccagaacccacauggucaaaggagagaacagacaaucuguauugagcuccauacgcauggcuucucucuuaaaaacgagugauccuagcuauaucugcugcuucugcccagugggguggcacagggaucgaaugaucucuuugcaacaucaccucaucucugucuggcagccucaguaccugaaugcagaguacaguuguuucacuuagaucuuaaugaguaauuuaauuuggugagucagaguuuugauuuuuacagccaugaaauaaaaccaguguucauccauuauucuuuucauuuuagaaaucacuauuguuucuguggaauccguucagcugaugaauauuaagccugacuucugugggaggcaacuagcagaauagaaaggcaauuauaauagauuuuuguuguuguugagcaaaauauuuauacugaaaucccagaguccaggcacgcucccccuucuccgccacgucccgccauaaccuaaagugggccagugugcugccagugcacucacaagagaaucugucaaucagguggaauguaaugaucacaaggaaaacuuaaaguuuuggaggaauggguuuuuugaagacuacuccacaugugaauaugugaaguuaggaaaagcucaguggacacgcagugagcuggcuagaggggcuccuuagggcagcugugaaucagguuugugcagagguaccccaaagucauagcacuuauuaauguuaccugagagccuuagucagugacuuauugagaaugaaagaauuacagcaagaucaaacaacaaccacaaaaaccucagcuugguaccucaggauaucaugccuucuggauaacucacacucugucucucugccucugucugucugucugccuaucuaucuccccccuucucucucucucucucucucucucucucucucucucucucacacacacacacacacacacacacacacacacauccuauaagagaaauaagguuguagagaguguggaauuugcauccauuugccuguucauuacccaaacucuuauuggauccccaugucagccacugguuugggcucuagagacaggacuguucucguccacauaaauguguuuucuucuugggugauacagguucaaggaaagaauuuucuucuggaacauucaaauaaucaaacauuuaccucaucuggcugaucgaacauucugcagacauugauucuuaaagagggaacaagcuggauauaacuggcugcucuugaacacuguggucccacacucugagauguggucccaugcucugacagugucccacacuccagcagcuagcauuaguuacaugggggaaagucacagcaacguuaggcgguccucuuuuuaaccuguguucuuaucugagucuuagagaauuuugcacauuguguuauguucauauuuauccauaacuccuccaggcucacccugcuacugguauucuuuuaaaagaaugacucauugagcccuauuugugcugccuuugacuggcagcaggccucauuaguguaacaaauggucaguuggaguuugucaugugucuuagccuguguuuuguugccguguagagacgugaccacagcaacucuuauaaagaaaagcauuucauugggccuggcuuacaguuucacaauguucguccauuuucaucauggcagaugguagcugagaguucuacaucaugauccacagacugcaagagagaaagagagagucaccaugccuggcuugggcuucugaaaccuaaagccacuucccuaaugacacucuuccuccaacaaggccacacuuccuaauccuucuaaauaaugccacacccugaugacuaagcauucaaauaugugagucuauggggaacauuuuuaugcagacugcuacuucaugccuuucccuaaagccccagaaccagacagcuauugggugagacccacagacaucacagaguacaucccucucagcaggacuaaaggagugaccuccuugcugucaguaucagauuuaaggagggcgccuggaguacaggccucacugaaguaaaucuuacacagcgauauguagacauggcccuuaucuaaggcgauggugaagacauaaauccaugaagacauguuaugggaaugguacuuuaacgggacuccugaugccuggcaguuugaaaucaucuugcccauggcuugacuucuguauuaucugucaucucuaugucugccucacaauggcaggcaugugaccuaauucaccaguuucuacuuccauagucugauacaaaguugacuuguauccugugacugauuguaguaaccgagaauacagaugauggagucuuggaaugcuguacuaaauaaacacuucuguacuuuacaccuuccgaaaugaccagacgaaauucugccgcaauuaccaucuguacaagggcagaauggauggaaaccuguuuaacagugacaccugugagucacuuaagggaccuagggggaccaaacaaacucagcacgagucaacagcucagaaagcaaaugucuaaauuguuacuaggaauggguccccugucacaguucauuucaacaaggaacugucccuuaacaggugcugugcaggccguuggagagcuauaaacaaaugaacaaggucuccuguauggaacuguacauggauguaacucaaaauauaucaaaugccgaaauguaaaggauaaaacuauccagcucuuagagcaaaaggggaguaaauuuaaugaccuuggauuuacuuguggucucuuaaauauggucuuagaagcuuaagcaacaaugggaagacaacugaaacuuuacuuuauuaaagcuuaaaauucaaugcagaaaaggacacuaccaagaaaauaaagaaaauaaagacacaaagaguauguauaacauccagaauauuuacgacuuauuaauuaaaaaacaauguaauuuuaaggaaugagcaaaggacuugaguaacuuuucuguuaaagauaagcaaucagaaaugggacugcugugaagacgcucagcaucguuagucaucaggucagagcugugacugauggaggaaugauggugugacucaaaagauggacccuaacaaacguuggaaagacggggugcgggacugggcaguugguaagagguacagcugcugugggcaguaguugaacucagaauuacugugugucccagcaguucgacuuacauuugcccccacacaaauuucuacauguucauaaaguacaaguagacauagcucagaugcuccccaccaacucauaagugggcaaauaaaauguggcuugcauauggugcagcucuguauguccauaauacaagugagguacuugcuucagcacagugaacaccagaaacacuguguuacacgucagaagcugaucacagauuaucucaugguaaaacugcauucaugugaagcgaccaggcuaggcaaaucuguagagaccgugaguggaugguaucagcagaggcuggaggauggacgcucuuucugggaugauggcaaugucuuagaagaggugacaguugcagaacaccguuaguaugcuacaagccacugacuucuaaagucauucauguuugucuguauaaauuuuacauagcucucaaucaaucuguuguuaaaaacuuacaccccccaugcacacacaccuugaauagagucuccuucacagugccuaggucccgucagauuaguaauccuggguuccauucugcauagaagacagaaguaguuuacuucacccauagaaguccagcacaaguuuagacauuuagacuguugaggugaaacagucaaagcacauggggugguuagcccauuugaaaaaggaaagggcuuacaggcauucuggucugucauuucagauuggugcuugcuauggaaaagggguccaaacuggucucugucuuccuagaauauaaggaagagacuggcaugguguuuuaaugcagagaacuuucuuuucugccccccccccaaacaggguuucucuguguaguuuuggcuguccuggaacucacucuguagaccaggcugaccugccucugccucccgagugcugggauuaaaggcgugcgccaccacugccggcuugcagagaacuuucuaaacuggaucaucuaagaaaggaggugccuuucagggaauagugaugauaaagacuccgugaggcuggugacagagaguggaaggcuccgguggcuuuggagccaggccaaucuugaugacccucucauucaucucucacacaugccuagaccuucaagacaccugucuuucaugacaucgagcuuuccagcaguaaacuacauccggauuuuugucacuuaggaaguggcuaucacagggaagaguugcugauaggaccauuacuuucacugucuccucauaaucugcaugcauguuuauccgaaauggcuaucacacacgaggccagcccauuuacuuuagcagaagucaccgaguuuacaucaugcucuagggccuugcccuuuuaguuuguccuacuaagaaugguagugagucugcugugucugcuguugcuauauggcuggccaugaccaucagagccaucagaauugucaucagcaucuagucucccacuuccuacuuagcuguggucucugaugucuuucacuaggaggcuagaacaccgaacagcuagugauuugaauugagaucagaaauguacuaggagccacuacuaggugaugucagagagugauagccucugcugaggacuggacaccugucacagagcugucugaacucacgggcacgagaggcauccuuuccugaugcacaccuugauccagcuugcuaagggcaugacacugguauccagcuugcauaugccagucucuggaaagaaggugcucuaugcucaggggucacucacaucgugucuaacagccacacacuuaccuaacuuguuaaccuccuucccuaccauucugguaaaagcauugucuuacagucuugugcuguuguaacaaaauaccacaagcugguggcuuaaacaguagacagucacucucacaguucugcaggcuaaagucuaagaucaaaguguugcugggcuugguucuuggugggaucccucucuuguuggcuugcagagggcagcucugcagagcagaaggcagagucugcauagauucuauaucauauagggggcucugcucucaugaccucaccacagacggcuuggcuucuaaacaccaccuccaucuacgagagcuaacucaugaguccugaagagguuaauauauucacucuaucacaaacagacccuggugucaaauugccuggauggaaucccuugcucacuauuccucucugggcucaguuuccuccacuuuaaaaaugaggccaauacuacuguuggccucauggguucucaacacugaucaaguucaugacccguuggucuccaaggcuagcucuucaacuuaccuaaccaggcuggagcagcucaggaaagagaauucugauugcccuuugcaguggcccucagagugguuuggaguuagagugagaguccuugcaagcauguguaugaguagcaaggaaacgaugaaugacaccuucagcacaacuuuaccuugaccugggucaaaaacuucuggagucucaccaagugguuuagcuuucuuacacauuuaaacacaguaaaacuucggggaaaaaacaaaguuauuacaacaaagcuuuaggcauggccacaucaaaauuacuuccuaaaguagaucucuuuagcaaagcaccugugacauuuccuccaagaguguguucucauugauagagaagcaguguucgggauaagggccuagggaggaagaguuugaaagaagcuuaagaagaguucuguugacugagaaugcaaaguacuugggaccucuucuauugacugagagacaaagcucagaaucagacccuaaacaaugcccaggaccgugggggguucuggugaacgccugcuuccuagacuagcagaucaccagguuguugggcagcauccaacgcaggcaucacuuucuucccugggggaaaaagagcugaguguucaacaguucugauuucuguagugccuccugugagcugugucaucuacaauagacaaguagaugacuuuucucuaccaugaaacaugggaaacuuaggugucuaaauaggguuucuaugcugugauaaaacaccauguccaaaaccaacuugaggagaaaagggcuuauuucauuuaacauauccugacucauaauccaucaagagacgucaaggcaggaacacaaaccaggaagaaacuugaaggcaggaugugaugccaaagccaugaagccagcugcucacgggcuuaaucuccaugccuuacuuaucuugcuuucuuacagcacccaggacuaccacaucccagggauggugcuagccaccaugggcugggucuucccaugucacuaauuaugaaaauggcccacaggcuggcuauaucuugaucuuauggaggcauuuucucaacugaaguucccuccuuucauaugaccauagcuugugucaacuugacguaaaaaacuagucaucacacuaggccugguuagaagaaaaacaggccaaaacaaaacaaacagaacugguccucgguguguuucucagaaaacccgaggcacugucccaugugggaauuuuuugagcuaaggucccaagaugaaacugaccagcagaaagaauggcccuuuuagaggacauggaagugccagccgacaucucuugaauucauagccacuguaccuucaugcuuucuuugugcuucuggcuucaaggacuuggcuaagaaggacugcuagagcuagcccauucuggacacugcagggcuccucuaacugacaggucuugcucaguaccccaucugugugcucagagauugaacuacucaguauguucuccuucccccagccuuucucccugucuuagguaggguuuccauugcugugaagagacaccaugaccaaggcaacucuuauaagaaaaacguauaauuggggcuggcuuauaguuucagagguucaguccauuaucaucaugguagaaagcaugguugugugcaggcaggcauggugcuggagaaggggcugaaaguucuacaucuugauccaaaggcagccaggagauucccuucuggaggcaucuaggaggaggcucucuucugcucuaggcagagcuuguguaguaagagaccucaaagccugccuacucagugaugcccuucccccaacaaggccacaccugccaauagugcuacuucccacgggccaagcauauucaaaccaccgcacucccuaucggugcuuuguuuugcucccaaccccucugucuuugaugggcauuuuuuuuuucucauugaacugaguucaucuugguacuuacuucuuggagaagucaaacugacaugcacuuuucuacuguuagacaugucaucuguguaccuaagaaagcaggugugcuucccaucuauguagaugaaccugcauagcaauagcacagcaagugggaaaugcaaauggaguuagugagaggucacauucaaagcuuugauucuucaugguguaggaucaucugaaguagcucauuucccagucaaguuucagauaaaguggauucuacaauuugaugccauaucaugaggugacagggacacuggaagcauguggaaagccuuugaaaggauugaaaagcagaagacuggcaagcaccgagcuccauacugauagagaccuguuugcauuucagauaccuggaacuuucuaauggcauagaauggaaagauacauggaguggguaagcucggcauaguucaggcaacauuacuccagcaagugcuucuaaacucugccucugcaguggugugagggucuacaugagggaagauaucagcauaagugcaaacugugguaccugugagccaucagcucuucauagugaugccuuuuacauuagaucaguggugccccggcgccuucagcuuacaagccacaucuguuguucucagaggaaauaggacacagcagcaguggugcuuuccucucccucggcuguccuuccccuggcuuuagccugaacccugucuguuuagcauuacuaaccuguauucaucuaccucuuacuacagggaacuggauauggucuggcccagggccacugggccauguuacugaucuacuguguguccagccauaaccuuucuguuuuguuucugauggcauuagauccuucugcaaccaugugcucugggaagucuugcuugguaggcacagcuagaugugcaauggcucugucuuugguggggugauuucauagcauucaaguggugcuguucugaucaaauauauagaauugccacuuucauugacuggggcacauauauuuaccaucaaaucgauuagcuuucaaaaauggcuguaugaauuaguguaaauguauguuaguaacaugguuaaaauaaaaauggaaaccccagaaacuagacccagcaugagaauccugcagagccaagcaggacguucuagugccauaugagaaacacugauaacugcaugaguugcuaacacaggacuuugcauauuugcagugcaggcaaaaugaggccuugggauuugcuaauagcagcuuaucuucaaauaaaagccauaaauaagauaacucaaacuucaaaccugagacaagaggaccacuuuuugcacuguuuggcuaugccucagucaggguuuuaauuucuaugauaaaauaucaugacccaaaugcaacaugggguggaagagauucauuucagcuuccagcuccuagguuacacuucaucacuaagggaagucaggacucaagguaggaagcuggaggcaaaggccauggugugugcugcuuaccgguuuugcucagucgucuuccucauaguccaguccugccucagugagcuggaccuuccuucaucagucaucaagccagaaggcgccucacaggcuugcacaggaaccaucuggugaaggcauuuuuuucaccugagguucccuuugucaaaugacucuagcuuacggcauguugacauaaaacuacucagcacagacuccuuggucucaaacuaaagacaaacguuucaagagcuggaaagagguucacucaguagggugcucgccuuguaagcaugaguuugauuccuaggaccauguaaagcaaugccagcugugguagccuucacacgaaggccgguugcuggggcagaggggcgagcauagacgaaggccgguugcuggggcagaggggagagcguagagcuugaaagcccacggcugagacacuugagcguguaugggcuguggucccggggcuugcuggccagccaccauagccugccagcaagcuccaggccagcgugagacuaugccucaagauaaggccuguggcuccugaggagaggcccagcaaagauucuccuccugccuccaaacguacauagaauacacaugugugcucucgcagacaugugcuuguacacacaaaaagcacaugagaauaaucagguucagccucaugaaucaacauagaacuguguagagauuauuaaauucuggcaguuucauaggguucaaccagauagcauaaaugaaacaucaguggcaggguaugugagcacaggaggugggcugagaguccaucaugcaagcaugcuuuaguguccuuuggcuuucacaccgcuguuugucaucugauuugaccuucucugggucuccucuccaaauguuuccaccuuaugcagguauaccuaguagaccaggaucuaucugcauaggagggguguuccgauucgggugucugggugcugacgugucaggaagcauguuugugcucguagcccacauguggcauuccacugaggcagacuguggaagguaguuaggcuuucuucucaacuccacugacagacagacagugcacuaagaagcagacaggacuagccacugaguguauuugcuaccuuggcccauuuagaaaaggagauuuaaaacuugguuuugagggaaggguuuuauaguuugaaagguucccccuuuucuucugucugaagcucuauuaagccauucuauuaugguguuauuuaacagguaagcucuauuacguuccccaaaauaaaauguggcuuuaaagaauaaaaacauguguaaauacauuaugagaauacuauugaaaauuauuuuaaaaguaaauacuagcuggccaccaccuuuaacccuggaacuugggaggagaaggcagaggaacagcugugaguuugaggccagucuggucugccggggcuacauagugacagcgugucucagacaaagggggaacacuuaauaauggguagccagccuauaacuuacucuguuuguuguugacuucuuuguuuacuuaaguuuuauuuuguuuuuuguuuuguuuuuuugagacagaguuucucuguguaucccugguuguccugaaacccuccuaggaccaggcuggcaucaaacucacugccucugucuucugaguucugggguuaaaggcguggacuccagcuugacuccaacuuuuaaguacuaugcucucacuaauguagaccaagccacauauauauauaauaaaaagaaauucuuuucauuguaacauaaguuuaaauugauaccaaaauuaaaaauagaaucugaaauaaauucuauuuuaguucacauaaguauuuuaaucacagaaaauucugucuauaccucuaguugaaccaaguuguaggcaaggugagaugacgcgugccuguaauucuggugcucagagguagaagcagaucuuugagcucagagcaagccugggcugcagagagugcccaggucugccagagccacguagugagcuccuguccucagagagaagguccaaagcaggugaagaggaaggaguaccagugucaugccuagcaucacgcugggucacuuccuggacaggccuggcuagcuggcugaguuccccuuaaaaaaguccccaaguccguuucuuaguagaauaugggaauguggcagugacaucguugguacacgcuugucaauuuaaaguaguacauauagaaaucuagcauucuuaauuuacaacagauauuuucuaugucuuuuuugaagacacaaauauuuuuuuuauuuuacuuauuuacuuguuuguuuauuuauuuauuuauuugguuuuucgagacaggguuucucuguauagcccuggcuguccuggaacucacuucguagaccaggcuggcccugaacucagaaauccuccugccucugccucugccucugccucccaagugcugggauuaaaggcgugcgccaccacgcccggcugacacaaacauuuuuuaaagaguauacuuuuccuuuuugaagccagguauggaaguuaugugccuugggagggauugacucuggcaccccagaccccugggugugugaaggagugugcccacuugagugcagccuuuacccaguucuccccagcucagguuggucacucugaagggcagugccucugcaacagaguccagucccagucccuuccugacacguggacagccauggcugcagaauggccuuuggaauggcgugggcggcccacucaggcuccccugaugcucauugacauggcagagucaggacaaugauuggucuuuuuacauagucagaaagggaaauggcuguuaaccgugacuaggaggggcucucaguuuguugucugcagaguaguuacuguuacagguagggaagcagcagaaauaagaaaagcuguauugguaaaccuauguggguauuguuugcuuauuuuugucuagcagacagugacuuuauccauaguucuuaaguuggcaaaccagcaaacacuagacuuguuuucucccaauuuccugcauaaaauaacuauggccauaaacuguggcuagcagcucuauacauuauuugagcacacacgaaguugaggccuccagguacuaacauaaugagcugcacaguaaguacaucggggaugacccaccaugaacaugagauagaggugcaacuuggaugacaguuuccuccuugagggugacugggauguuguugagcaagcagacugauaacuucaggcuuccugaaugacauagggcucugccuucccauuacaguggacccugcuguucuugaaugaguggcaggcccugcugacaaggcaggacugugggacagcuggcugacggcccaagcagacggcagcccagccaagagguuccuggagagugguggccuuuuucggacuuuugaggauaucgggcacgcccucaaugggauggagagaaacuagaauggaaggaaaaggcuggcugcuccuggaagcagagccagggacaauaaugucccaauagaacagacuagaagugcagacucacauacauaaaggauucaagcagguauacacacccagauagucaacacagacauaugcacaaguacacacaggacccagauacauauacccagagaccuacaaaguacagcugccaaaauaaauuccgcaacuugucacauucuuucuggccuuuuuugucaccacaugauguguaagugguggccaccgguugugauugcauguucagagagaacacgguuuaggacugccugugacuccugaagacccauguuggcuguagucagaaagcuucagacccacacagugaaagaggcucugaggaauguuggagacacuucuccgagcuuugcucucugaggcuccucaucucaucaagaaggccagcuaagaacacggauuguuuucagggaauuucagggagauucuaaaguuuaccaggaauccaugaggcuuuguaaauauagaaaauuuaucacagacauuggagaaaaaucaauuuugccuagauagacuagcuugguuuguuuguuugcuugcuuguuuguuagggccaguagaaaaccauuugcagggaucaccuguuuaaaagcuaaaaucuuugauuuucacaagacagaaguaaagaacccccaaguccaacaagaugacaguguaaauguggauaaccacagagcuucugagauguuuuggucucugugccuguccacccuuagugacaguacugacugguuuugugugucaacuugacacagcuggaguuaucacagagaaaggagcuucaguugaggaaaugccuccaugagauccagcuguaaggcauuuucucaauuagugaucaagggggaaaggccccuuguggguugugccaucucugggcugguagucuuggguucuauaagagagcaggcugagcaagccagggaaagcaagccaguaaggaacauccuuccauggccucugcaucagcuccugcuuccugaccugcuugagucccaguccugacauccuuuggugaucaacagcaauguggaaacuguaagcugaauaaacccuuuccuccccaacugcuucuuggucaugauguuugugcaggaauagaaaccccgacuaagacagugacugucacuaacacuguccccuaaacuuucaugaagaacuuaccuaagccaggguuuugggggaugucgagagcuggagagaugcaagucggggugagcccuggccuuugcuggggcagagagcaaauucuagaaaugagacaagcuuucuaagcaccaugaagucacuggcgcagcaccgagcagaaccgagcaucugggaagaggaagcuucuaucaguagugcugaacugaguccugagggcagguggacaggaagaggggugucgaggucuagggaagagggagccugacuacuuaggggggacuccugacuacuuagggaggacugucaaacccuuggaaaaacaucaugcauggcacugugacugauucaggucacagggaccaaggucugucaugugggacuuuggacuccauccugaaagcaagagagacucccaaggcggaguuacucuguccccaggacugauuguucauuauuuucaguaauuugaauuugggucucucaacuuccagcucagagacucuaucucagaaaaaucuagguggacagugccuauguuggagauguuaacaucuuucguagaaaggugcacguguguggcuccacagguuccagcagugggcguggcagaacgaaugagcaggaagcuccaccccugagcaagcagguuucaggcugggggaggggagacuacacucaagaagguggacuccagaaaaucaaauaaccccauuaaaaaauggggcucagaacugaacaaagaauucucaccugaggaauacugaauggcugagaagcaccugaaaaaauguucaacauccuuaaucaucagggaaaugcaaaucaaaacaacccugagaguccaccucacaccagucagaaugucuaagaucaaaaauucagaugacagcagauacuggugaggauguggagaaagaggaacacuccuccauuguuggugggauugcaagcuuauacaaccacucuggaaaucagucuuggcaguuccuuaggacauaguacuaucggaggaucccucaauaccucuccugggcauauauccagaagauguuccaacugguaagaaggacacaugcuccacuauguucauaccagccucauuuauaauagccagaagcuggaaagaacccagaugucccucaacagaggaauggauacagaaaaugugguacauuuacacaguggaguacuacucagcuauuaaaaagaaugaauuuaugaaauuccuagguaaauggauggaccuggagggcaucauccugagugagguaacccaaucacaaaagaacccacagcaacuuuuauaaaaagcauauaauuggagcuuguguaaaguuccugagguuuaguucauuauuaucguggaagaggaacauggcgggaggaaggcagacaugacucuggagaaguaccugugaguucuauauccagauccauacgcugcagcaggaagagagccuguugugggcuuuugaaacauuacagcccaugccuguggcacacuucaccaaggccacaccuacuccagcaaggccacaccuccugguccuugucaaguagagcuagucccugauuaguuagcacucagauauaugcacccaaggggcgaagcuuauucaaaccagcacaccaccuauuacuuuucuuagaagauuccuauagaaaagggagcgucugugccuaaucacaugaaugguuaccaaaucugauuucccaaacucuuaguuaauccuuccuggauuccaaggcuggcuguggguuuuaguucuaggccuuguuuuuagguacucacaagccucugcaguggcugaacucuuuugucacguguacaggcucuggguuugagcccagcacuguaagcaaagaagugauugacuucagucuagacaacagauuuuaguaguugacaggaacuagauuuguacuaauuuaagaaagguauuauucaucuuuauuucuaguucuuacuacagcauuuuaauuguagauaaauguaguuugugacacccuaggguguaacgccuucuucccuuggccaagaugauguauaaaaugucaacgaagauuauucuucuuuaacaauaauucuaaguauuaccaaguuccauaaaccucaaauugaguguggaggagaaauaucuuuuaguuaggucugugucuuuagcaaauaugggauugguguggcuuguaauagcccaugccauuucaaguauuuauuaugaccccaggugcccuuccccgccacucuuaagucuaccagaaguuuuuucagccauuuucuccaaguguagcggauccuacuucuuguaucaucucucaguguuaauuauaaggcuuugaucugccgcacuaauuaaucaguaauuagauaguacaguacgaaaagaaauuaacaaagauaaaaacaaaagcagcucuccacgcaggcugcagcaucugguaacuugaucccaaaucuuguugaggaaucuggguuaagugcucuuuacccaugaacuccuuugauuuugguggugguggugaccucaaguaacuaauggaauauacagguaaauaaacacucugguuagcuaggggcaauagcaccuaugagcccugcacucuggaggcagaggcaggagaauugcugcaacguucaaggccagcccaucuaaacaguaaguuucaagcuggcaaggaaaacagugugacucccuguguccaaaaucuguaaaagcuaaacaaacaaaaaauacuugcuuacacugauuugucauugucaccuucuccuccucucucuucuccuccucucccuucucuuccucuuccuucuccuccucuucaucuuccuccuuuuccuccuccucuucuuccuccuccucaucagaaaucugcuuuauguaugaagaucaauaauuacuuugaaauguacuaguauuuuuggaaauguaaaauauaaaugcacaguuuaaagugauguguaaaauaaauucauaguuuauagugguauguaaaauaaauucauaguuuauaguguuguccucacuauuguuuuucauuuuaaaauucacauaaaccagcuuuuaauuuuuuugauuuuuaauguuuuauuagcacuuaguaguugcacaggauaacagauuucauuacauuuucauacauguauauaauguauuuggaucaugguuacaccacauugccuucuccaucccccucucuuugauacauucuucccagaaaguuccacuucuccuuuaaugacuuuuuguccuuuucuagauuuaaauuuuccuauguauuuauuuugcugaggcaaucauugggggaacuuaagagacaugagcgagagguuagugacaggaacaugaguaucuugccagggguuuaacacaaggaaaacuucucuucuuccagcaaccguuggguccuuggaggaggugggccuugccagcucuccccucuccuaucuguuaugcaggaacucauggcugcuuuugauuucagucuaccacaccucacccauccaccagcucuuguccucucuuuccacgguguucccugagccuugcagggagugacagagaugucccauuugugacugagcauucagcaggcacucauuuccagcccuuuccugguagguucucuacaguuccugcuguccaccaccaagggcgcuggcagagacaguguccuagagacagugccagcucaggugccuccccacuggugccucugaccuccucagccacaggauuucagccaggauuacaggaccagaggugggguccuuacaguggagaggauccccauucuaacagaaagugcuugguugcucccauaagacuguaauccuguaccguguacacacccugcccugccaggcagcaguguagauugcagucuacacagggaugaggcugcucacaguucucccuggcaucuuccagcacaguggggagcuagcuggcaagaaagaagcuuccagccuggacucaccaaccuggucuauaacugugguguggcacaugccugaccaggacacaucagagccauugauuauuugaauugucagcuagaccucuaaaacaaaauguuuaccuuacguuaaaaaguacaaacacaccucucaaaaugaugcaaggagaauuagugggaagggacucugaaacccagauggaugugggcagaugucuaacaaguauuguugggaaccuucaaguguugcgggcaccuucgcauccucaggugccugcuccucucugguccuggauuuagaacuuuuuugauguauuaguuguguauuuucucauugcuaugaucugcuaugaccugacagaaaccauacaagaauccauuuugucucaugauuuuugagcguccaggagcuagacucaguaugacagacagguaaggagaggggccauggcuagauauccaggauggcugguuccuuccuuagccuccugacauaagacaaaacccuggcagcuccugugucccgccagcaggccccugccgguggacuggcucggcagguucaaggccugaccaggacauguugcaccacaugugauuacaccacaguugcagaccagucaggcaccaugccugucuucaaagugaccaaucaggggguaggaaagaagaccuccacagcucucaaaaccccuuucuccuuacuccuacccucuguaaucaugaccgcauagggagucugagccugcaccacacucggggcgcaugaagguaccucacccucuucccuggugcugcgucucuguaguaaacagcgucaccuuuugcuggcuguagggauccuguccacugugauggguauaaagcuuguggguuugugccauugucuuguaaguucccacggaagcaauuuuaugguccgggcuccugcuugcuuauacaaguguuuuuauuugccaggcacugaaagaaauaauuuaccucuugauggaacaguuuaggguguaaggacauagauccuuggagaaggauuuuacaggaguguuucagacguucuuucaauccaaguguaccagacgauggaaacccguaauaacuuaguaucaguguagauauccggaagucagacucauuuucuguaacuucacggugaaacgauuaccgguguguuaguugcuuaucuugcugcuaugacaaaaguacgugaggaaaacagccaagaggagcguuuauuuuggccccaguuugagaguacagccgucugcggagaagucgugcagaggagcuucaccucaagaguugcuccucagagacauuuacagccugugguauccacugcugaugcccuucauagcacuugccauagccagagaggcuucugucccugcugguuggucugucuuauucagcaucaguggcacccgcagcagcaucuucuggcucaucagcacacucaauagguaguuguuggaugaacaaugaauaaagguacccucuucuuccuggugcauauggcuucaauuggauccugugaccucuuauccguaaaacaacuggcagaacauuggcuuuuccugaggauucauuagaaaguaacgauagcaugagcccagacagacagcacuucuuccuguuuuacagaaaaucuucagaggaacuggacauggacaaggugacugcagccaugguauugaccagcuugucaaccagcccuuugguccgaagcccuccugugcggccuaauggugagucuagaguauggaacgugcccauuagcuccaagagcaaggccucucucuccuaggaaucucauuccucccaauaaacaguuggcuucaaauugaagacuaugugggaaguagagacccagggccgucagccucccccuccuccucucccuuacaccccaggauacugaugugcucaccuacacagcucacagacacugaguucuaccacuugauuacucuguuucaggacauaccuaugcaguacuuaugugccuuuuuccucagguagccggagaauggucuaacaaacuugucuucccagcaucauuuccuuuugauuguaccagugagcacacugaagguugaguaguuuguagaagcauuaucauacacuucauaaccaaagagaauuacuuaguccauucacgaacucacuguauacuuauucgaugccaccuagaagauuugaacauaucaacagaauauaacuaguggccauacuucuagggacugcgcagucuccuggggagaagacugucauggccuuguuaauagcuagcacauugaguaugcugucugugcugcuugcucuaugucaucguaugucuaccaacaagcguaugcaauacuguuaccacugcuuuacagaggagggagccagggcauguguggcuugaugaauaaaugaccggacuacauuucucgguccuaucuucuucauuccagaucugccuuucuagucaugcuucauuuaaucugcacgauaaaucaggaaagcagacagcgggaguuggaguugaauggaugauacuaggcacuuuaucaugacagguccuggaugccuaaggugguccacacagagaggggaaaguuuggauuaggacagcaggcagcaugcacacauguauguguguaagugugugcauuuaaauacagacauacacagaugaacuuacaugcacugcauaggcacaggcauugagaugaaguggccauucuugcuuaguggccuuugggagccucuuggcaaauacccagauuugccuuucucaucuagacagcauggcuggagguaaaacugggguagcccccaaaccauucuaggaaugagauugaauacuuagagggaaaaagauauuuuaaaauuaaucauuauuuuuaccauacaauucuuuuuuuaaaaauugagaacauuucuauugauacuuuguacuuaaagguuaaaauuaaaguaaaccuuuugauucuucaauugcaauuuucuguucacucagcaauaagaguaugccagugcucauuugugguuaaaacaaaacaaaacaaaacaaacaaaaaaacagcuauuuaccuaggcaugauggcacacaccacuaaucucagcacugaaggggcagucucucugaauugaugaggccagccuggucuacacagagacccugccucaaaauaaacaaauaaguauauaaauaaaaacuuuaaaaaauaacuaccucagugcuaaauuugaugucucccacugguuuucaaaaggaagcaaaauuuuaaagcaagggaagcaauuuauaauaagaaaaucacuaguuugggugggaggauggucguucuccagaauugugguguaucagugaguaggggaacguguugugaucuucuccugugccugccugagacggguugcuccauuaggagguagcuuugcaaacaggugagagcccagcugggcccaucugcgucuguggcuuaugcucacuugggugcuguaucccagggaacacucugaaaugacccuuucugagucacuugggcuucacaagcugguaagccgacgcgacgcgaugcuguagugcacugugagaauugcuaguuuucaaaagcaguucagccgcuccguugugaugugguagcauguguauccagcacugccacuuugauuuuauuguacaaaugugcgguaggguaugugaggaagucauugguuuucacgccuugugcuaguuuuaggaggucaccacaucuagccaucucucccaucagucugcaggaaggagacucgaagucacuuugugauccuugcaaggugcagguaugcagaaaugagcauuuaauucuggcagagguucauccccacgaaauggcagcuucuguagaacuucaucucuaaaccuagugacuucuacucaacuuucagcuuuguguaguugaggaauuugcuggaaaucuauaauuaauuagguaaggguaaugauuucccacaaaugccuagucuacuagucaucuuugcugcauuaguaauuacacagacauuaauaguauuuuuuaaugaggcauuuugggauguuuuuuucuuccuccccccucauaauuaguuuuaauauauucauggugcacauaaauauggaagagaaacuacccagaaaaaaguaguuuauguaaauacuaauuaaguuugagcaucuugaaagauaaaguaagucuauagugacuaaagcccccuccucugacauuagcaggaaguaaucucugucagacuaccuauaguucguuugggcaccagccuagucaguaaacccugaugccauccaguucugccacagagauaaaaggauguucacagugaaggaccuacaugcgcugcaagaccaagggccacuaucagaccaauucuagccuuggccagccagguucauuuccuagguagagagcaggcagaugagugcccuaaggucuagggggauuggaacucaggguguguaagcagaaaaggggacugauaagugugaaggaggagacuaguaauugggggccagagggaaaggggaaauuagagugaggggucaugacccugauauaugacaaugccaucacgaagcucuguauucugacuuugacaauuaaguuuaaagggauauaaaagcagucagaaucuaaggcccaauuauuuguuugcaucgguagcgguggacuugcuuuagaugccuaucgagaaaugaccauugcucacagagucuuugucuacuuucuuaugcguauaucccaagaaccguagucguaugaguaaugccauuuuuaaauugggauggggaggagcaggguggaggcuugccggccagauaguuuggguagcuaccaugggcagucucccacucagaagcacuucagccagcaaaccagaggccgcacaguuggugaacaagaaguaaugauuauuuucuuguucuuguaugaucuccaccaauuccaaggaaggagccggacacuagaaugcucacugagagcacagacaguguguugcaguguggcuagaacagcugcuuagaaagaaccgugugacuggggugggugaagacagagccccuuucccggaggcucucacuugcuguccccugugcucacagagggucucagcggguccuggaaggaaggugcaccauccagcagcagcagcaguggcuacuggagcuggagcgcuccgagugaccaguccaacccauccacacccucuccaccacugucagcugacagcuucaagcccuuccgcagccccgccccaccugacgauggcauugacgaggcagacgccagcaaccugcucuucgaugagcccauuccgaggaagagaaagguagguucgcggugcacuguguugugcacccaagguccugguaugcacucucacccaccccaugccuggucuuagugcucucugacauugcagauuccccaauuaaagacaaaagugacugaagccuccaugucugugucccauccgacauguaugcuccaucuguguauacauugucuaacacccuuaccuuucuuagaagcugaaauacugaacugaggcuuccugugcgugcaugcucuuaaaauauaguauuuuuuuucuuuucugcuuccguuagcccaaaaggguuuguucauuuuauacagauagauaggaaagauacauaaaagcugacauauauacaagucuacuucaucccaaaaauuacguuuaccaaacagaaauguaaagaauagcuaaauagaugaauagauuagagcucauuagacuuacugaccauacauguguugguccucacaguagagcucuguagagaccaaggucccaggauacauuuguuccauagcccugcaguccaccagagccaccaugcaaauccacagccucuucauucucuucaggagucuuucauuuauugucaccauuuucuggguuuccaguguuuuaacauuuacuuauuuaugccgugugucguguguuuguuuguguauauagaaguuagacaacagccugugggaguuggucucucuuucacuauguggguucuaagaauugaacucagacuuggcagcaagugcuuuuucccaccuacaucauucucacggaccugucacccucuguuuuauagaagcauuuuuauuucauagacugcaacacugcuacuaaaucuagggaacacuuuagcauuguuugaaaguuaugugaagcugugauuuuuuuaugcuaguuuuuaauuuuauaugggugucaucauucuuaaauaugacucauaaacaaggcaaacugcagccccaaggauguagucagccuuguccuccccugaaugugguccagcauccucucugcuucccuuggcaucacucacagugcgcagcagugagcacuaccauggcucucucuggguaugccccuaggauagggccauccaccagaaaggagggccuuugugcagcaucccgcuguucccagaagcaggguccugccugaagaguccaucuuaugcaagggcacucugcgagacacuuggacccguggauagaauacacagagagaauauacagcagcguggagcugaacucuugcuuagccugccauucccagggaaucuaagcaagcaguccugaguauggccaguguuguggcaagaccucauacauagagcaggggcccucuagugcuuccaaagugcauuaaugaauuaauugaucgaucaccuaucagagaucaguuuguauguuuuauagaacugaaagucauuuuccucccuggucaggcugcauuggacuggcucggguaggcuauccacauaccucagcaaaauuagcaaacaguugcaucaccagaggaaagagugggagcuuccccauggguacaggacuugacacgcaguguguggacuggaguucagaucgucagaauccuuagaagauggacacaguacugugcuuccagagccucagugcucuaugauggagaugagagacuccccgagaccucacaagcccgauacacagaacugacaccuagcgcgcacacacacaccacuuauuugaagaccauaggcuucauuuacaaaaugcuaaguguggacacaaacagguugguuagaacuagguauuaucuucuagacucagccuuccccacagugauaaaggaacugauggcgccauguugugcggccuuggccauuuguaucuaaacuuacuuugaguaguuuaaaaagaaaauaggacagcugcucuucacccugcuguuuacuuagugaacuaauauuuauugagcaccauaggcaaaacacugaacagccuggaagcagggcacaagagcugguccauucauucacugagagcugggugggcacagguuggugugugaaggggcuggaguagcuucaaacgcugucuucagauguugcaggaugcaagcucugccauuacaguuacuguacauuucaaaccguaucucaaacggucucuacagaacucauuguaggacuugcaaugccaacuucugucucagucucucagacccuuccuaucugggcugaauggcucccaccaaagaguauaaaaauauacagcagcauuugcacauucacccagggagcuucaagaaauguaccucucggacaucaaagaaaucucagaauuugccauaagaagugggaacuccagcuguacacacugacaaccaggguagccacaccacccaggagaagagaaacaggaauguuccguggcaugucugcgucggaggaugcacuuuagugaccuucgugcauuaggucggcaaucgugagggaugagaacugacuaccaagggaaaagauauaaaccuaagaaauaacuaauuugucugggcagacagucuguuuuuguugauggagcuuccuaauuucuuaccuguucuuuuagauccuuacuguccauuugaaaucaacagucauuugcaggggagguuguuaucuaguggagguuguuugagaaccuucuacuuccagauugacugggaggcugugagucacuguaaugagaggugagcgggagugaggauccgcugaagguguggggucagcacugcccucuguugggguuuuuaucucaacagugugcugacacgugaguggguccuguacuguggccugucacucagaacguuuggaagcaccuagaccaugucaaaugauccccaguccauccccucagccacugcucugggacccuaagaaagccagcuugacccucgagauggcaccuuuuuguaaaccugguaaugcacccucacaccuugagggacaguugugaaguuauuaaaugugauuccacguacgagagcaugcacucuuuuaacagacauccauucccuagacuguaaacacagcgagagaaguguucacugcacguagguaugggucaugauugcggacacccuccgcucugucugaccugcuaacacucgaauaaggaaguucaaagugugaagugcuaugcacagacacguauuaucugaugagcacugcauuuacacguuuugucacaguuuaucagauguguauacaugcagcuuuucauuucauuggacccacaguuuucgguagagccugauucccacuuugcagaagcaagugauuaaauuuguacggcuugcccaagguuguuuauauugugacagaaaaacagugagcugagcauaaauaauagaggcugcuugugagcaagaugaguaaaagaauccacagaggagaauggcagccuagucuaugggccggugggagcugaggcacaagagggacacuacuccuuccucagccacagcggugaaaugugagagaggcaccaagcuguccuggcucugcacgucacuuggccagcuuugggagggcagaaucuagcagacuuuuuuccucugguuucuuucuuucuuuuucuuuauuagauauuuucuuuauauacauuucaaaugcuauuccgaaaguucccuaccccuaccccugcccugcuccccuacccacccacucccacuucuuggcccugucguuccccuguacuggggcauauaaaguuugcaagaccaaggggccucucuuuccagugauggccgacuaggccauuuucugauacauaugcagcuagagucaagagcuccggggguuacugguuaguucauauuguuguuccaccuauaggguugcagaccccuucagcuccuugggugcuuucucuagcuucuccauugggggcccuguguuccauauuauagaugacugugagcauccacuucuauauuugccagguacuggcauacgagacagcuauaucagggucccuuccucaaaaucuuucuggcauaugcaauagugugugggguuugguggcugauuaugggauagauccccggaugggguagucucuggauaguccauccuuuugucuuagcuccaaacuuuagugagguaacccaaucacaaaggaagucauuagauaugcacucacugauaaguggauauuagcccagaaacauagaacacccaagauacaauuugcaaaacacaagaaaaucaagaagagggaagaccaauagguggauacuucauuccuccuuagaauagggaacaaaauacccaugaaaggaguuuccucugguuucaaauagauuguuuccgaacuacuauggaaugugacugggacucugagaagaugcaguuccugucaugaccacgaggugaugcaaugacccaaaguaugggcacuaugguacucuccagagaaaaccaauucuguagaaggguaaaaguuaacuaccaauuccacaagaccuucuggaaagucagauuccugguucugucauaucuaggugugauguucuguguauucugaaguuggggugugucacugcugugcugugugugcugugcugugugugcuuucgcccuuggaugcugaguggguugggagcuuaggaacccuaggcauagagacaagaugccaugggccugauccuguauugauagaucagugcugaauggcucacggugacugugaaccccucagucacccagugcacuuuugggguuaaugugagaaaacucgcugcaauguugugaguuuggguagcucuggcagaaauugggaauacacaggaaaccugacucaggagucugucuacuggaccagcaacaguaccccagaggcgcuuauaaaccugguuuucaucacuuucccuugguucguagguguggugaccauggacaguuuuacuggggguugguuggaggggagcuugaaucaaaacaggaagcuguaagcuaacacaggaguuucgguagcuguguggucuucaaccacgaguuaagcauuugcugcacucugcauuuuuuaucuuugggcuuauacuuaucccccaaaacacacagaucuacaaaacucauaaguaugauguguuguuuuaaacaaaaucccaauuguucaauuuuaccaaugaaaacuugggagccagaugcugcagaugcuggaguuaaagccugcuagcucagacaggcagagaaagcaccaacugaccuuccuccuuaguggaccucccaaaaccgaaugucccucccuucuacuuccugugcaucugccuaucagguccuccugacucccucuuacuaugucuuuuuguuaauaaucacauauucgcucccugucaaaugccucuugaccuaugguugauuuuacuuaaaucuuguuuacaguauucaagcaaaaaguuccuggauuaaaaguguguguuagggcugagcuacaccacaacuggaaauaaguuuuuccaauaaauaacacaaucucgggguccacagugugguuacauauccugcaacaguggugcccaccugcaucgugaacucuacagcguucauuccgaaucugcuucucaggagcaggaaggucucccaagggagugcugugcagaagcggucccaaugaggauagugcgugagcacaccaaccccaaagguacacugggugauggagaggcucaccacccugagccacucggcacugacggaucaauacguaucaggauggaggcaaguguucucuuguuuccauaccuaggguucccuagccccccaccugcccagcauccaaggcacagcacagcacagcaagcauuagcagcauucauggcucuuccaucuuuucauccguguguguuucucuggaaugacacaucaucaggaagagcagcaagcaguuaaccaggagaggaagagcacagaucagagcccugggcucccagaguccagggugggccagccauguggucccuagguugagggugcuggagcaccgaggaacucagacagcaucuacagucguccuaaccauccaaucucaccuaggagucaacaggacaaaaugcacuucuagaauccauggauuaagaaaauaauugacuagggauucuuauuaacucaggaacccucaggccacacguuuaccucuauaguaaauuccuaucacugcagugccggccauggugggacuggcugaggggaaguggaaggaugcaggguucguacaagguccuaaguucuggcaacaggaaugaaugcucacucgcauugccaguagaaaugcaaaaugugguauaacuacuuugaaaacuaguuuggcaauuuccuacaaguuaaauaugugcuaagcauacgacccaggaacucuacuguugcaucuguauuuaccuaagagaaaagaaaaugcguguccacaaaaagacuccuagacaaagguucauugccgcuuuauuuauuaucaccccaaccggaagcaacgcagaugucugccagcgggcaugugaaaaaggagacugguguauucauaguagaauaccacacuaccaaaaaagagaaaagcuaccaaugcacagagcaacgggccacugucagaaugucagcgugugguggggauucagccacaggagacugcauuguguguaugcugugcacagggacgucuugauuguucgucguuuuuaagacagccuuacuucaagaccaagcuagccucgagcucacuguggagccgaggauggccuugacugacuuugucuaccucccaagugugccuauguguuuauacaaugcuggagauggagcccacggccccuugguaccugcuagcaagcauuaccagcugagccacacccuuugaauuuacucagcacugcucgggaccaagcuguacacauggguggcuuuaccuaaucugugcuuggcauauuugaauucauucacuuuguguuuacaucacuaguacuaaucucauuuaaucuguuuguuuuacaaauaaaggggcaagagaaccccauaagcguaagaucacauuuauaaagcuggagcuccauacaguagcuauuucuuuagcuuuugucccuugauaaggaucuuagugaaccugcuuaccagagacaccaagacaggcugaaagggauacauggugaggggcacuugacuuugcacaggaaccugauccacaguucagcaauuuggacaucaaguaucuccccuccacugcaguauaaacacacacacacacacacacacacacacacacacacacacacacacacacacacacgaggugauuguauccacugcaguauaaacacauacacacacacaugaggugauuguauccacugcaguauaaacacacacacacaugaggugacuguauccacugcaguauaaacacacacacacacacacacacacacgaggugauuguauccacugcaguauaaacacacacacacacauacacacacacaugaggugauuguauccacugcaguauaaacacacacacacacacacacacacacacacacgcgcgaggugauuguauccacugcaguauaaacacacacauacacacaugaggugauuguauccacugcaguauaaacacacacacacacacaugaggugauuguauccacugcaguauaaacacacacacacacauaaggugauuguauagaccucacaacaaccauauugaauaauaauacaucccugagggucuccagugcauacaaaacaaaacaaaacaccaauaugauccucuaggcuguaaccaugggccuucuaugccuaccccauggaggcuuaucuuuauuuacagugguuuggccuuaguuuauucuugcuuuccaacuaacucuuaacuuauauuauugcaguuaugcuauucugugucugccacauggcugguuaccucuucucagcuucauaugucagacuuccuccaagucuggguagggaaucugccaugccuccucucccagaguccucucugucuggaagucccaccuuacucuucugccuucauuuuaaccaaucagaaugugccuuaggcaggcaagggaggacagagccacaucuucacacagugcacaaaaccaucaccucaccacuaggccacugugcuacaguggugcucuuauggccucuggaguauuaauucaguguaagcuaagcaugucaaaaucaaagccaugccccuccaccuggaguggaaagcuaccgcugccagccacccuguuugccuugugcaucagucuaggcuuuaucgggaaaauagaaggcacuccauauaucccaaguaugaaaccauuuuaaaauagcacuguggccggguguggugcucaggccuuuaaucucagcacagucuggggagguggcauauaggcagacauaucucugugagagccuggucgacacaguaaguuucaggacaggcagagcugcauagcgagacccuaucuugggguggaaaauaggauugugagucaggcuuuguggcacggaccugugguuccaguacucaauaggcugaggcaggagggucucaaguucaagaccagccugggcuacacagcaaaguacuaacucaaaaagauaaauaaauaaauaaauaaauaaauaaggaaaaauaauugagaccugaggucaaagggggugccaccagcacuggggcacuuagucuucaaaccagccauacaguuaaggaaucuccagaauuucucuuuaacccacgagcagauaacgaagagccugccaggaaacaucuacacaccucacaugggacuaaaauuccgagucugcaacugucuggagugcccagcucuccuggaaguguuguaguauuagcugagguaggaggugcaaguucccgcuaauaggggccuccucugcccuuccucuguccuucagcugcucccugugaagagggccugucugugaggcuucaggucagcugacaggacuuugauguucaacaaaaucacuuuggacugggggugaauuuucagcuguugcccaugccuuugugggcagcacaucuguuggcgcccuaaggaggggccagcacugagcacagauaggccguucacacuugguugcugugacuuggccaggagcugcuugguuuggcuuccuccagacagcuuggcccacgcagcauuuuggccguuguuuauuuagcuauuuuuuccuccuccuguggcuugcuuugcucugccagagcagcaaguagucagucuguggacagagguugauuucaacuggauagagugaauauauugaaaagaauuaagcuuccauuaaguggcucuggccuagggaagcggacccuuggcuuguguagagcaaagcugccggagcccauugaagcugcgacacaccuccucuccuguuugcuugucuccaguuuuaggcaggcucuauuagucaagucagggucaguuugcuuugguuuuguuggcaggaucucaccauauaguccugccuggucuggaacucccuguguggaccaacacggcuucaaacucacaagagauucacauaccucugccuucugagugcugggaauaagaaagugugccagguugcccagacgagacauaauuuguguaaguuaagaauagauagcagugggucucaauauagauuguucaccaagcucagggcccucaguucaaacccucagcaccagugaaggccaagaaacauaccagcaaacaagccaaaaauaggguacuuuuuaaauguugaaauuaacauaaaauauaauuuuucccaguuuuuugauugguugggguuuguuuguuuguuuguuuguuuguuugagacauagucucucuacauagcucuagcuguccugggcucacuauguagaccaggcuggccucuugggugcugggauuaaaggcccaguauuugcuuuauaaaguuuuaguaucaguuuugcuuuaugcuugguugcuuucacccucacuagcaaauccauuccuucauuggcauuagagcccaggauuccagguucuagugaagacccguuguaacauguagccuuuuaaacggagaaacuuauggauucuuauuagacuuucuguucguagccaaccauuaccgauuagcuggaccccacagccuguuuauuuauuuuuguguaugacuguuucgucugcauguacguacauaaaccauguguacacuuauucuuggcagagguaagaagcgggugucagguccccuggaacuacaguuacacacgguucugagacaccauauggauacugggaaucaagccuggguggucugcaagaacaagcauucuuaacuacccagauacagaaguguugcaacugguucucuacacccauacuucaccugcccucuuucuuccacgucuaggaagacucugcuaagauggauggggagauguuuuugagaaacucugggacuggaccaagcuuauuccgauauucugcagguccucccguuucacuccacucccucuucucaguuccuuuuuauuguguaaucuaaaacugugucugcuuaaaucuaccuuaaaaccuugcucguccauccagucugggcugggugcccugagcagaccuugagcacgaacuccacagccagucccacaacacccagaggaagcuccacuuccaggagcucuaacacgcccaggaucagaggaucccaggaucccagaauuguaggaucccagagacagcugaacucugaggaguucugacacaagcaggaucacaggaaggacaggcuccaguuacuuggcaucaucagaacccaauucugucaccauagcaaguccugaauacacuaucacaccagaaaagcaagauuugaaucuaaaaucacuucucaugaugaugauagaggacuuuaagaagaacauaaauaacucccuuaaagaaauacaggagaacacagguaaacagcuagaagccguuaaagaagaaacacaaaugccccuuacagaauuacaagaaaguacaaucaaacaggcaaaggaaaugaacaaaaucauucaaaaucuaaacauggaaauagaaaaauaaagaaaucacaaagggagacaacccuggaguuagaaaacauagaugcaagcaucaccaacagaauacaagagauagaagaaagaaucucaggugcagaagauaccauagaaaacauugacacaacagucaaagaaaaugccaaaugcaaaaggcuccuaacugaaaauauccaggaaaucuaggacacaaugagaagaacaaaccuaaggauaauagguauaaaagagagagagaagauucacaacuuaaagggccaguaaauaucuucaacagaauuauagaagaaaacuugccuaaccuaaagaaagagaugcccaugaacauacaagaagccuacuaauaaaacuccaaauagacuggaccagaauaauaaucucaucacauaauaaucaaaacacugaauguacuaaacaaagaauauuaaaagcaguaagggaaaaaggucaaguaacauauaaaggcaggccuaucagaauuacaccagacuucucaccagagacuaugaaagccagaagagccuggacagauguuauacagacacuaagagaacacaaaugccagcccaggcuacuauacccggccaaacucucaauuaccauagacggagaaaccaaaguauuccaugacaaaaccaaauuuacacaaauccagcccuacaaaggauaacagguggaaaacaacacaaggagggacauuauacccuagaaaaagcaagaaaguaaucuuucaacaaacccaaaagaaaauagccacacaaacauaauuccaccucuaacaauaaaaguaacaggaagcaacaaucucuuuuccaaaauaucucuuaacaucaaugggcucaauuccccaauaaaaagacauaggcuaacagacuggacauguaaacaggacccaguauucugcugcauacaggaaacaccucaguaacaaagaugggacacugccuuagaguaaaaggcuggaaaacaauuuuguaagcaaauggucccaagaaacaagcuggaguagccguucuaguaucaaagaaaaucaacuuucaaccaaaaauuaucaaaaagauaaggaaggacacuucauacuggucaaaggaaaaaucuaccaagaugaacucucaauucugaacaccuaugcuccaaaaaccccacauucauaaaagaaacuuuaguaaagcucaaaucauacacuccacacauuaauagugggagacuucaacaccccacucucagcaauggacagauccuggaaacagaaacuaaucagagacccagugaaacuaagagagguuaugaagcaaaugaaucuaagauauuuauagaccauuucacccuaaagcagaaggauauaccuucuucucagcaucucuuggaaccuucuccaaaauugaccauugacaaaacaggccucaacagauacaagaagauugaaauaauccugugcacccuauaagaccaccauggacuaaauaucaacaaaaacaacgaacagaaagcccacauacacauggaagcugagcaaugcucuacucaaugauaacuuggccaaggaagacauaaagaaaaaauuuaaagacuuuuuagaauuuaaugaaaaugaagacaacauaccaaaacuuaugggauacaauaaaagcagugguaagaggaaaacucauagcucugagugccuccaaaaagaaacuagagagagcacacacuagcagcuugacagcacaccuagaagcucuagaacaaaaagaggcaaauucacccaagaggacuagaaagcaggaaauaaucaaacucaggacugaaaucaaccaauuggaaacaaaaagaacuauucgaagaaucaaccaaaccaggaggugguucuuugagaaaaucaacaagauagauaaacccuuagcuaaacuaacuagagggcacagggacagcauccuaauuaacaaaaucaaaaaugaaaagggagauauaacaaugaaauacauguuaaaauaauuuuucuguuugaugaacauuaacaguugaaaauauaaucauguucuauaaauauggaaacauuauugauacuuuuucucacugcuugaaauuauuauuuucuuaauguuuuuaacuucaaagaauuuuugcuauuuugaaauuuuuaaaauuuauuacugauaaaaucucuccuagaaaugcugguaaucuuuuuuaaguaaacugauuguuagacaauauacacagaaauauaauguauuuuaaauacucucucacuaugucagggguaucauauaagggcuuuugaauguauuucuuucuuauuuuuuuuaaaaaaagauuuauuuauuuauuauauguaaguacacuguagcugucuucagacacuccagaagagggcgucagauuucguuacagaugguugugagccaccaugugguugcugggauuugaacucgggaccuucagaagagcaguuggcgcucuuaaccacugagccaucucgccagccccauugaauguauuucuuaaugauucauuuuuaauauuuuaugcuccuuuacuaugcuuaauuuccaaaggauaucuuguauguuuugaaacaauuuaguauuccacauuagauauaggauccucaguuauggauaguauuacauauucauuaaugauauuuuuaggguaugaaaggauaugaauuuuuguaaaaguugaacaaaguuuauguguauuauuugauucucaaaauacucaauauuauuaauauguuugauguauaaaauucauuuaauuaauaaaaaauuuaaaaaauaaauuuuaguauuuaaaaaaacuuacaaauaacuauaaacaucacauuuucacuuccucucucccacagaaauauuauuuauguucuuugauaauauguguucuuaauuguucaaguucuggcagagggccaugguacacucagguagccuuaaaguuuagucuuacaaagggagugagcaggcauggugggagaacccagaaucuaagcccaucccccccaccacagccugaggaagcgccggaccagagggacucccagaaccuuggaauaaccagagcucuagaagaaaugcagcucuagaagaaaacaauaaccacacacagguguggccaggagaagggaaucgggauuuucuccacccuucugcauucugacaucaccucccauuggccacacccaccacaagccggugggccugagcccuugauuguacccugggccucacgugggcaccgagugggauaagaggucagagcaggauggccugcagagccaagcagggcaaauucucuucagccguguaagcuuaugaacugaugaggucgccugcucagucccacaaaguaaaguuaauuggaaaaaaaaagaaaguacugggccagagaggugacccugcagucacgagcacuaagugcuggguucuguucuaagcaccagaaucagagcgcacagcugcagcugcugcggcugcaggagaucagugcauucuggcuucaucgggcccugcacagccauagcacacacagacaaguccacguggauaaagaagaauagauuauuuucaaaaagaaauuaaagaaugaaaaauauauuguagcuucauuuuuagcaugcucaguguauaggaaugguaucagcugcuuuuuagcauacucaguguauaugggauggugucagcugcuuuucucuugcugugaugaaacaccaugacuaaggcagcuuacugcagaguuggguccaugauagugaauauaaagggaggggcaagaaacugcgagcucacauuuucaaucacagcacaaaacagagagagagagagcaccaggcuuugaagacucaacccccccccucccacuggcauacuuccuccacugggacuauaccuccuaucuuaggguuuacugcugucaacagacacuaugaccaaggcaacucuucuuuguuuguuuguucauuauuaauaauuauauuauuauuuauuaauuauuuuauuuacaucccaaauguugcccccucccagaguucuuccccccaaccccuccucuucgccuaugagaggaugccccccuccagugucccuccucccugggucaucaggucucuacaggauuaagcacaucucuucuacugacaaggcaacucuuccaagaacagcauuuaauugggccugcuuacggguucagaggcucaguccauuaucaucaaggcaggagcgugguaacauccaggcaggcacggugcaggaggagccaacaguucuacaucuugaucggaaagcaguugggagacugagucuucugcacugggcagagcuucagagcccacccccacagugaugcacuuccuccagcaaggccaccccuccuaauaaugccacuucccaugagccaacggauuuaaaccaccacaccuccucagccuauccuaacagcucaaucaacugagaaaccaaguauucaaacaccugacccaaugggggccauuuucacucuuaaacagccacagggauuaacuuagcuaagccccauuaccaaccuaaagauugguaugaugacuaucuuuuugcauguaugcuacagcuugagugugauguucucacccugucuacacacacccuuuuccaagaagcuuaugugugaagacuuggucugcggcuuguagucauucagaauuuuuuuuaacccauugagucuaauuagcuuugcccaaauuugcauggguguggggccaucuacucuugugugguugcaccagccagcagccacagacucccccucguccagcagccugccacucucaguagcuucucugcuagagacaggaucccacucacuuggcagugcugacuggcuugagcuugggcacauccucuacagcagccucacagcucuaacuuggugagcgcacaguguugucacgaucagaagacacuguuuagcugugguccuccccagccucuggcuguacagccuuucccccucccaccucagagauggucccugagcgucauggaggagggguguaaaaucgaugccugacuuuuggcugagcaaagcacagacacuuuggcccauuaucagugccuguauuaacugccaucagcugauaagaccugagagccgcagucgucaaaugcuuuggcauaguauaaucaaaagacacaggauuugauacuuacaugcugaggaaugagaauaagaaaauuuuguuuuauauaauuaagccauguauguuucuauaagagcagaaaacuuucuauguacuguaaaacacugcaauuauaacauauaguaggcuucaaagcugaauccagauguucagggguauaggcauuggguggcguaacaacaugugcuauacagaguguguaugugucuggugugugugugugagagugagagagagauguauguauguaugugugguguguguguguguguguguguguguguaugguguauaucugugugugauguauauguuguguaugugugugugugguguguauguaugguaugugugucugguguguauguaugugguguguguguguaugugugguauguguguaugguguguaugguguguaugugugugugguguauguguguguguguguguguguguguguguguaguguauaugugggguguuuauguguauguugagaacaaagccuacagugaaguuaggcaauaccccauggguaaggguucccagagacacuucagaauuacucugcuuuuaguauugaauuaauugugaucauuguuguuuggaaacuguuugcugggcagagaagguagcucagcuggugaugugcuuaggaggacuuuagcuuaguccccauguguaaacaguguauaaaagcuaggcucaacugcauacacuuguaaccccagugcugagguggguaccagcagcuccuggggggcuugcuggccgaccagccuaguauucauggaaaguucuaaguacugaaagaccuugcaucaaacaaucaggugggugaugccugagaagcagcccccaaggcugugcucuguccucugcucgcaugucuuccugugcacauacccauguccccucacacaguaauacagccacaaaaaggaaaacuauugcugaguuauuccagauugaguuaucuugcguguugcaugacugcagcaaaggcuauaaauuaaucaaguguuuuaauguuaugauacuuuagucuacaggcaguagacacagcucagcagguaagguaacuugcccaccugggccugaagacaagcguuugauucccaggacccacaugguaaaacaagacuccugccuuccacaugcaagcaaaccauggcauagguacuaccucugucucagucaccguucuaugcugugaagagccaccauggccaaggcaacucuucgaagagaaggcauuuaauugggggcuugcuuauaguuucagacguuauuuuaucaucaucauggcagagagaauggcagcaugcagacagacauggugcugcagaaguagcugaguccuaaaucuucauucauaaacagagauagacugggccugaugugggcuuuugaaaccucaguuccuagucucaguggcggccacauuuccuaagugacgaaguauucaaaucugugacgcuaagggaggcauucucauucaaaccacuacaccccucacacacaugcacacauguaaacauacaaacugaacacaauuucauuccaggggaacugcuugcuuagcuuguccaagccgcugagacccaucugagcacugcaaaaauguaaaagugcagaccagggcacgaugacaguaauucaaugacagcugcucuagggggugaucaccccagaugccguucugcugguuccugcccauggcaucauggaggcuuuacgcucaucuguaggacguuguauuacaguuccuguuuugugaucaauagcacugugguggggggaaaaaaaaagaacaccgugguggucagaacaggcccaugugguggccucgugaagcccguggugggcucagucacugugcuaggaggcauuuggaaaaugcuaaacccucacugaggagcguuguguaauugugugcuggguaaaguuuggcuucugcagcagaucccagguuugcuccuugagucucugaaacucuuuagcauggaggccacuagcagcaucggucucuggggaucaacugcuuagaacagcacuccccccacuaaucacuuaguuuaaguacuuucaggguguccccagugguucuuaggaagaaauggaaguugucuggguucacccagcucuuugcccacugggaaagcccagagcggagauuccgguugucaggaagauggagagcgagcaaaggauauagcacgcaguggggacgagagggagacuggauggacuugcuugcauggugauguuguccuuaccucuuccuguagaacuccaugaaggugauguucaaaugccuuuggaaaagcuguggcaaggugcugaacacagcugccggcauccagaagcacauccgggcuguccaccucggguaaggcagcgcgcccucuguccaccucggguaaggcaagacagcgcgcccucugccaccuuggguaaggcagcgcgcccucuguccaccucggguaaggcaaggcagcgcgcccucuguccaccucggguaagguaaggcagcgcgcccucugccaucucggguaaggcaaggcagcacgcccucuguccaccucggguaaggcaaggcagcgugcccucuguccaccucggguaaggcaaggcagcgcgcccucuguccaccucggguaaggcaaggcagcgcgcccucuguccaccucggguaaggcaaggcagcgcgcccucuguccaccucggguaaggcaaggcagcgcgcccucuguccaccucggguaaggcaaggcagcgcgcccucuguccaccucggguaaggcaaggcagcgcgcccucugccaucucggguaaggcaaggcagcgcgcccucuguccaccucggguaaggcaaggcagcgugcccucugccaucucggguaaggcagcgcgcccucugccaccucggguaaggcaaggcagcgcgcccucugccaccucggguaaggcaaggcagcgcgcccucuguccaccucggguaaggcaaggcagcgcgcccucuguccaccucggguaagguaaggcagcgcgcccucugccaucucggguaaggcaaggcagcacgcccucuguccaccucggguaaggcaaggcagcgugcccucuguccaccucggguaaggcaaggcagcgcgcccucugccaccuuggguaaggcagcgcgcccucugccaccucggguaaggcaaggcagcgcgcccucuguccaccucggguaaggcaaggcagcgcgcccucuguccaccucggguaaggcaaggcagcgcgcccucuguccaccucggguaaggcaaggcagcgcgcccucuguccaccucggguaaggcaaggcagcgcgcccucuguccaccucggguaaggcaaggcagcgcgcccucugccaucucggguaaggcaaggcagcgcgcccucuguccaccucggguaaggcaaggcagcgugcccucugccaucucggguaaggcagcgcgcccucugccaccucggguaaggcaaggcagcgcgcccucugccaccucggguaaggcaaggcagcgcgcccucuguccaccucggguaaggcaaggcagcgcgcccucuguccaccucggguaagguaaggcagcgcgcccucugccaucucggguaaggcaaggcagcacgcccucuguccaccucggguaaggcaaggcagcgcgcccucuguccaccucggguaaggcaaggcagcucgccucugccaucucggguaaggcaaggcagcgcgcccucuguccaccucggguaaggcaaggcagcgagcccucugccaucucggguaaggcaaggcagcgcgcgucugccaucucggguaagguagcaugcugccccucuccccuuuggagcugguggaagucucucaguacagccccacacauguguaccuggccucuggcucuuccugguuccuccaguaggggugauccugcugauagucagccaccaagucaccaggccgcagagccucccuaaacuagugugagucaccuuaguauaauccuuacucugagcccuggguccauuuaaaaugaaaugucggcugugagggucagaguuaaacucugugcaagagacacuauguauaaaccacaccacgagggcaucacccugcgagcugugaauguacuucaaagacaccucaugugucuguaacaugaaauguguauuuacuuuugcaauaauugauaucaugacuuagaaccucucagaaugagcaccaccaccccacccgacccccgagacaagaagaaaccguccucacaccuucgaugacagagucuaaugugauggucuggcucagccuguuucuaagaugacuguuuucuuccgaggcuuuaacaaccuuccuauagacagacgaguugugauuaggaccauacagcuggacuuacagccaggggcaguagggggcuaacugucccugccuuaguccccacucugucuuguccauguagcugggguuuagaagagauccugugugaccauaguuaucaccaaugugcauaaagcaagcaucacugccuuaguagcucugcgugcucgacacagaaggguccuuuuugacaaaauggcuauggaugauucggcccuggggccaccuuagccagaaagaagcacgcuacucugaaaacugguauaggcgagccacaagaaagugugcaggcagccagaagagagugucagauccagaauguauggucucagccaccaggccacaccugccucuguugucucucagucauacugugcuugguaggagccugcucagugccacacaugcugauuacgugugcagugguacagagagcggcaaaagacacagcccuggagaaucagucaugagaagacaaagaggcuuucagagcuacagaagcaggcugcagagauggcucaguggugagggcuuucagcaccagcacugauacccaggcaaucaagguccucucuuguguuccaugucucauuauuaagaucauuuaaaaacagacucccauggaaacuuggggacaauuucauuagaauuuaaaaggaccccaggacaggcaagcuauaaaccucagcagcugccuagagaaagaauagagauaagagggauuaaaaaacaaacagaaaccauguugagucagcauggaggacagccacagggccuuaggcagugccuaguggggacugggcucucgaggaggaggggaggcccgagugugggcaaaagcaugcuuaucucugcagcuaaaggaagaggcagaaaaaagaguaaaagccggacucagaaaagugggcagagccaccugagcucucagugggcugugagaauucugggaaggagaacuggagugcuugcuaaaagguuggaugugguggggcaggcuuuuaauuccagcacucagggagcagagggaacucugauuguugaggugaauuccaggacagacagagcuaaagacagacacccuguuguaaauaaaauuagccauucuguccacccauagaaaaaacaaacaauccagguugguauuuuauuugcaagcuggaagccuagguugggcagguuuggagcuauucuaacuuauuucccagccauaauucccuuguuccuugcuguuucuccuggcugggugcucauggccugucuccucucauggcugccuccuccaccuccuuccucuccccccccccccucucucucucuuucacucgauccucaagucccacuuuucuaaccuuuuauugaccaguuaaauuggggagcaagguacacguagcaucacuugaugcacauguacuggagagaaaagcgugauagcaggugguagaagcaagcaggaagagguuaaggcuguaagcacucacagcaaggcuagacuuccuaaaaguuacauaaccucuccaaacagcaccaccugcuggggagcaaguguucagguacaggauccugugagggacauuucucagcaaaagcaccauccgcaccaccugcggguucugcuuucuuccuaagccucagcaugcagguagaugcuuaccugucacuucuucuaaacauccuauguaaaaaccaguacuacucccaaccguggaccccucuccuaagggcucgcagauauugcuuaaucuuuucuuacuaagacuuaacaaagccucauauauuaaauagccguuuacuagggauaucuugucugccucuagacuauaaaaguuccaucaagcugggugguagugucacacucaggaggcagaggcaaauggauuucugaguuugaggccagccugguguacagagcaaguuccaagacagccagggcuacacagagaaacccugucucaaaaaaaaaaaaaaaucaaauaacaaaaacaaaaauaaacccauaaaaacaaaagcuaucaucaaaacauagucuuuguuuuguuccuguuaggaaguagaauguuuuauauguaauguauucuccauaaaucauucucagauuaguaaaugaaugaccagguagguagguagauggguagguggaagauagacugcuuuaagaagucuuacucuaguuuuuguugcugugguguaauacuggaugccaugggaguuaaaggcaugcaugguaguuuauuuggcucaugguucuggauacugggucaugcugcacuaugaccauagucaagggugaggguguccuuacuacaucugguuuuccuuucagaaccacuugggccaguguaccagcccaucuucuugucaucgugcccugcccccaucuucauaccauggugcuugccucacuuccccaguccucuugaccucuccuaauucugauugcuuuucaaagacucucuucccaaacaccauuaacgcaaggauuuggaaaguaaguuacuaacagacagugcugguggggggcacauuuaaaccagagcagaagcugaugagaaccuucuucaguaggaugguugagugucaccgcguaguguaggguugccaggccgacagagaggagaucauuccgagaggagagaauggucugcacaggucgcaagcacgaggacaggcugcugagcuucgcucugcucucuccugccuaggcgaguuggggagucugacugcagugauggggaagaagacuucuacuacacggagaucaagcucaacacggaugccacggcugaaggccucaacacuguggccccgguuucacccucccagucucuggcuucagccccugcguuucccaucccagacuccagccgaacagaaacuccuugugccaaaacagacacuaagcuggugacgccacugagccgcucagcccccaccacccucuaccucgugcacacugaccaugcuuaccaggugcgugcuaaggaccuugugcaaaagcaguagcuaaguuaacacacacacacaaaccacagcaacacacguggcagcaacuccguugguuuuucuauuuucccucuuagccaggaucucaagccauaagugguggcuugugaucccagcacucaagaggcugaggcaaaaggaucaugaauuugaggccagggaugggcuauagaguuuuuucgacaggguuucucuguauagcccuggcuguccuggaacucacuuuguagaccaggcuggccuugaacucaguaauccgccugucucugccucccaagugcugggacuaaaggcaugugcuaccaccgccugggcuauagaguuuuaagggcagccugggcuacauaguuaugaccaagucucugaagccaaaccaacaacaaaaagggucugguaguccagggcuguauguacucuuggucagucuagaggccggguacaaaaccacuguaacuagcugaaagauuuguaauuaaaaacaaaaccaaaaaccuaagccuggagaaaaaaaauacuuugcagacuugaguccuggcaucucagcuauguuuauuuguucaauuuuaagguuuuaaauuuuuucuugcauuuuuauuuuguguguaucuacuuguguaugcacgcauacacccgacacauugcacuuguaaagguagagaacaaaacccucucugguccuaaggauugaacugggaucuucaggccuggccccuuucccugcuaagcuaucucauuggccaagucuuuaagcauguucaaaauacaugcugugcagugaccaucauuguauccauuuucuuaggaacaaccuuagaugugagaugucuaaugaccaaaacaauugcacuccuaaaauauuuacaucuuagaugugcccauuuccaaauuuauuguuuaaguuauuuccuaauaugguagucauauuuauguccaaaagcagguauaugugauuuucagacacugacauccaaucucccauauuucuccuauaccucagguagacugcuuauaugaaaagcuucuuucuggcuacucucugacccuguucagucucuaccuguuagcauauguuaccagaguagcccuguguguuccuacagcccagcuuagaaaugagaacucagaugcuguggacagucgcucuuucaaacagcuuucucugcucccugccucucaggccacacccccggugacgauuccuggauccgcuaaguucacccccaauggcagcagcuucagcauuuccuggcagucucccccagucacuuucacuggcguuccgguaaguacgcagagcauagcaaggugagccaaggcaaauguacacuuagagaacaaacuuugaaacagccaugaaaaagaugggaguccaugcccaaaagcgcuacuacauuuugauucuucucuuucuugagguuguaucucaaggcuagccuugaacucuauauagucuaggaugaccuuugaacugcugacccuccacugcccaaaugcugacaguacagguguuuaccaucauacucacauuccaaaggcguuugcuucuaucuuuuuuuuuuaagauuuuuaaaaauuuuauguguauaaguauuuugcuugcuuguauuucugugcgccacaugcauaaacugcccauggaaaccagaggaggauauuagaucgccuggaacuggaguuacggauaguugugagccgcccgccgugugggugcuggaagucuggaagagcaggccuuccuggcucagcuagcucuccagucccacauguauauuuccuaagcgacucacauuuaccugcaaaggccgcuggugaguuagguggcugcagcuagggaagauguucugacugauagaagaagcugucagcuguugguguuggaaauguaguuuguguugguguuggaaauguaguuuguguugguguuauaguuaugugcccaaaagaugauugaauucguagcuugauucacucuucuuacagaaaagcugguguuuaucauuauaaaaugcucauaaacuuuguuaguuugauauaaugucuuaaagauaugcuacuugaaaauccaaaaauuaaauaaauugaaaucacaguuuuuuucaaagcccaagcaacccaucuuugauggauaauuugaaaguaaaugaaugcuaaaauaugcagcagugguuuauguaggaaauaaaaauuaacucaauauauuaagugauucugauaaaucaccuugaauuaaugugguuccuaacaguucauuuuaaaacuuacugggccuuacauagcuucucacagaguaccaagagaccucccugcacaacagccaugcucacagggugugacuccugagaagggucagaacuaggcucccaagagcagaugguagcuugucccuggccaguuccggagguucccagcgagucuagaagccucccucggagguucugaguaacuggauaaacucugucugcucugcccaugcgugucuaccaaacuccauaaaaggagucagugagcagcccccugcugacagggcuaggcgaggaaggcuuuccagaacauacucugggguugugguuuuuaagcacugucauaaauaaggaauaacuuuaaaagccacugaacagugguggccccuguuaaugcucaaauggugaccuucuacauuuuuuuguuaguuuuacuuguggcacaaacauugcucugcccauguggccaccagauaacugugaagcauuuccucugggagacguuuuccuugguggacaaaagccuagagugauuugccauuugacacuaccugucugugacgguuaguguugucaauuugacaaaaaucuaaaauuaccugggagacaggccucuggacaugccucugggaaauuaucuaauuaucuuguguuaauagaaauggaacgauggagccaccaugguuggcauuaacucuagacaauacagauggagaacaggaacuggagaaaagaggagccugcguucaucauuccuguguccugaauguggacacaucgugucccgugcuccagguuccugcugcacuggcuucccggcguggauuguacccuugaaccagaguauguuaucacagcagcagaggaagaggcuaagaugccuucugugauggccugguguauucacucuccccauggcugucagugccugacaguaggaacugaaggaagagggcuuauuagggcuacuggcccgccaugguggggaaggcauggcaguagguguauccauggccuggagcagaaaggugaaugguggugcuccaguuggugcuccacuuggcuccaucuuuuuuuuuuuuuuuuuccaaccaggcccaggccacagaauggugccacccauacucagcauagaucuuuccuuccuccugggaaagcuaucccagaaacucccagagguguguaugcuaaaucuugucaaguucacaaugaagauuagccaccaucacaccuaaagugaaagcuauaguuccaauuucagcuacaggcugagagugcagcaguuucucagcuccucacagcauuccaaacacauaggccacacggcuggcucaucagugugagaagagcuuguccuggccaccacgcuccacuugguguucacaacugaaugcaaggccucuggcuaggcaccugcauaucucucuccuucccccuccuccucccccucucccucucccucucucccccucccucucucccucuuccucucucucucucccucucucucucccucucccucucucccucucccucucccucucccuuuaccucucucccucucucccucucucccucucccucucccacuuaaacucacucuacagcccaggcauacccugagugugcuauccugucuccagauccaccgugccuggcuuaugcugugcugggguuugggagaagggggaguuguuguuguuuguuguauuuuguuuugagaggccuggguuuugagacaggguuuuuuuuuuuuuuuuaagauuuauuuauuauuauauguaagcacacuguagcugucucuagacaccagaagagggugacagaucuuauuaaagaugguugugagccaccaugugguugcugggaccuucagaagagcaaucagugcucuuaaccacugagccaucucuccagccccgagacaggguuucucuguguagcccuggcuguccuggaacucuguagaccaggcuggcaucgaacucacagaucugccugccucugccucccacgugcugggauuaaaggcgugugccaccacccagcucuacucugcucuuuuuaauuagaccauucuagagacaugguucugguuuguaccggcugucucuuuucccaguuccuaaaagugucuuuagcaugccagccaggauuccuuguguuguuuguuuuccaacaaugaaauuuuagaacucuuccauggacuuuauagcuguugauagccucagucucgaugcaaccccccccccuuuuucauuucugcuuuaguuuccaggggcauccuagcagggagauugcacagaagauagauguaguaucugggucaacuggaaagucuaccuucuguggcuguuucucauuuauucuuuucauuuuguuuugugaugggugguacuuuuauggguauguguguguagaccggaaguugacacagauugccuuccucagcugcugccccguauuguggcagggucucugaacccagagcacacguuagguaaaccgacuggcuggcuagugagggcccugggauuggccgggcucccacggcgacuccagaguuacagaugcacugcguguagcuuguccauucugcaugguacuguguuccacacucagggccucaucaguacgcagcgggagcuauaacaacugagccuucccccagccucugccucccaugucuaauuuauucuuagagucucugguuuguaaucugcuucggccaagacucgagauaaacacuucagcagucaagcuugcugcuccuauuuuaagguuguggguauauuuuuaaaugcuuaguuugacucuagaaagacuggaauguagcucuaaaauuauuccuuauacuccugaacgccuggcagugcuuucaaagaacacaagguugggugccucccguccugugcccuugcuggugggcucacuuuccuaacugcaucgaggcuucaggaucggcuugaaaaucucuucugucuuuguauucccaaacgaaugcccugagguugcucuccuagguccaccccugagaucuagugcugaagagaagccuugggggacuuccuaugggaagccccuucugagcugucccgggucuccugacuuuugcuuuauucacuucugugcgagauuucuugaguacuugcuuuagugaaccccagcaucaaagcccuucccaacguguagccgugcagacuugcgucuguagacaccacugcccugccgcgcacacgugcuucucuagccugaggccuaggagugagcaggagaguuacuacagcagcauagacugagcggugugaguggcaguaguguauuuccuggaagcuacaagcccagaaucgaggugucggcuguuuuacauguggugagggcucucuccugguuuguaguuguccgccuuuagagcugugccuucaccuggcuuuuucugguguguacggucaauaguaagagauggaagugggggcugagagagguaagcaugcauaccggcccucuacagucucugguugaagugugugcacucaagugcacugucugguaucucuucuuauaacacuaauccuauuguugcagggcccuacucuuauaaccucaucuaacuuuaauuccuugaagggcuuauuuuuuaauauagccaggcucaggauuuaaauuuuccacauaacguuuuaggggaagcagggaggccaggccuggugguauuugccucuagucccagcacuugagaggaaaagacagaaagaucaagaguucaagacccaccuccaccacauaggaaaaaaaaauaggagguggggucuagcuggaggaaguggguugcugugguugugucucagaguucaugucugcuuccagccugagcugcuuugcaaacucaaaaguugaucaggcuguaccccagcuccuaccauacccucucccaccauaguagagaacauuuccuugaacugugaaccaggauaaacaucuccugugagccaugcugucauauacucugucuugaccacaagaacaauaacucugaagaugcugggguuuuauuuuuucauugccuagaagcagggucuaaaaugcuacugaaagauuccuucagucaaaaaucguuccuaguccauaugacaggagaucacaaggaacauucucuagaacauauauagaagugcauugcaaauccgaauccugugcuauagcacccaucaacucugaccucgaggcacucauacgaccuuucuuaagcaauugcuuccauuccaaaacagcccuguagaguuguacugcucagcacagcagcuggcagucagcucguguugcaggaugcccacuguuccugcugucagagugggaaacgacaaagucaaaucuuccuauguaaaaacauguguuccagauaccucaugugacucacuaucugaacagauuagccaugauggaaaaacuacaaguuagaguccuuuaaacucacuggaagucauacguacugaguaagcauggugugggcacauagcauaauaauuguauuuauuuauaaauaauagcauaugguacuauccguagugauacaaaguguacuuuauauuuaguaaaguugacuucaagguagacuuuuggacacguuugagauacaagacaaaaacuagaauguagagagcaggccagugagauggcuccauggguaaacaguugauaagacugaguucugucccugagcccacacagagguggcacaagacagugggcuguggcuggaguagaccuggccauauugguuuucagaguaugacuguggaaguguuuggaacuuggagcuggaaaggccguuguuugcuuagagauaaugggcuuuucugugggaguuuggaagauaaugacaaugagagaaauguuggcagcacucccccacucucugggcucugaggugaguuaaagagcaguuaucaggucagcauagcugucucguaccagcugcaaucccagaguuccuaaccuuggcaguuuaacccugacguucauuuuacucugcaguugagaacaaaaccuuucugcuuugggaaacacgcaagggaagggggaggaucuguccgucaaccugccuguccuuguuucccaggugucuccuccacaucaucccacagcaggcucaggagagcagagacagcacgcccacacagcccuguccuccccgcccagagggacagucacccuaagguaugaccgcuugaugcuacuucaccucaaagggauuuauuuccuaagaaauggagaacuagcaaaagggaaggaaauaugacccacuguaaaaugucuucccaggccaugagcgcgcuucccucccuucccgugguuuccuaaccaguaacuaguuaagggcacuuguaguguguaggcuggagagcuguacucacuguccucgauuaacuucucuaugauaggaacaguuaguuaguuuuagucuacaucuaggagagucuccuaggaagccucagccagaauucugaacacuggaaagacacugaaaauuuggaagagcacuguuguucucugauguuauguguuuuguguauauuuguuguuguuuguguguuugcuuguuuuguaguaggcaggguacuaggggguggagacagaagaugcauauggugcauaugugggguuugucuugguggggugucucacucacccacugcagucaagcugguccaagagcuugcagggaucucugucagcaucucucaccuugcucuauaaacacugggauuacaggcaauugcaugcacgcgcuaucacaucaagcuccauauagguuccaaauguccuccucgugcuuggugagcagggcugccccaggucccccuccacaguccccaccucuugugucuaccccuuacgcuuacaccauggccaaggaaacauuuccaugaaugggauuuagaaacaguguaaucacaguggccagagaaguccccagcccuacgggaaguccuacuccaugcugggcuuuuugucuucuguucccccuuauucuuugcaacucuccccagaaggccgccccguuccugucccuaaggcugucugugugccgucuuucuuacaggaagcccagaggagaaggcaaaaagugccgcaagguuuaugggauggaaaacagggacauguggugcaccgccugccgcuggaagaaggccugccagcgguucauugacugagccauuccugccucuccuuccaaaggaagcuacucaaggcccagggaaggcccugccuggaaucccaggaauauaauuccuugguggaauuaaagcaaaacaaaaacaaaaacaaaaacaaaaacacagcaaaaaaucagcacugcacugcucugagaaccaggcgagagcgccaaggaggaccuuccuucgaaggaaaagcccgcuuccuuagcucucagucuggucuuaaagcuggucuucuguagcagcuuagccaaccaggcccauuucaccuagagagaaggcacauuuugauaagcuuucugaacucuggcauuuucgaggguuuuugacacugaaaacaauaugcccauaagcuacacaauauacccauaagcuacacagucugagguagcauuuguauaaaggauaguaccuaccuugugaauaggcaucucucuguuuuuccgugcgacuccuuggaucagucugaucaugauguauuucaaaaaagaguuuuucuaugucuguuuuguuuucaagaaggaccccaaguggaaccauuguaaagauguuagcuuggaggcccugaguaacuuacauaaggccaaaagugauugacagugagugcgagucaccucagccaucaccugaggucaggacaccaagaggcacugcagaaagcaucugaaaaucguccuuggaucccaugugagugguggcaccacuaagucucugccugccauggcucagacgagagcuggcgcuaguagcaaucugguaaaccuugaugcugcuuucagggauaucacacacacugcagccuggauaguguguccugcuugguucugccaagaccauagccaggacucuggguuagcauucugcucuccaaccccgcccagguagaaaacuccagacuggccugcagguuugcuuccagcagagcauagcugugggaaagauccacuagggcaucaagccaacuuccauugugagugcacuuuucuagauggcgaggggauggcuaggggaugaguuaguggacucggugacguauauggauaauggaacgcuaaacuuuguugucuuauaggaauauugaaacuaugaauuaagaauuugcucagaaacuaacuuacaggaugcccaaaggcagaugcaucuugguauaggacucucuccauugaguagggccaaggcuuaggcuggguuccagccauuggaaccugauguacuuggcuguuggaaggguggagcuuggagcagcuaucaagccuuguaaggacuuauucugucugcccugcuuaagagaggaguguccuguaccuaugcaugguaagagcaccuuauaggagccacuagguagggauggggaacauggugucagcaauaugaauguuaaaugaacuugcacagaggaaaacuuaauauauguuuaaagauuguacauagugcuuuuuuacagaguagagaaggcauguaggcgucugagacaccucuuuguauauaagggguguauauggaggcucuacagcggaacacccuuaacuggugcguucauguauuuuggcaauuuuauuuuuuaaauucauguggcuuuuuuaccacggaaaucaaggaaaacgggaaagagaugcugaucuuuuccuuuggauacuuaaaaggaaaacaaaacacuuacuucaagagaaaagagaaagcuuucucugauuucccuguagguugauaaccaacaucagcuauaccaccuguuccagaugcuuuuaccugcaaccaggaaacaacuuuuugcuuuuaaaguccagagcuagauuucuuuccccugggcauguccucuccuuaucuccuguagccucacucccugaaaugguguucuagcugcuccaagaggcccugagcaacguggagauugagacaucaacuguuuggucaaguucaccaugugcuuaaauaacagauggauccuaggcuagaggguuuucuccucagcaaagcucccuuaauuuuuaaaaucucagaugaagacuuuaaucaaaacauuaaagugaugugaaauucaauccaccuucucuugaagaacuuggaggugaaggaaugcugucgucugugugagagagagcaguccuuaggugcugagcugucgcccccagaaacacagccuaagggcaggucugagcccgcuuagcugcauauugucagcacaaucgugacaccaaaugcaccugaccugagucccucguuuucucagaaaccuccaucgugccagcucgugugcauccccagcccaccuagggcccucaucuccaggccagccuuaggcacugaacauuuccuuaucuggcuuccaaggugcaggcaaauccugagugcagcucuggacacaugcccauucccuguguggaaggguguaaugccagggaccggaagcucugaauugcaacauacaguuaacugauuauaugaguuacuuuuugugugaguuacauuucuuaaguaguuauuuuguuauuuggggacccaaacaaagugccaaaugaagccugacuuuucauuucaugccauguccaugaaacuaaguucuuuuugugucuucauuuuguggagaaacagaaagcaugagaguuggugagcuggcugcuagccugaggcucugugcaccccagggcuuccagcccugucugucaaaggagcagugauguaaugaauucuuguccauggaaaugucuaguucuucuucuuccaugaugaaaaagguuucucauuucucccggaaaaagcaugucacagugacuagcaggacauucuccagccagcuaggaagcaaugugugcaacaggcaauaguuuccagccuuagccuuccuggaauauggacacuuauuuugugaaaaucugugagauaacguggagaaacccccagguagcauaugugucaagggggcagugcgggagaccugcacaccccuaucuucugcucauguucuugggcugcucagcuaggacuccuccaugucugcuguagaugucugacacaagacaggagcugcuucggccaggaacuauccaucaggcucaccugccaccuuaugucugggaaguuagguucucuggauuagcaaaagcuagcgccaggaagaagacaguggguuuccaaaccagaguggaccucucgugcacguugauaguaccauguccaggaggcucccuuaugaaccucccaugaccaagcuauaaaggacgaucaucucuagagaaaagcauuacuguugagcucuccaaaaauuccuucagacuucauguauguuggaaaaauuauuugaagccaaauuguuccccauugcaauugaagaugacaagauuuggagucugccaucucugguauccaagaacaaguacgucacacuuugccagaagcccugggcuuaaagugaguagugagccccuauaaaagagucuguuucaucucucacuucagcugcccugcaagacaaagguggcauucaccggagaagguucugagaaaagaggugagaacuguacauacaagaaucuguugagcauagcagcagaauacuguaaauacuacucauuuccucagggagacaaggaugcugugggaagagaucuggagaaccccgagaccaggaggauuuuuaucuccucaagucuuuucuugucagaacaaguuuuucuuuauguaacucuccgugucauuucaaaacaaauccguguucagcuggacaggcagacgacuuccaugagguguggcagagggacugucuguucguagcugcccuaaagcugauugagguuugagccacaggugaagagccugcugggcauccauagacauggugaggcuuccucugaauguaauugggaacaaaaagccuugcuguuccuuguuguaguuccucagucuggaugcuguuuauuauacacagcauccucuaagggagggaaagcuggccacgacgugugguuugcuuuaguggcauguucaggagcacacugccauggacucugguggacaaggugcugucuuugcucuuguccguaggauuuccaccacccacaucagcuguggcauugaccugugugaauaugugcggaugaguggagccagcauggcccgucaguaugacagcguugggagcgugggucauuuugaagggcauguuaggcauaugagucaacugacaauucuauuucuguaagaaagaaaccuaccagcagcacacaggugccaccaauccucccacguggagggauuucuccauguuacgauuucauccuguauuuucugcauuguaaguagccacaggggaaguuaguaaauaagaugagguuagcacuuuuagguaccaguuguccugaguaacuguacuccaacagagcaaggacauaugaaauguacucaagacuugcuucuggugacagacuuggaaaaggcccauuuccaaugacacacaugcuuuaaagaguguaccuaucacaggaccaggaaucaaaacgggaauuuuaucuccuguccuguuuuguaaguagcuuuuuuuuccuaagacaaucucauguuuuauaacuuguugugugugucugagaaucauaaugguaauguguuaugguaaauguaaucuuaaauacaauaauaauuacaacuuaaauuuccaaaugaaagaaauacacugcuuaggcuucugcaagagacaugacacuuuuauaauaagcauuaguacuucucaaguuuaacagaacuggaaauauuuuacaagauaccgcguuuuguaaucacagagaacaugaacacuuugugggaaaugaccuugguuuuauacauuguagcuuauuuuuuaaaaugcaguauuuuaaccggcaggaaguguagauauggcacacaguuccugucccucaauccaagggcuaugccucuuuuaagcaaguguuuugaugcguaucuuuucaauuaacccucugagcaaggguagaaauggagaccagauagcaaggucauuugcaagagaaucaaugaagcagcaacuauucccucaugaccaguguguauucaaagcaucuuugugggggcagggggcaugucacaugaagauucaccuucuauauuuuaaacccaagaaaagaugcuagcacauaggcuucuaggccaaggaagaaauaucccuuuagugugguaugaguuuucuuaugaguuuucaccuaucagaacuacaugccugcauuuuauaagcaagcgucauuugguggcacugucuaaaacuguaguauauaugcccaaagaaccuuuaaacggucagcaguguuugugauuuuguuguucuuaccaccgccaacugagaaacuuccucaucaggaccguuugacuuuuguuuguuuuucacuauggaaaacucacaggcacagaagguugugagcagaaaaaugacagaauucccaugggacguaagaaaugggagccacauacacagugugagcacugccaaggcuauuuuaagcugucccacaucaacaagcccacucgcuguuaagaaaacaucuucccaagaguuuauugacucaaaaagcuaggccaguuagccacguaugcgacaguuucagaguagaagcugagguggggcagcuguguaccugccagguaacuguaccaguuacugagaggccauucuagcuuuucuagccguaucuuccauguacggcugacagucuguuagacgggaacuauaaaggcauuguaugagggaacaggggguugugcagccuugcacccagugccugagugggcuggcuugcagcuagcucgccauugccauccccuaggauaguaccacugauggauggcauucgggugcccagcagguuuucacugccacaugguuuugaacuaugugcgacuuacuccaccugugcguggaggcuuccuuccagagacugugugcgcauuuagacacuuuagaacagcuggaaaaggacugcagauguucagggcgugucaggaccaacaacgguguuggacuagacaacugacaucuaccgaacaggaaggacccucacucagcuuuugacaaucaggccagguugccagauccaaacuggagacauggcaccacccgacaauucaguguugaccacuaacauacguucucagccaauccugcagaccaagaaaagcugugugggggcagaggcauccuguggccacaguaucagcuauggcaaacuuccacacuugugagcuaacaggcccagauuccuccaugagcaucuuagacucaugugcugccacgaucugaacagcagacauuucaaaagagggaagacacuauuccucccuagaggauauccucauggaagacaaaaauagaaaugucaucucuucagcuuagcauugcuccugaucagaaugcacuaaguugucacccggcucuugcaagagcugccuccugccauacccaggccacaccccaaaguacugaauagcuguaacccugauacugugucugcuaccgugaccacugugaugaagggcagagggagggaggaaggaagggaaagagggaggcaggaaggaaggaaggaagggaggaaggaaggaaggaagggaggaagggggacaaaguaaucgggagccuuugauuuggcagccggguacccuggugcuuuacaguagcacauggccccucccaugccagcgcccucugccuacgcuuugugcucccuagcuuccuaggccaucucucuccuugucccacuauaaauguauauauaauuucaccucugaucugguaaggccccugcuucagaacuagcaggcacuuagguguuuucaggaguccauucaccuuaaaggaaguuuuuccacacaggcaaccucagucucuuucucgcagggugaaauaaaacugagaauaacuuugucacaugaguggagggcuacacacauuagacuuucauuguucugagaaaguacauuauuuuaaacucuugucuucuauugaagucuauugaaguucugaugucacagggagaguucuguaugguaaaguaugugucauucagacauuacuuccuuugaucuucauaugaaucuaguauagaaaacaaguccuaaggccacuaauagcuaugccaagacacuggcucaaaccuaugagucagcaccgucauuaccugcagagagagaccuggcccagcuggccuccgcugugacucagccguggauucccugggcccaccauguucucagcccagaaguaaagagcacccucauucaugucacuaagugcaaguuuaaucauccccaaguuccguccagugaaaugguaaaguguaggaggaguuuguuagcuaaagcaauauucugauaaaaauguugacuccuuaggaaaaaauagcuugcuucuggccucuggccuuucagacucuaacuuuaagcugaugcuggauggugguuaacaaccagcucagaauuaccauguguagagacgacucaaaacgaccugcaagcaugcugcagugccuaggucaguuaaguuguaugugucugaaugcaguuucugcuggcaagcuuugacauugcucccacuguggaugaugauaaggcuguccaguauaugaauacacuccauccaaggcuuccagggugucaggugagcauccugaguucagaggaaagcucucacaagaaauccugucauaagaccagaaggaacccccagacagcuagacuggccaguucccuagcugaugagcagggaggcaguuaguuugccccuuucuccucugacaaaaggcagugggcuguaugguuuggcugccugugcuuggcuggcagugcacagaaagggccuaguguuagcaagggaaaaaacaaagcgcauaccagauacugaaggauuggguuagagucaaauaguaguugguucuuuuuaaaaauguuccuuuucaguggggauugcugcacugugacccuccgaggagaacacccuuugaugugacaaggccaccugagcgaucccuaagacugauuaacuacuucacuuucuauuacaaucagucuucccaaaauguucauucagaaaauagccaaagcagagcauggcagccccuagaaaggacaagaaagggauuacuaaagaacggaaucgagccggacgugaugacgcacgccuuuaaucccaacacuugggaagcagaggccagccuggucuacaaagugaguuccaggacagccagggcuacacagagaaacccugucucaaaaaaccaaaaaaaaaaaagaaaaaaaagaacagaacuguuggggaaacacagcugucuccuguuuugucucuaucugugacuggaaacagaaaccaacacucuggagaagacauaacuuuaagugagggucugaaagaagacuccacaucuagugccaucugagcagauaguuggguagacacuuucucucccuucuugauccucaucuccuaacccagaagccaaauguguuuguugccagauccagagacagccauuauuguuacuugguuacugaaugcuugcucugaagucaacaccccaguacauggaugcuucccucuagacacucauucugcucagugaguggcuacccucccugcaagagaaagccguucucugucugagcagauguagucucugggcuaugaggacagggucugcauuggcaccacccugccacacucagcccacggcaaagcagcagcuacucccguccaugugccuuaagacacucaguguggucaccuagccagagcuagagucagcaagacaggaugcuguguuaggguggaagagaauccaagagggcucagacuaaauccuuccaggcucaaggauucaaggggaugggauuggccuucuccacguggcgauggaguuuaguugcuccuguuauauaucucuggaaagcaaacacugcuuccauuugcuuaccugucaaacauucauuccuuggcccaggacaggcucaucccucauuucaggcacagacagcaagacagaguggacagagggcucccugagggcuugugauuguuuguggguuugagcugccccucagggaucugucccugcaugggggaaggaugccuaauguggcagauugcacucagagagagggauaacuuuuaggcccuuacucuauauccuuacuggaaguauguggcugugacauggcauaacagcaggagcugaucacagggagaaagcuucaggugaaaccuagauguuugagaaaacacgucacacuccuaaagcaugcuauuuccauggcuuccaaaacuaaaagcaccuguggcucagcuagcgcaugaacaugccaguagucacgguuuccuaucgugcacccugaaaucccuauuuuuguaauuuaugauuagacuguggucagucacuuaaauaaacacucuuaugaauuaacuaguauacccuaguauaguuuccaaaauauaucauacuguauagcccuaugugcaugaagaucucagggggaggaaguacacgcuaggucccaaaggguccagacuaucaucaaaagcgcaugccaaguggccugaggccacugcucauacacgagggggcgggggaggggauaugggcugcagccccucagcugcccuuaguggugggaaucagcauggucgcuguuaaaggaaagccaucuuuugaauuuuucaacaccaaaucuuaaaguaucaaaaaaaguuaccgaauguuaaaaguggggucguuaguggaaauguugucuguaggaaguuuuucucauaguguuugauaaaaacaacaaaagccaaacugaagcccaagaaguguccucugggggacacuggcauuaggguggucgaugacugaaggauacagcagugcuguccuguacacagagcucuuuugagguacaaucuuuccaucguuucagggguaaguacuuccuuacaaagucuuuaauaaugaaugaauguauaaauuuauaaacuaugcauuuucagagagaaacauguauuuuguaucaaauccgaguacuuuuuuuuuucauagagauuuaucacaacuacagauuauucaaaauaaaugagaaugccaauccucauaaggguguggggugccuuuguuuuucacucugaugguuucaagaccaugcauccagacuuugaucugaaaagcuagccaguacaguaggcgaaggaugauucgccuucuccuggaggggaccacucgcacaccacccaguucuuagggauggauaauuuaguaacacuggguuagcggauagaagggccaggguguggcuuacagauagagcccuggccucacgugugugaaggccuggguucagucuccaguacccaaguaguaacaauaagcaggcaggcaacgcuguuaccauaguaacauuacauuaccauuguuaccauugcaucggcuaaagaugacccagcuuagguaguuguggcuaauugucgauccaacugugggugaggaagaguuuagguuauaguuuucaaagaacaaaauauaaaguuauugucugacaaggcaaauaauuguuuuuuuuuuuuucaaaauuacuuggaggugaucucuuauagaaaauguagacuauacccagauuucuccagccuugugcugauaggccuuuucacggagccuuucccacugguaauuguucuuuccuccuuggucaguacucaccucaucacuccagcagccuccccgcuaucugacaaggaggaagugaaccccauuucuuugcuguuccgguucucuuucuguaucugucgaggagguuucuaggcugucuauaaaauauggggaaacacauuucuaacccugguacuuauggucauacaagauauguuugcucccuaaguaggagcuagaggggagggcaaugugucuuuuuacaugauuuuuagccaaauccagcuguucugauacuauguuucugaauccuuuucugacuguaaauacugccugcagaggucccgguugacagccuuuucugagacugguccucagccaugcuccuugccagcuguuggcacauuguacauagaugcgucgaguguuucaaugauguugguuuucuaaaugcuauucucuaacacauuuuuugaaaaaaaaaaugucuuuguuguucuggacuuuguguguucguuuuacaaaaacauuuccuaagauuuaacaccaggaaaaaauauuuuaaaauacacuggugcuaauuggaaaagaagaaaauuuuuaacuucaagauuuacaaaagaaaaugaucacagcaguuaacugcacuuucccacggggauggcugcuguccacuuacaaugggcaucaagaggaccagcaaaaguuuacaguagugaugacccauugaugugucauagagcaaggaguccuugucccccagagaggaggauuugcuggguaguccucaaagcauguaguagagaagggauauagaguuaacucuuuagaaauagucuucugguccuuggacuuucauguucuguaaugcuuagcuguaacaaugaauaugguguugccaaucuagucugacuucauugucaaccuguacugacucuguguauggcucuguccuuggcuugcacuggcacaaaccaagccagaacacaagucuuucagaaagaccauucugauuucuaugauguucacacacaugaauuuagaugcacuuguaacugguuaauuaccaugaaguaagucuaacuuccacuuaauaaaaguuuuuuuguguaucugcuucuau

SEQ ID NO: 1357 - RNA, 2886 nt, Mus musculus
cagugcggcgaggagaggaccugagacgugcugcagagaaagggauauaagcagcaucauucauagccucuaaagagcuucugcagaaaccacgcccuaccacgcgguguccucucugaggcggagaugggguggaggggacuggcgccaucgaggaacaaaagauggggcaaagggaaaaggagagugagugcugccacgccaggggaggaugauggggcaggacgguggcacaggugaggauaggaagagaaguggggauaacauuaagaggcaacugaggggcuguuuguagggggcucacagcaguaccgcuggcacgcaccugugaagggccggaagcaaugaggggcugcuucgggggcaagaagcagaaaaggggagaagcggggugacccaccacgugcggagccggcgacaaaggcgggcacuccauccuaacugccgcaaggugcucccugcagcucccccgaucgcaugguggaagggaaccaacacauccccacaaggaugaggagccagggagggguucggcgauaaaaucucaccuagcucuuucauguacuccucaaagccguggcuuuccaucaggcgccacuucccuucgagauccuuaagacuggccauggugggagggagagcacaaaagcagcagagacgcgguggcgagggcgcuguuccgcuccuggcgccaucugcgcuuauaucguccuugguguggggguggugucgggcagccaauaggaggcgcgccucagccugguaccgccccucgccacgcccggacuugugcgccuugggcugugcuggggggucugaaggugccacccuggccuggcugcgccggacugggacgucacguuucccgcagcuccugcaagcugcgacucgucuggcgcgcccugugccucccuuagugacagcugcggcacagucccgugggcccagggaucacccccacccccacccgcgccaucugaggacagccugcgcgccguggucccacuguccugccgccuccauuugcuuuugauaaguaccugggaggaacaaauuagccaucgcuuggcgcuauaggaauugaauggcugauuacugaauuaauaaacugcaaucuccuuagcccuacauccuacucccucaugaaagaaccuucugaccccacccucccgccuccuggggccucacuggggccucuugguugucugucugugcaugcuagacaauccuggcagcagucucuaagggagauuacaaugcucuacaaguuuguuuucuccacuacacuagcaaguuucagcuuagguaacugucacuuccugaaaaaucuuacuagcuucuauuccccgaucagggaucaaaacuuuuacuucccuccauccuuugaggguggcuggcccagcuaugaauuaguaaauugccuagaauauacugacuauaaaaaaaaaauuaucacuuugauaugcacugaagucccacaaaacauaaggcuccaaggacaauccgcugacaguuagaugccaucgccagucacagaaucugaguguguggggaggggaggcagggagagauacagggagacaaagggagcacauuuuaugagacagugagaagaggaauugaguaaagguuauggagcggucauguagcccaggcuagccucuaacuccauaugcagcuaguagcuccugaccaucacucuccagcuaccacaugcugacauuacagguguggccaacacccuugcggaaguugucauuacacaguuacugauccucacuuucagugucauuuuuaguaagccaccugugauaguccaugcuuuguuaggauucagguuuguauuagauaauuugcccaaccacaggccaauguaaauguccuaagucuguuugagggcagcugagccauaauuuuuuacuagguuggauauauacaauaacucuaagugaauuuacugcagucacgcugcccugcagcugaggaagugaacccaggauggaagacuccuucagauccacagcacccacacaaaagcugcugcugugucugcaccuagaacugcagcucccugguacagcccacccggcauuggcaagcuuccgggucagucagagauccugucguggcagacagcugaugucaacuacuagcuuccacauacaugugcacacaugcaggcccguaaacacacacacauacacacacaaacacacacaaaugcacgacaauuuauacuuaugauuuucuuugucuaaaguacguccuuucaaagcuauccaaaggccugcagcuucucagaccagcucaaaauaugccauacauacaugaagugccacauucucuacuaaggccauacauauauugauguguccugagcugcgacaucccacugacugaggccaucaguucccuucuguguguggaaugaccuuucucagacugucuuuuuuacagaaucuuccugccugcucccacaccucauuggagguaacaugggcugaaaugaaguugucgccacccagacgggcuaucaccacggagacaaggucagcuuguugaguuucuacugcucccucugugguccuuccuggcauuugcacggaugaauuuuaaugccugcgauuccugaggaaguuaucccaguuucacaggagaggagacgaggcuaagagagccggugcugcggaguaguagaacuggaaucgcacugaggaguuucucacgaaagaucuugugaaacaggaccacaccugccuguccuuuguucaugaugcuuauaaggaagcuaagagaagaggccacagccacccugccaagacacuaauuauuguaucaucccucacacaauuaaaaucugacaagccucuaccaugcugcaagaag

SEQ ID NO: 1358 - RNA, 7104 nt, Mus musculus
cauggagcccugcaccuccagugcugcuugccuugcuacgagacaaagaguucaguguaucaugcaacaaggccaaaggcaaagccuagugggccucgguguggcagacaugaaggacaggcagggaggugaguggcagccaggagcucacacagaaccugccucuggaagcccugccgucuugcgacaucugggcagcagcaucuuggcaaugguccaggacucaugguguuucagauccagcaacccugaacucugacuagcugcaaugaauauuugcaugcaaagcugucuaauuuuccaaugcuacacaacaaaugaauacucaaugcagaguugagguagaugaauggugcaguaaguuagcacugaaaaugcaacagaggcuaggcugugacccuccgugcucccaggcacugucaggcaacaucgguccacaagggcaaaugcacagacaggagguucagaaguccugugaguacagcaacaccccaggacaccccaggaccagcuuuggggagacacaccaacuuuacuuggggucaaucaaggguuauauuuuuuuuuucuguuuucucaagguuucucuguauagcccuggcuguccuggaacucacuuuguaguccaggcuggccucaaauucagaaauccaccugccucugccuagugaagcgguaggaauauccaggguaggcaaaggucguuggcugaauugaaggcuggagguaucucauuaacauggggagauauuucaggaaucuuagguucuagcugaaugcguucuuauuggaagaaaggaagcugaaccuguaaucuuaaccgaagcuaugugauauucugcaaauacaggguguggugucuggaaucccccaggcugagaaaaggaagccucgcugacaaagggagucugaguuuuguacugagcucagggcuuuccaguuaugucagacucucaccugagcaucagggcaacaauaggugugagagaaggcuaugguggaccaggaaaaugucauugcugagcagggcuguagggguagugugcagcagccuggagcaugcagcccagccucgugaucccccuguucugagcaauaauaggaugucugagaugaagagcaguucguuuucuggauuagacuaccuccaaaggucucuauggucagugcugccucuggcggccacuuugguaucuguagucagcugcccagaccauguugaagccccagguucaaguggauauccaugguccuacagcagccaugaaccuugcuuaugucucugucccgagaaggccauaugaauauccuuggucuccaucaacaccugaggcuauucugugauagccaaggaccacguuguuguaaguggccuuggcagcuuccugugaccauggugauguccaggugcgugcugcugccaagagccaugucugggugugugguccuacuguaguuagagcuugugcuuauguccguggcccguguggucucgacugucaccugaagccauguugauguccauguucugcguugccacaggagaccauggugaggucagcagcaugcugauaccagggagcacacagaugucucaaguccaugguccauguucuugcugacuguaaagggcaaagaagcuacuuucaccaugguauuggugacugaaauuucacaguugagaaauagggacauagaaggcuucuggugacaggcccccccccccacacacacacacacacagacacagcuacagcuagacaggaauccaucagagggaacuuuuaaacccugugauaaggauguuaaaguguagcucuccacaguggauggcuugggggauacuggaggcuggggacaacacucaguuuucuuuaaggggcugggccagggaguuuggcuaugcccagugaguauguuugcaaugcaaguuggacuuuuaaaauuguaaaaacaaggaaggaaaaaguuugagcaaaguuuaauuugguccauguuucccagaguaucuaaauauaagggacuuuuuaaucaauucccaaucagacaaccgcccaacucucaacucuauaguuucacuucuugcuuugggcaaacaugugguucuuuacccaagaaacauguggucucuuggguaacgugugaagagcauccacguggaguaagggcaucuccgggguaucucuguggguggaaguucucugcgauuccuaucucuacuacuacugcaugucugaucuuacauccuuccagaugcuucccaccggugcaagcacauggugagcagucucaauuagugagcagguucagagcccuagguacucaacucacacugccccugcccuugggcucggguggggauccucccaguaagaggaaguggaaccccacggggcugcccagcagauuucugacugaaugaagggcaucugguggcuccuuacaggaaggagcuuauuaaucccaacacuugggaggcagaggcaggcggaucucugauuucgaggccagccuggucuccagagugaguuccaggacagccagggcuacacagagaaacccugucucgaaaaaaaaaaaaaaaagagaaagcaucucuaaucacugguagcagaguugagccauugucuuuaaaacuucaaaagcguccggccgccgccauuguagcgcucggagcccucaucgcggccgaggcggagcccgcggcgggauggccgaugccgacaaguccgaggcggccgcgggugacgacggcucgcagcagcaaccggcugagccgcggcgagacacgcaccccggcgagcccgagaaaccgccgcgcagcagcgccaacggcguuaaaauggagaaugaugagucagugaaggaagaaaaaucugauuuaaaagaaaagucuacaggaaauaagaaggccaaucgguuccauccuuauucaaaagauaagaauucgggcacuggagaaaagaaagguccaaaucggaacagaguguucauuagcaacauacccuaugacaugaaguggcaggcuauuaaagauuugaugagagaaaaaguuggugagguuacauacguggagcucuuuaaggaugcggaaggaaaaucaagggguuguggcgugguugaauucaaagaugaagaauuuguaaagaaagcauuagaaacuaugaacaaauaugaccuuaguggaaggccuuugaauauuaaagaggauccggauggagaaaaugcucgccgggcacugcagcgaacaggaacaucauuucaaggaucacaugccuccgaugugggaucuggguuggugaauuuaccaccuuccauucucaauaauccaaacauuccuccugagguuaucagcaauuugcaggcugguagacuugguuccacaauuuuuguugcuaaucuugacuucaaaguugguuggaagaaauuaaaggaaguguucagcauagcuggaacugugaagcgagcugauauuaaagaagacaaggauggcaagagcagaggcaugggcacugucacuuuugagcaggcaauugaagcaguccaagcaauuuccauguucaaugggcaguuuuuauuugauagaccuaugcaugugaaaauggaugacaaaucugucccucaugaagacuaccguucacaugauaguaagacaucacaguuaccacguggucuuggaggcauuggaaugggacuugguccagguggacagccuauuagugccagccagcugaacauaacugguguaaugggaaauuuggguccaagugguaugggaauggaugguccggguuuuggaggagugaauagaauuggaggaggaguuggguuugguggucuggaagcaaugaauagcauggcaggcuuugguggaguuggccgaaugggaggcggcagcaugagcggcaugagcacugugacuggaggcaugggcaugggacuggaccgcaugagcuccagcuucgacaggauggggccaggcauuggagccauacuggaaaggagcaucgauguagaccgaggguuuuuaucaggucccaugggaagcggaaugagagacagauuaggcuccaaaggcaaccagauauuuguuagaaaucuuccuuuugacuugacuuggcagaaauuaaaagagaaauucagccaauguggccagguaagcaacagcagccggggaaggugugaacauggagaccaaggaaaaggaagaauggcugucuucagugacuaggacaggagagaaaagcagccaccagcaguuuugaaggagucagcugagacugcaauagcuguugaagugaagguuuugagaaacuauacuacuaagccaucagacuucaaaaauucuguaauuauguuuuauguuaagagugacacuuauuuaaagcuuaccaguaaauucgguugucaaauauuaugccaaaaacugcuccuacacuaacugcauacacugcacagucucggaagaggggccagcaggagaguguugaaaccuggaaaaugaugguuugauuuacugugugcauuacaguguaaggcauucaagaacaguguauaauacugaaaucacguauauuugugguaaacuauuguuaaguuugcauauuacguagagaaaaacaauuuuaaaguaaaauuguauauaaaccuguacugacuuuuauaaauuucauuaagagaugcuuauggauuaugucaauugaguaaauguuuuucuagugguuauuaaauuugacugaaugcaaaaaaaaaaaaaaaaaaaaaaaacuucaaaagcuguuucacaggugcuuuuuaaaaauaagugguuuugucuccuuguucauuuggcaaaucccuccccgucauauccccuguuuuucauuagagcugagaaguuaugaguaaacagagauugagccuaacaguuacucuccuuuaaugggccgucccuuuacuuccugaaaguaggguagaauuguagagcauggaaccaggcacauugggcauggagaggcacuccauuggagcugcugaagacacauggucuggacagucuuggguggaaggaagggauucugcugucuacuuucucucauuauuguagcaacuucuucugaggucccgccuuugugcagggcuggggugcgcagcuuuccaaccugucuagaauuuucagcucuguuuucucugacaaauguccuagaacagugauucucagccucuggggucaaugacccuuucauaggggacccugaaagccuugaaaaacacagacguuuacauuaggauucauaacagcagcaaaauuacagucauaaaauaccaaugaaaauaauuuuaugguuggguucacuacaucaugaggaacuauauaaaagggucccagcauugggaagggcgagaaccaccgucuuagaguaagaugcugagagcugacaguuuuaaggugaauggcucaacagcuuaggaagcuguucucguggaguugugauagcuaaagcacauuuuuuacucaaugcaauuaauauuuagcauuugaaguguacaauuuucaguauaugcuaauuuuuauucucaacucuuaaaccgugcuuuuaacuugcuaacauguuaacacuuaaauuuuuguauuucucacauugcguuuuaaucuuucauuuacaauuuaguguugacugaauaccaauuaaugacuaagauaugaaauaucuaguuuguuaaaguauuguuuucuaaacauuaauuccuguuauagagcaguguaauaguuugaaaguuucuucaaauugugucccacuuuucuguuuuugaaugaauuauuagaaaccaaaaucacagcaucugcucuuugauagauccuucgccaauucugauuuauuuuuguugcuuuuuaaauuuaaaauuuuaauuuaauuaaaauuaaauuugauuuaaauuguaaaugaacuuuaaauuuaaauuuuguuuucaaaguuagauuaaauuaaaagaaaaaacacuuccugaaauggaauuaagguuaaaguauugaagaguuuaugaaaauaauauuaaauguguuuaaauuuuggaaaaaaaaaccaguuuuauuauaaugcaucuuggaaaaaucaaaagaaaaauaccaaaugcuaaaguuuugcaugcaaaguaugucaugugggcuguuguaguaaauuugcugucauuuaacaugcuguugccaauucccuaaggauccagagucucaaagaccaggcuuccaagugcccaagcaacaaaauuuuccacccuugccuggauccuaaaggcugagauacagaagcccugugccugcuuugauuggcacacagugggcugggaaucacugccaggcaaucacuugggagcaggugugcuuggagagguggcccaagugguggguccagucugggugucugcuggcagguagauucuaugcagugccaaaagucugucagugacuaugacucugccgccagcaucguaagccaccuccugcucucugacaucagcgcuguccucuuuucuccugugaagugauuacacgggaagcaggguagccuggugccaguugcuuccuggaauaucauguuauccccacuaggcgugaaagaaugucaagaaggugccuugauuuauuuaccaaacgguagaacucaggaguauaugcuuaagcuuagcucagggcacccagugguacaucgucauauggaggagggcacaauugaaaugcuuugaccagguauagugguuaauacuuuauuguugacuugacaccuaacaaaccuguguguuucuagauuaacagagauagcaagacucacucuaacuguggacaacaccauuccuaaguuggacuccugacaucagaagcaacauaaccagccucaagcucuugcugcccugccccgucugucaugauggccuauaguuuccaaugaaaucgaagcaaaccuuuccuucuuaaaguugcuuuggucauauauuuguaaaaaguagugacauaaguaaguggcacgcuaggugcuggugagcuuaguuugagcucacuggaacaaguguuucuguacugacacacugugugagccuuaaauauuuauuaaaaacaguuuucaaauccau

SEQ ID NO: 1359 - RNA, 11591 nt, Mus musculus
cugcccuugcggcgguggaaagauggcggaguuggacauugggcagcacugccaggugcagcacugccggcagcgaggugacgcuggaagccccauuuucauccgcgggagaccugggccggguucugacggccggggcgguggcggcgggugagggaggacgcggggcgugagcgaccuuccagggugauacugguggugucuuuguuacuguuccucgguguaggggcgaacuuuguggcucccuugguuugcacgcagaucccgaaugcacaccuugcagacuccucgggguauccagauggccuugcucaagaagcccuggucggcgaagcgacuuagaucaggacuccaguuccccucgguccuuaccauugccaccguggagcauccacuuucccaggcuuuuucuugauugauuuuuuauuuuuuugucugacaaaugcguugaagagcaucaguuuucagcaguguguucgcagguuuuuagacgucuugguguuucuaauauuaacuuaagcuauuaguugcagaucaguaaaccacauuuuaggaagguuuaauaaauacuaugguaaugguagaccuugucauaaacauaggcccuggugguaugcgucaaaguucaggguguuuagacuccuauagccggcaaguccuuaaagcgucaggcucacagucuguuagaucgcacuccaaaugugagcagaggguuuccucaugcugcagcuucuguuaguuccuaacaaggucuugaaugcagcucuuggguuuggccuggauuccugcaguaggugaugccugcacuaagcaaaggcaagacaggacguguuguuguauauguccuuuaccauucacucagcagaucaauuuuguuuuuguuuuuugguuuuuuuuccccauguaguccuuuccuagggaagcuuggcuauuugaauuugacuguuaaguuauauacaucuugucagguugauuuacuaguaugucuaaauauaucuaccaucugugauauagcucauccuuuccaguuucacauaucuguaguguuauuaagaugaggccuaucucuuggacuagcagaaagggggugcaguuaaguagggauaugugaugcuaagaaauuauuuuaaucauaacucuuccuccugggcuaccuugaauggcauauaauacuugcuugaacccucuaagucucaaaauagcaaacacaaccaauuuuucccauugaaagugacauaaugggccagugacaaagucuguaauccaaaccucggcgugugucucagacaggagcauggcuguaggcaggacccucauucagaggcacuagccaggaguaagacagacccugccucaaaaucacagugggaagagagaacugauucccgaaaaguuauccuccacccuccauuugugucaaacaagaaaacacaacacacacacacaauaauaagaaaaauaaaucuaaaaaaguauaaaaauucugcagauuauguguuugaguuuacauauugacacauaucucuaauuucuuggcaugaaauugaagcucacaguauuaugauucguuuaauaacaauagugauagcucacuaggcgcuucucauucuaggaaaacauucgggcccuuagucugcaagcaugauuaccuagggggacccucuuggcauuuuggauuaagauacccuacaagguaucuuuucuggacuauuaaaguucucuguaaaggacugagcaguacugucugguugccauugugaaagcagugugacuggguuuguguagcuuauguggccacuugcugggauucauauaugagauagauugaagucaguuagaaagugacugagccagguaugggggcucauacuguauuuccagcacucuagagucugaaaaagggggaaugaggaguuuagaggccagccuuggccauaugagaccugugucaaacagaaaauaaacacaaaaaagugauuguuuuuaauaauuaguuucuauaacugaggauugauacuugugugaacuuuacaaaguauauguauauagacagcauuaguaugaauuaacuaauaaggaauuauagauauaagugagauugauacauacacauauaucuaugugagagagagaaacauauauacagcauauacuacauguauaucugcggcuuuauuauuaaguaaacuacuuacuauugcuagauugauguuaaauggugucagaauuaaaacccagaauuuugacaccaaaugcauacauucugcagcacacuguucuaaaaaaaaaaaaaaaauaccuaguaaaucuuggaaacaaaacaauggagaaaaauaccaccauuguuuuuuuguuuuguuuuguuuuaacaaaguuacuaaguaacaucuaccucccauugauugagccacuuuccuagaguuggagauuugguacuuuuugguuaauaaugauuacauaguaaugauauacugggucauuggaaagaaauuuuuucuuagaguuggcagcagauuuuuuugcuuaagaaaacuaaaucaagccaggcagugguggugcacgccuuugaucccagcacuugggaggcagaggcaggcagaucucggaguuccaggccagccuggucuacagaguaaguuccaggacagacaggauuacucagaaaaacuaugucucgaaaaaccaaaacaacaaacaaacaaacaaacaaaacuacaucaaaaucagacacuaaccaggaccuacuauauuuuccucuaauuuuagauuuucuuccauuugugugugaugguuguucaggaauauuuugguaaguuacauuuguauguaggauaugaaaagaauuuuggugguugucaauauggaguuaauugugacaaauaugauguaaaccauaauucagucagucuuuuccacaagugacuacaacgcugaauaggaacugucaguggcuaaaguuacaacacucuucuacaucauaauuccagcacucuagagucugaaaaagggggaauggauuuggaaagucaugccuugacuuucaucccuucauuuacugauucaguucauaaacaaucuagcaauaguaaguaguuuacuuaauaauaaagccgcagauauacauguaguauaugcuguauauauguuucucucucacacauagauauauguguauguaucaaucucacuuauaucuauaauuccuuauuaguuaauucauacuaaugcugucuauauacauauacuuuguaaaguucacacaaguaucaauccucaguuauagaaacuaauuauuaaaaacaaucacuuuuuuguguuuauuuucuguuugacacaggucucauauggccaaggcuggccucuaaacuccucauucccccuuuuucagacucuagagugcuggaauuaugauguagaagaguguuguaacuuuagccacugacaguuccuauucagcguuguagucacuuguggaaaagacugacugacuagucacaguuucuaauuggcuacgcguguauguccuuaagcauuaaguuaccagaaauguauucaugaaugugcacuguaagauuauguaucguaauuacagugagagaauaauacccauacuuuaaagaaguagcuuugaaaacucuagccauaauuauucuguguauuuuugugaacauacguaaaguguccaaccuauaauguucucaaaauggauagugcaugguauuggaacacagaccuugcaaauaugcccuggguuccacccaaggauuuggaaagucaugccuugacuuugcaucccuucauuuacugauucaguucagaagaaacugugagaccccuuguuugcaugcaguuaaagcacuccaauuaaacauagcuagaauggugcauuguuuauauucaauugcaggugaacacuuacggugaaaacauuugagacuguacacgccccuucguucuguggcuucugcuuguucuuaccugaaagucacuacuguagugugcagaaugcaccauaaggaugugagaaguuaaaacagcccgaguuacuucaguuaucauuaaauguauuagcugauugcauuuaaaugauuuuuuuuuuuuguaauuauuuaagccuugaacacagaagcaaggacucucaugguuguucugaggugcguuuauuuucucuuauuacauaauuuauauaucuguacucauguacuuuguuuuagaauuugauuagauucacggcuacuugguacacuagaugugacguucagaaucuuuugcuucauuuuguuuuuugaagaaaauuugcugucguugguguuuagguguuuauucucauagcuuccgguccuagcccuccucuccacgcugagcugaguguucauaucccgcuuggccuccaugcugaggucccauccgggcagggcucguuuucccuggggucuggggauaggagucuguggcagugaaguguucagacccuucagccuuggaccaccacuugauaauaaaauauuccauauaauauauuauauguuccauauaauauauauauauauauauauauauauauauauauauauauauauaauaguuuaugauuuugaagacugcuucaugaugcaugugauuuuuaaggguuucgucuccuaaauaguucuuuauuuccaaaaacuggccuaaaaaguagguacagcuccccauuugaggguugaugaguuaaguaucuggacauauuccuuuuagggcaccucuguguaccgcugauacaaaccagagaguaaaaugcuaggcaauaaacugggcgcagugcagugguccgcccuugucaucccagcucucaagaggcagaauagaaauccugcaaauucaaagccccugggguguuacaaaguaaggacacggagagcgagaggaagggacgggagggaagagaggguauggucauucuacuuuaacuuaagacauaauuagaacacauuagaaaagucaauuugaacuagaacaauaugguugcugccuucuauugcuggcuuuugugcuguuuuaaaugggaaccauagugccauuucuccgucuugugguuuuaggugaauguagucaaggagagaccaaagacagaugaacacaaaucuuacucaugcucuuucaagggcugcacugacguagagcuuguggcagugaucuguccuuacugugagaagaacuuuugccugagguaaucgcugaaccaugcaagcuuuguguaccgcuuagcuguauauaauucaugagccagagccagcucucugauccuugcagacaccgucaucagucggaucaugacugugaaaagcuggaagucgcaaagccucgaauggcugccacacagaaacuugucagagacauugucggugagucccacaggcuuccauggcugcuuucauuccuagagcacaucugccacucgccaacuccugcccccuacaucucauucccguuuauggaggcuuugcucacugccccaguguaagaacuugcauucuguuuuaaaauguuacuauugauuuaccuguagauucugaggaugguguuuaugccugcguguaugucugugcaccacuugcaugccugaugcccuaggacagcaguuacauacagcuaugagccauguuagugcuaggaguuuugaacccagguccucuggaaaggccucuuaacagcugagccaccucugcagucccaagaacuugcauuuugaugaguccuuguuaaaguauuuuguacaaagccuuuugaccacugaagaucaggaaauaguaauaagguucuccugggguagucucauuuguugagcagcagagauguguugauugaguguuaacaguugugguagguauguugaugaggcuggcaugguggacugcuuuguuuacacaauauguucuacuaagcuguuuuguaaaugcuacuaaccacacaagguaguuccaggacagagcccaguuucgauuuagcuuagcuucuuuggcaauguauuacuuuaguagaccuuuuuauuccauguuaaagguggugcccuuguucaaaccuaaaguguuacauaaaagggucagugguugcuuuagauuaaauacguuaaauagcaugugccugugcacucucucagguagauauuguuuggaucgaccaucaguaauguagagcucuacuguauaauuucuguaugcugaaggccauagugguuaagcugggcauggugguauacuucuuuaaucccaucagagacagguguaucucagcaucaauguuaccuagggaggccuugucucaaaacaagaggaaaaaaaaaagaaaaagaaggaaggguggaagggaacucuggaacugauggggaggccucauuugcuuccacuucuuccucagaugccaagacaggaggggcagcaaguaagggacggaaaggcgcaaaaaguagcggaacagcggcgaagguggcgcugaugaagcuaaagaugcacgcugauggggauaagucccugccgcaggugaaaagggcacuguguuaaacacagugaugucuggaugucuccucucuuccucucgcuaauugaauacaacuuaacccucguuugcaucguugcggaagaucaugugcugucgagucuguauaaguacuacaucuuucccacuuuauagagauggcggugaaccaugaaugucggucuucacuauuuaucccacucugcaucaugauuuuaauauuuuucuguacgguauaguucauucagaauauucauuuuccuguuguaugacuguagccuacuuuauuuuucuaaauaaucccagcuuauucggugcauucuuuuuaacaaauguuucuccagcgaaggcgcuuguguuuagggaggagaccuucucucgauaggaucuuuaggaucugacacucaggacacugacguaggagaucaggaguucaagguaaucgagcuacagagugagcgccaggcagccugggaaaaaaaaucucagaauauacaagcauaccuaguuacaugccuuacuacagauuuguuaauuaacuuuuagccaacguaugugucccaguuugcuucucugucgcugugauaaaacacagacuaaaaccaacuuggggaggaaacuguuuauuucagcuuccacauuacaguccgucauugagggcagucagggcaugaacucaggcuggagccauggaggaacauugcucacuggcugucugcaagccuugcucagccugcuuuccuauauagcucaaaacaacauccugcucagggaugacacacccauaugggauggggcuggguccuucuccaucagcuagcaaucuagaaaaugccauacagacaugccaacagcccagucugauggagccagcacuuccucaguuguggcuuuuuuccaggugucucuaguuuguguaaagucaacaaaaacugaccagcagaauauauuauaugcucucucuauauuauauaugugugugugcguacauauacuuaauacaugucuaguggugagggcuauaaaugaaggaaaauggguuucagauggauaauaucaucucucugauuuauaucccauugcuuaguagaaaagacccuccagugugcccacacugcugauguuuccuugaaagugugcgucauauuccauggaguaugugacuuuuugccauuuucccaucgaugaauguugauucugucuccucuuauggccauugugguguuugauuguuuucuuuuuuugagauagguucuuguguaguccaggcugcucaaggagucugaaguucucaguucugcuuuacgcugcccucuagaugaugcucaaauucaccaucauuaauuaagccuuuuuuaaaaaucgaggaugauagaaauuuaucugguuugaguuucuuaguuuagaagccauguuuuuagcuuuugcauuucuucuuggauauuuacaucucguuuuauuuccacuuguuuuauaguguguuccuuuuuguggguaauguaucucacuguacaucccaaugacauucugucuuuagauuucugcuguuaguugcuuaauuuugaauuuuaaguguauugauucuacaaguucaccuugacuuugaaggguuuguaguuuaguuucuacuuccuugccuuaagcucugggcagaccaugcuaccagccaccgcccagguucccuuaguuccacagaugaaacacacacaagcuuauuuuuaauaugcuuuuuaacucaauggccgggcaccccuuggcuaacauguccuuaccuuccacucucagcucaacaccucuaaaucuucucucagcuuaguugcccaguugcucagcaucguaaaucugcccucagcuuaguugcauuucuaaucucccgccugcuaccccaggcccaguugaggaagcggccaauggccacuccauccgagaucucauauggcuaguggcucucuuucccucagaagcauggcaaaucuuucuuccuccugcaucuccuagccugcgugcuggaaccuggaaguuccgccucuuccgcccagccauuggccacuagcaucuuuauugauagaucaagaaccaauuggggaacaggacgcugaugguucacagguagauuccggaucgaucuaagcacaucagaaccacccccuacagggcuucuuguguauuucucugcccugacuucccauccccgccuugucuucuggccacucacugagagcaucagcugagggagcugaguggcaccugugugguucugaggcugcugcaguugcagccguugagucggacgaguucucugugcuuuugugccuuucucuguacugaugugcuuagggcagcacucagcacccaggaaccuccugcuccagcugccuguuagucuguuuuugaucccagacauacuuuuagagucugguagcuuuaguuuucucuuccugccuguucuuacugcuuuccuuuuagaacagggacugcugguuacagacaaggaccaaagcuuagguuuacacugauuuucuuuuucuccgaaugcuuuuuagcuaugauucauugcacugacccucagcaaaucuaaauuccuuucugauuagacaggaguuguuuugacuguauuauuccuuaagauaacuucgauuauuucccaacauuuccauuagaaacaccucacuuaggggauucuuauuguacaggacuugaccugugaagaugccucccuaacgcaguguuuaggaaucagggaauauucuauucccacuuauuuuuuauuuuauuuaauauaugugaguacacuguagcugucuucagacacaccagaagagggcaucagaucccauuacagaugguugugagccaccaugugguuucugggaauugaacucagaaccucuggaagagcagucagugcucuuaucuacugagccaucucuccagcccucccacuuauuuuuuaauaaagauaauuaaauaacagaaugcagcuggagaagacaagugagacacagcuuaugcuagagacacuguuucugaaacccuguuguguuacuaaacucucuuucuggggcuuuucuguacuuuaguuuuucacuuucguucucaaaaaaucucaaaccucugacauaccuuuuaugucuuucacauaaaauaaguguuuuuguaucaagaagccuugucucucaagugacaggaccuugauuccaaggaguacaguugaaacaaguuuaauuccucacagaacgaaacagagggaacauguugagggauucugguguuguugaaugagccgucagucuucuugauuucucucuguucauguugaacucauucuuaacuugggaaugcaggggagauaugagggaagccugugguccaagucugagucucuggaacucaacaaagaaaaaaagaguuccucugcacccagucccuggacauaaaaaggccguacaacuugguuaugcagauaaccuggcuaggguuuugagucuuugggacgugcaguuagguagguaggcuacaugauggguucuucugaccagaacugacgucauaggcuauucuguguugacaaaagaagaguuaaggaaccgcuagcugaauaaggaaugccuccucucgcgugugucugaucuguaugguaacuuuuaauuacacagacagaaagaacauacuuccaggucuacuugccaaaggggagcaaggaaaaaagcaaagccauguucuuuugccugcgguggagcaucgggaagguuguggacuuugcagcuucucucgcuaaucucaggaaugaaaacaacaagcugacagcgaagguaauguccggugaccccuuuuccuucaaguguugggauaugucugcaagugggccucacccugugcgccuucucucucucucaccagaagcugaggcugugucaugucccuucaggagaagcccugccauuggaucacacauuggaaagguggaucacgaaggaggagugcccuuuauauaauggaggaaauguuaucuuggaauaucuuaacgaugaagaacaguuuuuaaaaaauguugacucuuacuuggaauagucauucaaggauucaagccagcagaauccuuauaagcagaaaccacuaucaguagacagucagcuuuguuguguuuguuuuguuuguuuuacuacagauacuuuuuuaaaacucucaaaguugcugucuuagaauuuauuuccauuagguccuaauuuacaccaguaguuuucuacuagguuccauguugguguuuaauuauguguugacaauuacuggcgaaguauuuuauuagcuguuucuggguuaggcuguagaaauaucagcaaaagugucuuuccugguagacuaauggcagccauugacuggcugcugugucacagccuguacugccuucccuccgagaucccgcucacacaacacccaccuuuuugugauuuugccauucuacggcagaggaagcugcagauggcagacucuuuggaggggucguacaagugguacuuaccaauauuauuuaaaggaaguccuaugauuaaaccucauauuauguccagaauacauagccuuacuggauaccuaaaucaugacgcaugaauugcagacucuugcagauccucucauucagucuuccaggauaaggugugugauaagacaccacauaccuaagaagggaacguaauuuuuuugguaucauguaauugcacuggauauguuucugguaaggaguuuucucuaguaggauucaacuuuuugugugugugaauguauuacaaaugagaacuucacucgaauaaacugauuuuguuacagucuaugcuuccuguaacaaagcgagacaauuauugcauuugaucuauaaguugaaauaaguccucuuggggaaugccuucugucuacaccugaggagaaugagugucuucuguccacacuagaugaaggccuacauacacugugggagggagcaguagguuaauuaaagaguaagcugagcaugcucauuuggucuuugucagcuccaucuuuucauguucagaccauaaacagugauaauuucuugcuuuuau

SEQ ID NO: 1360 - RNA, 2834 nt, Mus musculus
uuuuuuuuuuuuuuuuuguugaauuuuucaguuuuauuggaguuaguuacaggacaauaaaaauauacaaaaugcuaccaguuuuauuaccuauuuugaggguuguauuaaagaccuuaaauaguuuccuuuugaaauggauuauuucugucucaaugaaaguguuauacaauacuaucuucugacuuccuaacuuaucuucaucuuauaacguuugagggugaacaaguaaaaaggugucaugaaaagcuuucuacauuuucacauuuucagaguuucucccaacauaaauaguugacauuaucuaagauuugaacauugcaugaauauuuucacaagauuuucauaaucauacuaauucucuaguguggagccucaaguguugucaagaauacaacauuuuccccaacagaaauacuuuacccuaaaaaguucuuagauguucucucugaccugaaaugaagucaaagauauuucuucauauaaugcaugaguuaaguuucuagccuguaaguauucacuguuacagucuaggaaauaggccaaaaggaaaggauucauaccuacaauauauuugaaaaguuugucuucucuaaguauucucuaaugaauuuugagaugauauaucuugguaaagaauugucucguucacuucauuuauaaagauucucuacuguaugaaauaacugaugauuucuaagacugacauugugaguauuguauuugucacauacauucuauuuguaagguuucucuccuguaugaauuuucugaugaauacuaagaugggauuucuggguaaagcauuugucacauucacuacauuuguaagguuucuuuccuguaugaauucucugauaaauaccaagauggaauuuucgggaaaagcauuugucacauucacuacauuuguaaggucucucuccuguaugaauucucugaugaauuuucagaauguuuuuuucauuaaagcauuuuucacauucacugcauuuguaagguuucucuccuguaugaauucucugaugaauacuaagaugggaugguuugguaaagcauuugucacauucacugcauuuguaagguuccucuccuguaugaauuuucugaugaauucucagacugcuuuuuacaguaaagcauuugccacauucacugcauuuguaagguuucucuccuguaugaauucucugaugaauccucagacugcuuuuuucaguaaagcauuugccacauucauugcauuuguaagguuucucuccuguaugaauucucugaugaauucucagacugcuuuuuucaguaaagcauuugccacauucacugcauuuguaagguuucucuccuguaugaauucccugaugaauucucagacugcuuuuuucaguaaagcauuugccacauucagugcauuuguaagguuucucuccuguaugaauucucugaugaauacuaagauuggauuguuggguaaagcauuugucacauucacugcauuuguaagguuucucuccuguaugaauucucugaugaauacuaagauuggauuguuugguaaagcauuugucacauucacugcauuuguaagguuucucuccuguaugaauucucugaugaauucucagacugcuuuuuucaguaaauuauuugccacauucacugcauuuguaagguuucucuccuguaugaauucucugaugaauacuaagauaggauucuuggguaaagcauuugucacauucacugcauuuguaagguuucucuccuguaugaauucucugaugaauacuaagauuggauuguuugguaaagcauuugucacauucacugcauuuguaagguuucucuccuguaugaauucucugaugcauaguaagauugaauuuguuuuuaaaacauuugucacauucacuacauuuguaaauuuucuuuucuguaugaauuuccugaugaauacuaagauggaucugauggguaaagcauuugucacuuuuacuacuuuuguaagguuucuuuccaugauaaauucucugcugacuuuguagguuuucucucuggguaagauauuugugaaauucacuacauuuguaaggguucccugcaauauugucuuuuuucaccaugacuuuauguuuagaaacaaaaaucuugucuaauucugcauuucgguuguguuuuuucuucugcauguuaauuccuugauugagacuaaugguagaaaacaaacuuaaacuguuuacagagucauuguauuugcaaacuucuuuaguguuccugggcuuaagucuuuuuugguucgagaauugaagagcaucagagcugugauuaguuuuguaagguguacacuggagggauucaagaaugacauugcuaagcuugucccauuuagaagacuucucuugaauauucauguguucauggacaauguacuggcugucuugauccaauaccuucccauucuuuccacguaugcaaugauuuuccacaaacaacagauuguuguaauucuccaacaucacauccauguacaaugaccucugagcaaaacugagacauucccauuccuccagugagaaguccaaggccacguccuugaaaguuaacagacccugugguguauuuaccagacacacacucauucuuguuguuguccuucucccaggguccagugaagaacaaaguuugaauucuucuugaaauuucacaucaaggucuggaaggugacaggaccagcugcugaauauccuaggaggccaacaaggaaauuuucagguucugcaaauacuaggcacuagucucccuccaggacuuccugaccacgaggcagccaaggu

SEQ ID NO: 1361 - RNA, 1413 nt, Mus musculus
aaaguccucgugaauuccaagcuuuauauuuuuugagaacugcucauaaaacuuuuuguaguucucuuuaucuucugcuaguucaguaaauaguucuaagcauuucuugaccaaauucuuucugauaacuuucagaauuuuacuuuguugcagccuuucaugggaaauauuuagagggagauccucagaauccacuaccccucuaaugaaauucagauacucagggauuaacuccucacaguuauccaugauaaaaacucugcgaacauacaacuugauguuguucuuuuucuuucuguuuucaaacagaucaaaaggagcgcgucuugggacaaaaagaagggcccggaauucuaauuguccuucaacagaaaaaugcuuuacugccaaguguucuucccaaucguugguuaagcucuuguagaacucuccauauuccucauuagugaugucaucaggauuucgcguccaaaucggcuuuguuuuguugaguucuucuugaucaaugugcuuuuccuuuaucuucuucuuuuucuucuugccaccauccuucuucuccuccucuucuucaucagagccaacaucuucuauuucagguuuaucaucagacuccuuuucuucuuuuucuuucucuuccucuuucucuuccuuuucuucagccucaucaucacugacuuccuuaucucguuccuucuccacaaagagaguaaugggauagccaaugaagugagaaugcuucuucacgaucuccuuuauucuccuuuccuccaaauaguuuggucuucuuucagauggaagauaaccuuuguuccacgacccauugguucaccugugucaguccucacugugaaagaucccccagcugaggacucccaggcauacugcucaucgucguuaugcuucgugaugacagucacuuucucagcaaccaaauaggcagaguaaaaaccaacaccaaacuggccaaucauagagauaucugcaccagccugcaaagccuccaugaaggcuuuggugcccgacuuggcaauggugccaagguuauugaucaagucggccuuggucauuccaaucccgguauccacaauggucaggguucgguccuguuugcugggaaugagauugaugugcagcuccuucaccgaguccaguuuacuggggucugucaggcucucguaacggauuuuauccagagcguccgaugaauuggagaugagcucccucagaaagaucucuuuguucgaguagaagguauugaugaucaaggacauuaacauuucugccugaaaggcaaaggucucgaccuccuccuccuccauugguuggucuugggucuggguuuccucaggcaucguggcugaaugaacacgcacgagacgugacgcuccgcaccaggacacugaagcaacucgu

SEQ ID NO: 1362 - RNA, 4318 nt, Mus musculus
aaaauguuugaucaaaauauuuuaauaaagauucuuucugacauagauacacauacaaauggucguacauagcugucauagucugauugaccuauuuaauauauauaucauucuuuacacauccaaaaccaacugauagauccaucauagcucugaaaucaccagacaaacugaauuuguauuaucuguaaggaguggaaaauagcaagacuccauuuuaaaaggggguguucuggauuuucacaggaggaaaggcaggcagaucgccaugcaaacuaaaacugaaagcucgcuuuggguaaauagcuucuuccucuuccguagcuucauuucaugucuuuuaaauuuuauuuuucuuagaaaaauaacaaaggauuucacaccauaagcaaaugaaaccagucuuuuaacuuaauaagucaucacaggaggaauaacuuauauauguacaucuauauuaaaaacaauuaaauuagaccuuuuaaaaugcacagcacaaccugaaaaauauauuugccuaguauguucuuacuuguaaaaucuauugcugugauguuuuucuguuuuggaaugcaaauagguccccuuuuggaaaagagaucaauucauucaucaauuaagaauacaccuuuccuguaauuuuuggacugaagcaauuuauuaaagcucaauuuaaauacauggacgaugcaacugaaaauauccaaugcccuuucaaaaaccucagcagcucagauacaucaauauuucucuucauauuuguuggcaaauauacccuuugaacacuaggcacacaguguaaguuaauauauaaaacagaauuuuagaagcauuaaaaaaaucuacacuuaagacccaauaccuuaacacauaauaaauacgguugauguggaucauugaagaauaacaaauaaauaccauaaauuguuaauacaucauugcagaguagaaagcaacaaggugcacauaaauauuuuaaaugcaauucuuucagccacagccugcuuuuuaauaucacucucaccaaaacuuugagcauuuucacggaauuuuaaguucagagacaauaaaaaauacaagucuuucauagcaacaugucucucugcuuuccccuccacuuaaauaaagucugcauuucaaguuuuucuccuggcucagaaucaagauguauuuucgagugcccuuucugauuugucugaaugaauauucuguccccgagccucucaacucugaaccccucucccuuucaucacuugccaauugucagguguuaguaggauuaguauuuugccacucaguacuuuucucgucuaauaaucaagcacuacuuuucaacuuauuuucgccuccaaagaagacuguacuuccuugagaucuagggagccaccaaaguugccacuuuucugaggggaaaaaggaagcacacuucauccgcacuaaaccucccucuccccucccuccccaccccaaagaccgagauuccgggcuugccaaggcugaauguccgguuugucucugauacuucuaaguuccugccucugcuuuguuugcccugcaaguguuucacaacuuaggagaggaccaaaggaaaaggaauggggagcagcuucucacuuuccucuagcuuuggggucggucucgagguuuucgaagaagggaguguuuaaggcuucuccgugcacuguuugcagaggcuggacgagacgcuguugaauagggcacacuucucggggcaggaggcagcgggcggcagcccugcacugaacggguagccggccgccugcucguaggcgccgagcgccgggugcagggcagcggccgccgcagccgcggccgcggagcugggaagagaggcugccgagauggccuggccuugguugagguaggcgacuaagcgccgcauuuccuccagggccugugccugcaugaggauguaguucuuggcgaggagcagcguggcgauuuuggagagcuuccgcacugaagggcugugcgcguaaggaaugaccgcgcgcagcucauccagagcgucguucaggucgugcauccuccggcgcucgcgagcguugauguugaggcgcaacgccuucugcucuuuggauuucuugcugcugccgccgccaccgccgccgcuuccgccgccacuuguggggccccccggggggaggcccgagccaccaugcaagugggcguuggagcagcccucggccaccuuggcgcugccgccccccgcucccggcgaugcccgcgggucggggcccccggcucgcagcaccagcucgcagcggccgucgcugucgucgucggggcucugcucgcccccgcugcucucggccacggagccgcguccggcgcucucgccguacuugaggcacagggcagcccccgccggcaggcugcucaggcucggcucgccccccacgcccgcugagcccacgagcagccccgggacacucaccccgccgccgccgccgcucgcgccaccgccuccuccgggcggaggcagcagcagcccagccccuucgggaucagcgggcucgaaacagccgaggggcgacgaggacgacgccgggcguucgcgaguuggaggcgccagggacagguccaugcccggggguguggagcgaaaagccgccuccaggcgcuuggcggcggaggugcccaggcucuugugcaggaagaggucgucuucgcucgcggccgccgcaccgaggugcaacccgcguuccaucguccgggccagccgccaccugggcuggagagucaggcggccgcacagacgcgcgccggcgggguuccggagcugcugcgugcgucgguccccacgcugcccgcagcccuguccccuucuuuuucuuuuucgccuucccccgcgcucgccgccuccucuucuucuucuucuucgucuccagccgacggugcuggcugcuaaggcucaccaugggccgcggccccucauggugggaggcuggucucggagggagcggggcugccgccgcuaccgccucugaguccaaucccgcgccugcucuacgcaccguuuaucuugcuuggauucaccuucaagagauuuccggacccaucaaccagccgccgccacagacgggggagucuuuuacaucauuaucucugaguagguuauuaugaagaagacucgccuguugggacagcgcuuucuacccaaucagguuaacguuuuaauuaauaggauuaaaacgguaacaaacaaucgcaagcgcuaucuggccgcgagucugaauaguuucauuucccaggucugaagacaggcagcagccagagcuuuauaaaaggcgccugcuccauuauucugccugccaucuguauacacagcuuagcgcauauguuugcaaggcgcuggguccuguuaguaacccaacaacugccuuuagcuugacauguguggcgacuuucacucaucaaugagcacacuaaaagcccuacuuagagccgaggauguucuuugcuccuucagcaaauuguauauccgcgguaaagacugggaguccaguggaaagcccccgcccccacugagcaccccccacacacuacccuucacugggccacuacugucucagcuugcuuaguuacccucauaggagagaauucuauaucucccuguuaauagcaugucugcauuuauagauggaaccugggggcuggggguaggggugaggucccugcuggcuugucucgaauuuacccuagauuuucagcuaguaugucagcaaugcaagagccaacccagauuuucuccgcaccacuuuucccacagcccuccacuguccauuuccuauauagauggaaaaaaaaucaaacaauuaaagaaagcaacaaaaugaugaccaaguugcuuacauagcccguuugauuuaaaacucggagggggcggagugggggaggccuuugccgagucccccacgcuguuaaguugguggugagagaagcucacugcuucguggacagaaagaaaagaaaaacuagucucaaacuuuccucaagauuaaauccaguugcuucgcaagagggaacauucagaguggaaucuucucacacaccaagugggggcauucgugcauuuagcugcucugaagacguuuggggacaucuggauccgucugggcuguuccugcaggguuaguucagggcagaauuguggaaacaagagcugucuggauggagauaguacacgugguccucgugcuucugaguccaguuucucgaagcacacgauauuuaguggcuaguuuucauccuuauaaguaaaaaccguauucccucuuaucuggcagaauuacug

SEQ ID NO: 1363 - RNA, 88217 nt, Mus musculus
auuuccuucaaaacuuuauauauuuuauaaauuuuagauaagauaaaaaacuuugauacuauuacaguuuccugaaauuuuuuacaagacauguccaaacaacgaauacuucaaauuugcuauacacccacacacacacccacucacucuuaaagacaaguaaaagauagcuuuuuuuuuuuaacagauacuacugaaucaagugaaagccacaaaugacuaagucaacagguuucaauuuaagucaacagccaacaagaagcuaaauauugaaaagaacaguguuugucuuuaccuuuccauccuaccagguucuaaagauggauuccaagauaacuuacaaaacuuagacauaaaguuuaaaauguaauugauaaaguuaguauuuuacucaaaguaucauuuucaauacuugaaacuguauauucaaauuugaaugcuaagugacuuagcaucaaaagacacacaugguauaaguuuccuuauuaagcuagucucucaaacaauaucccagcauuaccccuccuagucaguucugaaaacuaauuacaagcacuuuguacacauuuuucuuuuaccaagacaauuugaacagagacccuggcuuguaacuuuuaaugcucucuaaaaauugaacaccuaguuccauguucugcauucauuuacuauacaacuucagcauuacauuacugaacuacuuccaguaaauaaaugucuuagcaauaacgugauaaaggguacauagaacuccacaguaacuuguuuacugauagcccaauuuacaucugcccacuacccugcacacugaagaaugugagagaccuuuuauguuccugucaguucacccccaugcugcuccucagugguggcucucucuccugaagacccuuggggguccucucgaugcuacgcagguucuuaggacacaauggcugcaguuucaaaguuaugcuucaaaaacauggcaaaaguguggcaacuaguuugcacauuuaaguuacugaccguaagacauaagcuugaguccggcagcgguggcgcacaccuuuuaucccagcacuugggaggcagaggcagguguauuucugaguucgaggccagccuggucuacagaguuccaggacagccagggacacacagagaaacccugucuugaaaaaacaaaacaaaaacaaaaaacuaacuaacuaacuaaauuuagaaaaggcauucauuuucagagcugugaagggauuagugcaccucuaaccuauaucucagguacaggauauuuuuuuccaaguuugcaaaggacaaaaaaaauguaaauuuugcuuuuuucuuuuaauacggagauucauuacaaacuaauauguuuagaguacaguguugaugaccauguuaggacaagacuuguuaaaauuuuuucucaccucuagagcagagacucccuaaccuaccccagcgccccuucagcagugggcccagauucccaaauggcugcuacauacucaaaaauucuuugaaguguccaauauaucaugaaauaccaugaauuuugugcuacucugaauuugcuuuuuuuuuuuuuuuuaaugaauuugcuuuuuaaaaagugaccuaaaugguuccuuaaauucuuguagaaaacccagcugaucaaggaaaauagguugaggcagguaauucccacagcugcagaaaacaaaugugauggguuugcaagcaccacuaaggugacccuuugagaagcugagucaggaaagcuaaaccuuccugcuauuaaacuugaacacaauggagcugccaaucaagccaauguauagaagccgcuagcggcagagaaccucuagcauccaggggaggaggaacccaguucacagauaugauaguagcagcuaucuccacagggagauggaugcuuuaggaaacuuugugucccuugcucagaauucuugcugaggaaaccagcugauccuaauuuggcuucugaagauuuaccuaaagggagaaagauugguaguuauguuuuucauugcaaauuaaaauaccaagacuuuucuuugcaguuaucagauacugugugaacuuguuuaagguaauguuagcuugcaggagacuuccucagaccccggacggucaaauaugcugucacuuuaggaggggccaguggcugucuuuggguaaugacuauuauccuguacccaugcuaauaggagagccgaaugugggcaugggugaccacuugaaaugaggcuaguauaaauugagauguacuguaaguuuaaaacacacacuggauuucagagacuuagcaacccacuuuaauuauacuaaaagaaaauauuuuggauauauuagaauuacuaaaguuucagcuuuucuagaaaacugggcaaacauuugaguggguucacuaacacuuguacuuucuucuaggaaguaggagcagauacgucugaucuaaaacgugaacgguaucccuucucaugaguuaggccugggagggcaguaaggccacucuauuggcacuguggaugguggcauacaccuuuaauaguaggacccagaagcagggagguaucugaguugaggccagucugucuacauuguuaccaggcuaucugaaagaaagaauuaagugguuauuacuuacugcuguaaaaggccaggaauacaaacacaacugcuauuuuuaucccuuucaagggugugauuucuuaggcaauuuccaacaaaugcuauacaagaaugaccaaacggaaccagaccuugccacacuuguacggugcagagugaggcucauacacuccaggaagacaaagucugcauacaacuuagacuucaaaauacccaggacugaacgggagaggcagcagcuaacugaucaccuaagaauccagcaugucacuuccaaaggacugagugguaagguagagugcaaagauuaaccaaugagcaaagaccgguuuuauuugucaaucagaaggugaagcaacaggcacguguuuaaacgagugugcccaagccuucacacauggcuuuacacucaaguucucucccaagauggcuguugcaacaaacuguaaacauaaugaacagucuuaaacaguaacaagggaaauagaagguaacuaaaagaaagcaccguuucucuuaaacuagguuacaguugugcuugcucuacauaagaccacugaaaacaacuuacaaaaguggaauguuuuaagucuaaaauuaguccuuaaauuuuauccuagaaaacaucuacucacaucaaaagguccgccaaaggguaauguuucaucaaagugggggaggggggacaagaaaacaaugcacuuuucaaaucaaaaugagaaguuuggucacuuagcuuugugcauaguuuaaggcaucuggagcaaucuuacagcuucaccuaccuuccccucccccaaguguggcugcucacuaugucacauucuagaacaauaaauaagaacuuacacuucuaauccuuucccacauggauggacagaacaugcacagccauacaugcacaaacaugcacgcaaacacacauccauacagccauacacaacauaccucucacacacugcagcgaaagggacuuuaguacccuugauuugaaggacacacuucccuagcccacuuuauuucagauuggcaaauccccugagcugauuaugguauguuaaacauuccaccuuuugcuugcauguguaggucaaguguacaguagugaaaacaacaugcagugucuucacugcagagucagaacacagcuaggacagugguguuccuucccucccaccccauguuaaaaacuaacaguuaaaaaaggaaucugcauugccaaccacgcuggagugaaaagcuucguguggcgucugugguaaauaaaugcucagucuccaggcacagagcagagcagcaggugggaggcgaugaugacauugacauccgaagaagaaaaggcaaaugcugcgaagagcugcagucuccagcucagcugagaacggucagugguuccuucacaacgaugcuccgaggcaauuuagaaccaauaguucagauuugauuuguaaacauuugauugauucuugccagaggcagcagaggcugggcacuucacauuucuguuuucucagagagaauguaguggaagggacggaugcgcuguuggacuggacugguugcaucaagauugcugcugagguugaguucaaguuucagggcuugaaggacacacacucugaaagcacauggcacaccuaaaacaucaucuuccuucguuaagaacccuuugugguucuccugcugagcuuuacagacuuaagguuucauacaaaagcaagaugcauauugcuguauauucaugucuuaccauuaaaacgugcgcucguaugaucuaacagaagacaucuugauagauaaugcuggcaucauccccuuggaaaccucagcagucagaaccaguucuuccacucaagaccauuucacauuuccacaauguugcaggagggaguugucccacugguucaggguuaugauaaccgauuuuccugaguuaguaacugugaguucaacucaaaugcagcauuggcauccucgcugcugggcuguugucucugcagucccuuccagcuggcuuuauucagccccacauguccaagcaucgucugugacagccgugugucugaaaaccuggcccacucuguaaauaaaggcuccacuagguaagucauaaaaccuugagagacagaggaaaaagcuguuaaaauaugucuugaauuaaucuuuaaaacaucuagaguuuuaauguucuucaguuccacuccagugucagccaaaauauuagcuuuuaaaaggucuguguguacaugugauuuacaaauugggauuucugaaguauucaguggagcucuggucuaaucuauuucucucagcugaacaagcacaucuuaagcuaacacacgugauggccauaucaacucuacgggcacuagaacacaauccagggagacaacugcuggccacuuccucagggauggaauauuacaccuggcaugacuuauuuaacucagaauguacaaugucaaaauuucuaagagauaguauuaaaauaauaaaaaaaauaguuuaauauuuucacuacuaaagugagacugucuagaagacgugggggucagaggacagcuugugggcacugguucucucuccaccauguggguccccggggucaggcuugauggcaggguacauuuacccagugugccaucucagcagcccccauuuucuucuuugagagagucucacaugucccuaaggaugaccuugaacuucaggucuucccuccuccaaaacuggugagauuuuaggcauuuauuguuaugcgcgacuaaaaucauaacuuaaaaaaaaccacauauuuuuauuuuguguauuuuauauauauuugagugcuuucaggcagaggcuacaagaggaggucauagcccuaagggcuggaguuauguaggagcaaacugaagugggugcugcuaacaaaccucaaaagagcagcaaguacuuaaccacugagccaucucuccagcacaaacuacaaaguuuucaaaaaucacuugaaaguucuuucuuuaggcuagaguaauuuccucgggcuacaaggcauuuacgggagcugcauguacccacucauguagcuuucucucccuugccuacaguucacuuagucuuugaacuugaguagcucuccuugagaaucaaaacagccuuucuauugccuuguuaacuccacccaacagaaaaacaacuauccggcuuugccacggagucagcacugauucccacaggcgcaguaccaugcaagcugugcccauuuccuacaucucugucugacacagucacgucagucccugcuguucauuguaagcacagcaaaggugucaguguugcugcuguguccccucccaacugcauuaugacuaugcuaguccugagcuuuuagaaacuugaccaucaugauguuuaucaacaaccuucacgauguucagcauaaauuguaaggcccuucccaaucccagguccccauaauauauucagcccaaacucuagagcugacaucuuucucugcuuucaaagcccaaugauacacucagccuuaggcaguccuucccggguucucugcgagcuucuguauagucacaggacauguccccgugcuucccaguacauggugagcucccucaacaguuccaaugugcuucccaccucuaggcacagcguggccaaaagcaaguaaagcuugugugaauguagugcucuggaaaccuggcaguggggacugacugccuucaggcaggggaagguggcuuuuggaagggacauuugagccaucaagaaaagccccugaagcagacaggaggggcuggcagagcaaaggguacauacugugacaaugguuaagauguccuacaaauuacagugaacauaauuugauacuuuuguuuugaauaauuuucuagucuagucuuaagaaaaucaaaacgagugauuuuuuuuuuuuaaaccagaugcaacuaaaugugcauaguuaccaaucuggauguuggcaauagacucagucugacgaucacaaaguggacucacacccaaaugguacuuuuuuucuauaucuccuguaaauuuaagaaagagaacuguuaagaugcaacacaucugcugguuaaaucuauaaugaauaccuucacugcuaucuaugaauuuacuggaggagcauuacggaauccucaugaaaggauuaaauguuaacuuagugacacauggaaagcuugcuaaauuggaccaaacaacaguuuuugcuggguguuccucccaagacuaaugcugucaguucuuucagacaugcuucacaugcuccuaugauccugcucucuacauggugaagugaugggguaguuucagagcaaucuuucugcagagaaguuuccagccuacuuucugugccaucaugaauacccaaggucacucaguuucaaaucacauuucgucuguuacugguuauacauacaugaaguaugaauaguuguuaaaauauaaugcauguacugugaggcucuuauacauggccgggucugaguuuauccacaugugucuauaaccugccuugguggaagaauuccuccguuacuuuuucacuccacugcuugcuuaauucccaguuccgacauggguuacaaauaucagcacauuucaaggccaucuagcaaacaaaauauuaaaaggguguuaaggaagaaaagaucucauuguaccaaguuuaaaucgacuccagcaauggggaagagcacugaagagagagaggagccccugacauguuguguucagugugcaugggauccagaaccaaguaaaauuaaaagccagcaaagaagaggaaaacacugugcaagaaaaaucacugugacauuaacuucaugcugcuacugaucuaccaaguaucggugcagaaggcucacagggagcuaacucuguagaauuacccuugacaauccaaaggagacacaaugacugaccagucagaaaauacaaacaaauccagagacaccauauacuccuugccccucuuuucaugaggaaacucaucagaguagucacuguugacuggacggcauucucagaaacccugaguaggaaaagucccaaagccacaugccucuccuguauguucuggaagggaacgugcugucuguggaaccuccuuccucccaacuuacccugaaaaaaagaucugcuauauuucauccuuguucuaccugucacaugauuuacccuggaaacaaucuuugcaaguugcagaacuuuaccuguagaaccaaaugccuaugucugccaucgucaagguguaagucaccuuuauccaagugagaucuaaacaaugacagguacucguucuggcgacugauauccguggcuaauaucaaagcaccuaucugagccuccaucucuugccuggaauuacagaaauaaugagacauuuaguacuuucaauuuauuuucucucuuaaguuuaaguauucagaaagcuuuacaaaacccuaagauacucugaaaguugcuuugaacuugauauauaagaaaguauuaugaagagugcauuuaaaaauauuaaaauaacuaaaguaaaacuaagaguuuucagggaaauacuacaaugcaaagaugccaaaggaagcgucuuuaugcgucagccaaagucaaauuauuugcuuaaaaggagggaacaaccaaccuaauaccauuaugcuguuugagaaaauucuuaagaauuuucugagauauucuuguauguauaacaaacaacuuugucuuauuuuuuggugccuaggaccuaaaaaaagauucaggcagagaaaauauuaauugucuagugagacaucugagaaagaugcuuaaugcuuaaugaaauaagcaucuuaauaaaauucuacucagcaguuugaucaaggggccagagauggguucagcaauuuaugguauaggcucuuuuucuagagguugguucccaacucccucauggcagccuacccauaagguaauuccauuuucagagaguuccucacucucuccuggcucugugcuacccaccauggauguggugcauggauauacauguaagcaaaauacacaugcaccuaaaauaaucaagagucaguuaucuguguaagaauauucaaauuuaucuggaggaaaaaugucacauguuaauacagacagcacauauacugcaucuuuuuaaaaacggccucauaugagauuuaaaaaaaaaaaacccucaacagagucacaauaagauuaucuugguauuaaugguaacaagaagaccauugagauggcucacaggaguccuugccuccugagccugauggccugaggucauccuugggaccccagaggaagcagacaaaggacugcugaaggcaauccucagaccuguugugccacagcacaccugugcugaguacacacacacacauuuaguacauucggaaaaaaccaaacagguucaaacaaacacaauacugaauauuuaacacaaaguuuaaaauaccaugccggcaagguuugagauguuuuugccaacaccaucauauuggacuuauuuaacuuuaguguuucuucuuaugccaccaaaauggccuuaguccuuaguauuaaauuauuuuuuaagcuauuuucuguuguuuuauucauuauccuucacgacagcuccaaagcguacaugagggcacagggccuuauuauccuuguuuuacuggcuuugcauauguuguggucugaauauaucuuguuaugcacugucacuuucuguguaaucuuucagguaugcaccugaaaccuuuauuagaaaagguacguacacccacugagccauuaugugugaagugacuuuuacaguacucaaaaagggguaucuuucauaaaaauaaauagccaauguaaaagcgacaacuacguagcaggcuuaagaauuuggguauaacuuccuuuggauuuccaguguaucuguguuuggcucacauuuauguaugugugccauguguagauaucugugagcuaucaugugggagcugggaacugaacccagaucuucuccuagaacagcaaaaacucuaaacugcugagcccuuucuccagcaccacaauuuugauaauuuuguuguuguuguuguuuguuuguuuugcuucucgagacaggguuucucuguauagcccuggcuguccuggaacucacucuguagaccaggcuggccucgacucagaaaucugccugccucugccucccaagagcugggauuaaaggcgugccacgcccagcuaaucuugauuuuuaaaaagauacguuuaguuuaaugaaacgggaagcuauggagcagcugaauaacauauuuuuaucuuaauuaguaacuuuauuuccauaggcaaugcauuuguuuuaagccaccuuaccugcuuuccaauggcaagugugagaacaaaccagauucucuuaacaagcccacugcagaucuccaguggugauucuccaggacugaggaauucuacaagaaagggucucuugguuacccaacagucauuucugcacacgaagaaccauuugucaguaauaauuagcuugguuaaagcauuaacauucauuggaaauuuacuuugacuccuuucauuuccucaaaacauuaaauaguguagaauacagaacacuaaaguauuguuaauuuauuugugcguguguuuauuugugggugggugagugcauuuguggagugagcaacgugcacccaugcauguguguagaggccaaaggccaaccuuggauucguuccucaggagucauccacacuguuuuuuugagagggucucucucucucucacuggcuugagccucauggauuagacgaggcaggucagcuaguaagcucaagggauccucuugucuuucuccuuagugcugagauuuuaagcacauacuaaaaaacaagcaacaacaaagcaaaccaaauuaauuuccaaugaagcgguacugaccuuguauaaaguugcuagauaaugguugguuuuaauaagaaacggcugauuaacaccugggugauccagaucgugaguggcggcugcaauuaaacucagcaagauaucccaaggagugacagaacuggcaagcugaagcggaacagaagaguuagucacgcacguuccugaaauacgcucuccaccacaggagccaguggggacaguggcucuccugcucugccuguuaauuucucagugggacaacugcuaggucaugaagcagcagccuuguggugcuucccugggacagugcagugcaggcuguguucugaugcacggugcugccgccugagggacagggcucaccugauagggagggcuucacuuucaucaacuaaaaacagcuaagguaagaaacagucucagaaacaggacucuaaacugauauacggggcugaguauuuucauucuaccaauagauggccacauucaggacccuuuucacaaugcauucaugccagaaagggaauuucauuaauagcagcaauguaacuuuacucaccaaacuuaagaaaauaaccauuaucaaaguuuauuagcugacuauagguuucagcaauaaaaauggccaccuucagucuaaauuuucaggucaaaacucccuuccuucccuuuccccuuuucccugccacgcacacuccagugaagucuguuugacaggcugagaagccuggcagcacucacgaggcauaaaguuucaaaaggaacucaccuccuggaguuuuggcguucucauuaacccguauacucacacccuaucccuaucccugaguuagucuaguguuuggacccacgugcucucuuuuaguauuauuuuauuauaagugucuuuuaagauugaauucugacauagcuaaagccucccaccaguguuccaauauuccagaagccuaaccgagcuuggaauccgguaggaaugcaggaaggaaguuaccuauucaguaacuaauuaagcauuacaaaagacagagccagcagcucagggcuggucugcagaguguuuaccaugaaagagccagggaaucccacugagauagaaaucuucaguacaggcuacauugcacauuagaagcaaguugguuaauucuucugacaaauggagauucuccacagacacuuaaaaguuaaacucauacaagaaauuaucagggcccaggaaauagggggguugugguauugcaguauucaugagaaggucugcuaaaguagaaccccugguggugggcuuaacaauagacuagcuuuacaccugucucccuucuuaguggcaguggccugguccuucuuuugauguacgcauuccuuuuguauugugucacuguaacuugguggauuguaucuuguuauucuucuguauaaaaaguuugaugcuggacuugacaaaauacauucagauucucugugugcaucugugucauucccgccuacuccuugcccaucugcacccagagaccuguccaagcagacaaggggacccagagggucugcagcauuccucuuuccccuccccuuucccuuucccuccccuuucccuccccuuccccuuccccuuccccuuccccuuccccuuccccuuucccuuuccccuucccuucccuucccuucccuucccuucccucccucccucccucccuuccuagcagcauguugcuuaggacaucaauaaauguacacuaguaagaaaaacaacucggcaauuaccaauuucugacaggcaagggagagaaguuacuauuuauuuagucugacuucaaacuccuggcaauccugcuaucucagccucuuaagugcugggauuuacaggugggaaccuccuugucugccuaaagugaggcucuuauaugaacuucaagggacaagaugaacaauauuuaagugcucuccuuucaagugggcuuacaugucucagggacaggaguaaguauagcguuuuaugucuuauggccucaggcucugcaccaacguacccagcaaucucacaugggggacacuugaaaacaaucuguacgaacacagaguccaaggcuuugagagcucugggucccguucucuaguucuucuacuuauagccacaucuggaaacacaaucugguuugaucucacucucauagcagaagcuucagacacugagcugagguacuaacuuauggaaaucuguguccacagaaauugucuggcgacuuucaaccaccuaccuuagguuccuuuaaguaacagugcauggccugaguaacgucugcagcauggacugcauugugguaaggauuuugacugugguaaucuucuugaaucauaacugcauuuaaaaaaaaaaaaacucaaauuuuaguauacaugagggacauccgaauauugaaagugguaaccauuagugauccacguauauuuuccuugugguuaucaacuuaaauaguucacauucuaaaacagucacuucaauucaaccaaucaccagguauuucaguaucaugccacagcagagaccaugagaaaaagaguaugacugcuaaccagcugauacaugguuuaucacacaugguuuuuaacugcaaagccagcugauacauggccuaucacacauggugccugucacugaugaaauuguugccaugucuugaagagcuacaagcacgugcuuuaagcuaugauccugauaguuuguuacagcugacugacaguuaugcaaguucuuauacagccuuguuaaauguauuagaaucacuuaccuaaaaaccgacggaguuucaccauaucuaaauggaaguacucaaucaauccaugaagacuaaauaaaugaaagguuaggcuuacuagacuauuuccuagaaagaaagaggagaggccauauuaguaagacaugcaaggccagaagacugcuguccccagacggagacuccgagcgagcauggacuuggaagcaacauccaagcccacuuugcucugccaaugccuguagcucuguacuuugauuaguauacacuuuaaauguuaaccucuccauucuacacuaaggaaaaaauguuucagcuuucuacaaagaacugaaagauaaaaacuuuuaaggauuuucagguuaaacacguuggacaacaaacuaauacucaauaguagaauaugggaaaacugaccuagagugaacaagccaaucuaacuuuacaagcacuucauagaaaugaauagaaccacagcagaaauuuuuggcuacaaccuucugaaaauuguguuuauuuuuacuggaacagaacuuggagaggacagucuccucuucacaguccccaagacugaagcucugacaaaagcucuccucuuuucuguacugagcagagaccugagagcugguggagggcaggcagcagcacacaccuccuaacugugcagcugacacgcacagacaaguggccucacugcugucagggacaggccucuuucacucugcaaagcaccuguuguaagacucuguuacucuucccaaacauuuuaaugugcuucuuucccauuuuccucaugaaccacagccucauaggucacagggaaaaagcucccuaagucuuuagcuucuuuuuccuuaaacauuaauuuacccauauuuccucaaagacagauccccaucccuuggauacauuucaccacaacaagccauguugucuugucucuuucuccuacaauuucccaagcaccacaagccuugagacacgcuguacauucuauguacugucuauggcucuccauccccacacucaugcagccaguguuuauuccugcugucugaauccccaucuuuacuaugcuuauuuccccaucccugccaaaaaugcuccaguauauauaccuuauucuaugucucaggauuuuguagacucaauacaggacaaauaugcuauauuaacaguuaaauugacuauuuuaaagggauuuaaucucauaauuuacugcaucacagauaacaguaacaugcaugugauucuaguuauccucugaacucuaugauauugguaaauaugaaaaagaaaaacuaaucucucaguaagaauuuauaauauuuaaaagggcuaauaaagaaugaacuaacaacucaucaaaccacugucaacagaacccaucgauggauacauguaacaacuugcagagaacgucaugaaggcaggggaaggccacaaagaagauuuuuaaauauaauauuguuuauuauuguguauugaaacaaacaugcaugaugggagcacauaugccaugguguauguguguguguguguguaaaaagucaaaggacaaccuuggggaaucaguucucccaccuuucuugggaauugaacuuaguucagcaaaugaagacacuuccugcaaaagccucaugaccuaucuugcuggaccauaaggauucuuuuacagacaaagacacacacguauauaugcagguaugcaugccaugguacacauguuggaaguuggaggacagcuugcaaaagucauucuugcuuccuagcauguaguccagaacagcaaacucaugugugcugcuuugguugcaaaggcaucuugccagccccaagauucuuuuaaaaggugacuuggcauaucaucaccauauggaaaguaguaaguauaaccuuaaauuggaugccagugagucaggcaugguggcacagaucuuuaaucucaguaucugggagggagaggcaggaagagcucugugaguuugagaccagccuagacuacauacugaguuccaggaucaucaggacuauaaagacauucucacaaggucugaaaaaaaaaaaaaaaaagcaggaggaacagaaagaagagaaagagggggaggaugaagaagaggaggaugaugagaagaaugaagaggaggaugaggaggaagaagaugaugaugaagaggaaaagaaggaggaagaugaggaugaggaauaggacagugaggaagaacaggaggaggaagaagaagaagagaagggggaagaggaggaggaagaagaggagaaaggaagaagaagaagagaaggggaagaggaggaggaagaagaggagaaaggaagaaggaagaaguaggaagggaaaagggagaagggaaaaggaagggaggagggaggaaggaagagggaggaggagaagaaaaagaagggaagaaaagaaacaguauuuagaguaaaacugccacaaugaaccaaccccccccccccaaaaaaaaaauacagaccagcuaagauguagugacucuccaugagagcuugaguggaaacacaggcuggccacucuccucuccaugaaccagagguggucaggagcaacaggcacaauccuguucacaucccucuaacagaaaugucagacagcaacuguucuccuccugggagcagaugagaugagguauaccgguucuggggcaaaccaacucagcucuguccccuccugccuguuuucuccccuguacuaccaagaggguaccagaguaaaacuauaaagaaccacugggucaauaagcaagcaggggcaacuaugaacuuggauaugguaaacacaaaucauguauaauuuuaguucuaaaaggaaaccauuucaacuacauaaugcaaguugaagaacaguuuuuuuccugcccauuuguucaauuacauuucuucaaguagaaaaucucugugguuuccaggggcuauaguuagcuuccuauaaaagcaaagguggguagcuaacaauaggugguuuuaucuaggaccaaguaauugggccaccuucuccacaaagccaguucaaacaggguggucuacggaaagcaacuguggcugacauagaauacagacacacucacuagcuuucauccuaagacccugacuaacagguugugcacuuuuuaaaaaucaaauuuagaaaagagcaacuauauuaaggaauggcaggcauccuagcagcccaagaauagacuaugagcuaucaguuuauauaaggcuagucuuuaaaaauguuauggcugguguuguuucaucuauauuuaucuuaugauaauaacugaaguuauguuuguguugaguuagaaaagaaaaauuucacaaaucuugaaggaggugggcaucuaauaauucacugcuuguauuaaaaaaaaaagaaagaaaaagagaaagaacaauccccacaaggccuagaggaagguaaauugccuuuucguuagggcaccauggcuagaugcagccagcgagaggcagagagagcaacaggacacaaagcacccaaggguaaaagauagcgacaggggaagagcagugaugccuggcgcuguuccgacacaggcaaaccuuaagguccccaccaccuugcccuucaggcucaucuacuuccugucugcagugcagagauaagcagggcagguagagcccuucucgagaaaguaacagugacacccaaacaaccacagcagugcuggggaagguggcagcggucacuggguaagguacuuguaucuacaagcucaacaaacugaguuggaacccugcaauccauagacaggaaagagaacccacaacagcaugcuauccucuggcuuccacauguguauugugggcaugugcauacacaccuccauaaauaaacacauuucuagaagaaaagaaaagcagguaacuuuaaagucaagcaggggacacauuacuccgucccuagcaacagaaaaacugaauucuuuguguaauucuauuaaaaaccuacuuuggcaaaggggcaaagacagguaaguaucaccaagaaucugucaaauauguuauucuuaaaaaaaaaaaaguuuccaaauagaacccaguuuugauuauaaagagaauuaaaaaaaaaaaaagcaauaucaaccccacauaaaagcugggcucagcuggggcaggagagcuuagaaugaccuauguaacauuucuccaaaccucucuuaacugucacagagucugacgauacgcucuucuccagcguggggaggcagugccaaaggcaggcuguggaaccacgcuaauccucugcagcagguaagaaaaaaggcucggggccagcacacucaagaaagcaagcagcuugggggagcaggccuuugggaaaaaucuaacuacauggaaaacugcgucagaagaugccacuguaaacagucacacgcugaagaaacugagaagagaaaaugaagacugcagugagacucaggcugaguuauuaaaaacggcaguaauaacugccaacugguccagucaugaugaagugauuacugucaagacuaauaguaaaaacaaaaauugugaaaugauuucuguuguuuuuuugaaaagugacuaacaaagacaaaaugcuggcacagggucacaguccaagugaaugacagcaaggacagagcacacuaaagcuucaacauaggcgaaugaccacagaaacucgaguauugucaaaugcuucacuuaccauuuguuagucuaucaaacagaaagauaucaaaauuccaauuuccaacuuuuuccagcauacacugaaaugaaaaccaaacauuucuacuguaauuuaaucucaguaagacccacuuucggcagauagaccauagcaacguucauggaaacgaccaaguggcugacuggcuuugagagacgccgagaucauuuaccuucguucacguucuguucuagguuugugggcaggguugcacuguacagcccugucuacagcucacggcaauucucuugcuucagccucccaagaauggggcguaccagagugugccaccacacucugcucucagccucuucuuaguuaugacucuuuccacuggcucaaauauucucuagagaaauaaauuccacuugagaacaaauucuuuuguuuuucaguuaaucauagagaggucaggucagucuuccacccuguuccuauggccuacaaauuuaggagaauucugaaacaauucaccaucaaauaguccaugugcugcagucuuaaaucagauuuuaaaagucuggcagcgaguucuacuggguaccuggugagcaggcgaggcacucaagccucaccgacuccugggaacaggcaguaaguaccauggcucagcuguagcagaaagcugucauggugacugaagaguccaaggucagggacuuggagagcacaguaaacccacaccacacugucacucaaguauuugcuguucaggguuguuuguuuguuuguuuugcuauuuugggacagggucuuucuacauagcucuggcuguccucgaacacagagaucuuucucccucuaccuccugggugcugggagauuaaaggcaugcauggcuugcuaaccauuucuuucuuuucuuuugcugaauucugggguauuuauugacaaucuuuaaauaucauucaaaccuagcaguaaagcagucagcucugaggaugauacacacuguagacaacaaacacauccaaaguccacggcacagaagugugcgcuuuuaaaguaaagguuuuuauuuuguaucccuaaguuugcugugguauaagaugaagaauuaaacaccacaaguaauauuagugugacacuugugaagguugaaagcacagugucaggaaccagcaauaacacacaggucaacacucuaaccgcgacagcaggucaacaguucccacugacugaucuacuaagcagggaaugauucuuuucuuuauauuguaaugaaacuucaaagaagacacccugcagccagucuauauaacuuuagaaaucuggccuguaaaauuuaaggaacaaauaaguucagguacauuaaaauucaagauuauaugaaaucccauuugaucaaaaccaaacccauuucacuucuaucuuacuuaagacauuuccugaaaagucuguaagaauaaaguaaauaauucuuacuaauaccauuucgguuaagauuagcuaaaccuucaauaucaucugacugaaaaagauggccccaccuuccugagcugucuguauggaacuauggggcaagcacaucuguagugagauacagaccccgguguccuuaucaacagcacuaaagcaucagaucaggcccgggcucacauucuucccagcacccaacucugugcuagcuuaaaguugauuguccugcugaucaacucauuacuuaauguucuauuaaguaacuaauauagaaaauuaagaaaacaaaugcacuuacuacuuuaucucagaaguuuuccuugcuccguuauaccuacuuagaaacaaccagcucuaaacucucaaaaauggcucaauucagacagggcaucuaaaucaguguuuuagaggaggccccaguaaacuuaucaagcaacucauuuugaagaaguuguacaaaccuuggcuuguccauuguaauccucaucuaaaaugucuagagaacuacaaacuguggcaccccgaaaaacucgugaggaucugagauaucgcuggaaacuuaguaaccuucugauguuccuggcggagacugaugcuucaaugucagauugagcugaaagaaagggaguaaccaugaaaaccuggcagaccccaagaaggcugccucugaaacacccccaaguuccaugcaagcacuuaagguguauacaagcacuugaaauuuuuccuucauuuucuguguauggguccuugucugcaugugugcaccuagugugugcagugaugggagaggccagaagaacacuggauuuccuaggacuggaguuaaggaugguugugagccguugugugggaugcugggaaucaaacccaagucuucucgaagggcagccagugcuuuuaaccucugaggcauuguuuaaaauucauaauuuccacgagcaguucuuucuauggggagguggcuuuuuccuauuuugaagugaagaauuagagaagaguaaaggccaguuuugacaggugcuagagccaugagagcgucugggcuuagacucagcuuuaaagcuuaauuuccauuaacuacuacuacucauuucgcuguuucaacacacuauauaaaaauuggaagcaaacacacacacacacacacacacacacacacacacaaacacacacacacacacacacacaaauuauaguuucaaaugacugagaagccaaaucccagucacauagaugauauuaacaacuacaguaacaacauaucuuaaauccuaaugagauaguuuaaaguauuuuaaagauaauuuaauuauauauacauauacauguauauguauguauguauguauauauauacacauauacauaaaugguucuaaaggcuauaaacacauauuugucuaaagaggaaaacucugggcacuguggcucuucacuggaaacaguguguccuucaaugagccuaacaacuguuuuuuucccucuacucuuagaauaauccagcuccuuuaagcaucaaaggacacguuuuguuauucagcucugcacaucagcuccaugguucauuccuugcacuaguugacaguuccuaaguuacucagcuucaggccuucugaacgcccuccugagcaacacuugucccuggguccugcugguugaacuuuucaauuccucuacuuucuuauuuaucuuucagucggccagccgguuggccgaccugccugcccuccugccuuuuuuuuuuuccccuuuccauuccuuccuucucccuucccucuuuccuuccuuucuuuccaaggcacuuuguucaguaccacaaucagacgaugaccuucagcaaucaguagcauguguguauuacugagauuugacaagaaaaguuucuauuaggaaacuguccuucucugucugaaauuaaacaguaauguguguggacacuugagcagaccugugcuuagguguguguccuuucaaucgucauguuuucuuuccagacagaguguuucaaggucccucacucucugcauacugccugacgugggccucuguauuuguucccaucugcuggagaaagaagcaggaagacuauaaacuuuguagugugugugacagcaauuguucaugugcauagaaagugguagcuacucaacuuuuucuaauuccuauuuuucucauaaagaauccugcaauaauaaguuuuauguguaaauccuucuucacagccugacucccucacuccgcagaaauagggcacgugaaaaauaguaucugauacaggccuugcuggagaaaaagguuuuucagaauuguccuggaagagcuuccaaaauacaaucuaauaaagggguugggaacuauaaaucaacaauaaaacauccauugcugugacaauguuggaaauguguauuuucuucacacuugauaacccucugucccuuaucucugucugucugucugucugucucucucauaccugucucuguagaagcaaaguccuuacacugaaaacuccaauagagacaucuucaggggcaaaaacuaaggguuaaguuuggaaggcugcccacagcauuucuuucaaccuaguuaagccuaugccacuguacagggagacaccaggcugaaugaauuauagcauuuaggaauauaugaaagcggaggcauuuggaaauggaaaagaagccaguacccuucauuuagauaauuacuaaaaagcucauccucuggccaaauuacacaaaaacccaacucuauuaccaauacuccgaugagcucauccugugacauaaagcgagucauuacucaucucacagcacaagagacaacagaccagacuugucagccgucaucaagcuuggacuauuuacuugcugauacagcuuagaaagcuggaggcauacaaaagcucauguuauuaucagagaguaccauggccccauggcauagccauagaccaaucaguaucaccaaagcuaaagagcaagggcacuguguccagguauccuuuuuccguauuucuggaccagaaaagaaaguggagaagagcuggugauuuuuaaaaauauauguauuuuuccuucaucaaaguagaaaauaaagaagaaauacaagcuaagagaagaaagaggcuggagagggcuacacugaacagcagguucccaucucuccugcaggugcuucccugcuacccaagccacacacaguugggcacagcugcuccaucagaaagguccugaaggagacagucaccgccacaggaauccacaagggggcacccugcaaucacugccucuguacacaaagaauuacuauggaaaauuacugcucagauuuucauguuuauaauuaaguacuuuaagguuuuagcucuagcuuagccaauuuuaugcugaacaaagacugaauaaaaaaauucuaaauaguuucuguauuguaauucuucuucuucuucuucuuuuuuuuuuuuuuuuuugagacaggguuucucuguguagcccuggcuguccuggaacucacucuguagaccaggcuggccucgaacucagaaauccaacugccucugccucccgagugcugggauuaaaggcgugcaccaccacacccggcuccuaauuuuucuuuuuugucccuaguuuucuuacaacaacaacaaaaaagagugaaagccauaucuaaaagucauuuaaaaaagaguaauucuaguuaucauacaucuaugggacaagucuuuuuguucuuugggguuuuuuuaaagaagaauuuuuagucuuagcauaucucagaauauacugacacauagagaagcacuguuccaggcuucugugagcaauguuauucagcugccugugcugagaauggauacagaauggcagaguggguaaaggcuggguggaacuccugcucugucaccagcuuuguaacauaaagcagauuacugaaugauccucaguucuuuaucuguaaagcuggcuccugaggacugaaggcagagagcaaaugagacagcauacaaucucuguacaguuugggggaaagaagcaagcacucaauaaacuuauaaaguauauauuauauguguaauaaaaugauaauuauaagggccaggugugguggcgcacgccuuuaaucccagcacuugggaggcagagccagguggauuucugaguucgaggccagccugaucuacagagugaguuccaggacagccagggcuacacagagaaacccugcaucaaaaacaaacaaacaaacaaacaaacaaacaaacaaaaaaacaaauaaaaugauaauuauaaacauuaaauauuuuaaaaacauaaccuuauacuuuuaacuuuuaagaguagauuucauuuuuaugguuacauauuuaauacugaaaaccacugcauaugaaaguacuucagaacuaacuguauauugacaugauuucaaaauaguuugacagaacuuuaaauguauguaguaaaagcuucacuaugaauaauaaaugacucacugcaauaagaaugaaauguaucaucaguacuuuccccuuaagcaauucguauaauccugguucacagaauuacuguucagucugaugauuugaugauuaaguaagagauucaaaacucuuuaaaacucuuccuuuuucuuuucuuuuuuaaaaaaaaauucaauacaggguuucuuuguauagcacuggcuauccuagaacgcucucuguggacacaggcuggucuaaaagucacagagcuuaaccuggcucugccucccaagugcugggcucaaaggugugaacuuuccaguucccuaugagccagcugggagaggaugggaagcaagugccggcuucagcagcgcacacuccuucaaagagcagcugcaaaaucacaucagggccaaguucaacuccaccaguuccauagaguccaaaagagcaaugaccuuuaaauuggauuaagauuaagguccaauucauaccagccugcauaguuuaugcaacaaaguuaucaaagacaucuagaauacuggcuucuuccaagucugggacaaagcaaugaaaaccaacaguucuuaaaugcaggaaucugagaacauucuggaaacuagcauuucccuaugcaucaacauggcaucuccacaagaaccaguugguaagggaacugccaccaauaggaguaggaacucgggucacuggcaggggaaaaugauguuguguguguguguguacauauacguacaugaucaugucggacuacagcuugcaggaguugauucccuccuuccaccauguggauacugacaauugaaccuaagucuucaugcuuggccacaaucaccuucaccuacugauccaugacacuggcccacuuuucuuuuagugaaaugcuuugugaacaaaggcagacaguauuucauauaagacaugacucuucauuuucacugugccaugcuuccauguaccacacuugcagaaguuggcucucuccuuccacccaccauguggguccuggauacugaacucaccuuggugacaaguaccuuuaccaacugugccaucuugucagcuguuucuagugauagcuccaugaauucaaggaaugcugucuuugaaacaggugugauuucaagacaaguauaugggagucaacuaauuuaucugaaacuuuagacaaagaauggccuuggucuauaauggcacaacuacaagugcacgcuagauguuuauguaagaauccaauacaguuuggucuucguucuucuugaguuucaugcguuuagcaaauuguaucuuauaucugggguauccuaaguuucugggcuaauauccacuuaucagugaguacauauugugugaguuccuuugugauuggguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuggguucuuuccagcuucuggcuauuauaaauaaggcugcuaugaacauaguggagcauguguccuucuuaccgguugggaccucuucuggauauaugcccaagagagguauugcgggauccucugguaguacuauguccaauuuucugaggaaccaccagacugauuuccagagugguuguacaaaguguggacacuuugccccuucuuagaauugggaacaaaacacccauggaaggagcuacagagacaaaguuuggagcugugaugaaaggauggaccaucuagagacugccauauccggugauccaucccauaaucagcuuccaaaugcugacaccauugcacacacuagcaagcguuugcuuaaaggacccagauagagcucucucuugugagacuaggccggggccuagcaaacacauaaguagaugcucacagucagcuauuggauggaucacagggcccccaauggaggagcuagagaaaguacccaaggagcuaaagggaucugcaacccuauagguggaacaacauuaugaacuaaccaguaccccugagcucuugacucuagcugcauauguaucaaaagauggccuagucggccaucacuggaaagagaggcccauuggacacgcacacuuuauaugccccaguacaggggaaugccagggugaaaaagugggaguggguggguaggggaguggggggggguaugggggacuuuugggauagcauuggaaauguaaaugaggaaaauaccuaauaaaaauauuaaaaaaaaauccaauacagaagacaagaaacacuuuugcagaccaaucaaucaccaaaacaaagcagcuugugaauaggaagguagggagaggccaugggaaacugaagaagaaagcaaagacagacauacaggucggaaagugccaggcaaacaccaaugcuuaagagucagaaaguagcaauaaacuccaggcacagcagaugcccuuguacagguacuacacgccgaagucagucaacccaagacaaugagaccagucugacccacacuagacagcucaagcauacauagacacagauguuuuucauaccauauaacuaugaagcaaacaauccaagcuucauacagcuuugccacaaugaaaggaaacaacuacaagccaacacacccgagaacuaugggaaaucuaugaagaguuuuguauguuucagcagucaguugcuguaaugaagacaacauaaaaggcuaggcucaagagaaaagcaacaaaaagcccgaaccugagugacaguuaauaaagauuaucuuggggaacugcaagugagacccuguaacuguugagguuuggccucugguauguauuguaaugcuagauacuggcccccaaggucaagagaagccacauauaaacccaaguggcacuauguaaccuuuccccaaguuauuccugauugguaaauaaagaugcugacagccuauagcugggcagaguuucugggcucccaggugugcugucagaagagaccacaaagagaggaaagagugccaagggccagccucagcuuggaggguuguuugagaauggagaaguaaaugacucgaaguugaaugauggguccaggcugguugccuguauucugcucaagacagcuuccaaacugcucuauguucugcuuucucgggagaucuccagacaggucuuuucucuauuuuucuguuugagacaguucugcaagcaguucauuuuuguuauucuaaaauuucucuggauagcucaacuuuugcagaccauaagcccagucuuuucuucuacauaucaauccaaucauuuacuucagguucccuuuuaauuauccuacgaugcagcauuccaggaccccaguuccuugggaaggcaagcacacuuuuuuuuuuuuuuaaacauugcaaaggaauucagagaucugccugccucuguuaagcacagaugaugagguagcuggguggaacccuacucugaaaugaccauuucuaccacaccuggaccuaaccuugcuaugcccaggcugauccuaaacccaggagucugccugcccauguaagcauaaacagagcacucagcugguugggguugccuuggacaaucccuuucucguuccuuaguuaguaucugacaaguuggcuugcugcucaccugcuccuguuccuuucaauuccugacgcuacucauacgauucauauugcaucuuuauauuuugcaugguugauaaguuauauuuuuaaauucauguuuuuugaguucuguuccacagccuagggcuguccugaagguccuagcguuuacgauuuugcugagacaguagccacaccuucgacuccaggacucaugcugucucugauggucauggagucauuaccauuaacagggaggacauuccuuccgagaaaugugaaaauguguacaacagacaaacaagccuacacccacagcaaccaucaacacucguggaggcccaggccugcuggcccuguucccgaggcagcaaccaugucaucccacccuuaccaaggccaugcucacccagcaaaagagcaugcggaagagaagaugccaugagggcagauguacuaccaagagaacauggccaggagagacagaaaauguuuggggaacaccucuggaaauguagccaagcuagaaguuagaaaaguagauuagggauucuaacuggcugaauuuuaagcaaagaaaggguuaguugaugugugccagcgugugugugugugugugugugugugugugugugugugugccagaggaugaugucaaaugacauccucaauagcucuccacucuuuuuguuuguuuuauuuuugguagugaugguacugagcacggggccucuuauaugugagguacacaguaccauuacaacauagcccuagcacucccagacuuugagcuaaggucucuagugaaacguggagaucaucaauuuacucgacuggcugagcagcaaggucaggcccuccccccuccacuccguguguccugggaucugaggcuuguccucccauaccuuguuuuauagggggugcuaaggaucgaaacucacaugguaagcacuuuacugagacaucuccuugggacacaaacacaaaucgacauggaauuccuaucaucauguccaauuaagagaggaacucuauauggccaguagaacacggaacacaccagcucuauagguuccuuggaacuuaggcuucagcucacugaugcaaaggaaggaacagcaaggagcuugcuuuuuuuaguagauuguagcuaauauacauaaaauaaauaaaucuuaaaaaaauaacuaagaugcagggaugaaaauuaaaguuguuuuagacucagaggacaaugcagaaauguguaucaagaacccuaaacaucuccucucaggaguucacgaccagaacuagaaagggauaaucggguauuaaaugugugaguucaugcagagaaauuuacauuuuccuugcucgugaucauaaugucuuuuuugacaccagaagaaggcaucaguucucauuacagaugguugugagccaccaugugguugcuggagaacugaacucaggaccucuagaagagcagucagugcacuuaacagcugagccaucucuccagccccaucuuaguuaauuauuuguugaacgucccuaaguuacaggaaucuguuuguuuaguaaggcugauaauuuauuauaguuaguaaguuuuugugcucaacugauuuuucuuuccuuuauuggagauagaagggaggcugagacaaagucucauauaccccaggguguccucguucagcauguaccugaagcuggccuugaaccccugaacuucuugccucuaccucccaauugcuaggauuauaaguguauaucauuaacugacugucuucuuuuucauacccaagccuacaccuuuaguaggauugacuuauuuauuuugaguucaguaacccaagcuggccucagacugcuaauccuuugccuugauucuggagagcugggaucacaggcauaagccaccauacccagcucaagcucuucauaguaaaagccuacggauaccaaaugaaggugcauuuauaggccuuggagagaaaggacuguuagaaaaggacagcuaagacaaaaacuccuugguguaagagagauuaacauugaagucuuucuuucaaacucugaaaaaaaaccaaaacugaaaagcaaagugccucccaucccagugugccugcucacccaacucaggagcagcacacccuuucugccauaggacauuuucuugccagacugcuuugaguuuauuucuguuccuuugugcuacaucaaaauauacuuuuugacacauaguaaacaaaugcuaaacuauacuaugcuaaacacuaaacuauacuccuaaagucucuucaucagauaaacaaaagaaaacaaaaacaacaacaaaaaaaccuucaaaaacuaccgagccuauaaaugcucccccaauugguagcuaucuguuugaaacuggcugacuagaaaauuaacguucaguaugugagcccaagcagaguguauaaucaguuacacacagaagaaaagcuuauuugcacaauagugucuggaugucucauuucuaggaaaauuuuguaaagacuauuucuucaauauagagaaaaaaaauauauaaucuguaaguuaaaaaucacagcagcaccugaagcauacucagcagauggagguacagcacagagugcaccagugcagacuagaccagccgaagccugugugcucggcaggcacaugguguagcugaccugcucgccaugcuuuccucuaucuuccacuacagacuagccgcagccugugugcucggcuagcacaugguguagcugaccugcucgccaugcuuuccucuaucuuccacuacagaccagccgaagccugugugcucggcuggcacaugguguagcugaccugcucgccaugcuuuccucuaucuuccacuacagacuagccgcagccugugugcucggcuagcacaugguguagcugaccugcucgccaugcuuuccucuaucuuucacuacagaccagcugcagccugugugcucggcuaaccuguuccugaugcuuuccuguaucuuacuugcacaaguugaaaagaccugaucuuggaugcuaaguagugaaugcaugagacagaaacccuaacaggagaaauacaaaaaauaccagaacuacagacaguucaaugacagagggcagaaaaacaugacugcuacuuaagaauacaaaaauggauaggacuuaguaacgggcugaauuuaaguagaaaggggcaauaacaacugugcugguuugaauaugcuuggcccagggagcggcacuauuuggacauguggccuuguuggaggaagugugucacuguggguaugggcuuuaagaccuuuguccuagcuaccuggaagucaguuuucuguuugccuucagaacaagauguagaacucuuagcuccucuugcaccugccuggaugcugccaugcucucaccuugaugauaauggacugaaccucuaaaccuguaagucacaauuaaaugcuguccuuauaagaaaauuauagcuguaaugaauauaacaaaccuauauccagaauuuaaaaaaaaaauuaagcuaauuuuaugucauuauagaaguaauaauauuuuaaauuaaaaauguaagagaaaauacauaucacagacuuuuaaaagauuuggguaucccucaagguucaaaccuacucugcccccaccaaaauuuaccauuuuguccccuauuuaaaacuuccaacauccuucauagcagucuuauuucccagauucucucauuuacuaaguuuacugaaauucaaggggcauaugagagaguacccuaaacagacaucagagacagaugucuucaacagucugaggauuuuauagcagauccccccacaacuuuaaaagacugguaguuuuaaagcugcuuaaacuuccagaucauaaaauggaaacaaacaaugcaauuuuauaaagcaaagcaaaacaaaacaaaacaacuuuuaaaaagcacucacauucuuacuggagugccagucagcaauaagaucuuguaacaaauaccaccaacaaacaagacugcggucaaugaagugccuacagcaaggugcuuucugcagaaacugaccacacugcucagucaggagggaacagugaaggcugggccuguagaaaccuuuucuuauagaucucuacaguuuauucuuuauauugacuagccauaacuuuucuccccuauucuuauuaacguaauaaguuacacugguuuucuucagcuuaaagcuaccuuacauuccuagaauaauauacagauuuaauccgacaagcucucugggaugcugucuuacucuggugugauaugauuguaacuguucuuucauaucuacacaguagagaccacacuggccuuaagaacacguguaaguauguccuaguuccucugcuucaacuuucuuucuuuccauugcuaucauucccgucgucuaguuucuccuucaagugaaaaugugguguuuuuguucagcugguccuccuccucauggcuccuccugucagccucuccucagaacugccuggcugcccuagcauggggggcucagaagccagugaggcugccuuggaagcaagcggccccacaaagccgcggccccaguuggagagggcagacacagaaagaaagucuucuuacuggcagaggguaaugcccuuuugcaggugaguguuucgccucucgcugguuuugcucuuuucucuuuggcuuugcuuuucaguugcacugugaacuuccuaagcaugcuuuuccuuaaauguuacucugcucaaugcuuacaaaccuuccugaugugcacuuuaaaagauggcuuaucuaugacaaguaguuuugcgucauuuuuuuacuguggaaagaagugauccuucaagacagccccagugucccuguacaauccuacugguugugccaagacuggaaagccccaacugcccuuugucuagcuccuguucucgggaugaucuuuauagccugcaaccaccaggacacaaccagugcuugagauauuucaaagucaggauucauuucuaacuuaggaaguguuuugggcuucacccaaacaugaauguuccucagcagugccucgcccucccucacccucgcacacugugugaagcccuccuucugcuccuugaguggcgaguggcagcucucugcucaccucugcauucucuuucuaagaaucagcacaugacccacaggggaaaguaacucauaaugccagacuuacucuuccaucucauuuacauccucaauuguuuaggaugucucuuauaguuugucaaguuuggacucaguuuguaguguuaaugcacauuaccaaaccuuaccaaaagcaaaaugagugccaaaccagauuuaauauauucagcguuuaaaauucuuaaaacuuguuuuucccuuucucuucacuaugaucuagacacacacaaaauguuuguuuuuaucauucuaucaauauuuuaaaauaaaccaaaaggaugacacuucuuucaacuucugaaaaccuauuaucauauuaucugcauugaauauguugguguugucugaaguaaugaaggaagauacuaaaggaaacaccuaaaaccuaauucagcugggaauguggcuccgcuggagaagugcaugccuggcacacaugcagccuuaacuuuggucuccaggacucaaagaccagguauagagcccacagcuguuauacagcacucaggagggacacggagguagaaagauccaaaguccaaggucauccuggccagugaguaggaggcuagccuguccuacaugagaccuugagucaaaagugaaguuccaauuauuauucucuccuacuuaucucuauuaaucaacauuaucuagaaagacagcauaauuuauguccuaauguuuuuaaaaagccaaacaauaacacagcauuuuuuuccucccuuguauuuuuuucuuucugagaaaacuaaaugcuagaaagacuaaguuaaguuuucaucuaagucaugaaaacuuuaaaaaauuuaauuuugaaaauaugaaugaaauacauacagugaaaaauacggaagucaauguacggaugggaaccucuucuuucuguuucaaauccugcucggcuccucacgcggacaucuccuggacagaaucaggaguaaauguaagguuaggaagcuauuacuaguaaggaggucccaugcacaagcaggcccaugugggauccugcuccuuggguacaggccagcccagggaagccagggaggaagggaagugucguuacagcgacacauacgugacauauaugagagugccacgccauaaggaaacccaugacucuguguuaaaagauaaaagcaaacaaaugaauggcaugguuaagaacuggcuuguuuagaggauguaauaaaauuucaguauugagcuguaaggcuggguuaagaagcuuaaagauuauauuccuuaauaauuaucuguauucuaaaggucauuuuacuacucugauguggcugaaacagcaaccauaaagucagugggaaaugaaaucuguuucccagaggaaaaagccacagugagaagcaggcauuuaccagcgucugcucugccugggaugucugcaaacaagacacaggaaacacacaguaaucuuauaaugcagcaaagucacugugcacucacccaagguuuuagcaaguucuuaaacuuugguuuuuaucugugugagacuguucuuacauaaccccacaugauucucagaugaucuagcacuaaacuaccaggcacucuguaucacaggccaugcugaauucugaaaucacacaugcacccauucuguggaugcagaaauuggguucugguagauuaaaucacauuuccaagccuguguugcugcagcugacaagccaguccuuaaacccacgggauccaaaagcagucuuuuguuaaagcugucgcaucacucauccucagagccagccugcccuuuccuguccuccugaaacucugaccuccuugaaggaucuucuugcucugcguccuuaaggaagacuugcuucaugcacugugacuccauuuauaucuaccaaggccucuguuacaugguuacucuucauugugaccaagguuugcugaacacguuagacccaggacaugccagugcacaaaguuuaucuucccaaauacaaauacaacaaacacagaacuccuuucuacagaggaggguuagaagcuauagaguacguuaagaggaauggggaauggagggaugggaugggacaauguuaucaggggaggccucacugaagaggugucuaagccgguacuugcaaugagugacacagugagcugaauggcuaucaggagaaaguccaauacuaggaagaacaagcaugaauacccauccagcagcacaccuaguguauucacacacaaguaaaaggccagcauggcaggggucccgggaaagggaguuugggaagaguggggucaguaaggcaucagggcuggaucacacuggaccuugauaucuucugugacagagcuggcuguuacuuuaacgcugaaagucgugagaguacucugaguuaagaugacuuuauuauguacuaaaaaaacacuucaccuggguuggaucaaccacauuucaugaagaccaagugcaagaugcacggcaaaaaccaggguuuguauuggguaacaaugugaucaggauggcgagaugcuaguuuuugaagguacccccacacaagacuugccaaugcacuagaguauauaaagucaagaauuacugcauuuugggauuuauaccuacuuagauggcaagauguagaaaacaaaucuucucaggccuauuaaaagugugagguaucuauacuauacccaccaaaacacacccacagaaacacaggaaauaugucugcagcuuuguuuuaagacaugcggggaggaaaugcacaacaaacacuugcuguccuagagcagaacggaaguggguaacacacaagacauagagugcaccgaagaggaaggaacaagaacaaaaucagaaccacaggaagcaacugugguagauaacuguaaggacuggcucagguucucagggcugaaggaagaauucuaaccacagagaaaaaaguuaguagcaaauaugccuagugagaucuaauugcauguuuaauagcaaagagcaagagacguguuugaaugcauagauaaugccaacaaagucagggagaagaaaaacauauacauacauauguacauacauacauagccaguuauacugauuuguggaauuaggaaauguauaaggugcauaucaaguucucucaguaagcuaccucagcacaaaaugaggacaacaugaccauguauucauggacucgccauugugcuauccuuguguuauucaagugcugauuucucugcccucauaucuggcauaacacaguaaagcuuauaucgagaaucuccugugucgucuguggaaacaauuuuaaccauuuauucucugccuugucaauaaacacugaucacacaaugguugggcagaaacuuccaccaaaugggguguggggguggggugagggagaugcagagcaacacaaggaggagaggguccaagaagacacuacaagaaaaccaccaaagagccagaucaauacuaugcaagcaucaugggauggagcugggaggcagccagauuagcugaggagaauaagguagguuauuuaacugcucagcuauugagguauagcuugaaauaagucuuggauucucugugugauuacuggggacuagcaaagguaaaggaauacagcugcuggauuaauuuuauuacuuacauuuauauuaaaauaauucauuuuacacacugugguaugcacagcuaacuagcaguugguuggccuuuagcaguguuagaaaccuauuuaaccuauguuccauaaagaaugcucuaaaacagcuaagcuguccccuaaaaguacuguccuauuaaaccagacuuuuaaauugcccuaacucuaaaauaccucucuuuauucaucacacucaguauuaguuuucagaugcuaaacuucaauuucugcuucaaaaaguagugaaagguuaccuagugcaagauaucucaucucagauaauacaaccgcaagacuaacugguacugguauaaaguuuuacuuaggggcuggagagauggcucagugggaaagagcacucacugacugcucuucugaagguccugaguucaaauccuagcaaccacauggugguucauaaccacccauaaugagaucugacacccucuucuggugcgucugaagacagcaagaguguacuuauuuauaauaauaaauaaaucuuugggccugagcaaguagggacugagcgagcggaguugacuggagugagcagagguccuaaauucaauucccaacaaccacgugaaggcucacaaccaucugugaacucauauacauaaauuuaauaaaaacaauaaaguuguacuuaccuagcauacgaauauauaacgcagucugaucagaacugucauaggaaauagcuccacgucucugaaaaaaaaaaaaguauauauuucaguacaugauaaugaaaugugagcuaaaauuuaauucagugaacaugcuuguauuauuacauguaauugcagcauauugcaccaaacaauguugaauauacaaaaugcaucugcucuggaaaucucuagcuacgagacaaacagguacaaccuagcuaagaacuccuaagaaaaggacacaggagugaagcgucugagauggcacacagcugaucucuucuguggaguggggugcugaggauggaacuggagucuuuggcacaguauccccagccccaccgaaguugguuucuaaaacaaucgcaagaguuacucaaagggaacgagaggggaaaggccaaucuguugaugguucaggugcaucuuccccaagccccaggccuuagaggaguggcuauuucaggucccacucacaaguccuccagugguccccacuguacugggaagugaguuccaaacccaugcucucagauccacggccucucaugggaugcuuguguccuaccacaucccuuaccaccaugauguaaccuccugacuuuacaccaugccuagugucugccuucgguaacuguucccaucucuuaggccagauugaagcauuguuaggcauauccugauuacuaaauaaagccuucgccaccugaacauuacugcagcgccuccaggcuacugccuuuaaagcaaccaauuuuacuaacuguguaagaaaaaacccaacccaauacaacacaaaacaaaacaccagccaggcauggccggccacauacaccucuaaucccagcacuugggaaucagaggcacucugucuccuuguugcacuuggcuaguauuaucuuauuugcuuuguauuaaaauagaaguuccacaggagcuggaacuuuaucugucucauugaccacaguggugaggccucugaaauaugaccuauuacuuaauaagcucuaaauaaauauuuuguuaacaaaugcacuuguggcaaauacaauguaugagcuaaggaauaaauggucaguuacugccagaauugauacacaugaauacacuucaaaaucuggaugauaaaacugacuaaaccucugauuaguaucuaaguucugcaccagcaaaugccuaaaucauugcuggcuacuccagacccagaccaaaucccaacguucagagcagcaccugacacaccaaaaauagagaagcggugaaaugauucaguagguaaaagcuugcugccaagacugauggcccgaguucaauccccuagacucacaguguaggacgaggacugauuccuucaagguguucucugaccucugcuggcaugcuauagcguagugagcgcgcgcgcgcacacacacacacacacacacacacaugauuacaauaaaauugucugugacaggguccuacuaugaaaugauggcuggcuuauauguagaacuugauauguaaacuggcugaucucaaacucacagagaucugccugccuccugaauguuaggauuaaagguguaugccaccaugccuggccccgguguguguguguguguguguguguguguguguguuaacaauugauaaaauuacuuucuuuaaaggcaguagucuuuggagccagugccacgauguacuuaucuguacagugaugugacaccauaaagaccugaggagacaauugagcagggguuucugggacgauacuauuuaauacauacaccaaaaaaagaaaggaaggaagaaagggaaggagagacggaggguuaacaaucucaucagcaaaaaugagcacacugcagccaugugaucaaaguucuacucauagauuacugagcuucugccccacagaacgcuggcugagauuuauaggcacuuaacauucauguaucuacaaaucuccagggagguaagaacaucaaccuaaaaaauaauuaugaaaaaaguuuacuuuaagaaauuacaaugaauugguaugcaacccaguguguguguauguaggcugggggucaaucuccaggaccuauaccucaggcaccauucaucuuguuuugugaacugucuugcacuuggccuagaacuaacuaccaaguaggcuagccugacuggccggagcccuaaggaucuacccgaguccucagagcugaaauuccaagcaggcaucaacacgccugaggacugaaugaacucagggccucaaugcuugcacaagcauuugcuacuccagucccaagguauauucuuaacgcuuacuugucacccaagaaaaaacaggcugaaaccuuguaugacuuaaucuuuuaaaaagcucaugaaguguagaacaaaccuuucaaccaaaacuaaauuuuaucaauacccauugucuccaaggacaucaaaggaaaggcagaaugaagauuuuuaauguggaacuuugcgccuuuucaacuuuauaacauguauaguuauuauauuucacaaaguaaauaaaaagugcaaaucaucuaaaaaaucugcaaagaaaggaugaucucaaauagcaaggaacugauucauaaagcaugccucccuggcccccgaaacagugugcacaccugcugcugucucacagugagccugccacucuggacucaaaagccacugcuaucaccugaugguaaagaugucaucucuaccaucaaauauuuguuaaaauuugggcaaaaaggguaaaauuuaauguagcuuaauucaguauauuuugauaauuccuuaauaaaauacucaauuuguucuguuaaaguacuuaauauaccuaccaaguaaauacaaaagaaauuaaaauuuuuuuaaacaaagaaucaacuuuuaaaauaaguaucugaacccacaaaugaauacaaaucucacaucaacuuccuuauaacucacauuuguuaucaugaaguucucuaagcaaucuaguuaaaguaacucaguuuuaaaaagugaauuacauuaugaauuaaaaucaaguuuuauuccacuuaagagugucacuuaaaaaaaugugcuuuauacaccaagacacaagcuuaacaaacguuucuuaaaagaucaaaaauuuuaaggccacauacugguagaauuuuaucuuuaauaaaacuagaaaaacaaauuuuaucaaaauccugugucuacaucaguccugaugucccgugggcugccguccacauucccauuacauuucucuagaauagaaauaaccaaggcgccuacucgugacucuucuaauuuagccauccugggaacagcuuguaaagcaaacuaguauaggucaaaacaugggcgaggccaagcuaaucagcaaccagcggccacagcauaaacaaguuaaacgguaggcuccaaagaaccauggcuguucagggcugugcgcucuggaacagguugagucauucuuccauaaagacuucacugcagguaaguaacaaaagguagacauuguccccaauauuaguuaacacguaacuuuaaagacaggcaugauaaaagcaacaauagauaauguucuagaugucuucauaaaaaaaucucauuuaacccacaagaacucuuuaagguaaccuuuauuucccacuuugcacacugguaaacucagcuaaugaauuuaaugaauuuacaggggucuaaguaaaacuucuggaaacaacauuggaaaauuauaucacauacgcaacagauggaacauggccaaaauuccaaaacuauuuuuucccaaauauauagcaaaacaaguuuuuuuuagaauacaugucucuuaauauguacuaaaaagauaagcuuuugacugccuaaaacacucaauugugaacaauuagacagcaggcuuacaaugcugcuugaaggagaacauuaacuuuacaggcacuuucuguugcucagcaaacagcaguguuauaagucuuaacagagagacaaaaggagcugcaugguaaaugaaagauagaaccauuucuaugaacguauagaaaauaauuucaaauagugucaacuuaagugucuuuggcuucaggcucaggcuuacacacuaucaagaauuucucaacugaauuuaacuucaaaacaacaccuuauaaguauauuuuugugaauguauuuuagcuauacuccaagagaaaaacagggaacauacaacaggauggguuuuguuuuauaaagcuuggcauuguuuagaauacccucaauaauuauacuuuacacauauaaaugucagucaacccuuuucucuaaaagaaaauaucuaagacacaaauacucaaaagucuggcuuguuuaauucuauaaaaucuucaaagucagcuucuuuaaagggaagcugcuuugcuucuaaagaauaaaaagccuguaagagcaauaacacgagguaaagaaaaauaaaauaaaaccuauaucccacagcuccuugaagucagaaagaucaaaaucaauacaaaaagaguaaauauuccacagcaaucaaauaugaaaauuaaugauuacugucacaaugcugagagcaaagauacucuaccuuagaggugauccacuugaucagaaccaaagccagacaccagaucaaagugauucccauuggaucaaccagagguccaccacauccucucuccugaaggaguccggugaauaacagcccucccagggcagaagagagggggcacugacugccuugaaccucaagcagcugccuccagacagugaucagcugacucuucugggaaugcacugccuggcuagccuuucugcccagcgcaugcuuaaugccacgaccucaccacuagugcaaagcaggagaaauaguacuggaagacaagaaaaaucuagcuaauaaucucacaaaaggucucaggcuagcccaaacaugccugugaucuuuguucuacagaguauuuuaaaacaauuuucaaaaaugcuuggcaaggcuaaacauuuccucauccugcucacggaggccaguuuugcaagcauaaugccauugcacucgaaaauauuugaacauuuugcacuuuaccucugaguauugaauuucuuuaaacuuuuguuuucuuccaauaugggauuacuuuaugacaacaguggcacgauaaaugugaucugugccauuuaaauucauagguaauucauuuuagauuuacugacaaggucauguauuuucacauaauaaaagauauuuguucucaaguccuaagaaagucuaguuccuguaauauuaggguccauguccuguucuugcgacugagcgaaugagcuguccagaaacaaagccucuccgcauccaaccucucaccucccauggcacccagcaaguuacuuuugauaaagagccucucacgaaacucucaaucgagaaguuagcaaauauguauuaaacucuaguuacgcagcaggcuccauguuaaugacaagaaugucuaaaaaucauagugaucgcaaaccuggcuccugcccuucagacaauuauaguucauauuaaccaaauggcugcaaacaaauaccaaauugcuagaaacggaaaaagaaacaaaagaaaacagaauaacucuagugcagagaugggucagacaaggcugcaggaggaacacacgccaguccaugcagaacuguugggaaccugugcuaaagaguuuaaaacacuuuagccaguauaguucccagggguuaggggcuggccggcaguugggauaucauagaggcuccagaaagagcugacgacagcuggacggacagaaauaaacauucagaacagaccgugccacgggcuucaguacacaaggagacaagaucaucugcauagauuauagauuauaguuaacauaucugaacagaauucaaauaguaauuaauguaauguuuguuauccauucauuccucaguacaagggacuuauuugguuuagagacugggggggggggggggggagaggaagaagagggaagggaagggaagggaagggagggaagggaagggauaugaacgaauauaggucagaggacaucacucaaguauccagguauguguucaaguauccagguauguguucucuuauaacuuacaagauugagauuaaacucaggacauuagaggccuucacauaagugccucuauacacagagucaucucauuaguauuuaaaagaacuuaauucuauaccuaauacacaugaaugcacuugucuaaauuaugguuuuccuaaauugaaguuauucauaacacagaaccauaaacuucacacauccugcuauaucaagacacaauaacaagauguaacaugcaaauucuuaccuuaaguugugugaggauuaugucaugaaacuagguuagacuauuagggucucugaugcucugcuccaguaaggcuccaacaaccaagaucacagggcagagguugagcagagagcaucuuaguacucuuaguacucuacuuauccuugcagagccuggcaccucugugaugcccaggaauucaucucuuagcaccuuuacacuucuugccaaucagcugcuaauauuggcuuauuuuaaaaagccaaauauaaaauugcuauucuucauauacuauuuaauguuuaauguaucuuuguguauggugaacauaucaauuugcauuuucuuucaaacuagaagagaagagcugauagaaaagaaagaaccgggauucagaaacaccauaaaaaagaacaauaagaaagguaaggucaaaguucucuuauuuaaaugaacuucuguugggauuguuucuaccaucgcaaaacucuacuggacuuggacaugagagcagccuuaauuccccaucccucaccgcauacaacagcuagccauaugugggagcacacacuuggaauccuuguucucaggaggaguccaggcuagccuaugggauaccagaguuugcaugaaacaaccacaaagcccugagccugagacaagcaggcuggugguagggugccuuuuuggcacgcacauggguuuuaugccaccauaacaaaauucaauucaugguggguuaucagugcuaugcccuaaccucgauggcuccaaccugauucuggaccucaauuccaguguccacaggggcagccugaacuauauuagucaaguggcaaaacucuuugccaugaaacaggaccaggaacuaggcuuucaauucuaacaggcuaagaguuuggcucucuacaauggcccuccauucuagcaccgacuucuuaugucuacugugugucugacccugugaaugcagagacauucaagauacaauccuuucucucagaaaauugccucugugacuacugaaauagcuauugacuuuacaacuaaaaucaaaaggcuucauugcugauaauaucuuuacaauuucaaaauuuugcucaaaucacaggcuauauuaccugaguucucuguaaaauauccuaaacuaucucaaugucaggaacacaauggcguccuaacuuuuuauuauucugagacacauuuacuuaguacuaacacaucuugguaaacugcaaggcuaccugucauaaagaaauuacuucugauaagaccaaaacccaaaagucuugacaaauuaguucccuguuucacuaaugccagacacauucuuucacaguaccuucccuuagccaugucaaauccuuagugaaacauagcacuguuaacaaaagacugauugauaauugcagaaaaaucagggcauuaaaacagcuaaaccaucaaaaaacaaucuuagaauauaagcagaaagggugacucuucuaaaaaucuuucuggcguuuauaagauuaguaucugaaaaacucaguuacaagcagaccuuauucuuuugugaguauggucaauaaaaaccaaaguaugacuuugaucccugucuccuagaagaguaauccaagagcagaauguauccaagggcucccugucacccugagaacaccugucuaucuuggcaacaagcuuuagccauaaagagacucugcaugucccucucuugaccaaguuaggcuaaccucaucugcauugacagcagugccuauaauuuuggaaucuugaagacagaaauagcuuaucagaguucuuuauauaaaugugguguacugucuuuaaaaaacaacaacuaaauuuaccauagacaaaugcggacaccauuagagugaaacuccaguugugcuuugccacuuugcagcccagaacaguaacaaguaaauaagagcaggccuuuucugccucuuucacuaaaagccacaauauaacauuuuucaauaguaugaauuucacaaacaaaacaagacaaaacaaaacaaaaggugguggacugagauagugcaguacuaaggggcuugccaccugaguucaauugcuauaacccacauaaagauggaaggagagaacaaaccccagaauuguccucuagcuuccacagauguuccaugacacaagugcccuccccacguguacauccuguggucuuaggaacccccaagcacaaauuuauuuuuacuacuacuucacagcuguaauuuugcugcuaagcagugucucaauuuucaagaccaucaggaauaugugauuucugauggucaagaccugcugcuguucugcaaauauuaacaacuuuacgucaaaauacaaauaaaugcucaaaaauuuuaaauucagcuuacuaaauaagcaauaugcaaccuuuuuuucugauuuccauuccugaacacaaacuauggaacaagacaagaaggcucucccacauggacauggagugcuuccucuuggggaguaugugcuugcugggcaagcacucuugcuaacagggguacaggacccacauugcacucagucugcuuuuauugaugccaucagagacuauagcaccucagugaauucgggugcacuaacuaguaacuggcauucucuuggucuacugugcuacagccugaggcugacagcaugcucuguaugugguuccuuuugguguccaugcucugaaauuguaagauguaaacuaccauucuuauccuuucaagauuuuggcaguuuugggugacaacuuuugacuuuuccauaaauuuaaagugauuauaagcaugaguccaauaagcaaaccuauaggcuaucuuggugucauagaacaauauucuuucugcuacacugaagacuuagcuacuugugaaaaauccaacguguuuacucuacauacgaggaggaauuacaugcucauuuccauggaauuuuggguuacaaugugucaaacuguauaacugagaaugaacauaugacagaugccaugucaguaugacugaugugaugucaguaugaugaugugauauccguaugacacaugugaugucuaauucaagauuuuguauccugaagaaagauaccaggauaaugugacacugcuaguuuuucagguaaaaaggauaagaaaaaagaagaugggauaguugcuccaacauauaacaaugacacaugcuccacuauguucauagcagccuucuuuauaguagccagaaguuagaaacaacccagauguccuuuaacagaggaauugauacagaaaaugugguacauuuacacaauggaguacugcccagcuauuaaaaacaauaacuucaugaaauucuuaggcagauggauagaacuggaaacuaucauccugagugagguaacccaaucaaaaaagaacacccaugguaugcacucacugguaagugaauauuagccuagaagcucggaauacccaagauacaauucacagaccacaggaagcucaggaagaaggaagaccuaagugugggugcuucgguccuucauacaaaggggaacaaaauacucacggaagcaaauacagagacaaaguguggggcagagacuaaaugaaaggccaucagcaacugcuccaccuggggauccaucccauauagucaccaaaugcagacacuacuguggaugccaagaagugccuacugaaaggagccugauauagcuucugcagagaggcucugccagugccugacauauacagaggcugaugcuugcagucaaccacuggacugagcacaggguccccaauggaguagagaaaggaugaagaagaugaagguguuugcaaccccauagcaagaacaguaucaaccaaccagagcucccagggucuaaaccaccaaccaaggaguucacaugccgggacccaaggcuccagccauauauguaacagaggauggcuuuguuggucaucaaugggaggaaaagcccuugguccuuugaaggcuugaugcuccaguguaggggaauucgagggcaggaaggcaggagugggugggaagggggacacccucauagaagcaggagcaagggggugagauaguaggauucuuggggggggggacugggaaaggggauaacaugugaaauguaaauaaauaaaauauucaauuaaauaacaaaacaaaacaaaaccaaaaaugcaaaaaaaagaaggugagauagggucaguauacuuaacagucagaaaaaugcugccugaaaccaccaggugcgauuacuacuaguaauauauccacaaaugguuaaaauaaaaauaaaaagauccacaauaucuuguguuggcaagagauggcuugaacacaaauauucauaacuguuuuguucaucacaaucaagacuugugacaacucggcuacccauccacuaaugaacuaauacauuaugguauacagcaaaggcaugcucuccagaaauacaauggaggagagcacaaaugcaagcaacagagcccauauacauacgaugagcaaacagacaagaaaaaugcaguuacagacuucuaauuaaaagaaaaaaagcuacaaagcugagaaauaaaaagcuaagcuucuacaggacaacaguagcaauguguacauguaguagugugggagcuucagcagugaguuaagaccauucagcacucugaguuacacugucuggcacacuguaacccaauauccgaugaaaaugagcauguuuaccugcagaaggagucucaaaagcaucaugaaaacccaggaagaacacagucagcaggaaacaguuaaaccagauuccaggaaucacaacugagcagcaaugacacaaaccucaucaggggugguuugggggaacaggugacaucuacagaggaauauaguaucucggcuaggagaugguuguaugaguggacacacuuguuaaaauccccagaacucuguguauauuauguccauagguaguuuaacacaauuacugcguaaaguuaaaucggaaguggugaagugacugaguuuagaaaaguaguaaaacuuuucugucaaucauguuaugaaauuugaauuguuugcaaagacagagucaugaauaaauuaaauuuuugaaaaaauaggaucuacuauaugggaagaaggcuucagucugcaaaguugucuguaagaaagcuauugcccaaccaagaagugaugaugcccuaagggcagacagugggacagcaagaagcugauuuacuuguguaucugaggacagcuaaguggaaacauccauccauucugugcuggucacuuagguccaaaggccuuggaggagcuagaaaggaagacacuacccagagcugcauggagacuaggguuauuacaacaaagaagagcaacucaaaaccuuuagccucaggaacagaagaggauggggauagaugucggucuaaaacuuacaaaugguuaauuauucaaauuaaacagcaaccccaucccuccaucacccaccuucucucauagauauauuuguagauaauacuucugguacucucauaccucaauaguucuaaggccagaaaagaaacuugaaacaauucacaaggcaagugccuuaguuaggcuucuacugcugcgacaaaaacacuacuaccaaaagcaaguuggggaggaaaagauuuauguggcuuuuacuucccaauccaucacuggcggaaguuaacaggaacucaagcagagcaggaacuuggaagcaggagcugacgcagaggccauggaggaugcugcuuaccagcuugcuuuacugacuuugaacucagagcuccgcaugccucugucucuugagugcugggauuaaagauguguaccaacacacuuggagcuaaacuuaaauuccuuuucacaagaccuuuauaagcauagccacuaugccucaagaucuagaucacacgugugcccuccauuucuggacuguaguucauuucagauauagucaaguugacaaacaagaagagucaucacagcaagugacaagaagguucaacaaauaucaaacugaggacuagggacguggcacagugagcuaaaugcucacugagcaugaccuggcuagaucgcuggcaccacauaaaccaggcaagguggccuauaaccccagcucccuggagcuggaagcagaaggaucaagacaugaaacuuaaggucauucugagcuccacaaugaguuagacaacagccuggaauguaugagacccuaucccuaaaaacaagcacaaugcccauccagaaaacugaagcccccauuuagauccagcacagacaaaaaucuggcuccaauacucuuugcuucucuuucaggagaugaaagcaaaguaucccagcuaauguuaaaaccucuucaguucugacaugggcacugauuugcauauugccuaauuaagacaaaauuuguguccuuaucauuuuuguuauuuacuaagaagggugaauggaucuacuuaacaaaaauucugaaaauaccccaacaccgaagaaguucaaagaacuggcucuacagaugaacugcaaaucgcugggagcugcagagacaucuucuaaaauggcuccaugaacucuaugaaaaugagaacacucaacaaaagcgaagugcaggagugcaagaggagcacagacagcagcuuuuccucaaguuagcacagugugauccaacaucuucuguuuuccaaaucucucaggucagauaaaaaaccaaccaagucuaggaucuggccaacgcucagagcaaccugguaaaacaaguacugauggaggacagugaacacuagucaccacagaucaacuccaguaacuaguacuguggaagacaaugaacacuaguuaccacacugcacacucauuuagagagcugcaauuaagucaugugcacuuugaaaaccaucauguagggaaaauggcacaaaaucaugaaaacuagcaaucaagcacacaaacaccaaaucaguacacuuuagagaaaaugguuucaaaggcaauuaagacaaucaguaaaucaaguuaaagaagucuaacuagaacaauucaugaaaaaccauucaaaucuaaacuauuuucucaacaccauauguuuauauuagaacaggaagcauauaauuauaauaguuuaauuugaaauagacaaagaauuuagaaggcaaauauaaugugauuugcauugagguacacugugcuuuguguuuuuaaaagguacuuauaauuaauauucuguaaagaaauuuaaaaguuaagucauguggugguuugaauaacaauggccaccauaggcucauauguuuguguggagagccgugaguaaucgccauuacaagauggcgcuggcuuccgcugugccuaacugguaaacaaguaaugugagcaggugcaagaguaaauaagccacccuggaaacaaauguucuguucuuguuagucagaaacauucaugaccuacaccuggcaucaaggcaaccgacucccacaggcuauguccuggggaggacacggaauguauaugaaggccucuaucucaaaccggucauuagguaacuaggagaauuaaaacuucuuuaaaaaacaaaaacaaaaaggggggauagaggcuaugacgccaaagauggcucuaucccuuauaauauuuacucuuaauuucuuaaaacuggauaaugcugggagaucaccagcugaaaggcacggacaauggccucaacugcucaaugaaauggucaaguggaagaauguccuugauaauaaaugguauggcccggauccuaucuuaaucagaucccggggagcuauuuguguuuuuuccacagggugaagaaaauccacuuuggguuccgacgcgacugacaaggaccgugaaagaucaagaugaaucccaagaugauccuguuauucuuacuccugaugauugagacagggauaaguauaccuuugugggccauaguaagaucauggccgguaccuuuaccaguacauuccaauucuucuaccuugccuuuguuuuuggcaacugaauauuuuuaaagaaaaagauuaucucuaauugggcagauuucauuagccaaaauaaagugagcucuggaguguuauuuaaugcuuuaacgcaaguugcucaaggagcacagucaggcucaagugauguugaaaauaauguaacuucaccuauaaacaucaccacaauuaugauaaagggaaaugcgacuauucccaaaagaucacaauggccuguugacaaugcuacugcuauacacagcaugccuuggugucauccggaccuugcauuuccuauaguuuuuucaccuugucaaucaaauauuuuuccucagaaaaaaauaacauaggguuuuguuuugucaccuccauuggauuuugcuguaaugaaugauaaaggagaugcuacaggaaaagaaaauauauggccauguuaccaauggauucuaaguaaugaggcaggugcuaguaccagucugucagccuuugcacugcugacuggaaccuuucaugagauacugaauguuucugccaaacuuuccaauaucucugcucauuuagauaaugauaacucuaauagaguuaucagaaauaugacuacuucuccaguagaagucuguguuaauccuccauuuuucuuuauauuggcugaauuucaaaauaauacagaaugguuagauuguacaaaugucacuuguuucuagaauagaacuaauuucuuagccuuagugguacauuuaccaaccuuugucccuguugaggcagauccagaaaaguucccaaucaugagucuuguucagcaaaagagagauuuuggaaucacagcugccauugcaguguccguggcaucagcgguuaccgcaggaauugcuauggccaaucacguuaauacugcugacaccauaagucagauaacagaaaaaacgucugaggcauugcuuacccugcaaaggguagauucucuuaucgccucaggauuaauguuagugaauuaaaagaauagauauuuuacaacauaacauagaacagaugauggaugccauacaaaugaguuguguggcaucuacaucgcaugugugcauuacucccaauagguauauuaauaauucucuuauuaaaaguacagaccuaucgaauuaucugaaggggaacugguugcaggaguuggaaagguugcagacgaagcugcagauacagauccuggaccuuaauggaaccagaguggaaccagugacccuuggagacuucaccucuuggauuaccucugcauuuucuuacuuuaaggaaugggugcggguaguuuuauuuggugcugccaucugcugugggcuugugcucaugcucugguuggucugcaagcucagaacccaacaaaaccgugacaaggucguuacugcucaagcacuugcagccacugaacaaggggccuccccugaaauuuggcuauccaugcuuaagacuuaauuggcaucugaguucucugcucuuucgcuccucgguucugcggaaaaugagagagacucaacaauuaaagcucgacccaggccauacucagcucuugcaccccuagaggcuagacucauugcacagggacgagugaguaggucguugacucuuauggauuguugggcuaagcaccgaauaggaguugcucagagguuuggccacuccuagaagacaagucgauaugcaugaggguugaguguucaagugucccuccccuaggaaaaacggcacgggagcaggucaggguugcucuggguaaaaaccugugagccuaagagccaauccuguacauggucccuauuucugcacacuagggauucgaccucuaucuucauccauuaaagaguggcuugcauuuuaauaaaauaaaaagggggagauguggagagccgugaguaauugccauuacaagauggcgcuggcuuccgcugugccuaacugguaaacaaguaaugugcgcaggugcaagaguaaauucgugccaagucacugcccaucccgggguguagcaaugaggugaugggugagcaacaaaucaggugcugacacgccacacagagggguauauaagcagcaucauuuuccggguucggggucuuccuccuaaugaagcaauaaagcuuugcugcagaagaauccuguuguccgaguguguuuuugcuggcgagaaacuagcucgggacauguuugaaugcuuagucauagggaguagcacaacugaaggauuagaggguguggccuuguuaggguagguguggccuuguuagaggaaguuugucacugggggugggcuuuaagguuucagaagcccaaaccagacccagugugucuaucuuucugcugccuguggaucaauauguagaacucuaagcuacuucucaagcacuaugucugccuacacauagccaugcuccccccaugacaauaaugggcuaaaccucugaacuauaagccagccacaaugaaauuccuucucuuauaagagcugccuuggagagauagcucagugauuaagagagugguuaagggcugcucuuucagaggagcuggauucaauucccagcacccacauuguggcucacaacuucuauagaugggauccaauauccucuuguggccucuagaggcaccagacaugcaaaugguauacaaacaugcacacaggcaaaacaacuauacauggaacaauacaauuaaaaacauaaaaaaagaagaaaaaaaaggugccuuggucauguugucucugcacagcaacugaacaguaaaacaguaacuaagacaaucuguguuaucuaauagcaacaagauuuucacauuaaaaaauucuaagugagauucaagcauccuugcuugugcuucuuugggucuggggaaugcagcauggguauccuguauuuuauggcuaauauccacuuauaagugaguacauagcaugcauguccuuuugggaccagguuaccucacucaugaugauagucucaaguccaugccuguaaaguucaugaugucuguuuuucauaacugaauaguauuuccauuguauagaugcucugcauuuucuuuagccauucuugagaggcaucuaguuguuuucaguuucugacuauuaugaauaaagcugcuaugaacauaguaacaucccauauaagcaagugcuuuugugggauguuggagcauuuuugggggguauaugccaagaagugguauagcugggucuugagguagaacuauuuccaguuuucugagaagcgaccaaacugauuuccaaagugguuguacaaguuugcacucccaccagcaauggaggaguguuccuuucucuccacauccacaccagcaugugcuauuucuugaguuuuugaucuuagccacucugauggguguuaagauggaaccucagaguuguuuugauuuucauuucccugaugacaaaggacuuucuuugaacauuucuuuaagugcuucuuggccauucgagguuccuuuguugaaaauucugucuagcucuguaccccauuuucuaauuggauuauuuggguuguugaugucuaacuucuugaguucuuuguaguacauuuuggauauuagcccucugucagauguagggauggugaagauccuuucccaaucuguaggcugccauuuuguccuauuaacaguguccuuugccuuacaaaaagcuaugcaguuucaugaggucccauuuaucaauaaaacugugauaagggacagauagaggaacuaggaggaagggggaaugcacaggggaaugguaggggucaggaucagguguggggaaggacaggagagauggccagaugacaaugaacagaaguggaaaucugcaauugauggggugaggaggaggggggcaucuccaggaugugacagagaccugggauaagggagguaauaaaucaaugggggugaccuuagcugugacucacagcauuggagauacagaaccugaagaggccaccgccugaagcuaggcaggaaccccaguggaagaauagagacaccaauccacccauaaaacuuuuaacccaaaauuuauccugucaacaagaaaugcacauaggagggauagggcagagucugagggaaugaccaacuaauaaauggcccaacuugagaccugucccaugggcaagcaccaaucccugacaacguuaauaacacucugugcauugcagacaagaacauguugucuuuugagaggcuucacccaggaguugauucagacagauagaugcagccacccgcauccaacaguggauggaacuuguguacucuuaaagaaaaauaagaggaaggauuuguggguccugaaggguauaggaacuucacaggaagaacaguggaaucaacuaacaugaacccuuggggcucuuagagucugagccaccaaccaaaaaacauacauggguuggaccuaggcuucccuccacauauauaacagaugugcagcuuggucuucaugugggucacaaugaacuggagcaggaugucuuaguuagggcuuuauugcugugagcagacaccaugaccaaggcaagucuuauaaaggacaacauuuaauuggggcugucuuacagguucagagguucucaugaagagguucucaugaaggugagaacaucuaggcaggcuugguacagcagaugcugagaguucuacaucuucaugugaaggcugcaaugagccuacuggcuuucaggcaguuaggauggggaucugaaagcccacacccucagagacacacccauuccaacaaggccacaccuacuccaacagggccacaccuucuaauaaugcuacucccuggacugagcauauacaaaccaucacauaggcuaucccaaaagcuguugccuguacauaggauauguucuccuagcugggcuuugucuggccucagugggagaggaagcaucuagcuuugcagagacuugauaagcuaggauagggggacaccugguugggggggggggcauuggcucagagaaguggggagggugauggggaaaggauugugggaggggguggcugggaggggggcagugagcgggaugaaaagugaauaaguaaaaaauaaaauaaauucuugucuuggcuggggauucagugagagcgcaggucuagcacucacagugugugugguuuuugccuguacugaaaccauucauccuagagacaagugggagaaugggaaggacuuuucuaguggaugagagggauuuaagucucuguuuaugacauacacuuucuguuuggaaugauaaaaaaguuuaagaaauguagaauauucuuuuauguucuuuaaaguuuggaauuuucaggccaggcuugguggcgcacgccuuuaaucccagcucuugggaggcggaggcagguggauuucugaguuugaggccagccuggucuacagagugaguuccagaacagccagggcuacacagagaaacccugucucgaaaaaaacaaaacaacacaaaaaagccaaaaaccaaaacaaaacaaaaaguuuggaauuuuccuuuucaagucugaaauuugugcaaacaauaugcucuuaaagcaggagcaagaagcaucauuuauaggcuaucugaucacugauuucaauucaaggcuuacucuucuuagacauuuagcuucuuagcacuuuaaaacaauaucuuuaaaauauuuuugaacauauguauguauuaaguguauguucgauguaccuauguuuguaguuuugugugugagaguacacacauccaacaguaaaugaguggaggucagagaacaaucuuuggaaucuaggggucaguccuugccuucuaucgugcauguaugaaucucuguauguguguguacaccaugaaacacacaccuagagguauguccuauucaauacaacaaaauaucucuaaauaaaaagguguucuaucugauggagacaagucuguacagagaagagaggaaaaaaacccaaagagagcuaaauaucaagcccucccacgagacugcauguuaacacaucaguauauauccuucuccuucuuauuacaaagaagauagaggauaccacuguucaauuaucucucguggcacaaauguaacccuauugucuuguuuuuauccugaauacccuacugcccccaaauaauuacucacagcuggacagagccugaacauuauuacugccuaucuuucuuccaauuuagucucaauuuagaauagauauguacccugauuuaaaagguuuaucaauuuuaaaaacucuaacauauguauaugaaaaaauaaaauucuauuacuuuugacuaugagacuauuucauaacuuaaccaaagaugcuuacuaaaaaaaccugaaauagguaguuugauaaaacuaaaagcuuagauucauuuuauggacaauaaagaacccauuauauauucaguacacacacacacacacacaaacacacauauacacacacauauauaaagaguccaccccaauaaaaaacaucuggauaaaacaucuggaguaagugacaucuuagagcaaaugcacugacaagcacaugugggacaguccauucaaacuccacagcacacacuugcuucucagcagcccauggaucacuuucugaaauagaccauauccuggacacaaagcaaguccaaaucagaauaugaauauaaaauaauucuaccugaccaaaggagaacaaccagaaaucaaccucaagagaagcugugguacacagacucaugggacugaccaagcacuauugacaaugaaugucuucuugaagaaauaaaaacaaacuuaugaaugcccagaguugaaugaaaauaaaaacacaauacagcaaagucuguaggugaugagagcagucuggaaguggaagggccuaaguaccugcacuaaccacaccagguucacgaugcaccuuagggcuuugagaaacaauaacaaaccagagcaaagccagcagaugcacauaccugggcuuggggcagagugaugagauagcauggaggacauggguccuuaugcucacagacaagcacagggguacagaaauguuaauuaagcacacaggguuaucuggucaaaggaauagauguagaaccuguuuucuacacagaaggcuggccauggauguaguuaauagcacuaucuguagagccaggccacaccuggcuccugguucuugcaguuaucucagucauucuugaacacugauucucagucaaucuaccauccuuacaggagaugucacauguauuuuacacaugggagcagaggcgguuaauagucugcugaucuuggcacugcuugugugauccaaaccacauuugaucuuccuccaaacgcacguguagucaauguauaaaacccauccuuguggaagaggucccguguauuuuaugaagaguuucgacauagucaucaugccuuaagcuuuguuacacggaacugaguaauuaucaccagacuuugcuguauuuacagaugccuaaaacagacuguccagggucagauucuagaagucugaaccaauaccugucacugaguccugcugaaguagauuuccuucuugccucauauggauugacacugccagcucugguguuugcagagacccuccaaaagugaagcugaaaaaccacuaagaaucagugaaagaaaguugcccuuucaagaucaacagauuuuuagcuaaucuaccaaaaaagaaauuuugggaaugaccaaauuaauacaauuaggagugaaaauggagacaucacaauggauaccaauguaacucagaaaauuaagacauaccuaaaaucuacaaaaacagguaaauuuguagacacauauugccuaccaggauuaacuugagauaaauaguguauacagaucuacaagacugaaauaauaauauauuuuccaacuaagaaaagucuaggcccagauggaugauagugaauucuacuagagcauuaaagaauugacaucaguggaucugagacuauuccaugauguagaaaaugaaggaauucuucaauauccuuuuaaauaagccaguauuacuaauaccaaauccagauaaagacaagagaaaaagaaaaaaucauaaaaccaaucuucccugauggacauaguaaauauuuucaguaauauacucaaaauuuaguucaagaacacaugggaagaucauucaaugaagggguaguuaaauauauacaaaucaauaaauguaauaaaucauacaaaugaucuuaaggacaucucaacagguacaaaaucagacugugauaaaauccaacauucuucauuacaaaaagccugauaaaagggaaauaggggaaacauaucucaacauaauaaagaccauagagggcaaaguuaacccaaaucaaucgacaugaugagacugcaaagcacuuccacuaaaauaaaaucaaguacugagcauggugcacacauccuccauacuuaucugacaagguacaguaagagaaggaaaucaaaggauaacaaugggagaggaauuugcugaugaucugacucuaaacacaaaagacccuaaaagcuccaccagaaaauuguuaggucugauagacauuuuagcaaguggcagaauauaaaauuaacauagcaacucucuuaccuaccaacaacaaaacauauaagaaaccagaacaaucccauucaaaauugccuuaaccuauuuuccccugaaauaaaccuaagaaagugaaaugaaagaccuuuacaaugaaaacuuucucagugccaguuuucacaguaaucccgggggggggggggaaccauaaaauuuauaugcaaagacaaaacacuccaaagacccaaaucaauccagaucaaacagaaugauggagaugucaccugacuucaagucacacucuagaaccauagaacaaacccagcaugcuacugguccaacacuggacauguugauuagugcacugauagaggaccucaauaugaccccaagucaccaggguuguuuuuagcauauauuaauuaccuuuaauaguguguuucaugacacguuugugcacauguacaaaauaugauuauauucauccucacugucucuuuucaauucccgcuuucgugagugugugcacaugaaucccaaugaguuucaucaggguugcuuacgggagcaugggugaaagguaauuuacaggaacauggcaccuugacaauggcuacaccacuaaagaugucuaccuccccuaagaaccauaaaacaccuuaaauccccagaaaaggguggguccuuaugaaucccuccuugcuccaugacaggagggugauaggcccaaucucaggcagguuuuauguaggucauuacagcugcuaaaaguucaagagugacaugaacauaucacuccagagucuggagaacaauggcccacaacaauccacucagacuuacucuuucugcucacucuucugugauuuauuacugagccuuagagucuuggaggaggugauacgacugucaaauuuacagcuugacauucagcaaucauuuauucucaacauuugaaccaauuaugaauccaucacuaaccacuguccaccauaaagaagcuccucugaccaauuuguacagcaacacuaaucuaugagguuaaguauaaugcucgaaagaccacuugacaggcacauccacuuagcaagacagcuguagcuucccuacuagggccucagucgugggcuuccaaccagguuuacaguaucagacaugcaaucccuccuguggagcaggccuggauuucagccagagaguaguuacccacacuucaccuguccuaacagacuagccaguagugcaagugagcagcuccugccugcuacugcugucagagaacacagguucaggcugaguaagacaggugaugacaauucuccucagcagcccugucaggcaagcacugugaggccuagccaguggggaggggaugucuaacucagcuccagcuugacuucucuauguccuguaaccagagcaugugaugucuucaguaaaagcaugccuauguguauguauaaaauauacauugaagaaaauauggaaggcuuaaaaucaucaacaguuaauacuauaaaacaaauguucaaaccacuuccuaaguaacaaauuaauccugaggcaauuuaaacuacuguaaaguuguagugaaaaauauaugcagucaguguacaaauacauaaaacuagauugccuuauuaucacuaguaaaggaaggaggaguggcgauggcugucacugggcauggcuuuguuuuuuaguguucucacuuaagagugucuuuuugacuucuauuuaauguauaugggcguaugucuauaugaguauauguacauauacaugacaaggccagaauaguguguuagagauuuccugggauuggaguuacacacagugcugugagcuaaccaguguuguguugggaacugaaccaaggguucucuacaagaccagcaagcauuuaaccacugagucaccuucucaggcccaucacuguaaaaaaaaaaauuaguaauuugggauuuuuuuuuguacuuauuaaaauacucuggauuagacaucagugaaaaauguacuacuuuauaaauuuccuaacaacuacuuaguugcacagcuuaaaaggauaaaucuagcuguauguaaauuauauccuuuaaauguguuuauuuaaacauuuaaauuuuuuaacucugaaaauaucuaucaaaauacuaacauugugccagauuaaugagccuaaacaaaucuuaaaacaggcugucucuuggugccuuuacacauguccugaauauuuuaugcauuuguuauugauuaacagagcuugggguuugaauuggccuuuuucccagaaggauauucaaauauuacacgugacuguccaguugcuuuacaacaaucuauucuaugggcauucuuuuucucacugaaaggucuucacacccuuguuaaaaauuaucuggcuauagacaucaguuuauuucuggauucucaacucuaacuccucagucugugucugugguuaggccuaaugaaguuagaauguucugauuucacuaaauuuuaaagugaggaaauauuggcucuaugcuguccuuuuuuuuucuucucuuuaagaugaggauuuuguuuucuguuuauuuccuauuugugggcucuuacauuuccauuuaucuucuaaauuguagcuggucaauuucuacagugacgacaucagcuagaguucuaaaaggguuacacggacucuuuacagacguugcagagggucugcuggcacguuagcaauggcaucuucccauccacacagaucagaggucacucugucuccugugcuuaccaucgcuuuccucauuccauggcacacgcuggccgagaacucacugcgcauuccagguuuccuguguggauuucauguucagguuguugguugacaguguugguuucaacacagcugauucugugugcugaucuugcacacugugacuuugcugaacucuguuauuaguucuaauaacuuuucagaaaauucuuuucuauuuuugacacagauucucauuuaauuguggcuaguucugcuuccuuuacaguguauaggaaucucuguucguuuuuaaguugucuaauucccuugguagaaucucuaauacacgacugaacagaaucagcacaagcagaccucuucaucccauuccugaucuaacaaggaaagcauccagucuuccaucuuuaaaguccuccggagccaggugguugguugguuuguuaucugucagauggagcaaguucucuucuauuucuaguuuucuaguguggcgguuuggaugagaauggcccucaugaauacgugguucucaguugauggaacuguuugugaaggaugaagagauggggccuuguuggaggcuguguaucacugggggagggcuuaacacccauggcauuccuagugucugccugucucugucugcuuugugcugguugaucagaugugagcucacagcuacugaucuagcacuguaacugccugccugcuaccauguucuccacuaugauggucauggacauuacgcccugaaacuguaagcuccaaauaaacuauucuguaagcugucuuaucacagcaauaugaaaauaacuaaggcaccuguguauuuuucuuuaagaaagcugaauuuugcuaaaugcuucuucugcagccauugaaaugaccauguggcuuagguuucuugguuacugacaugggguauuacauugguugguuuuuugaauguugaguaaccuuauauuccugggauaaaaacacuuuaaaaugcuauauugcuagauucaguuuaaucaauuaauuugcuuuuauguguauggguguuuugccugaauguaugucuguguaugccugguagcuagagaccagaaaacuguaacagaucccccgaaacugaaguuauagacaauuguuagccgccaugucagggcucagaaucaaacccaaguucucuggaagagcaacuggugguuaauaacugcucagccgucucuucagccccuggauucaacucgcugguauuuuguuucacuuuuuuucuuuuuuugugggggcggcggucagggugaugauagucuuauaaaauuagugugaauacuguuaucaucugcaaucacccugggcugucgcaacucugcugcucccacagaccggcuuagaaaaagccugugacagccaggauguucaggaucuccugagcaggugucucuacagaaagcaagauggggacuugucuuuccucagguugucauguuuauguagaauugccaaagccuucuugcaaucauaaugcaucuggcaugaggacaauauuaauacacugaaaacagcaaaacagaacgaacagaacacuggcugauggugcugaacuaacugucccauugccuaacauggagucagucuguuuuggguuuuugcuuauuuuuguuuguuuguuugauuauucauuaauccauccaucuaucauccauccauuuaucauccauccauccauccauccacccauccaucuaugagguuacugggaauugauguauuaucuauguauguauguauguauguauguauguauguauguauguaucuaucuauguaucuaucuaucuaucuaucuaucuaucuauguaucuauguaucuauguaucuaucuaucuaucuaucuaucuaucuaucuaucuauguaucuaugcaucuaucuauguaucuaucuauguaucuaucuauguaucuauguaucuuuguaucuauguaucuaucuaucuacagaguuacugcggcuagaacucagaucccaagacuggcagcuagcacuuguacucacugagucaccuauugcccucucucucuauuauugucuaaggaacacugaguauguuuucuucuacugacuguuuucugcuacuuguaacuaauacccuucuuguugauauagcacggugugcuagaacuugcucaugccagcucagggaaaccagcucugcaccucucuucccaaaucucuucagcaacauugcaacacugcccaaaccaacuacagcaagaaugugugccuuacaaaaccugucaguauuaaucacgguuacuuucuuucagaaauacagcugucaaacaucacuaaugcagauuucuguuuucuuuaaacaugcuuuuuaaauucauaauaugguaauuaaaaauuaaaauuguaccaauaaaauaguucauggguuuggguuacuagugacuuuagaaaaaagguacuuaguauucagugcucagaguauuucauaauaaugcaaaauugcugugcuauauaaauaaaaacccugagcauaaaacaugcacaauaagagaagagaguauauguuggacauauuaggauuacugaaaugaacaccagcacauucauaauguuaccucguuaugucuggcugcaaauaauguguguguguguguguguguguguguguguauaaaacuuguucuuuuaaguucacacugugacauuaauuugguaauaagaaaaccaccaucuuuuaaauacuaaauuuaguauuuauuacucaagcaugaugcuguucuuccacucuauguguugaggaaggaagggcuuaugcaguccuuugcagcaggaagggcucuaucucgguagcucuggauggucgccucuaguauaaagcuauagaccugcucucuugcugguguaggcagaaacaauuauauauugagcuauaauauuuacaagaaaaaauacugaauuugcuacucucccaccucagcaugcacacacuaacuuacucaccugcugcugucuguuccuaacgacagcgggcucaagcagaggagcuucagacaaagacuuacucuaucaaucaaacuaaacaguguuucgucacgucauuucuggccggcaacaaucucucguccuugaucucacuuguuauggauaccaagaauacuaugccacucccucaaggagaaaaagcaguagagaggugagcaauggcaucauaugccacuacuuuauuagcgacaccuuuaacaguuguacuuuguuccacuuugauacaaggcagcuuuauagucagugaagcaggguaccaguucccuaguaacaagcuaacuuggucacugcugccaagaccuuccuaucaaaaguauauguauguaucugugugugugaguguauacgugugugaaaucucuuuacuguuucagguuuaaccuaaacaacaaaaacaaaaucaaagacgacgucaacaguguuucuuccaaaacacagggaggaaagagaaaguaaagcuaucuaccaguucccacgcccguaguccuaaaugaaauaucugcacauaggaucauuaaaggaauagcagcauccuuaccuaaugagaacaaucuuauaaguaguguaaguuauuugcauaugaauuaaaauguugaacaccaacauaugcccccaaauacauuaagauaaaauaaauaucuauuucuagauaaauauuucuaaugaaguaaagaaaaggguuaaaauuauuuguaagaaaguauuaacuaaauaagcaaaagcacagagaaguauuagaaauauuguuuaauucauagcuguuuuauaaaaguaaucuauaaaaaucaagaguuagcugggcauuguagugcauaccucuaaucccaucacuugggaggcagagguagacagaucucuauauaaaguggucuauaucagugaguuccaggacagccagagcuacaaaacaagaaaaauucauugacuccaaaacagaaagaaagaaagaaagaaagaaagaaagaaagaaagagaaaagaaaagaaaaggaaaggaaagaagaaagaaaaaggaagaaagaaagguagguaguuuuuucuaauggcggcaaaaaaaaaaaaaacccuuuaaaauguauaacucauggcuugggaauaccuucauaugcauaaagcucuggguuguauccccagcaccacauaaaacuaggcauggugauacacaccugcaaucccagcaugcagguggagucaaaggaucaaaaguucagugccauuuaggcuacaaagcaaaugcaagaugaggcugggauacaugagacccugucucaaagaacaaagcaaaugguauaaaugcauaaaagcaagcaaaguguaaaagacuaugaagaaaagguuaagauggggauggagcucuuaggcagaguaugcacuuagcaggugugugcauguuuaugaguggcuauacccacauguggaucuuaacauaaaacacgcuaggguaacaucaaugucagaaaacuuuguagaaacccucugcugguuuggggucuuuucugcaaaucggcaauuccaaaguagaacuguugaaaacugaaguggaaauccaaagcuguagcauucgucuaugaaguggaaguccccugcagcaccucuagcccacaaggaccuggguagucaguguacaaccgcugcgggcuuuguggcucgcauccacuguaauucucauggaaaucccaagagacagcaguuacugagccugucgugcagaugaaaggacagggauggacugagguaagcccaggaucgaaagccacucccucuccuagacgcuucccagcuuguguacugugguuggauauccuaaaagucucuuccagaagguucuucucugaaaugacaugggauacacaggggaagaagcaagcagaaagcaucugcucacauuggaagguccauguucugucuuuacacaagucccgcuucaacaucguacgcugcuaaaaucucucuaaugucuggagauggaaauuuacuuuaggaauugagagauuuuagaacagugucuaaaauggauccuaaguucaauaucucagaccuguagaagugaagauauuacaaugccuacuggcaggcagcccugugacagccacuaacagggcaccuaguauucaaggcucucuuuuuuucaagcauaaauuuccccuauaauuacacauucuuaguccaaaaaaaauaaaaugucagcuucuuuuuuauuauugaaaauacagauaauaaguucaguguucacuguagcuacuaaaaugaacagaaucaucaaacucaugaugaagccacgucuacaucucgaagccuucaauccugaaacuaucuuauuaacaaacuuacuucugcugcugcaucaguaaagagagguaagacuuaguaaggaagcuugucuguaugagccaaaugucccuuugugaaauuacaauucucagguggaaguuuauuacaaacacgacaaaaugguccuucguuacauaaaagcaucagaaguuugguuuaauggccaugcuacagugacaagaaaugcagacaauaaauaaacaaguaacacacauaggaauugacauaaagcacauauuacaagcuuaauaucaacaaaucuaagaaacagaaacugagaauguuggcaaagcuuaaaaaggcacucacacacugcauguggaaacagauggguaugauuuuagcagcuuaggaccuaacagugguuauaucugagugguagcaccaugaguguuguuucuucuuuuucaaacuuuuuuauagccuuguauuuuauaacaagcauauauuaauucuagucccaccuccaaaucugaguuacuuuauaaaguucuauuuacauaucaccuaauucuucuuauagaagcaaaaaccaaguguuugcuauuuacaucucagaagggcagcuuccuaucuuaacuccaggucuacaccuccuacccacccagagaagcagaguccccagcccccacccucaaaguccuguggccuccccgcuacagcuccccuucccccacagccacugaagcccuguggccccaucacaaccccucccugcagccccacgcccccccaccacagcagcacugcagaagccuuagcuggaaggagcucaguuucaauccuaaguucuagucacaauugugcuacuacugacagcggacuucuaaauccuacugcauuuuuucucuuuuuauuacuuuugguuuaagucuaaugaauuuuaaauuuuaauuucguauuuugguacaucugguauuuuauuuuaugcauguguguuuugucuauauaucuguguaacaucuacugaacccauagacuucacaaggagcugaauccccugaagcuggaguuagaugacaugggcgcuggacaucaaacacagguacccucaaagagcaguugaugcucuuaaacacugcaccaucacuucagccccuaauuuccaggacauucuuaugugagaucuacauauauuuagagaauacgggacugccaauaaaacugaagacaaguuagaaacaggacaaagaugaagauggcauuacaauaugaaauuauuaaguaauuuggggauugaucuuaagggaagcuaaugauagccuaaguucugaccgaagaaugagaugagaaguuuuccuuuuucccuguccagaaccuuaaucuguuguacauuagagacaccaaaguggaugcacuaagcauguguuuuaugguggcagaaguggcagggcaaacggagccaacagcucguagagacagacaaguaagaggugugugccaaacaucaaacaacaaagaugagaagacgagggaaguuauuuuacacguaaucucaacacaaggaggccacacuggcugggagggacugauggccaagagcccugagaguccugagguuuaaugcuggcacauuccgacagaagagaccgaccucugugagagacggagaggaaggaguggggucucaucaugucugccacaccaagaaggggaaccuggacuccacaugcacaaaaccuugccauuuugagccgguugacaugauuuaacuguguuuuaaaaacuguuucaaccuuagccaggcauaguggugcauacuuuuaauccuagcacuuggggaggcaaaggcagguggaucucugugaguuagagaccaaucuacacaguaagugucaggauauccagagcuacuaagagagccugucucaaaagaaaaaaaaauauucaaccaccuaugaaaacagacuucaaguacaggaaaagugcuauggacaccagagguguagaagggaccuuguaggcugauuucugucugucuucagaaccgagcaccugggucucacacuguaaaaaguuuucugguuccuaaauccagaggcuaccacuuaaguucauaaacuagccaaaugaacacauacauaaaaauacauugcaguuguguguucacgggaaaaucuggauacuucaguucaagcccagaccuauaagaaaauaccacacagcuauccucuggucuccauacacacacauaauauacacacgauuagaacaaacaaacaaaccaaccuugaaacaaagccauuuguguucauguccuauggcugcuauaacgcaguacuacaacuaggaccaaugaaagcgcugucccgagugagugagaaugauggucaaacccaaagcucggagagcugugugagcugcagcuugcccuucccaguuccugcuggacccaguaagccguggcucugcugcugugcugcugccucaugccagcucucagcaagcagauccaccuagcuuucuccaagugcgucuuggucucuaugcauccauaaagacacccacgguugaauuuagguccuugcccaauaacaaauaaucuccucgaauauaauuauaaagauauuuacucuaagucaggucacacugugagguuccugccaguauuuuuuuuaauauauagauuuuuuuauuacauauuuuccucaauuacauuuccaaugcuaucccaaaagucccccauacacucccccccacuucccuauccacccauucccauuuuuuuuuggcccugguguuccccuguacuggggcauauaaaguuugcauguccaaugggccucucuuuccagugauggccgacuaggccaucuuuugauacauaugcagcuagagucaagagcuccgggguacugguuaguucauaauguuguuccaccuauaggguugcaaaucccuuuagcuccauggguacuuucucuagcuccuccauugggagcccugugauccauccaauagcugacugugagcauccacuucuguguuuguuaggccccggcauggucucacaagagacagcuauaucuggguccuuucagccaaaucuugcuaguguaugcaauggugucagcguuuggaagcugauuaugggauggaucccuggauauggcagucucuagaugguccauccuuucgucacagcuccaaacuuugucucuguaacuccuuccauggguguuuccugccaguauuuuugauacacggauuucagccacuguacaucaaucaacaccacagugggcugcuuucauugcacuuauuccuuuaagcuaacacacaacaucuuggguugcuucauguacuuuucauuuauguguuucauucauacauuguccuuugacccccucugccuggcucucaugcucuccuuucacauggaauguguuauucucuuuccuaccucauguccuguggcccuccuccacacauaaacauacacauuaacauguaugcacgcgcucgcucuugcucucucucauauucuuucucucuuaaaccuggguuccacaagaaagaaggcaugcacuacucaucugaccuugcauauuuugcuccccauaaugauuucugguuguguccauucccugcucagucucacuguuuuuaaaguggucacccugccuuaaaaaugaugaagacucaacacucaaagccaggucugcuccacaggaaacauuccugcaguaucuucaugugcccugcaguucugcaguucacgcauugauggacugagcucucuggucuacuuuuuauauuuuguaucccacauaccuuacugaaauacuucaguaaguuaauuucuggugcaagcucugagguaggcaaugaaguuucucaugugugugugagcuagcccccgucauaccucuccuuuguauuccauuaagaguacaguguucucagccaggcagugguggcgcaagccuuuaauccagcacuugggaggcagaagcaggcggauuucugaguucgaggccagccuggucuacagagugaguuccaggacagccagggcuacagagaaaccuugucuuaaaaaaaaaaaaaaaaaaaaaaaaaaaaaaaaagacagccagccagccauguucucuugcauacuacacuuuaaacacuaugcuugguggcaucaguuuucuuuauaucugaaucuuuuauuuguggacgcuaacucagacuauuuagacaccaauauacaacguggaguaaccauagauaucaggaaacuuaaaagggcccaugaagaacacuaguagggguaacaggaugcaguugcuaggaaagagguacaugggaaaagaagacgggggagacuuaccuguggaaggaagagaaauggcaagacugcgagagaggaaaggagaaagauaagcaacacaagaugacugaaaaggccacagggaauuauuuuaugcuugcuuaaaacuacccacccccacauucacucaagcauacgcacauauacuccuaugaauuuuguuguuuaauuaaagauacuccaaguaaggcugacaaugcucccccaaacuccauaaacuagcagauaccccagugccagguauaggaaaccuuuagaguuguugcugaagggaguccaagaaaccucgaaacaauguagaucuagcugcugcccuugguacuuucuggaaaaugcccuuuugcugaagacacuauacacuuuggccacuccaucuggaucacacugaggacuagcucacacaguauugaaggagccacauaacguacaagggagaaaagcaaucaauggcacuauccugcaguaucagcaaaccaggaugcccaauguggaagacuccaaaaggugcaauagaggcacuuauauccuggggguaaccagaaucuagcuagacugaaggccugcuccacaggaggaaauucaugccuggcauguaaauuuagcuaccagugguugguuaggucaugaaacacaggagaaccuguuauaaugagucucuagaacaguuaacuguguucuaagaacuuuuccauauacccacagguauguguagcucucacuccucaccaaagaauuucuacugggagaagacagagaucauuacagaaagccacagcuggucacaaagcagaaaacuugacugugccgacccacuuacuacauuuacagcacaacuccuacacuuaaggcuuagggaacaaauuggggaagaaagauuuaauaggccagaggaugaagaaauuugcuaucggguagucuucucuuaaaaccaccaccaccaccaccaccaccaccaccaccaccaccaccaccaccaccaccaucaccaccaccaccaccaccaucaccaccaccaccacccaaacauacaaagaacacggcagggggugaaggugaauauguaugauuaagauacacugcauggaauucccaaagaauaaaaaccaugugaaaaguuaauuaugggaaaacuucugaagagggcagugcuaaugcuaagguccuguucccccauugguucuugauuugucaguaaagaaagcugggagccaauuacuggguggaagguauaggugggauuucuaggucucaggagaagagggcagaugaaaggaaggaguuuuucugccaugcuuuggaggaagaagagugcagcaacccugugagggguccaggagagcaguggccuguggcaccacuacagauggguggccauggauguuugguagggaccaggugggacuagccacucaaaucuggggcagguggaaagaaggagaucauaaauugguaaggacacacuuuuucaggcaggagauaucagcacccagcaauuguaccaagaaggcaaguuauaaaggaacaaacugugugugucuucuaucuguggauucagggaagcugggaaagggcugggagcucggucaucucccagagcaaaggcaguagcuucaaacuacagacuccuaaaugugaggagguuguacaacacuugucuacuuggaaaaaauguauuuaucuuuauaguuaacgccaggcucaggaacacaguggugaauacauuacuauucacuaaauucccuagagccuggucuuuucauaauuuuaaaacucugcuugaacaguguucaaacugaacuaauaaaugcaaaucauuuuaaaauaggaagguuucaaagaauaucuuuguugauuuuagauuacaaaaaaguucucauuauguaacaagaaaucaccaaaguauaaggauaguuaaaacugccacaauuuucacugcccaaagacagcugcauuaauaucccacugaacuuacaaaguuugcauacugauacacugguaucuauaacaucaucaugauguuuaccuguaaauacagaugcuagcuaggaagcuacauuaauuagcuaagcaugguaacacaugccuggcaucccaacacuuagaagguagaggacaguuuaagguugcacaguaagaaaucucaaaauugccuucacucccugaaagggagggaaggagggagaaaaggcaagcaggcuacauuuaccauuuucaacuaauuuacucccucacucaaaugguauaauuuucccaugauaaaucuggcuagaugguaucacuuaauugaauauuguuuucuguuaaauuaaaaugccaucaauugauuugguauguagcuagcugguugagugucugccuagcacaucuaaagccuugguuuugaucuuuaccacuggaaagaaaaaauacaaugaauuuaaccaauccucuacuggugaacgaugaaauaccugucauuuaauacaagguguuguuaaaaaaaaaaaucuagauacagggcugacaaaaugguuuggcagguaaaggugcugccacuaagccugaugacuuggguacauuucucaggacccauguaacagaaggaaagaaccaacuccuacauggcauccucugacuuccauacacacugcuggguguacugcuggcacagguaaaugcacauguacucguguguguacucgcacgugcacaggcacgcgagagugcgcacacacacacacacacacacacacacucacggugcacgcuuuuaaucccagcacucgggaggcagaggcagguggauuucugaguucaaggccagccuggucuacaaagugaguuccaggacagccagggcuauacagagaaacccugucucgaaaaacucaaaaaaaaaaaaaaaaaaaaggacauaaaucuuaaucuauauuaaaugcuccauugacaaauuucaggguucaaaaguuauuauacucacauuaaaauuuuucauuugcuaggcugaagagauaaauggcuaagcaauuacgagcaaugacugcccuuccagaggaaccagguuugauuccuagcaaccaagcaauggcucacaaccaucucuaaucuccagcuccauuccuauucuuugccccucuacacauacacacagacaggcagacacacagacagacacacacacagaguuuacaaagaauaaucauuuuaucauauucuuaccaauaauaugaguauucuccugcccucccucaacaaucauuuucuuuccuuuguuauuagaagcuguacacauauuuuuaugugcuucuuagaaaugcucaaaucuucugaaaauuauuaacaaguauucuuguuuuuuaagaaucagaugguacugcucuuguuaaaauugaccuuuucaucuuuuuauuguuuuucuuaaaaugaaaauugauaaugaacugacacaaaaaagagauugaagauuauuuagaaacaguaaauacugacugaacuaaguuuauucuccuaacuucucugcuuuccaguuguguaaaugacacacucuguauaccuuuacaaugcuggggauggaauuauuuaaacuguucuuucaaacauucaugaaaacaguugagacuaagaauaaccaaaaccguggaaaggguuaggcgugguggcacacagcuguaauccuagcacuugggagauggaggaagacucccaauucacagcccaggcugugcaaugacuccucauacaccucugaaaagggggaaacagagaauaaaacaacaggaaggagaugagacaggaagcaggacacugaucaggaccucaaacuuccauuuuuaaguuucuuuugcuuuuuuugagcauuuacauuuacuuaauuuuuuauuuuuuguuuucucuucaauuuucuauuagauauugucuucauuuacauuucaaaugcuaucccaaaaguccccuauacccuccccccacccugcuccccuacccacccacucccacuccuuggcccuguacuggggcauauaaaguuugcguguccaaugggccucucuuuccaaugauggccgauuaggccaucuucugcuacauaugcaguuagagacacgaucuccaggguacugguuaguucauacuguuguuccaccuauaggguugcagaccccuuuagcuucuuggauacuuucucuagcuccuccauugggggcccuguguuccauccaauagcugacugugagcauccacuucuguguuugccaggccccggcguagccucacacgagacagcuauaucaggguccuuucagcaaaaucuugcuggcaugugcaauagugucugcguuugguggcugauaaugggauggacccuggguggggcggucucuggaugguccauccuuccauaauuuuauguguguuugugaguaugcauaguugcaugugugaagguaaagggauaacuugcagcaauuugcucucuucccaccuuguguauucugaggaucauacccagguugucagguuugguagcuagugccuguacccugcagaccaccuugccagucauaccuauacaauuuucuagaacuaccuugcugacacagcacuuugcuuugccucugcuugcacuuccaguccccuuucccugcuuccucuuuuuaggcucuucaugcagauauuuuaaaggucauuugugugugugugugugugugugugugugugugugugugugugugugcgcguaucuguguaugcacgugugugcagguacccacaggucagaggaggaucuguggucaccuggagcugagguuaaaagguguucugacuucugagugcuuggauccaguccccaggccucaugacuauacacagcaacugcuccuaacuacugagcuccuucaaagauagaaaccuuaacaaggaaugcuucugaaacucaccauagaguaaguacuguuuggaguuugucuguugggaguuugucuaacagcauuuggggaaucagaagacuauuucaaauauuucaaaauauacauggcagaaaaaaaacacaacagaacuaaacaaaagacaucaaaucuuuuuuucuaagucacuaauuccaugaaaaucuaguugcaagcugacaaagaauucaaauuuggauaagggacacuguuaucuaucacucagaacuguaaguaguauuaugaaaauacagcauuuuuaugaccuaccaauuuuaaaaaaauauugucuuaguuaggguuuuauugcuguuuagaguaccaugaucaaggcaacucuuauaaaggaaacauuuacuuggggcuggcuuauggcuuagucuauuaucauuauggugggaagcguggcaucaugcaggcauggugcuggaggagcugagagcucuacauccugaucugcaggcaacagaaggggccuaugugccacaaugggcauagcuugaguauauacaacuucaaagcacacccccacccccaccccagugacaaacuugcucugacaaggucacaccuguuaauacugcuacuccuccugggccaagcauucaaacacaugagucugagggccaaaccuauucaaaccaccacagaugcaugaguauuuugacacaaguauaugcaugcauacacacaccccuauaugugcacugugcaugacugguguccaugaaggccagagaggacaucagagucacugaaacuguaguuaugacaacugagggcugccauaugggugcugggaacugaaacugggguacuugcaagaucagcaagugcucuuaaccacugagccaucugccuagccccaaauuacuaaauuuaaaaaauagguuuccgagcugggcaugguggcacaugccuuuaaucccagcguuuggaagguggagagaaaggagaaggggaaggggaaggggaaggggaagggaagggggaacauagaggcagcuggaacucucagucugaguuccaggauagccaggacuacacagaaaccuugucuaaguaagugaggaaggaaauacucugccaccgugggaucugauguguccuccaaguccuaguuaguacaggaucaguucccaggggugcuaucccagcacggcacuguuagcaacaggaccuuugagagcuggacuucacgggagguguucaggucaguagcaguguguccucacagugggagccuagcuucuuccccuacuaacuuccuggccaagagggcaggcuuacuguaauaccugcccucaucacaggcucaaaggcaacagaaccaacugucugagaacugaaauguauaaaaugugaaccaaaauaagucuuuucucuuuguaagcugcuugucucugguauuuuguuauaguagugaaaagcuaauaaacuuucauuaugguaaaaaggugucaaaucaaugcaagacgccauguuuucucuuucuuuuuaaucuuuuaaucuuuuuacaguccaguccuuaucccccucucgguccacccucccacaguuccucauucuauuccuccuccccacucuccaagaggaugucccaccacccauaccccuggcaggccuccccguucccuggggccucaagaugccauauuuucuagugcugaauacaauggacagaugaaagaauugaaugaagucaccuaucuauaucacugaaaauccaucucugguaaauuuuuauuuuaauauuuauuaaaaauguugauuccuguuuuuaaauuuuucuacuauuauucacuuucuacuaguagucaugagugcugcaauaacucagaccaaaauaaaucugcaauugacacagcccuguggacucagggaguuuagguuguauuuacauguuuuugacuucaagacagagucuugacccagacuagccucagacucaucaugcagcugaccaaccguaaacuccgauccuccugccucugccucagacuacaaggauuauaguugugugucaccauauuuuuauguuauaauuguguccuagaauucagaacuuggugacuggggaaacugaagcauuucucaucaccauuuacucaguucauaagggacuuucaacuuucaagcucacuuuauuuguagaaaaaauauaauagaugauuaauaaaaauguuuucaagucuaaaaggauauauugggauaauaacauguaaagaaaguaugaguucaaaagagaaaacagaaagcugauacagucaugaacuggucauguguuuuaauggauggagaauuuuaacaagacccaucuuaaguugugaaauaagugacaaaccaagcacuuuauaauuacaaauacugaggccuggaugacacuccucggcguguaagggucuugcagcuguaacggucucagucuuacacgaggccugaccugccuccucacuguuguacgcuggacugauucccaaaugucagagcacagcggagcagagggccuggggaugcagcucaguggaggagccuugucugcucugugggaggcccuggcuucaaucaccagaauggcaaagugaguaggcagggagacaggcaagggagggagacuucuucccaccgggaucugcuacaaguucucccaaauuuaaaaaguaggacgauuggacccucccagagacaaaagccucacaaagccugacuccuagccaugcaguccucccacucugcuggugccauuuuaaaggccaucccacuagcucugauggcauagcucuuauucccaacaauauauccaugcuauuucccagccucucccucgcaggguaaaacagcuguacagcgaccugguggacuugaguuacccagaggauaauuaaauggugacuccagaaggaaacagaggggucaguuccucgacaacagugaugcuccagugucuuucaagccgcugucuccaucaucaccauagcaaagaauuuacaaucccauaaugcagcugacugagugccagcaaucucacccgcauacagcuggugaaaagaagaacugacaaacugauaacauaaacugaauauguaaacuucuaaguaaaaaaauagaaauuacuuaaaaguccaucauccugagacaguguuagcaucuggagcgauaccuagcuuugucuuuaugcaagcuugugugugugagugagugauagcuuuauacauuaugagggcuuuucucuuuuaacuuuuagguuaauuggaaaauucuagguuagcucagauuuucuccacuuaauuauguuuuaagcauuuuacccauacaauuaaauguucuuuaaugcauuuaguaacuacaacauuagaaaauuaggaaaaaauacuaaauauacuaaaaauacuaaauguauuuuugcuguaugcuuuacaccuucaguucuucaaaguguuuaaauagcuguauaaaauaaaaaugauuuaauuaccauauucuauaacaauaaaauugaacuuagccaugagaaauuguuauuccuaauuuuucauaaugacaaauaaugggauaucuauccuuaacaguucaucuuuaccaacauuucuaauucuaauaacucagguuagaguccugaaaguaaauucgcaaguaaaggcacuaacuuuauaagcauuuauuuaauuuaguggcauccugaagagacacacaauagauuauaacucagauacuauuccauaaauacaacccucuauuuauaaaaaagaaaauuguaaaucugaaguuaaaaccagccauccuaagaguaacagugucaccuuugaccagccugugaaggguguggcccccagcagacacugcagugaugugggcugcccugaacaaagcuuuacacugagcacaaacacugcguguggauguuagagcuggggcucugugcugugcagaggccgggcuggaggcuagcuggucaggacagcgagggucagcgggagcagcuguuugacgguggauucagauaugcuugaguuacagacuggaacguguggcaguuagcaccaguggccuuaagguugucgugacuuucucaugcuuggggaucuuagugguuuccuuuccuuguuagacguagugcuggagcccgggagugagugaggaagcugagacuuacuuggggugaacgaaaagccccauagcuuccaccgucuugcagggacgagucacucugggugccacgcucaauucucauguucguguuuuuagaaaaaaaaaaaaacugcuaauaaauaguggauguuuuacaauaaaguuguuugaugaucuuucccuaaggccucaaaaaauaaaaaacaaaaaaauacagccucuagaaugacauacuucccaugugcucugaaaagcccagagugccgggcgugguggcacacaccuucaaucccagcacucgggaggcagaagcaggugaauaucugaguucgaggccagccuggucuacaaagugaguuccaggacagccagggcuacacagagaaacccucucucgaaaaaccaaaaaaaaaaaaaaaaaaaaagcccagagugauccaauguguuucauucauuuuuuuuauucauucucauaggccaucaaaauucauacauaauccaugaaccugaacuuccgacuacaguccuuaccuucauaggugaagcaggucaauuaguaaaaggcaauuggaacaaagaugcccaucaaaguacuuaacggcccagagcucuauuacuacugggcacaaauaggagcaaugccacuuauuuuacagagacuauuuauaaagauuaaaagcaucagcuaaaauaaaaaaaccaaacaaacauguagguguuacuccgaaaugaacaguaauuauuauuuuuauuauugaagcaagggcaaugcuucuuuauuaagcaccguuugccaaguaccuuuaaugguucaaaccauucaaaccuuugagacuuugcugaaacucaaguuaccaaguuagccguuaucuucugaaaaacuaagguccaucucuaccaguagguggggccauggagcagcugaacccuucgucaacuacaaaaguggcagaacaagucccuuacaaacugagugccuacugucccuaucacaauucauggguagcuuugugaagagugaauguuaacaaaaauuuugcauaaugcacacuuacaaagugauacaggauuaggaguaguuaaaaaggauugcaaaauaugcaaaagacauuucacuauaaaaaugcaaauaccuuaaacaccacuugagaaagcacacacucuugcuuccccaggcgcagcccaucuacuacagggacaaauacguauaaggccuggugacauaugaagagagauuaaagcacugugacuauuugucuugguacuaugacaggacagaaacuggacagaaagccaaaacaauguucuuacugucugacaugagcuagugauugauuccaaagacuuuaucuagcaggcacgaaggcauccauuaaaucgaaucuuauguacaccaccuaaagcuugacagaaaaugugcaacaugugaagaaugcgcugcugauccaucaaccugacucucgcuaacgaucaguaaacaaagauuugcuguugcuuugcuuugcacuugcuuugcaguuguuuuacucaaacucaacuauaauuucauggcuugagucauacccauauuucaacugaccaccacuacaccuacauaguuaguggcuaucacagugaucacacuggagaguucagaguacagaucucgcuacacaaugcacccauucuccccucuccccuacauuuacuaauuugucuagaaacaucuacuuaaucuuuaguccuuggguuaaaggucaacagcuacccuggguuaccccaguuuauuccaggauccuaggugugucaucacacuuaguaacuccaguucaguaacuaccccacagauauuuuucuucccucaaucgguaugaggguaaaaugagagagagaaaaaaaguuagggcaccaagaucaaaguaguuuguuuuucuuuuaaauuaugaauccuuuaaauuuucuacaaaauuuccuuagaauacaaggagucuuaggguucgguauuuacaagaguuuauguggguuuuuccuuguaugaaauaguauauuugaaaaacucauucucacacaguguugcauuacugcaauuccagaacuucagaaauaaaagcaggagaaacauaaguucaaacuccucagcuauacaguaaguucaagauuaggcuggcuaccugagaccuugucucaaacaacccaacccggggcggggaggaggagcgacacugcacaagagcuguugugguauucauccugggguucugaagacaaagccagaaagcuuacaggugugaagacaguuucaagcacacaguaaguucuagaccagcugguacaacaaaaugagacuauauguaauagcuugcauccauauucuguauccuaauacuuuauucacuaaaauaauauuuuguccaguaaaaacacuuacacuuuuaugauguaaaaauuaaaccucaaauuacuaacccaaaugaaauguguuucuauaccucuaucuuuucuauugcuaugauaaaacacaugaucagagcaaccugauuuguaguucuccauccagggaggcugggccagagcacggaggcgggaauaccugcacaggccauggaggagugcugcuuacuggcuuauucucauggcuugcucagccugcuuccuaacaguacucagaaccaucaguccaagaguggcaccaccuagagugaacagggcccuuccucauguaucaucaaucaaaaagagugcaccacagacugcccacaggcuaaucuggcggggguacucucucaaaggggguucucuucucccaaauaacgcuaacuuccuccaaaucuaacacauuaccucaauuuucacauuuacugaaucauaaauauaugaaacaucaacggugaagacaguacaaguuauacccuuuuuuuuucaaauaugaacuuuguucugaaagacuaauguuuaaacuccucuauguaacaggcauucaaaacggcaacaaauagguuucauuuauuaaucucauuggucaaguaauucagaaucuccuaacagcucuuugaaaaguaucauaugacugguuuaagauccaaugucaaugucuaaaaaaguguugcagagguuuucaccagguacgcuuuaccauuugaacaaaaacauuaacugccacacagauuuuuuuuuuaacagaauaaaucuuuuaucuuggaaaaucugacucuaugcagcauuuuuuaacaaauagucacuuuguuacacaauacucaagucccuaagcuacccuacaguaccuuuaaaaaucaugcuagcuugugagacuuuguuucccaucucucccuugugguaugucagcugucaacuagcacuucuacagggugaaugaccuauagcugcuuguaauuccauuucagauuaccugcugcuuagaaaaguuugcucagccucguuggcucugagaugaugcccagaucuauguugguugcuuagagucuuguuuuaaguuuuauuauugugacugugugugugugugugugugagagagagagagagagagagagagagagagagagagagagaaagagagagacugagacuugauacuacagcuaacauguggaggcuggaggagaaccauggaagcaguucuacugccuuuauauggugccugaggacuggacuuggguggccaggcuucugugaucugguaccaugugccuuugcuaucugcgcaguauuuuucugcacguugucugggucauuuuuagucuacaauuacauguuugaaaccaaauuuuggauaaaugagccauuacuguacauauuguaccacuguuucauguuuaaaauugauacucaacuuagucugagguacucucaucuauucauucccuuaaauauuuauuaauuuccuacuaugaacugcacucuaauacugaagucaaaaugaacugaaaugauaacuaguuuugaauauauuuucaaauagaaaauuuguaaauaaauucuacuuagaaacuaaagaaaaaacuuaaauacauuuuuuuuuaagacucuuaaauaaaaucacaaaaccaucuaaacuucuuccaaauucuguaacguuuagcuuaggaaccaacgauucaaggguauggcagcuugugagucaaccaaaugcuuguuuuaaagagcacugaauaagauucuaagauuaucuaccucguuuuucccaugacauauugccaucuauccccaaagcauucaguuucacuacacgauuuacuacuaagugauacuaagugaugguaacccaugucagcucgagugagguacccuguuauguucaccaggaaaaagguauguauucacuaagaaaaguucugucucagccuaaggaguucccacauacucucuuggagaucuggaaguuguuuauaaguuuuaaaagcuaguaaaaucgguguaauucuauagaauuugugguuuguugccacagucacaguuuuaaaauuccacuacccauuuaaucuuagucuaggggugggcaaagaaaacugaagcuuaaauuguuuuuugugugguaauuaagauacuagguaaagcucuuggggucaguuuuguuuucaaucccuugaucuucccucucaggaagcagggacauguaacacauauuucauaacuuuagauaaagugugccuuacuauuuauauguaagugaaaguggguguucgucaugucugcugaucucaggaagaaaacaguauuuagaaaugaaaguuacuuccauuaaagaccuuuaauuacuauuauugaaaaccuucuccugagugcuuuaauauauuuugauauuauucuggaacuuuaaaacguguuaagcaauaauaaaaaauacaguucacaaacuacacuucaaaguaacaaaaguauuauuugaaauuccacuuaguauuuuacacugaauucuuuagcauacuaccuuguaucagaagagucugaccuuaaauaaagaagaacucuuugaaaggaaacucacacagaaccuccugcucuaucuugcaggccaaaaaggaaaaagaaaaaaaggcaaaugacaaauagaauuuacuggcgaucuacuauaagcaaaaucucuaaaagaugcuguccauucuaacugucuuuaaaauuuccuuucuuauaauacaauauaauugaagggagaaacagugugcuauaaaggguaaagaaauacuaagcaauagaaaaaaauaagaauacuuuauuuuacgaaaugaauacgggaccuagggcaauggcucaggccugguacuuggaagucugaagcaggaagaucaugaguuaaaggcaagacugaacaauuuagaaaggcccugccauaaacaagcacacaaauaaacgaaugaauggauggauggauggauggaugaauggcugaggcucacugauuggagucuagaccagcaaauguaagcacacuccuccaguacccgucccaaaaguaaucucauaaacacagaacuucuggcagcaggcaaugagggcaccagguucauauguaaacaaaguaaaauucuuccucuuuauucuaaaucuggcaaccaaauuuaacccaacuaaagagcugagccaaggacgucacagaaaaaaauuuuuuuuuuuuuaauguucaacagcaacugguguugggccaucggaaacaaaguccuuugugaaugcucaucagugguuucugaacuaaagccgccuuuaucaagcgagaaaacugauuggaaaccaucaacuuugcacacuaguuccugacaccuaggccccuucccuacaaagcagcaguucgcaguucgggugaggaccacaaugggaccacuaggccuauuguucugagaaacucagcacccgcagcgcugcaaggcucgagaaccugcacaggugugggggagggcuaggggguggggggcgaaaaggugagcucagggucaugacuaaggggacaagaggcccaacugguaggagacacagagaaaggaggggaggauaaagucauggcuuggggcuaccagcgggcgugacggguuagccgcggcgagggucgcagaggccaggggcaccgagcacagccgagggugaaagacuccgggaaggggaggccagccuaccgaggcgggaacaauggcccgagucccuccagaagacaaaagcaccgagcugcgggccccggggcggcgguuaccugcgagagcugccggggaugcgggcagccgaagagcgcggagcuggagcugaagcugauggcuccucggcggcugaggacgugcugggggaccggccuguccaggggcagcaccggcagcugguagcauacuuccauugaacacguccgccuuggauccgcgcggcgcccgccaguccgcggucgcccgccccugcgcuacgagggggccgcgccgcggggacccggggccgaggcgcgcgcggggcgggcggcgcuaguggccgccgacgccucccggcccuccgcgcggcuggcggcgggaagggcugcagcgggcucgggaagccgggcgggcggcguuaaaggggaacccgccgcccaggcgcuccgcggcgcgagagcuggcccgggccgcgagcacgggcgcggagcguagagcaguucggccgccggagcccugcccccuccccucccccga

SEQ ID NO: 1364 - RNA, 2744 nt, Mus musculus
ucagaccuugugagaaugucuuuauaguccugaugauccuggaacucaguauguagucuaggcuggucucaaacucacagagcucuuccugccucucccucccagauacugagauuaaagaucugugccaccaugccugacucacuggcauccaauuuaagguuauacuuacuacuuuccauauggugaugauaugccaagucaccuuuuaaaagaaucuuggggcuggcaagaugccuuugcaaccaaagcagcacacaugaguuugcuguucuggacuacaugcuaggaagcaagaaugacuuuugcaagcuguccuccaacuuccaacauguguaccauggcaugcauaccugcauauauacgugugugucuuugucuguaaaagaauccuuaugguccagcaagauaggucaugaggcuuuugcaggaagugucuucauuugcugaacuaaguucaauucccaagaaaggugggagaacugauuccccaagguuguccuuugacuuuuuacacacacacacacacauacaccauggcauaugugcucccaucaugcauguuuguuucaauacacaauaauaaacaauauuauauuuaaaaaucuucuuuguggccuuccccugccuucaugacguucucugcaaguuguuacauguauccaucgauggguucuguugacagugguuugaugaguuguuaguucauucuuuauuagcccuuuuaaauauuauaaauucuuacugagagauuaguuuuucuuuuucauauuuaccaauaucauagaguucagaggauaacuagaaucacaugcauguuacuguuaucugugaugcaguaaauuaugagauuaaaucccuuuaaaauagucaauuuaacuguuaauauagcauauuuguccuguauugagucuacaaaauccugagacauagaauaagguauauauacuggagcauuuuuggcagggauggggaaauaagcauaguaaagauggggauucagacagcaggaauaaacacuggcugcaugaguguggggauggagagccauagacaguacauagaauguacagcgugucucaaggcuuguggugcuugggaaauuguaggagaaagagacaagacaacauggcuuguuguggugaaauguauccaagggauggggaucugucuuugaggaaauauggguaaauuaauguuuaaggaaaaagaagcuaaagacuuagggagcuuuuucccugugaccuaugaggcugugguucaugaggaaaaugggaaagaagcacauuaaaauguuugggaagaguaacagagucuuacaacaggugcuuugcagagugaaagaggccugucccugacagcagugaggccacuugucugugcgugucagcugcacaguuaggaggugugugcugcugccugcccuccaccagcucucaggucucugcucaguacagaaaagaggagagcuuuugucagagcuucagucuuggggacugugaagaggagacuguccucuccaaguucuguuccaguaaaaauaaacacaauuuucagaagguuguagccaaaaauuucugcugugguucuauucauuucuaugaagugcuuguaaaguuagauuggcuuguucacucuaggucaguuuucccauauucuacuauugaguauuaguuuguuguccaacguguuuaaccugaaaauccuuaaaaguuuuuaucuuucaguucuuuguagaaagcugaaacauuuuuuccuuaguguagaauggagagguuaacauuuaaaguguauacuaaucaaaguacagagcuacaggcauuggcagagcaaagugggcuuggauguugcuuccaaguccaugcucgcucggagucuccgucuggggacagcagucuucuggccuugcaugucuuacuaauauggccucuccucuuucuuucuaggaaauagucuaguaagccuaaccuuucauuuauuuagucuucauggauugauugaguacuuccauuuagauauggugaaacuccgucgguuuuuagguaagugauucuaauacauuuaacaaggcuguauaagaacuugcauaacugucagucagcuguaacaaacuaucaggaucauagcuuaaagcacgugcuuguagcucuucaagacauggcaacaauuucaucagugacaggcaccaugugugauaggccauguaucagcuggcuuugcaguuaaaaaccaugugugauaaaccauguaucagcugguuagcagucauacucuuuuucucauggucucugcuguggcaugauacugaaauaccuggugauugguugaauugaagugacuguuuuagaaugugaacuauuuaaguugauaaccacaaggaaaauauacguggaucacuaaugguuaccacuuucaauauucggaugucccucauguauacuaaaauuugaguuuuuuuuuuuuuaaaugcaguuaugauucaagaagauuaccacagucaaaauccuuaccacaaugcaguccaugcugcagacguuacucaggccaugcacuguuacuuaaaggaaccuaagguaggugguugaaagucgccagacaauuucuguggacacagauuuccauaaguuaguaccucagcucagugucugaagcuucugcuaugagagugagaucaaaccagauuguguuuccagauguggcuauaaguagaagaacuagagaacgggacccagagcucucaaagc

SEQ ID NO: 1365 - RNA, 872 nt, Mus musculus
uaaagcuucggaauauaaaacuggauuaccucaaaggccugaaaugcagcagcuaugaccccuuugcagcuggagccaccaacagccucucuaggugcaauucagaugagcgcaaucucucuaagaaacagagagcauccacuauuguguaccacccggagggagagucccgcacugcucccuucuucucuauggcgucgucccugaacuuaccaguccuggaaguuggcaggacugaaaacagcagcuucucuucagccacucuuccucaacccggggacccuggggcucccccuuugcccucagaccuuccguuggaagaggggggaaguuguggaaacucaagugagauguuucuccccuuacggucaugggcucuuucacgccaaugauacaucaccgccuagcuguuuuacuagugaugcaaaaugcugugaaggaggccaucuuucuauacaaaccauggugacaggucacucacauucuauacgugccuuugaaaucaguguacacauucucuguaaauaggauuuguuaggggaaagaagcacucuaggguguaaaucaugguggucgugacuuuuccauaacguccuuucuuuuuuauuauuuuuagguguuugcguauuuugaacuuuuuauaagacugauuuuaucagcauauuucucaauuugagaaaacaacuuguggauugggaauaauguuuuuuuuuagcacauuuaugcuacaaauuuucagucugauuguuuuucccacugaucuggcaguacauuuuagcaguaagcuguucuguuucaggaaagcuggacacugggaaagcugccgacacgcucaggagagugucccacuccuuaguucugagaagccgucg

SEQ ID NO: 1366 - RNA, 1998 nt, Mus musculus
uaggcaaaugcugcgugcuuucugaagagggucgacauuauaaaaucucacuccaggcucugguguggagaaacucagagcccaaguacguugagagacugaagagaaagggaaaaggcaaaagaaaaaaagaagagaaaggagaagaggaagaaaaccugcaggaggcauccugagagaagucccucugcagaggcagcagugcgggcucaccuaccaagggaggagaagguaggcagcgccuagacgggcgccaccaacuuugugcugccugagcugcuguggugagccccggagccagcugcccaugugcuggaaugccugugccuaugcauguaugugugucgcuaacugugccuuaaaauuccgaugacaguggcgauuugaaaaagcgaaguuagacggcggcugcucaucuuuauccacucaauccaaucugccacucacugcucauagucugugcaaagaauggcuccccuauugcaucccauguccccaagcaaacggaguaagggcaggaauggagacagagaagguuguucucaauuuggcagaaaaggauguccgaaagggggcgauuagggugugcgacagcuuaaaccuguggcacuuguccgggcucagggaagucgguuuagggaagacguuugggagguccuuaggaagaggagccagggguugucccuucuaggucuccaaagaagggucaccgcgggcucgcaccaguugagcuuugcagguaccuagcuucagcaccgcggacagcgucaccgaagccuagagccugucuugucuguggguguccgauaggaagccccgcugcaccuuccagcugagcuaaacucugaccaaucuuaccuuucucccccaccuucucucucccccgaccucaaccucggugcuucagagagcgccccuaacaugcggcugcggcugcugguguccgcgggcaugcugcugguggcucugucguccugccugccuugcagggcccugcucagcaggggauccgucccccgagcgccgcgggccccgcagcccuugaauuucuugcagccggagcagccccagcaaccucagccgguucugauccgcaugggugaagaauacuuccuccgccuggggaaucucaacagaagucccgcugcucggcugucccccaacuccacgccccucaccgcgggucgcggcagccgccccucgcacgaccaggcugcggcuaacuuuuuccgcguguugcugcagcagcugcagaugccucagcgcucgcucgacagccgcgcggagccggccgaacgcggcgccgaggaugcccucgguggccaccagggggcgcuggagagggagaggcggucggaggagccgcccaucucucuggaucucaccuuccaccuucugcgggaagucuuggaaauggcccgggcagagcaguuagcucagcaagcucacagcaacaggaaacugauggagauuaucgggaaaugaaauguugcgcuuggccaaaacgauucugcauuuagcacacaaguaaaaauaaaaauuuaaaacacaguauucuguaccauaucgcagcuccgauaucauuuguuuauuuuuauauagcuugaagcauagaagauguacagggagagagccuauauaccccuuaauuagcaugcacaaaguguauuucugugucguaacaaaacagcguuauuuguauugcccaugcuuaauuucuaugugcaaauaagcgucuuuauagcgauaucuuaaagaaaauguggccccaaggaggaaaccuuugaaaaagcagaugggagucauccaguuguuuuuauuuggagcugcaguggaagagaauucauucuugagggguggcuaggacgaaauguguaagcucuuugaaucaacuuuuucuuguaaauguuucaguaauaaaacaucuuucugauucuuggucaauuugguuguguaagagaacguuaaauauauuuuuaauaaaaucugcaaagguug

SEQ ID NO: 1367 - RNA, 2938 nt, Mus musculus
uaaaccuuggaccuuucucaauacauuggggucuugauacaacuucagaacgguuuccgugucguuauucguacaagacccucgucucucucuaccccccauuugguucuuaggaggagguccccucgagauccucgaauaacuggaccugcuggacgggucaaguggcgcccgauguggagcacgagguacgacugcccuccggacaacggauuaaggauuaaagagguaccgcgcagacagagaaacagugggacaguccaccaacacuucacucgagugucgaguacggacgucgggagguaagccuaggcauucaguuguugucccauuaaccauggggcauuuagugaagagauaaaggguucucuuaaggagagagggauaagaguuuuuuaaaaaggggaauuuaauaauauauuuuuguuuuguggacaagagauguccauggcugguauuaaaugguucugaaacuuagaauaaaguagacaaagaaaucaauaguuuaauaaaacaaggaggagauguccaugaguccuuuuuuaguuauuggggaaucaucagagaucuccuugagcaggcagaaaagggcggaaaaggugcucgccuccuagcccuuacugaggauuuuuuuagaaaacucccaaucgccaucucacaaaagcaaaacuaagcugccggcgcacaguaucucuauuggaagguuuagcagaaggcuacuugguacccaauaaaugaaauaaaguuauucagucuguccucacuagaggccaauauuuaacuugaaagucagaguuuguggaagacaaccaccuggacugcugauaaaaucugugguuaaggcaauuucgcugcagacauaaaacaauuagggcucuccccuguuguccucgcccagacagcacaagcggcccugagagcuuggcgcgcugucccuacaacaagggcacuaacuaugccccuaaccaagauuauacaagggccccaagaguccuaugcgcaguucguugccagauugcaggaagcagcugagagaauuuugggaccugaggaaagugagggucuguuauguuaguucgacaacuugcucuugaaaacgccaauucagcauguagggcugcccugagagguaaaaccaaaaguuuagauauaaaugguaugaucaagcuuuguaaugagguagauguguuuucucaacaaguuucuaagucuauuaaccuggccauugggacugcucuaacuccagcuccaagauuggugucgaaccccauuggcccaaguuagaaguagacaucuguguccucacauugggugcagaugccgccuggggcaccccugauuauuauaugccucaauuaauagcaguuaacacagguaaauuugggcccccuccccaaaagacguuuuuucucaucaucggccgaguguccagacuuuuacaaggccuaauggugacuccuacagugguuaacaccgacuaccauggggagauaaaaaucuuagucuccgccaagcagggaccacuuacccuuagggcuagagagcacauagcccaagccuuaccacucccacuauucggccauuucccuuauaugaaagaggagcgaggaccuuccucccugggauccucagaagucuacugggcacagaaaauaacugauucauggcccaugcugacuuuguuucuagaggacaaacaguuucaagggcuccuggauaccggggcagaugcgacaguaauuuccucaacacauuggccuguagccuggcccuuaacagcccacuaaggaaugguguaauccacugaucauaaaauuuacugcuaagaggaggaacuuagaggcuugagaaaguucucgcccucucaccuggggccuaagauuguaucaagauaacuaugacaauggccugaccuuuaaaaccaucccuaacaaucauaaaggauccauaggacuuccagguacccaccucccuguucccgccccagggugugcuacgacccuguuucagcccacucucccugcggggaggccccccucuuccacugauuuacuguggucuauauugaaugcuucugcuuuagccuuguugcauaagacacaaagagauaaugcgucagaaucugaagauuguuggaugugcuuuucugcuuccccgcacuuuuaugagggcauagccuuauuugaaaauuuuacccugcuuucagacacuaggcagcuuccccuugagucaguucagcuuaccuugacagaacucucugggguaagaaguuguguguugggcccagacaugcuucgaggcccuugcuagagauuugcaauaacauguuuagaguaaauaaaaauggguuuuaaagagacuucguaaaggucaaaaaauucauagauuagguuuuauugaaaguuaagaaaucauuuccuaaaacuauauaauucauuuuaucaaugguguuuuuguugguugcaaaaaauagagagcguuuuuacagauggcuuuaaaauauuuaacuaaguguggaccgauaauggcuucaaaaaagauuuagcaugguaaacuuuuaggcuauuugagacauuuaguguauagagauuguguguuuucucaaaaauuugcccucagauuaauuaaauaaauuagaaguuuuggaugcuugccagaagcuguuagaaaauuuuggauuuuaaucuugguuugacaagcugccucuuacaagcaggaaaggaaagaaaaaaauagagaaauggauuuuaaaacucucccagggacagagagaaaucgggggacgcccuguuuuauucucucuggccccuacaggagaagcucucuacccucuuuugcaccaaucacgucaauucauguauguuuuuugucucguugucuaaauaauuguuucguugucugaaugacuggcuguuuuauguuucauguuaaaaagaaa

SEQ ID NO: 1368 - RNA, 1584 nt, Mus musculus
ugcuucucucucucuccuuucuuuuuaucauagcauucccuagggugccauuccagcagacaauccucaaauggucacauuuuacuuuuaguucacagaucaucaauauuuaagacaaugaacaugugccucuuaaaacaucuuacugaccaccuuucauccucugcugauggaagcauaaaauggaccacucuaggaaggaugacuuccaguguuuaaaauguuuacaaacacaucuagacauuccgaugguuuacagcacacccuauuauguuuggcugggcaauaccuuuagcuuccuacuguuggugcagcagaagaugcagcaguuaauggcugcuucaucaaaaguaguuuuauggucuuucaagaugcuggaauuaccuuuaccuugccugauacuguugcauacaaaacuccaaagugaaaugucccuuuagauuauaaaguauaaacauauaaacuuuauaugccccaguacaggggaacgccagggccaaaaagggggaguggguggguaugggggacuuuugggauagcauuggaaauguaaacgaguaaauaccuaauuaaaaaaaaaaagagagaaaaaaaaaguuucuuuauagugccuccuucauuuuccuaagaaaacacacguagccccagccaccaccucggaccuuacaacuaauguuggaccagucugccuuuuucagcaagagcuauaagguuguauuacuuuauggcuuucuucuaccaagggaaaaaaauuucuuuaaacacaauaaaagcgagaugggagaaggaaauucguaaguucucauucagauuuccagaacucagggucucgcauacacggaggucgcuaagaauaaauagagucagggcucagcagaggaaaugcagguaucccacccagggcuccuacuggaguaggcccuguuaggcauuccaucagauagggagcgucugaccuauggggacauccuugaggaguuagggcaguggcuagaagaccucuuucccccuaguccgucagaaccuugagcccuguggcucacucaagaagccucgauguuuuaccgugcaaggcgucucggacugcggaagaaccagguagaacccggacgcgccgcacugccuuugaaucgcagcacugggcggagcuccccacccucuuguauugugauugguuggucuucguagacucuuccuuuggauugggcccuggcggugccgaucgcagaacgucaccgguuucucagacuguugcaggaaggagugguguggacacgucucaccgggcggacgcggccuggcgguucugauuuggauuccggcgccugggccacgacgccuugaggagcuuuaucaggcugucugggaagaucuggggagcccagggcaucccgaagucaccccgccccgcgccauguccuauacguucacgaggugaagggcugaggggggcugggcgugaggccaauugcucugcgcucuauucuagugaaggugcgcgcccgggcgcuuuauaggugcaguuugcaucccuucugcgggucgcuugccgguguugcuccuggaggcaccaaugcauugucg

SEQ ID NO: 1369 - RNA, 1081 nt, Mus musculus
ggacuguuaauagcgggugguggcugcugagcgggacgcagauaaccgcugcccgccccgcggacgucuccccgggcccccgcuuucugcacguccccggcgucggagcuguucagcaugucuguggugccgcccaaucgcucgcagacgggcuggccccggggggucaaccaguucggcaacaaguacauccagcagaccaagccccucacccuggagcgcaccauuaaucuguacccgcuuaccaauuauacuuuugguacaaaggagccccucuaugagaaggacagcucuguugcagccagauuucagcgcaugagggaggaauuugauaagauugggaugagaaggacuguagaagggguucugauuguucaugaacaccgccugccccacgugcuccugcugcagcuggggacaacuuucuucaaauuaccugguggggaacuuaacccaggagaagaugaaguugaaggacuaaaacgcuuaaugacagagauacuuggucgucaagauggaguccugcaagacugggucauugaugacugcauugggaacugguggagaccaaauuuugaaccuccucaguauccguauauuccugcacauauaacaaaacccaaggaacauaagaaguuguuucugguucagcuucaagagaaagccuuguuugcagucccuaaaaauuacaagcugguagcugcaccauuguuugagcuguaugacaaugcaccgggguauggacccaucauuucuagucuuccucagcugcugagcagguucaauuuuauauacaacugaauuccuguaugcagaaguaaaagaagccgucucuaugagcacagcuuacauguguagaagaguaacuguagaacaaguuuugguuuucucuuguucccuaaauugccaccaccuuccuguuugaagaguaaaaugaauaugaccgagauagugguggaaacauguggcaguguucauuagcuuuugguucuacucauacuuuuuuuuguacauuaaagaaagugaauuucuuauuuguauuuuuuuuuaaguuucucauuaaacucugaaaagucuuaga

SEQ ID NO: 1370 - RNA, 9648 nt, Mus musculus
uagaaagaaccuggagcccacauaagagcaagaccgugaguguggauuuaacaaaaaauaugaaaauaaaaaugagaaaugaggcuagauagaugcuuggcagucccuggaauuguguuuaaagagaagaagucacuaaucaguugugucaacauuacaugauccuacaugcaucauuaagaggcaagacuaggcaggagauuaaaacaguucaugagaaauucagaggcaucauuaaggaauuaaugagaugggaauaugucuugcuugcuuuuccuguugaugugaugaaaaucacccaacaaaaacaacuuccagaaggaaggguugauuuggguucacaguuucauggcagaggcuauagugguggggaaggcacaguggcaggaacuugaaguggcuggucaaguggcacuugcagucaggaagcaaagagcuauagauauuggugcucugcuuguuuuucucauuuuuaucuuuccagggccucagucgaggaaauggugccacacauauugauggguaagucuuucuaucucagugaaccuuuuuuuauguuuuauguuuuuauguuuuauguuuuuuauuuguguuaacauaauacccaagcaggagggauuuuagaucaauuaggccaaccuuuuaccaucuggaaaaaacauaaagccuccuugggaaagagcccauuguuguuccuggaagagaaacuugguaaugcuguaaaaaucaaguauaaaagacgugucuuaaacccaggaaaggaguauuuaaaagguaucccccagagucauggaaaagcagcccuucacugcagcgugugagaagagaaacuugcuuguuaaacucaggagcccagggaccuccucagagaagauuaucuagccacuaaggcggauucaaagucauaggaaacacugagcacuggaugcugugagcaaguaugaauccaagaaucccagaaggacgcucuccaggugcaggagacuguggcacaacaauugcauuagacuggugaaguaaacucccaaaauagccauccucaccauagugcuggacuuacauuggaaaucacucccucccagcugauguauugaugagugguauucauguguaaacuguagaguuggagaccaagaugagggaauuucaaagggucagaagcagcaggucugucugugagacaggacaggacccucuuuaugacaucacauuguaguuaaagacagcaagaaagaacuucuacgggacuggggaguuaggucacauuuuaaagugcuuucuaugcaaccauggagacuuggguuuaauucuccagauccauguaaaaagauccugagauaaugauguacauuuguaauucuagcccugggaagaggagacaugucaguuccuggggcuaucuggccugcuaacucagucacuuagugagcuccaagccaaagagagacuguuucagagaaucaggugcaggcugggaagauggcaaaguagguaaaguucuguucaaaauaagaacccauggaaagcuagacacaguuggacucagcuguaaucccagcaguccuaaggugagauggacuguagaaaccagaaaaaucucuggaaacuuucaaugcaacaacccugguacagacagcauugaacaaggaacccugucucaaagaaacuggacaauaaggacuaacacccaggcuuuacaagaguagugaagcuuccucacauacauucauagaugcacacacacaaacacacacacacacacugaaaauuaaaauuaauuaauuauaagguggcugucuccugaggaacaaguacucaaggucgacuuccaguuucuaaauauauaaucacacagugaaccacccuccuacccacacauacauauacacacauacacaaacaugcuuguauuuuuuuuuauuuuaauuuuuauuuuucuuuacaaagaacuguagauaucggggauuugcucuuuuuuggauagggucaauuuuacaacauuuggacaaaugagaguuaacaggcauucuaaaaaagauaaaguagaauuucucuuuagccagcaagggaguuuuugagugguugaagaauauacaagguuugacuccacaucuuauaagcugguguuaacacaauggcucuacuuuuauugauaguuaaagucuccugcaacugagaaagccagcaaugcuauucauauauuucauauauuuuuacauauuuuugguuguuuuccacagugauauuuugggaaacauuuccucuuucugccagcucauuauccuauuuccuuuacuaugacuauagaacugaucauucuaagcaauucaguuggggauauuuaugcagaggaauggaacccuugcuucuuuggggaaaagauggcuaugugguccaagccaucuguugugagccaaucaguggcucacauguccggguucgagccugggaggcaaccuggagcugaaagaaaagagagaaccuaggcggguugagaaauaauggaaccaagacaugcuagucuguucaagguucgaauguuuaauggcggacacgcuuuauaaagaagaggggaggcccauucccgacaauucauccuuggagccuggaaacagcugcaggugaugaugugcaggacagggccauagucuccagaauagcuccagggccucucagcagguagcaguaucuugaagaggaacaacaacaguggcugaacaauagaguaaucuagggaggaaggcuccacucuagguaaucuccuuaguggcagcaaagucaaggucuggcucagccagcuucaggcuugugggagguuacaucuccucccuguuauuaauauuaaaaaaaaaaagcuggacugaggaacaaaauuuauuuaugcuccauaguccugccuaggaauuauggugguuggaggccaugccugucuuaggaaaucuuagaucuucccaaaccauucaauuccgucucggaggcuacgugcagcuaguuuguguuauauuucacacaaacaugguucugugguguauuaucaacagccauggccuuuugucauguaccucuguuuuagauugguaugguucugagaucugguugcccaucauugacuaaccggcccucguagcacaccuuauucccaaaucagaccaacgccacaauauguacugagaaugcuucuucaugaagaagcaccugcacugccaccuucacuguuggaggugaggcugaacaccugcugcagucaggcugaaggguguugacugaccugcuugaaaaacaaaguugagacagugaaaggcacaauacaaaagcuucuuuuggggaaguccagguacuucauucaauugcaaauuagcaaugaccaggcuuagacuuagagcuccgguguuggggaggugacuuugagaauugcagaaaggcuacagcuucucugggaguggaggcugugcuccaauuuaacuuuucagcuaaagaggauuuuuagccauaaucaagguuagagucauacuuacuagaugauuuaggaucuguguccaguugaugaacuaaucucucaggcagccauugugcucugucuucuuuuugugaaaaaacacagaccgagccccuuccccagauuaggacugggucuggacccuuccauucauuaauuacugggucccgccacuuuaccauggcauaagaacuagaaguaacugaaugccaguggcaaucaacugcagacugaccuuuaacaucaguuugcaaaaaauuuagaacaaauaaagcaaaagcaagaugugccuuuggugaccuugggggauauaacugcccuuguuuuguuuuuaaaagccauuuuuuuaaagagugaugagcacguucaacuauuccuugucccaugggguuauaaggaauuccaguuuuauguuugaugccaaauucuuuacaaaaugaaguaaaauuuuugcuagaauaggauggcccaauaucugucuuaauaaguuuaggcaaucccguggcauuaaaggcuuguaggcaaugaucaacuacauuuuuggaggcuucuccagccaucaggaugcuuucuugugacuuucugaauaugaguguuuguuggggcaugggaauuucucuagaaucagauccucaaaggacaaaaaaaaccuagacucagcugccguauaggaugcaugaauaacugaugguugaaaauaugcuaucauuucuaucucaaaguauuggaaaauuccagaccaugcgguuguccacggucuguguggcuaccuaaggccauguuggugucuguagccuguacugcugcugagagcuaugauggugucugugguaugugcuguggcauagggccauguugacaucgugaccuguacuaccaccaggcaccaugcugaggucuguggcaccuggugacacagaagaucauguagaugucugcgguuccugcugucaccagacacuauguugaacuucaugguccaugguccagcugacuguaaagggcaaggaagcuacuuuugcugaguuguugaugaacgcagacucacaguugugaaagagagacauaaaaggcuucuguucagccccucccuuuaccccacuucaccaccuaaaaaaagugauagugaaagagucguaaacucagugcuccaagguaugcuaaucauaaaacagagagcgacauuccuccacccacccgcuuccuggguucaaagaguguuaauucaaagaaagucacccugauccacccugaccauugcuggaacccacuaugcaaaggugcuauugcuaggggcucuuagauuguuaggggcucuuagaaacugucuugagagauauccugacacuugugacuuuguacuuccuugugacucuuaacugguauuuuugguauuuuccaacaacgcccuucccaccuccuugaguugugguuucuuccuuuaaauacccccuuacucagcuacucggggugccacaguccucuaccccugcauggcguaugaccgugggcccgagagcacucuugaauaaaaauccucuugcaauuugcagcaaguccguuucucguuggugguuuuggggugucgccucuccugagucagaacgugggggaguccucauguugugggucuuucauuuggugcauuggccaggaaacacgaccaccccucacacccgagaaccgacuuggagguauggggauccccucuuguguaugugccggccgguuucucuguuuugagugucuguuuucugaaacgaacauuggaacaugugcuuguuguguuggguuguuugugucuuguccuauguuucugaagcauggugaagucugaguuuggauccaucugaguuuauugaauaugugucuugguuucaggguuacgagauaguggguucgagucccaccucgugccuugguuuuacaccuggcagagugaggaacaagugugcuucucugguuuuggucgucuagguagaaguggacaacgguguuuguagacgauggggugaugggguuuucugaaaugcgcucgcagucgguauuugcagcuguccuuuugggccacaaggagcggaggacuguggucggcagacgugcuaggaggaccacaggcuguggcccugggggacgcccugggagguaaggagagccagggaugccuggccgucuccggaucggucagagggacagaguucuguugaaguggaagcuucccccuccaaaaucgucaaauucuuuugccugcuuguggaggacaagaaagggucgaaugugucuggaucuguugguuucuguuuuauguguuuuuguguauguguuuagagcuaugugaaaaucuagagaaacaaagguaauucucauaggugcuuuauacccugacuagagauaguuuacaccugagaugugagagaauggguuuugagaaaagcaguacucuccgacuaucuggggauaauuugguaaaauaaaauaaaauaaacaguaucaauuggucuuuggagcccuguaccuguaguuaggaaucuaguguggcuggagaagcccugcuaggagcugauuauagggaccagaagcuucucaaguucuacaaaaaucucugugcuugugauuauuggauucaucagguaacaaggugcuccucucuugaaauuacagcuagaaaaauuaagaauuuuguuugguuuaaauggacaaauguauacggccauuucauuuuuguuucuaaauaguuucaaaaguauaaauauguuuuauaugucuugguuauagauuaguggcucauaaguuauugguuaugauuaaaaauuuguaacauugguaacaaaaaguugucuuaaaacugguaacucuggguuagaguaauuagaacauguggcaugagccaacccaugggaacaggucucuaaagauacgccugaauuggguaauuuucuauguaauucuuauccuagaaacccgauuuauaauagauauauuggcggcuacaccuucuuguguuugugugcaggaacggacagccaaacuuuguagcaaguaauguuuuuggaguucauuuuucuuuagcugguggcuccagcuaaaucggcuccuccaaaaucuguaaagccuccugaguggccuaguccacaaccuuccccuuauccacagccucagcccccaccgauggggaacccugaaccccucaggguggcaggaggaggaccgcuguggguacauggagccacagagcacagagucuggguggacucugguggauccgcccaaacuuuaaacccuucaguacuggucauuuuccucugcugguauuuauaacuggaaaauuaaccacccccuuucucaggauccccaagccucacaggguugguggagucccuuauguucucucaucagccuacuugggaugauugucaacagcgguugcagaugcucuuaacaaccgaagagcgagagagaauucuguuagaggcuagaaaaauagcccggaagccaacggcagucuacacagcuacaaaauaagauugacaugagauucccuuugacucgccccaguugggacugcaacauggcuaaagguagggcgagcuugaaaaucaaucaccaggcucuggucuccaaggugccucaagacgggcccacuaauuuggcuaagauaagagguaaugcuggggcggaucgaaccucccucaauguuccuugaaaggcuuauaaaagccuucaggcgguucacucccuuugaucuuaccuaggaagcccagaaggccucaguggccauggucuuucauaaggcagucagcucccgauauuagaaagaaacuucagagauuggaagguguguuacaagagggagacaguuaugugaucuagugagagguagagaaagugugugugugagagagagagaggugggaggcaaaaaaaaaaaagagaaaacaggagggaucguagacaagaaauuugccacagugguaggagaaaaacaaaagacaggauauagacaggaaaccugggcaacugaagaccgagccucagcuaaagaggcucagcugugucagacuaaaguuacuuauuugggauacacccaucaagguggaaagcaguggcuaaaagaagccagaaaaagacuguaacucagauccccaccccaacuacaccaaggcaaguaagagaauucguggguacugcuggcuucuacagacucuagauaccuggauuggcgaccuuagcugcccaguuguacccccuaaccaaggaagaggagguguuuguguggaccccagaucaccagaaagccuuuaaagagauuaaaaaggcccuacugauggccagccuaugccugaccuaaccaagccuuucacucuuuauguggaagagagagcaggggucaccagaggaguccuuucucagacuuugggacuuugaaaaaggccaguggcuuaccuaucuaagaaguuacacccugcugccagcuggugguuuucuugccugauggaugaugaccaacgcuccugugacacaucagaacuuuuuguugacugaacgagugaccuucgcuucauuccaccugcugucccacugcgugagacugcaccuacucaucacugcgcugacauucuggcagaagaaaugaucugaaggaucagaucagccuuggccugagggcaguagccucgcgguugaagguaaacagaaggcgaggacagcaguacgguggugaacagaaagcaagugaucuagaacagcagccucccugaagggaugucggcccagaaagcugaacuugugacuuugacggggcaauauacaaagagggcuguucacaucugcagaaaaagaccuaagaugcuguggcuaaaaaaaucagguggcagaucuaaccgccaaacagguggcccaaggagcaaugaucuuggcagucaaggagccuaaagauuauuaugacaucagagagaccagcuuuagauacaccgcugagcacuaucaaguuauggacauuauuugacccaccugggggccaagaaauucaaaggugugguuagguccuuugacuacuauguuacaggacucucugacuuggcagaagaaauagucaaaagcugcaaggccugugcuaugaugagguagaauuucuaaaagaaaucuucccaagguaauggaccugccuuuguugcccagguaaaucagggacuggccaagauauuagagaucaguuagaaguuacauugugcaugcaggccccaaagcucaggacagguagagagaauaaauagaaccauuaagagacccuuaccaaauugacagcggagacuggugcuaauaauuggauagcucuccuacccuuugugcucuucagggauagaaacaccccuggacaguuuagacugaccccccuauaaauuacucuacagggggcccccuccacugguaaaaauagccucuguacauagugcugacaugcugcuuucccagccuuuguucucuaggcucaaggugcuccagugagugagacagcgagcaaaaaagcagcuccagaaggccuacucaagagaagaagaccugcuacauuagacgucuccacgcagaaaaccuugagacuccgguggaaaggcccuuaucuuguacucuuaaccagccuacuuucuaccuuuaugggaccccauuugacuuugcuucugcuuuuaauuauagguccauguguguuaaauaggcaagucaccuuuauuagaacaaaaauuagugcagugcagcuuuuaguuuugagacaacaguacuaugcccuaaaggaucaaguaugucagggaaaagauagugucuaguucuaagauuagaacuacuaacaagaagaaggggggaaugaaagaguaguaaacucagugcuccaagguaugcuaaucauaaaacagagagcgacauuccuccacccacccgcuuccuggguucaaagaguguuaauucaaagaaagucacccugauccacccugaccauugcuggaacccacuaugcaaaggugcuauugcuaggggcucuuagauuguuaggggcucuuagaaacugucuugagagauauccugacacuugugacuuuguacuuccuugugacucuuaacugguauuuuugguauuuuccaacaacgcccuucccaccucc

SEQ ID NO: 1371 - RNA, 1076 nt, Mus musculus
aaugaagaccccauucaggaagacaccuggccagagguccagagcuggugcaggccaugcuggagcaucugcaaacaugaugaagaagaggacaucucccaaaaaaauauuggaccagugugggccaagcgagccugugucucacccccugcacaacaucuuagguugcaggauccagccuggcuggagagagggcaauggcccuguuacccaguggaaggggacuguccuggaccaggugccuaagaauccuucccuguaucuuauaaaguaugagggauuugacugugcuuauggacuagaacuuaauaaggaugaaagaguuucugcacuggaaguccucccugauagaguugcaacaucucggaucaguggacaugaugauuggaaaagcaguagagcacauguuugagacagaggacugcucuaaagaugaguggagggggauggucauggcacgggugccugucaugaacaaauggcuuuacaucaccuaugagaaggacccugucuuguacauguaccagcuccucgaugacuacaaagaaggcuaccuccgcaucaugccugauuccaaugauucaccuccagcagaaauggagccaggagaaguuguggacagccugguagacaagcaaguggaauaugucaaagaagacggcucgaaaaggacuggcauggucauccaccaaguagaagccaagcccucugucuauuucaucaaguuugaugacgacuuccauauucaugucuaugauuuggugaaaacauccuagaugucaucacaaacuuugccaaauuuguggaacuauuaaauguauaauuuauagacauaaagaccugauugcuuuccaguuuaaugaaagcuuaaaugucccugcgaacacacaaucuccaccagcagagcugguguuguucugaauagugcagacugauucaaacacaaggcaucugugaggggaguacucccucuucaaagcaucugugugagggggucuuugcucuuacaagaaggcugucuguuggggguuacaagaaaggugguaaacguuaagauaguaucauagucauuuaaa

SEQ ID NO: 1372 - RNA, 1989 nt, Mus musculus
acauuuuuuuuuuuuuuaaagaauggaacuuuaaucuuuauuuacaggacaugacaggguacgaaauuccacauagaaauaaauucagaggacagcuucauagaguauguacaguuuauaacuguucaaguauaguuucuuuuguaaaaagugcuacaauaacaaaccacauuuaaaaagaguucuuaguagagaaacaguaagacaaaucuaugagaacacagaauagcacagcacauagcuaacaacuuugugccuuagcuggacauuagaaguuaaaggucccaggagcuccauccugaacuuggaaggcgaagccuucagagguaguuucuggcaccacauuuugaucuuccucuuccuccacugagaaguacuucucaauuaaguucaaugaggccuuguauacagacucguuuucaugccucuguagugcuucaauuuuauccaagccuccacacucuucaaucauuauacugagcuuuucugucucaccuaguuucucugcagccugaaagauauuugaaauggcgucaagaauaaccugaauaaucuugguaucuuuugcacucaggagguucaucaaagguucuauuaucccacagugaacgagauacacaaucugcucaacagucccaccgcugguauaguugguuauagcccacgcggccuccuucugugucuuaaaguccgccuuagagaggacaccaacaagaaaggggacuaggccgugauucacaacuugcuguaucugguccuggcguccagcuguaauguucgacauuguccauguggccuccuucugaauauuaguuuugggguuuguuagcaggcugggaaagacugcaagugcuccugcaucgaucacuuucugagucugcucaucuguuccagugacaauauucccuauggcucuuagugcgggagucacaaugggcaguucaguagcuccuagaagcuucacaaguuggggaacaacuccuuucuucacaaccaucucaaugcgcucauuuggaccaucagucagguaggaaauggcccagcaggaaucugccaauacuucuggaucauuguggugcaggagucgaacuaacguaggaagaaucugcucaacggcaucuaagggaggugcaggguucuuguuucgacaaagguuugaaagcguccagguaagauuacguaaguaaccacaugccaagguagacagaucgggaacugcaagaagugccaacagugggucaaucgcaccguguuugauaacuaagucucggaaagcugaaccaucaccugcaauguuuccaagagcccaaacagcuugcucgcugaugugagcaugaggagaugccaagagagaaauaaacgcugggauagcaccuccauccaccacagcuuuggucuguucagauguuccagaagcaauguuggugagugcccaagcagacucaaacugaauaggacuacaaucaguuuugcccaagaaggacacaaauuuugggaucaaaccagcccggaugauguugucuauaggaggcuguuucucucuagaaagcaauuuccgagcagcuugaguagcuuggagcuggcuuuccaaauuguuacuguuuaugccuuuaacaauguccucaacagaccaauuuacaguacccugguuguuccgguuuuccuguagcggagaaguagcaucaucaggaaaggagcugacguuucuucuuuucagcaucugcucaucuuuuuuagcuuuccugaguuccacauuaacuucuauucgacggcgacgcauuucugugcuguccuuccccuuguucuugaaccuguuaagucgggcagcugguaaguuagcauucucguucguggacauggcugcaggaacaaggaggaaagcuguacagccggcucagauuuccacgaaaggcggugcgggacacucaagcugcgggucggcggcuguggaaacgucugcuacccuucagcccucagauuuuguccaca

SEQ ID NO: 1373 - RNA, 1989 nt, Mus musculus
uguggacaaaaucugagggcugaaggguagcagacguuuccacagccgccgacccgcagcuugagugucccgcaccgccuuucguggaaaucugagccggcuguacagcuuuccuccuuguuccugcagccauguccacgaacgagaaugcuaacuuaccagcugcccgacuuaacagguucaagaacaaggggaaggacagcacagaaaugcgucgccgucgaauagaaguuaauguggaacucaggaaagcuaaaaaagaugagcagaugcugaaaagaagaaacgucagcuccuuuccugaugaugcuacuucuccgcuacaggaaaaccggaacaaccaggguacuguaaauuggucuguugaggacauuguuaaaggcauaaacaguaacaauuuggaaagccagcuccaagcuacucaagcugcucggaaauugcuuucuagagagaaacagccuccuauagacaacaucauccgggcugguuugaucccaaaauuuguguccuucuugggcaaaacugauuguaguccuauucaguuugagucugcuugggcacucaccaacauugcuucuggaacaucugaacagaccaaagcugugguggauggaggugcuaucccagcguuuauuucucucuuggcaucuccucaugcucacaucagcgagcaagcuguuugggcucuuggaaacauugcaggugaugguucagcuuuccgagacuuaguuaucaaacacggugcgauugacccacuguuggcacuucuugcaguucccgaucugucuaccuuggcaugugguuacuuacguaaucuuaccuggacgcuuucaaaccuuugucgaaacaagaacccugcaccucccuuagaugccguugagcagauucuuccuacguuaguucgacuccugcaccacaaugauccagaaguauuggcagauuccugcugggccauuuccuaccugacugaugguccaaaugagcgcauugagaugguugugaagaaaggaguuguuccccaacuugugaagcuucuaggagcuacugaacugcccauugugacucccgcacuaagagccauagggaauauugucacuggaacagaugagcagacucagaaagugaucgaugcaggagcacuugcagucuuucccagccugcuaacaaaccccaaaacuaauauucagaaggaggccacauggacaaugucgaacauuacagcuggacgccaggaccagauacagcaaguugugaaucacggccuaguccccuuucuuguugguguccucucuaaggcggacuuuaagacacagaaggaggccgcgugggcuauaaccaacuauaccagcggugggacuguugagcagauuguguaucucguucacugugggauaauagaaccuuugaugaaccuccugagugcaaaagauaccaagauuauucagguuauucuugacgccauuucaaauaucuuucaggcugcagagaaacuaggugagacagaaaagcucaguauaaugauugaagaguguggaggcuuggauaaaauugaagcacuacagaggcaugaaaacgagucuguauacaaggccucauugaacuuaauugagaaguacuucucaguggaggaagaggaagaucaaaauguggugccagaaacuaccucugaaggcuucgccuuccaaguucaggauggagcuccugggaccuuuaacuucuaauguccagcuaaggcacaaaguuguuagcuaugugcugugcuauucuguguucucauagauuugucuuacuguuucucuacuaagaacucuuuuuaaaugugguuuguuauuguagcacuuuuuacaaaagaaacuauacuugaacaguuauaaacuguacauacucuaugaagcuguccucugaauuuauuucuauguggaauuucguacccugucauguccuguaaauaaagauuaaaguuccauucuuuaaaaaaaaaaaaaaugu

SEQ ID NO: 1374 - RNA, 57040 nt, Mus musculus
uuauauuaauuacucagaugcaagcuugucuucaaaaauaaaaucugguuaguaguaagagcggaucgguuugcggugcuugguacuuuuucuugaaguuggaggugauggcagagagaccguucaucaggaacugggcuguuuacggaguaaacaagcgguaaccacagaaacaccugcugcauccagaggcgcugcagagccacgccuccucaagcccacauccgggcacuccgccgacguucgcacgcuccagccguuuaccggauuugaaacacacucacaaccaaucagccggcgccucccgaaggcagacguugggauugaccaaucggcaguccgcccgagguuccagccuaucaaaaggagguugacagagcgcgccaaucagcauggcucuuagagagagcgacuggauuuuuuugaaucggaggcggcagccucucucgagccauggcggcgccugugagggggagacuuaguguuugagaaggauaagcgaggacugcgccgucgugguuccuuuuuaaaaucucugagcguggugaggacugcggggugagugggggacgggaagggauucgggaacccggaacugagcacgggccguggcgaccaaggccggcgcccccgccgcggugagcucccacggcugcguaccugucugucccgcuccccuccauccuccuuccccacauccgccuccuguccugcccucugcucucgucccggcccuuccuugcgggaggcugggcucucuaucuauucugcuucuguccggcgccucagggugaagggcgcaguugggaccgggauuuuggccucccgcccgcccgccgcagccccgagcugccuugauuguuuugugguuucccucuggaauuccuguagaauuccgauuuucaauuuuuaaaaauauaaaacacaggccgccccgccccuuccuggccacagaugugugugguuagcgguuaacuuagcucccucaguuagacccggcuaggagucgcugugugagcaacuuccuuagccacaaacuggauaugacagugacauuugucuuuuaggauggcugcaagcguuaaaaaguggcaagggaaagauuuaagauagugacuaaaauauugagcucuaaguaaaugagaaucgcuaauugcacuguuaucaauaacguauacacuauuguaguuuggguuccuuacucuggugugacguguuuauggaaaaaaaaaagguuuauuuaaaagaaaagcugaaaugacuauuuguuuaaaagaauccauguguuugugagacaagaucucagguaccccagcauagacuugaauuguggagccuagggugacaaggaacucugucugccucuacccccucuucugggugcucggauuacagguguacuuucaccuuaccugguuucugaggugcccgcggaugacuucaugcacacugacugcagcugagucacaucccgagucaaagauagauuguuuuuaugaucacgauuccguuguguuuauuuuuaaaaggucuguagaauaugugaaaaggaagaaagugaccuggugcacuuaaguuugcggugauguugggugcuagaugcugguuguaucacuaguguagcguguagcucuuuugcuguauauuauggagcuguuuugguaauaaaugaucuguguauuuaagcauuuccaguguuuugggguguagugagaaaggguuuaguuauguaucuccucccucuguuuugugggugcuggaauuuuaggccacacauugucaguuguuuggugauuuuuuuuuuuaagaggaucauguaaacuaaaaguauccuuaaaggugcauuguaaagcuuuggcacacaguugcacauaauuguaggcuguguuaccacacuuuucccccuuuggacugggagauugaaaaacaaauaaaaauacauguuuuuuuuuuuucuccuggaaaaaaaagcaaacaugguagugaacacuucagaaggcuaaggcauauuuguuuguuugggcagggaugcacuauagcucugcugguccuggaauucgcuguguagacuagacuggccuugaacucagagcuccaccugugucugacucccaagcucugagauuaaaaacaugugccacuauaccugacucuuaguuuuuuuuuuuaaaggggaaauuuuuuuuuucuaaacauugaaaauaguucucucccucccucccucccucccucccuccuucucuccuucucucccucucucccucuuucccucuccugguuuccccuuccccucacucccucucccccucucaucucacagguucaagcuucucuaauggcugaucaagacacugauuuauggguaucuggcagaauguugauagaagucauguuguaacauuucuuuaagugacuuagagccguguauuuuauccuagagaugaguuuuaggggagguaggagggcuguaugaaguuggucauuugcuucugaguaaggacaccauuggagcucuccuguggagacuuaaaaaugauugccguggauaagacaaacaauaccaaguuaugaauauuguaugaaugaauaguuauuuguccuuucaauaccuauugaguuucuuucccaaccugcauuugagucuuagugcuaugucugcuuccuucauuuggaaacugagacgagacuuccugcagagucuugaggaggcagaguggagccaggaagcaggugucugacuuaagcaucugaguuuuacaacucuguguaggucuguacuguguaccuguacacauagacucaccgccuagaaauggagaguuguacuuuacuguuuccucagggcagacagcuuaaacugugucucuacuaagaaucugagcgcucucugacuacuuuaucaaucugaaaaaguggaucagacacuuuugaauaaagugagauuaagcucugagguaaaggugagacuguugguuauauuuguuugauauuuaagauauuuacuacccacuccaguuagguauagaacccagggcccucagcaggacuuaccccugaguuacaacaaacucaagcuccauacuucaauuaaacuuucucucuucccuacuugccuaacuuuccaguucuuagguccuagaggucgaagagagcuuucuuucauaguccagauuuauaaugguacuaguuuauauacauuugucuugucaagucuuggagauguuugggaauuaauauaaaaauggcagcuuacaguguaagcuguacagugaucuaugaaagauucugagaauccacauaaaggugaagucaagagugaugaaugaaguugacguucucuguagaauauuccugcugcggugaaauauacccaguuauaaacuacauugcaguuugggcuggaaaacugcucagaaacucauugcuggcacagagaaagauuagacauuggaguaccuugguuagagacagcaggggauuugggcaggaggaggaggugaagaguaaagcugggcuuauugggagguaaauguuguguagacacuuugcaagagaaguggguugaagacagauguagaagaaagguagaaaaacacuuguaccuuuugugugcagggagcuuucuguguuauuuauauuuuauuguauguuuauaacucaugcucgaguuuuauagaaaagaaaacuuagucuuauggagguuuugagacaggcccuuguaccccacauuugcuuugaauucgcguuuccaggggugaccuccaccuccugugugcugacugaccaucuagccuaccuccugggcccagcuuacaaauucuagauccacaaguacaguaucuaagucaguggcccagucugugggucucgaucccuuuggucaucacauauccugcauaucugauauuuaugcuaaugauagcaaaauuagagugaaguagcaaugaagcgaauuuacaguuggggaggagcuguauugaagguucgcagcaucagggcgcuugaaccacuguuguaaaguuucuugcucagugaccauguuugucucauguauucucauuucaaguuuuacuguuucagccuucaucaaguagugcaaacaauggcugacgacagcguguuaccaucuccuucugagauaacuagcuuggcagacucuucaguguuugauucuaaaguugcugaaauguccaaggaaaacuugugcuuggcgucuacuucaaauguugaugguaaguuuaguaccugcuuuuuuuucuucuuugguuuuuugagacaggguuucucuguguaacgcuggcuauccucuguguagcccuggcuguccuggaacucauuuuguagaccaggcuggccuucaacucagaaaucugccugccucugccucccgagucuuggguucaaagucgugugccaccaccacccagcaguaccugcuuuuaaaaacacacaauuguuaacuuaaaucaaagaauacuuacuagugaauuuuuuguauugagugauuagggcucuaugucuacauucucuguccaugcuuugggauaaugcuuccccacuuugaaaaagggcgugucuuaguguugauccugcuuucuugguauugaggcacucucacuauaacauugguaagcuggaguuuauucuugcuuaagugaggagcuacugugguuuauugcuuuguacuguuuuauucuaaaguuccauguacuuuaaggaggagggucaugcuucauaaugcuucuuuaaagggaguuguuucuuugauguaugccuuuugcuacaauguauauagccuuuuuaaaaaugauauguggucaaauauuuuuguagaaaauucagaauuagguuacuuuuuuuuuucuuuuuaaagauuuauuauuuuuuaauuuuauguaaguacacuguagcugucuucagacacuucagaagagggcaucauauuucguuauggaugguugugagccaccaugugguugcugggauuugaacucaggaccuuuggaagagcaguuggcacucuuaaccacugagccaucucaccagcucccagaacuagguuacuuuaacuucuggggauuuucuguucuccucagacauagacuuucuagcuagaaagagggucuaggaacuacuaaugugcuguugguaccuuauaaccacauugaaacauuuuccaucuuaauagaagaaaugccgcagguugaagcaagagugauaaugguccaggaugcugggaaacaagaagaacuucuaaaggccuuaaagguaaggaguugggguuuguaauucauuucuaaagagauucuucacccagcuuuguaaauacuuuccuccgcuucuuaaucuuacacguaagucucuuuucuacagacuauuaagauaauggaagucccuguuauaaagauaaaagaaaguuguccuggaaaaucggaggaaaaauuaauaaaaaguauuauuaauaugguaggucaagcaucucauugcauguggcaugcuucacuucccucgauugaauuacuucacucuggugacuggaaucaggcacgagcacugaauuagaaauguuggaaguagcuuauuuuagaauaaguuguuucugaacccuuaaauuauagcaucuauuagaaauucaaguuuucgagacuuggucauuauuuaagaaaaggaugcaauggguacaaaggucuggucauuuucuuacacauuuaaggacuuuuccccauuagcuuucuguuuaguuuaaauucgugcuauucuccaguguguaaccaguuugucuucauaauaauuucuauuuauauuuugucagauugaaccuagguucucguacauuccaggcaagcauuuuacuacugagcuagugcccugaccuuccauuacauuaguuugcuagggcuguuaaacaaaguaucagaccaugcaaauaauccugacagauuaaacaacagaacuuagagucuaaaaugagugccaguggguccaguguccugaggucugcauaggacuuccuugcugcaccccgcacggcccuguuucccuguacuccaucuuugcuguugauguucagacuucugagcaccugagucagguugggugaggccugcccuggacaccucguuuaacuugaaucgucucuguaauggccuuaggaccuuagcugcguacagucacauugagagagaagguuucauuuuucauuuuagguuagcuuucagcauaugaauuucagggauagaugauuugguccaucacuccagccuuucaaauaaaagcccaaauaauuuauuaauauauucagaguucuuuguuccguucuguucacacaggaauuauguaggcuguucagguuuguuuuuuuuuuguuuuuguuuuuguuuuuuuuuccaggguuucuguauagcccuggcuauccugcacuugcuuuguagaccaggcuggccucgaauuuagaucugcccuccucugccucccaagugcuggaauuaaaggcauucacuaucacaucuggccugguucuuuuuuuuuuuuuuaaaugaagauacuuuuaauaagauacuugccuuuguaugucauauauguguccugaugcagccaaauuagcucaugaccucucuauagcauauguauugaaaugagaaugucaaucaguaaccuuuuacuaaguguuaaacggcgggguuuuuucuuuuuuuuuuuuuuaagauagcugcauauguagauuaucauuuuucuugcucagaauaaaaacugguggauauauaccuaaaucaaaauacauguacuuacauuuuuuuaaaaguguagccuaguggcucauaucuauaauuuuaucacucaguaguucauggguagagugcuugccuagcaugcucugaguucuagguuugaucccuauuacuaccaacaacuaaaacuacaacccuggaaaggaaaguaccugguguucuauucuaguaccuggaacuuacugugcaugcuagguggcuuauagaccagagucagagagccugugcuuaugucuucagagcaaggucuuaauguguaugggguuauaugacguauaaaguagagaaauaugauucuacacuguuauauguuauguugguaauuauagacuuuaacaguuaaaauuucuaaaaagaugucaaaaaaauacaggagucaauuuuagggagucguauauuauuuuauaugaccuaugaauuauuuuuauuuguaauaacuaugaaaaaauccaggaaaugaaagugcccuguguaaagauggacucaauggaagaauuugaaaguuuggauuccccagaauuugagaauauauuuguaguuacugacuuccagaauucugucuucaaugacuuauacaaggcugauuguaggauuguugggccaccaguuauacucaacugugcacaaaggggagagguaagaaacguacguuugucaucucaagaauacauuuuuauuaaugcauucuuugaaaauuuauaauuagaaaaugcuguuaauugucgaguacacguagcacuuaggauaagaauaauuuguuguugcuggguaugguggcucaugccaugaguccuggcuuccaagaaggugcacacauaagccauucucuuuuccacuuaaaacuaguauuauauccauuaucauacgauuuaaauuagaaaaauuauuuuagguuuuuucuuuuuccuuuucuucuucuucuucuuuuuuuguuuuuguuuuuguuuuuguuuuuuuggaacaggguuucucuguauggcccuggcuguccuguaacucacucuguagaccaggcuggccuugaacucagagauucaccugccucugucugugagugcugggauuaaaggugagcgcuaccacgcccagcgcuuuuuauuucuuuuugauguguauuugaaugaguaugaagguguaugugagugugugaaccuuggguauugaaaaguuaacuggugccaggugugguggcacaugccuuuaaucccagcacuugggaggcagaggcaggccuggucuacagagugagcuccagaacagccagggcuacacagagaaauccugucuugaaaaaacaaacaaacaaacaaaccaaaacaaaagacagaaaaguuaacggguaaagagugaaaucuuuaagcaugaggaaaugcuuucucaaugcuaacggagaaggaggcucaugaguuuggaauuguguccuccagcccuugccguuuuccugccggccgcuguauuguacgaguaugcugaaccuggugcucugcuucacuggauucaggaagaaggaggagcuuguaaguaugagacccugaccuaguaacgcaggguuagauugcauccagccaucauuucuguuugguguugugacgucauuuaaaaacucauguuuguaagugauaguuggcccaugaauuccuagaaaguugcauaacugugaacucuuuuacucucuuguuaauuauuaguuauacuggucaacugaagguuuguaacaaaaugaauacugcuuuaaagcaagcuaaacuuuaaaguacuuuuaccuugaugaauaagccauagaaacuuuuuuugguucacaauuauuuccuaaguuggaacuaguaaguauuacuguaauuuugugggaagaauguugauguuauauaaccugauauuaaaacucaauauuuuggugcuggagagauggcucagugguuaagagcacuugcugcucauuagaggacaaaaguuugguucccagcacccgugucuggucucagagcugccuauaauagcagcucugggggacgcugcuucuggccucuguggguaccuacuuguguguguguauacucucagacacauaaauaaagauaaaguguaagaaaagaaauugauauauuuguuuguggguauauggcuuuggcuucaauucccaauauuguuaaaaaaaaauagaaggugaauaaaugaaaauacuacaucuguguguuuaggcaguaucagaguugguugccuauuauuagcuuaauacucuguguauugcuuaucuuuguuauagauuuacauguagcaagaacuacuuuuuuuuaacaagcuacucuuuuaaaaguguuuuuuuaaaguuuuguaaaguaguuaaugcuaaaugacuuaguacaaauuuugcucaaauuaauuaaaaucaauuuuguuuaauuuuucuuuugaggucaaauuggugacguugguucaucauauggguggaguuauucgaaaagaguguaauuccaaaguaacacaucugguggcaaauuguacacaaggcgaaaaauuuaggguauguaagcuuacuguuuuugucuuuucaguauaguauuacucuguaauguuuauuuugagacgaucauauaccauuuagaaacgauuguguaggccagguuagccuugaacucauuaguauccuccaguucccagcuccuucauaggcaugaucuaccaagccuggcuugugucuaauaaugucacuccucuguugaugguacguuuuuuugaggaucagauggagguugucauuggaaagucaguaaaggguuugugacauagcuuagcuacugagugcuugcuuagcacacauagcccagcauaccuguccugauagugcacgaguauaaucccagcauggagaccacuguggagacaggagaaucaguuaaauacugccuuuuccugcuguuugcaguuagccgguguuauguaagucccugucucaaagauaaaaccuugaaggagacugaaguuagauguugaaaugugugaugugggcugggcaugguggcgcacgccuuuaaucccagcacuugggaggcagaggcagguagauuucugaguucgaggccaaccuggucugcaaagugaguuccaggacagccaaggcuacacagagaaacccugucucaaaaagccaaaaaaaaaaaaaaaaagaaaagaaaagaaaugugugaugugaggggugguugguagguaguauugguaguaaaggcuguaugaccagcaguggcagcuaggucaaggagugagaacagauauuucacuguuggcuuuaugaaaagaaagcccucuuagaaaacaaaccugugucuuugaaugucuaaauuaucuauauauuuucuuaaaaagaauuuuuuaaaaaggagaaaauauuuuauauuuuucucucaagagagggucuuuuuauguuuggauuuuguuugugauagggucucuauuuuuguaacccugguuguggauagaccaggggguccugaaacucagagaacccccccuucuucucaaguucugggaugacagguaugcaucgugucugcccauguugccuagccuagccgcagacucguuaucuuuugccucagccucccagggguugggauuauuguacuaugcuacugugucaccugacacuaacuuacuuggguaggaaucuauugucagcugcaguugaguugugcauucgauuuauuuugggugugucuguguuugcaugugggugugugcuugugccauggcccauauauggucagaagacagcacugcggguacagguuuucuccacuccauggguccuggggacugcauggggacuucuuaacaacugauuuaugucaccgaaguagcuuaacgggaauuuuucauucauugucacauucucaguguauuuauauaagaaauuuccccuaauuuuuauguauacacacacacacacacacacacacacacacacaccuacaccugaaaggauggaagccaucauagguacauuugaaaauuaaauucauuuaccuuauucauuccuauguacuuaguaauaucguucaauguuacuaguagacuuuguaguacguuuguuuacugugguaaaauauagcuaaaagcuauuucauucauuuacauucaugguucauugccauuaucuacagccacuuuacugugugcaguuauuguuacaauccuucuauuaaaccuuuuguuucaggucuugagggcuacucauaccucagauaaacucuuguucucugguuuuguaaaugccaguguucugaguaacuuguuacgagaaaucuugucuuuaauuguauaguaagugucaaauaguccaguaucauaguuaugacagcucaccuccacccaagaauaugugugcaaacaguaucaaaaucuuccagagucaaacucuuguauugguaaagguaauucauuugcaggucacuuuuagguguacgugggaggcuuuucguuguccauucuauaaguacucuauaaggaauaagugcacuacugauaaaaccuaaggaauauauacuaucuuuguuucaagauuggaauauuguaaaaaauaaaaaaagcaucauucuaucuacauuaaguaacagcaagauuauucugauaacuacaagaucacacauaggugucuucauauuugccuuaaugguaucaaggucauagucagugccuagcuagucaugguuagcuaaagugccauggccccuccagguugagaacugcuacuaaagauguuugguucucuuugcucuagacguuccugaaaaacguauucauauucuacgaguuuagugauguaacuguuucguguuucuccccguaagcuccaauagacugcucagggcggggaaacugaaaccuaagcugcggcaggccaaagcuggggguuccugacuccugcguguccacuugcugcugggaaccacgcagaggagucgggaauugagggucaggguccaugggccugugaugaggccugagccaggguuccucagacuccugggcacccagaugccgcuggaagucgaggacgcugaggaggagccugcagagaccaggccguggggaugggaacucagggucagcucaggaguggugagucugggagcagagcggccuucugcagagacuuaggauggugaggcucuguagacaaaggguuucuccauguuccccacagugcuucuugaugagaaaguccuuggcuccaaauuguuuauugguuguucaguguggaaaaugguuucauaccaccuccuccggguggaccagagauuaaauaccuuuugcauguaggaauguuuagggagggaaguuuauuggcuaaacccucuagauaccucauuagcauggagaacucuguucugauccacgugaucauaggucguguuccuaugcugguaguauggucaugugacaguggccuggcaggaggcaggugaagcuccuaccauccucucagaggcuuccucagaggcuccggggcuuccagucugcucaaugcccacagucauuacuuguuuucuuuuguagucuuguuuuagccaauucuuccaaggugugaacagaacaaaaggagaaaucaaagagcuauaauuauagaaaauagcauaagaguuggguaccauggaacuuauuuuagagucaccauaacuguaagaaaauagaaugugaaauugugcuaauaauuuuauaaguaguucuuuagaagcacuuccuugagucccacuguaacugguguuaauauucccagguugcugugagccugggcacuccaauuaugaagccagaauggauuuauaaagcgugggaaagacgcaaugaacaguaagugcuuaggaauccauaguuaauuauugugugaauucaacauguucauucguucguucuuucuuucuuugaaauauuuguuuuuuuguguuuguuuuuguauauuuguguacuuggaugaauauuuuuguaccacauguauacagugucugaugaaccccaagguugcaggcaucaaauccacugggacuagaguugcucagagucaaaccugggcccuggaauagcagccaggguuuuuaacuacugagccaucucucuacccaacauauuguuauuauuuuuuaaagugugguuaacauuuguuuuaaagauaaagccaugugccaacaaaaacuaaauuugaaaauaguauagaaaacaugaauucuuugaauggcuuagggaauaaaacauagguuauaaaacucauuuauaauaagcauauaaguaagacagguuuuugaaacaauuaaaauuguaagauuugauaucauuggguuuuauuuuauaaaaucauuucucagaauuaagcacuuugugcgugauuguaugugugggcagauuuggaggauggagggugucuuagucaggguuucuauuccugcacaaacaucaugaccaagaagcaaguuggggaggaaagggguuauucagcuuucaauuccauacugcuguucaucaccaaggaagucaggacuggaacucaaacaggucaggaagcaggagcugaugcagaggccauggagggauguuucuuacugacuugccucuccuggcuugcucagccugcucucuuauagaaccaagacuaccagcccagagauggucccacccacaaggggucuuucccccuugaucacuaauugagaaaaugucuuacagcuggaucucauggaggcauuuccucaucugaagcuccuuucucugugauaacuccagcugugucaaguugacacuaaaccagccagugcagagggugauguggauuuguguucuccaucuacuguaugugcacuuuagggauuuagucaccuuagguuguuuggaaugguugcauguacuuuuaccugcucagcuagcucauggggcugauuuuuguuuguuuguuuguuuguuuguuuguuuguuugagacaggguuucucuguguagcccuggcuguccuggaacucacucuguagaccaggcuggccucgaacucagaaauccgccugccucugccuucccagugcugggauuaaaggcgugcgccaccacugcccugcggggcugauuuuuguuaagugaauuugacugagcaguccagaagcuuuggugggcggagguacuugcucccaagccugaugacuuauguuggauucccagggcucccacgagggggagauuagacuugugggcauugucugcugacuuccauguuugcacuacagcacccacgugcacacauaccaauacauuuuuuccauugucauaaacauucuaaaauuuauuagauaauaguuuaaugcuuucagguauuuagauuauguuuuuuucuacuuuauguguagauacauuuaaauugguccuuaaaacuuaacguuuuuugcuaacccuccaggugugcauugucugcucugguucuucuuuauguaaaaguucaugaaaucagagaaugucuguguuacagagugucaaacgcccagccaggauuugaaugaugggaagguugucugugauuauuuugucaggugcagugaaugacucccaggccugcacguguuaauuucaacuucuacuaagcagcauccugggcgaccuccucuuuuacuaaacaaaacaaagcagacaaaacuaacuuuuuaggacuuuauguaauauauuuuucaauaaaugaacucauucuuguaagaccuugaaaauuuacugagauuucacaaacuaauuucccuagcugauggaauugaagcugguuuuagaaaugcacauuuuguuuuuagguguuucugugcagcaguugaugacuuuagaaaugaauuuaaaguuccuccauuccaagauugcauuuuaaguuuccugggauuuucagaugaagagaaacauaguauggaagaaaugacugaaaugcaaggucagguaacaugaugucugugguggucgacacuggccugaggcgagcaccugagcaugucugugagggaguuuccagacuggguuaguggacguagaagacccauucuaaaugggggugguaccauuccgugcacacaaaggccaaagugaacugaaugccugcauuuaucucugcuuauuguggugugacuagcuagcuaccuuaugcuuuuccugcuguggcuuaccagucaucacuggacuguacuuugucugacccgaguaaaacaaacccuuuaaguccuuguuagaaauaacugauauccuauaaauagacacuucauaauaaauagcugcuuuagagauggaucuuuggagaacaguuguuuggcugaucuaucugugucccuguucucuuuaggagguagcuauuuaccaguuggggaugaaaggugcacucaccuuauuguugaagagaauacaguaaaggaccuuccauucgaaccuucaaagaaacuuuuuguugucaagcaagaggcaaguaacuccagaaugaaguuacuuagcuuuaguaauaaauacuauagcuucucugcuaaggucaauuuaaaaucuuaauuaauauuguucucucuuuuagugguucuggggaagcauucagauggacgcucgugcaggagagacuauguauuuguaugaaaagguguguuucuacucuugguucugugaaauugcaaaaucgauacuguuguguccagagcauuuauauauguauaacaagaaccaucauaguaaaaauuaaacacuuuugugcuuuugauuucaggcuaauacuccugagcucaagaaaucggugucucugcuuucucuaaguacuccaaacagcaaccgcaagagacggagauugaaagagacccuggcucagcucuccagggagacugaccucucuccuuucccuccccggaagcggcccucagcugagcacucucuuucuauuggcucacuccuggauaucuccaacacacccgaguccagcauccacuauggagguaguaauucacguuucauggaauuagucuuuaagauggaguauacugggauaacuaguagaauaaaucccugcuacagugaaugaacugggaaggcuuuucucuuaauagucuuggucuaguugaguaaacaagacaguucaaaacaaaagcugagcguagcuggguagucuacccuuauaauuccuagauugggcaaguggagcccagaagguggguuagagacacucuggccauuaugagacugggccucaaaacaaaagcaaaaacaaaacaacagaaacccugaagagagaaaucuuguaaaaaauaucaguugcacaguaaugcuuuuguugggugauuguuuacucuaugcuuuugugugauugucugugugucugucuugcaggccacugaacuucagaacaggaguuaggaauuguccagggcuauagcugaagagugacugauaauuguucuguuuuucuuuuugagacaaggucccauagcugaggcuagucuuaagugcuggguguaacgcuacaccugcguuaauucuaguauuaaacgguuauaagaaguccuggggaagugagguagaauaggugggagucaggaggaugaugucacuuuguguugaacagacaaagacuccuauagucaaaccuguuaugaucaccagcauuucucuugucuguaaauauguaggauuugcuagauuuaagauacagaaaguaaaagccuuugacuucauaguguucuguacuaauugucacucaugcuagggaggugcccuuccucuacauuaccagcccaugcuuugagacagaaaggggaauauugcuguguggccaggguguccuugaacuuacggcuuuucuucagcauccugaauaaugagauuauauaugugcacucugaaguauuuuagauuucucuaguugucuuaaucauguccugauuucuaacccuccucucccccaaacaagaagcucuuguaguuuaguuuaggauuuaaucuaggguaccuguuuucaccguuuaguuucuucucauugaggggauuuccuuuaauauaauaaccuugguaaaucugaagaguguaggccacuuaccuguacacugucagcuuuuuaauugguauugugguugagccuagaacuucacacgugccaggugagcaguuucccauugacucauguucucagcucugaaucaaugaccuuuuuggucauuguauuuuccuagccuuaucccaugaggaaguuuuacuuuaacagaaagcucuauugcugugcuuuauaaugucuuuauaguguuuagaucugccuucugauggaaccuuucuucuuucccagaaacaccgaaguccugugcuaagucuucuagaaguucuacuccaguuccuccaaagcagucagccagguggcagguggcgaaagagcucuaccagacugagagcaauuaugucaauauacuggccacaaucauucaagugaguagggugugcuuguagagugauuccuguuguuugaaacucucuccccucuugucuuccuuucugugacuuuguguuuuguucuuuuaaagaguauugguguuguuuugggugguagugguggauauaggguugagauaaaucuugcuguguauuucuggcugggcugguacuuaacacauagcauagacugaccucagacuuaaaguuaucuuccuugcucugccuccugaguacuccgauaaugggugugagugccagccccacaggaggaugacuuagagacuaaaccaauaguccuuaacugcaguguuuuuucuuaagaauagugccagucaggcugccaugcacuugguuucuagaugugcuuuuucuauguuacaccacagccuuuguguaaccuuguggcagugucuuguguuaauuacuaccaggcacuugugcuuaaacccuuuugaaaaggugugugucaccgccccccccccccuuccccaacuggguugaaccagcaccgacuacauuuggauucuuacaacuuccaccuuguuaagguacugcuuuauguuuagaagcgguaggauuuucugaaaaguguguucuagagaaauugcucuauuuaaugcugcauauauggacaacagauagucuguacuccggcugagaagcuguacaauacugacaucaguaaucuguuucggcuuuucaugauaccuuuggacuugugauccuccuguuuguaccucuuaagugcuagacugaaggugugcacugucugccaggcuuauguggugcuggggauggaacacggcuuccugcaugcucugccuguuaggcaaacacugcuaacugaauuacaucccuaguccuaguuuuuuacugacauuuaugaaaacuacauuugaggugcaguuuuacacacaaacccaaaaaugagaaaaguacagucaguauacaguaaagggcaagagaggcuggggguccugcucagagggugaaguucuugcuggguggcauggggccugcaacuuggaucagcagagcccuguaaugcugggugagcuuagcuccugacugugaguccagccucagaaguuaauguggaucccagagugucugacuaguaacauuagccacauagucuagcuuuugguuaggccaagaggaccugcuucauuucagugaaugcauaagaugggagagccauggagggugauucucaacauuaggcucccacgugcacaugcacagacagacagacagacacauacacucguacuauacacauguacauguuaccauuacagggacagguaaggcauaugcaguauacaugaggcacagauuuuaguguccauaucauuaauacaauuugucuuagucaggguuucuauuccugcacaaacaucaugaccacgaagcaaguuggggaggaaaggguuuauucagcuuacauuuccauacuacuguuaucaccaaaggauaucaggacuggaacucaagcaggucaggaagcaggagcugaugcagaggccauggagggauguuccuuacuggcuugccuccccuggcuugcucagccugcucucuuauagaaacaagacugccagcccagagauggucccacccacaaggggccuuucccccuugaucacuaauugagaaaaugccuuacaguuggaucucauggaggcauuuccucaacugaagcuccuuucucugugauaacuccagcugugucaaguugacacagaacuagccaguacacaacuuaaccaaagcuucuaacuugccaaacaguuuauccuuucuaaaacacagauucacaccucgcccccaauuuuugugaucaggaugaacuugaucuacuaaaaacaaauaaacauacuuaaaaaaccacagcugggcauaguacaaaccugaaaccccgauacuugguagguuaagguaggaggaaaacaaauucuaggccagccuggacuaccaugcuguaguaagagccuuccuucuuccaaagagagaggcaaguuuuggguauuuguuugaucuaaguggauaagguaaaauuaagugauuuugaaauuguuuccaacaaaagaaacacaaguccuaaaagcugucuuaaagagaacguucucggacugggguuugcucauuggucaagcuguagauuaacacacaaccugcacuuaauccggaauuaacccuguaggaaggagggaggaaaagagaacagucauaguaaaugcaggucacaggccuuagaaccucugcucaguuuauguaagcaaaguggcccgagacguguaauuucacaugcguaauuaaacaguuucaguuaacugggcauggugacccuuaggaguaggccaguucucuggaggcuacggcaguuggauugcuacgagugcauaugcacaaauauagaggucagaagaggacuuugaaggguuggaugucuccguccuuccuguggaucuguagauggagauugacagguuugguggugagcaucuaccugcucagucaucccgaguuaacaucuaagcuaacuuagaaucacucacuucuuucuguccuuuauguuaagaaccgaacaauuuguuaucuuacuguuacuuaacuaguaacuuuaaauauguacuuguucuuggagggguuuaccugacugcagucuggaaucagaacugacuguacucucacaucuccccggguuucuuuuuaggguaucuuauaauuggaguccuggugugcacccccugaggccuggguuccuucagaaucaucuaacuaguguguaucuauagucucuucccuuccuccccccaccccccuuucucuucccuguuuuccucuuucugacaguuugacuauguaggaugucugagauccaauguuugauucuuuagcgucucuuugcucuugcuaaaacacaccgacaucuuagugcacaaagagcucucaggguuuuuauguugugucguuucuuuccugaguuuuaagaguucuuuguauguaauuuugaguuuuaguccuuugucaagugugugauuuuuaaaauauuuuuuuaaaacaguauauaaauaagacaguugcuaauuaucuuauuagaauuuuuaaaauucuuauuaaaugucuguuuuucuguuuucauuguaguccacauuuuugaggucaugucuaaggauucuaccuaaaacuaaaucaugaauauugucuucuagaaauucaugaaguuagauuuuacuuuccaugaacugcuuugaguuaauuuuugcaaacagguuuuuauucaggcugauguucauugguauaacaggguugaaagaccauucuuugcgugguuaagacuugcuccuuguuguuuguuuguuuguuuguuguuuuccuucugguuuugccucaguguugaucuaguugaccuugaacucagcucuuucuguuugcuucugauacguugggauugcuacugugguuuuuauauuuauauaaauugugucaauuuucauuucuugguuuaguuauacuguaccauaccaucuuuaauauuguuuucuauuaugaaauaauuuuuuauuucuugagaaauucuagaaucagauuuucucucuauagaaaguccuaggacuuugauugguauuaucuugaaacaccuugaucaacuaacaagauaauugucauucuuucuguguccaguguuuccaucugcgacuguguggcuucuuuccuuaugucuuuaucucaccugucagaucugcuuuugagcaugugcacccuauacccaaauguuuaguuucuauuuuagaaauagauggcacagcuuuuuacaucauuacauuuucuuuuugccuggugugguggcgcacaccuuuuaucgcagcagaggcacgggaauuucugaguuugaggccagccugaguuccaggacagccagggcuacacagagaaacccugucucgaaaaaacaaaaaacaaaaaaauaaaaauuuuuuuuuuaaacuugugggacagaguguuacuauauagcacuggcuauccugacacuugcuauucagaccaggauggccuugauaucacagacuccacuuaccucugccuucaccuugcagugucaccaaaguccugugaguaaggugugcaugcuuuuuguguuuaugugugugcugcccuuuuauccugugaccuugcuggaccgacuuauucucuauaugagguuuuuuuucuuuccuuuuuuuuuuuccucuuuuaugauugauacagcuggcccagggagauggcucaguguggguaaaagcacuugccucagacacccuaauguccugaguuugaucccagcaccccaugauagaaggagaaauagacuucugaaaguuguucucuggccuccaaaugugcguuugcauguguacacccauguuuucucccccuuccucgucuucgccaucccucccuucucucauauacagccauguacaauaauaauaauagcaaacaugaugaugaugaugucuguagcaauaaguggauagaguucaggucucuucaugugagaugaagauaucuaguuucuuugcaacuggguuucuaugccaccauuucuaaaacauuuaguuuuuuauuauuauguauuuagaaagcuuauugcuuccuuaaaaauucaauuaaaaaagccucuucuaauucuaauaauuuauuuguuugguuccuuuuuuuaaaaaaugauauauuuuuauuuuauauauauugaguuuuggcacagugccuguggaaaucagaagaguucauuggauuuccugggacuggaguuguaaaccaccuugugggggcugggaaccgaaccuggguccccuggaagagcagcagugcacuuacuuaccuucuguccaccccccccccccgucccccccccgucccccaccucccaccuuguaugugcgugcgcacaaguacaucauucuauagaugggaaggaaaauguaaugagaaaagauggcuaaguuuagggagcacacuuuccuuggcucuuucuaggguugccaucgcuguuuaucauagcuauuuacauuucagccuucguuuccucacaguuugccuaacccugauccccccuccuccucuaguuauuucaggugcccuuagaagaagaaggacagcguggugggccuauucuugcaccugaggagaucaagacuauuuuugggagcaucccagauaucuuugaugugcauaugaagaucaagguaaguuuguauuagaggucaauaucauucuuuuugugggcuguguguaguuacuguaacauuuccgguauuucaaccuagcuacguaaaucaguacuguauguaaaacguagaucucacaauguuucuggcuuucccuuauggugguccuccuuguuuaggcuuuaagacacuacucuaggcucaaauaugguaaauaucuucaauaaaaauuuuugacaugcuguauguguauaaauauugccuacauguuugucuguauaccacgugcaugcuugguacucaaagaggcagaaguugguacuggauccucuauaacuggaguuagaguugugggugcuggaaauggcacauggguucuuucgaucccugagccaucucucuagcccauucaaguuuuuaugacuauuuuguguuuuagggcgacugaggaauuuuaagaacuagggguuagcagauaugguuuauaggcugcaucaggcccucugucucggggaagagugauagcagagcccguguccucauacucuccuuuccucauacuuucuauuuugaucucauucuuuccccuuccuccucccagagggcuccgcaccucccuaccacccagcuucauguuccuugucucuuuuuuaaaaagaugaauauaacaagucaagaaaaaacaaaagacagacaaaaaaaucaagaagacaagaaauacacuaaagcaagacaaaagagcccagaaaaaaagaaaaaaaaaaccauggcuccuauuugggguugaccaacugcuucugguauggcgccuucccuggagugugguugcuaaacccagugucacuccauugcagaaaaccaauucucuguuucccgggaaguaucaguuccuaauaacuucuucguuaggguaggacucacuuaagucucuuuccccuucucagugcucggguucugucuggcuuagacaugugcagguauuauguacaccgccacagucucugagcuuauaugugcucaguucuguuauaguuuugcaagaugcugcuuuuuuuuuggacucauccaagauggcucuuaaaaauauuucugccuuccacauacaucucugaggcccgagaguggagguuuguaaaggcaucccauuuaggacucaagguuccagucucuccucuccccauuuguuacuuuguaugguugcuucucaucguauucaaauucugcagacuugaauacuaaugacagaagacauauggccuuggaauauuuuccaucugucccuuuuaguaagauuugcuugaacccugcuacagguuauaauuuuuaaugacuuguguuaaauuaguugcuacagcagcaggauuaaaaauagccuuuucauaauuaauaaggucgaucaacuuucauagcuaguaagacaaaacaucgaucuaucagucauauaggggaauuaggauuggucugucugacagugcuauuuauguuuucuuaauuaauccaaaggcuguugucuuuguagacaaaaauuuaauucuuuguugugauaagaaguuugcacauaacauuaugguacugcauaagguguuuuuuuuuucccagcagaagaucucauaaauagauguuaagauguuuaaggagcuguuggauuuaaauguuugauuuuuuuucccccuuuuucaggaugaucuugaagaccuuauugcuaacugggaugagagcagaaguauuggugacaucuuucuuaaauauguaaguguuuauuguagaguucacauuuauuuaagugguaucucauuaaggacugacagggaaggaaaugugaaaaugccauuucccaugguuuuaaaaucugcuaggauuguucaugacuuuuaaacuuuuaauaugcccaacgcaacacaagaucauuguucgaacacaguugcauagugacuuuaguguaaaguugucugcuauccccaaaugguguguguguguguguguguguguguguguguguguguguguauagauauauauguauauguguguguauuauaauuuauaaaccuguauauauauuuauauguacacacacaaaaacguauuguuuaucucuuugucugccucuguggaauuugauuucuuaggauuaaggccacauauaugagucaggcaaggauguuuguugaguauucauuacacauuguacuaggggaggaagaaaccuuuuuauuaguucauguuucauuuaaggcuggagguuaggguaguucguguugguguuugccuauugugaauggggacuggauccaaucuuuagaacuauagaaguccuuuaacagagaauaaacaaaucaagagguagguuauagauacauacaccucuccuucuaacacuuaggaaauuaaggcaagaaaauuguaagucagaggccuucaaagccugucccaacaaaaggccuacaaaaaucuguguagcuuacauuuaguaaguaaaucauguguucuagguugugugguuuauaucuguagugcuagcacuuggagacugaggcaggaaaauugguagccugaacuuaaagugaaacccugucucaaaacaaaaacaauacaaaaaucccgaaacuauuuuccuuuuccugaaguccugugacuauaagcugcuuuuguuugaaucccugaggcugggguuaugcaucugagugcaugauguucuuucugcaacagugcuuuuguuuucugaggccuuuuccucauguuuauauauguuuguucagguuguugaggacuagaaacauaggaauuuguuuauuugauggcuuuuaacauguuuaauuggcuaaaacauuuuaaaaauuuaugcaugagugcucuuugcaugugugcuugccugacagaagaagccaucagauccuaauguaggugguugugagccaccgugugguugcugggauuugaacucaggaucucucuggaagaacagucaguguucuuaaccaccgagccauuucuccagcucuagccaagaaacuuucuucauguuuuguuugcaaagauagaguguuuugauuuuaaugguauuucuaugugugcccggguauaugcaggcagguucuugcagaggccagaaggcacacuagauuuccugggauuggaguuacaggguguuaugagcacucuugccuugugugggcacuggguacugaauucucauuugcuacaagagcaauaaauucucucaacagcuauucuaucucuucagaccaaaauuuuuccuuccuuaaguugcauguuuuagguaauaggauugguguuuaguagugguuuggauucuucagcaaacaauaaaugcaauuuuagacucuguacagaccaaccuuaauuucauuuuauguauucugaaaacagauuucaaaugccaaguucauagauaggugucaucauguguagauuauauugugcugggguggaaccccaagguuuuaugugcuuggcacacacuaucaacugagacucaaaaauguguccuuuuuuaaugugugugucguguguguguguguguauguguguguguguguguguguguguguguguguguacauaugugucuuuauuugcuguuuuaugucuuagguuguggauaccaguugaugcaugguuugaauagcaaugaaaaacagaguuugagaugaacucccacucuaacgcugagggugcccuggagcuugggaggccagugugcucuauuacuggaaaucuuggcagucucuugauuuccugagggcugaggccugugccauuguguccagcaucaauuuguuuguaaaggaaaguuguauuaacagaaauugugaggaaacuuuaaacuuuuuuuucuuuugaauauaaaucuuaauugugauugucaauugugucacaaagauuauuuguccaagggugacguucauaaccagcaguuucucuuuuuuguuucuaggcaaaagauuugguaaaaaccuacccuccguuuguaaacuucuuugaaaugagcaaggaaaugaucauuaaaugugagaaacaaaagcccagauuucaugcuuuccucaagguaauauacacuccuaucauacagaauucugagucacuucugaaagaacucauuaaaauagucuuuuaaaguaaauuaaaauagucuuuuaaaguuuuaaaguaaauuuaaaguaaaggaaaauucuacacauauaagaacgccuuaauacuugucuuaaaaucaguuguaucugggaguguuuaugauguuuaggccuagaaauuuggaauuuuauacagcagaggacaagagguaguuaagugaauagggauguuguuuugacugguuuuguauugguggggauugagcccagggccuugcauaugguugguugcccauaugugguuauuuucaaaagaacuaauguugucgguguaguugauaugguacguccucauaggaacuuagaaaggcccgugcauauaacucuguagaggaucacacuuuguaacacgccagccuucccucagcaagggaaaauuguaggucuuggagaauuauugagucauggugaugggccugagagcagcucccguccuguaugaguucuuaauuuacuuggugauuucucugugugcgcgugugugcuugcacagaugugcucaugccagggcuugugcaugcaugugcaggucagaaguucguuaaccuuugacccuguggauucuggggcuuggcauggcagcagcugccuuuaccuucagagucacugucaacugcuggcucuuuucuauuaaaauauuuuugcguuuaacaaauuaauuacuuccuuuuagauaaaucaagcuaaaccagaauguggacgacagagccuuguggaacuucucauccggccagugcagaggcuacccagugucgcuuuacuuuuaaacgguacuuguuuuacugggguuugguugguuuuuuggggguuuauguuguuugcuuaauuuuguuaucuuagauguuuuuauccaauaguuuuccccccuucuuugagagggcaagucuucuguagcccagcugaucaugaucucauagauaugacgacgaccgugaauaucugccucuccagucuccugaaugcagucacuaaugucugauuuauauuaguguuggaguuccaucccacagcuucccgcugcagccagcagcgccauccucagucugcugcauuuuuuccugaagaguugauauccuuauuuucaaaguucauaagguuuuuaagcauuaaaguuuuuuauagauaucaauuuuaugauaaucuugaaaaacagucucuaaagcuacaaauucugaguuuugccugacagucuuuguuguaauagcuguguccuucugcuuauauuuccuggugucacuaugucuaaaucuauuuauucaaguaacaaaauuccuacagagacuucacaggaagaggacucauacccaaguuucuaguccucugaauuuuagcuaaguuuuuuuaauugaguuuucuauuuagccuuuuuuagcaucuuaggauuggcagagugcacaaucccuaaguuugauugauugucuccagaccccaggcauggugcaguccuuuguagucagcacagguuccagggacuggcauagaaaguuugagccugccuaguauauauccgacccugucucaaauuaaucagucucagauugucuaguguacacuugcaauacucuauuauuuuacacuuaaaacuucaggucucaauaggauugucuaucacagcuuuaugauuucaauuauauuucuggcuaaaaaggauauguuuaucauuuauauuugguugacuaaauuaaaguagaaauucagaaaucuaauuuauugauuguuuaccuuuuuucaacaguuuuaguuaguauaaauuauaggacuaacaaaaaagggagauuuuuuuuccccuuacagauuacuuuucuaguugaaauuguuuuaggcuccccugaucuuuaaaccuauccauucuguagacuguggugauggucuuuaaauaauccaaccuuuagguuuucaaaauugaguuuuuaaaagucaauuugcauauccaaauucuucauuccuugauucauuuuuggaaguagagucucacuuuagagcaggcauucuuccagucuaacccugcugaggugggagcagauuccuagcucacaguagggcuuuuuauuaaguagaaguuuaucagauguuaccacgacuaacaugacuaagcaucuuuguguuacuccacauaaacauuagguugauguggugcuagcuuggguauggcuuggguaaggaugucucaagugaggcauagggaacaaagaaagagccugagaaaucugggcauagugguguccugaugucagcauuugagagguggggcaggcagguuggaugaguuagaggcaggccucuuaaacuuagagugaccuguaacaaacuaacaacagcaagaacgccacagaaggagaacccaagcagaacaaaaacuccagagucuuggagaagcaggguuagcauguuagacaugaaugucuccaguaaauaacacagagcuugcucaugaagugugcagaugcucucuauagugggguccuauguuccuauccauacuuaaaaacauguagcaguguaugagauacugggucauucagcauuguaggggaagcuugagaaaucuacaagucucccagagugacugaaaggcaugugacagcaaugguuuugguggugguggugguggugguuguuguuuuaaaaggucaguacuacauauucugaaaauuuaaucaguaaaguaguuuggaaucuuuuuuuuuuuuuuuuuuuuuuuuuuugguuuuuuugagacagggugucucuguguagcccuggcuguccugguacucacuuuguagaccaggcuggcuuggaacuccagaaauccaccugccucugccucccaaguaguagcuuggacucuuuaauggaagaagacaguguuauuagagaacuuugguuaaaacuuuuuuuuuuaaaguguaugcuugugaguagugguaguggugcacaugugaguuugagugcccauagaggccagcagaggcuaucagauucauugcuguuggaguuguaagugugagcagucuaaccuggguacuggcacugaaguaggcccucugcaaaaaagagcucuuagcugcugagcgccauuguuuuaugaaagacacugcggucugggaaauccugacacucacagugcaguuuugcauauaaguuaaguuuuaauucucuuuaauuguaucuugaaaauaucuuaugcugaguaauaauuuuugguuuaauguaauuaaagcaguuggugaacugauagauauuaauacuaauguggcauauccaauuagguguauuaaugggugacaauaauggguguaauaauguuuucaucugugucucucaaguguuaggagucaaagcaugcaccaauagugcugaggaauaagcagaccuaggacucugcuccuauuaagcaagcauucgaccucuaaccuacacauuaagccauuggugugagaauacgccguuacugugcagucaaguguugcuccaaacuugcaguccuccuucucuuaagguuagggauugcagaucugcuguacuguaccuggccacagacuucugcucaaaauaagggcuagauguugucuuugaaaacaguuaaccuauauuaaaaagagugauguauuuuuaaggcguagguggaaaaccacugacuucuuuuugaucauggaaaaaaaaaaccauuuuauuauuacagaucuuaaaaagcauacagcugaugaaaauccagacaaaagcacuuuagaaaaagcuauuggaucacuaaaagaaguaaugacguaagcaguuuauauuuuacuuugugugugugagagaaagagagagagacagacagagauugaguguguggugaacauguggcuuuuaucauaggcaaguggaagucaggagacaacgggagguuguuuccuccguccacuuuuacaugggauucugguauauggggcuguaugcuuuuaccuguagauccaucuugcuggcauguuuuuauuagauuaggcuggaagugauaaucuuugucauaaaugauagaaaaguaucaauaacauacuuuauaaagugucuaaguucuuucucuaguaguaugauuacaguuaaaaugauaaguauuguaagaauauguugaucaaaauauuuauuucugacuuaauuauauguacagagccaguaauggaaauuugaaaauaaacgugaaugcacuuucuugugcuccagagaaaggcuuuuccauguuauucacaugcauauggucuuuuucauggggauuuucugauuucaauuaaaaucugucuacaaaccuugcauucauagguccucucaccagcugaauuuucuuuuucguacuuuuuauauuucuugaauaaauuuucucaugugaauuaaacuucauucagugaaggcuuuacacauuccuuaaauucaggaaguucuuucauagaacauucucccauugaaccagauccuaaccccaugcaagcuuugcauuccgaaggcucccugcugauguugagcagggcaugagcucuagcuagagccucccugccccacuucccagugguguuucuccgugacaguaacuucaguaaguuugcaccgugagcagagguguuccucaccucuuagcagugaaaguucccacacucuuacauucauaaacuguucaccgcguaaauucucaggguccaguuagacgugauuguuaaaugagagccuaguccaauaaacacaauuuugggcuuuuaaccguuauguguuuucuaauuuuaagaaaaauguuugacugauuuuuaguuuugaacccaaggguaaaaggcaggcggcgucuaagccacccugucuaguagccgucgcccuuguggcuguucggaaaugacugccguaugacuugagaggaaaauauaaagccuaaugcaaaguauguuucaaaccugagaauuuuguuaacaucaaguauuauacaggcuaacuguauuuuagaagguguaaauccugaguaagauguuccauaguaagguauaacaauucugaaagauuccuuggaauaauuuuuaauaucaggauguuuugaaggaauauuuaucugauucauguuucacaauuaaggcacccgcaugaaaguugggcuuugugacaugagauuuauuuguauacugauuucaaugucuauauuaaaagaaauuuuaugaaacaaccauuaauuuuccagacauaucaaugaggauaagagaaaaacagaagcacagaagcaaauuuuugauguuguuuaugaaguagauggaugcccaguaaguagcuuuugucgauggccauugaauuuucuguuuuagugagguuucugugguuugaauguaaacagucucaggcugcagagaugccucuggcuaugugcacuugcuguccacugacucacuaccuaugacuccagcuacagaggacuggaugcccucugcuggguucuagagugcaguaagcuacacagagaaaacauauacacgaagagacaacaugcauauaaacagauuaacagucagagugccacuuuugaauggcagcuuguaaaagcugcuugauaacauuugacuacuucuuuacuguucacaggcuaaucucuuaucuucucaucggagccuggugcaacgaguggaaacgguuucccuuggugagcacccuugcgaccgaggagaacaagucacucucuuccucuucaaugacugccucgagguaaauuuguacucauugaaguuuaacacugcuguauuuugugaucucccuaauuauuuaaaauaaagcuuuaaucgaaguacaauauagaaauuugagguauauucaguuauuuuucaaaaaaaaaauugcugauuucauaaugcggaauacuuuuggggagaaagucuaauacuaacuuugauacaaauuuccagaaugcaaaccaagucagaauuccuuacaaguaaauuagaugaugaguucuggggaaccuuguuuuuauguauauuuauucaagauacacaaggugggguuuuguuuuguuuuguuuuuaaugaaaauggaaguaggcuuuagcagcuaagaugaaggcaauugaggaacuaauuugcuaacuuaguacugugacuccuugauuucucuuuccuauguugguagugucucacucacucuauagccccaaacuggccuugauuccugggcagcccuuccacuccagccuccccaagugcugggaugacagcaugagccacagugccaaauugaagucuuuaaaauaagguuuuagugauaagauguaguaauucuaauucuaaaacucucaccuguguauguucaguauuuucuuuccaaugguaccccacaggcaaauaaugaguuuuuuaacaauuagcgaauauaaugaggggauguuucuuaggguuucuauugcugcaaugaagcaccauuuucaaagcaaacuugggggggggggagggucuauuuggcuuacauuuccagagcacuguucaucaccaaaggaagucagggcaggaaccugaggucagaagcugacucagaggccacuucguggcuugcucagccuccuccuccuccucuucuucuuuuuuuccuuuuuaagagcccaggacuaccagcccaggcauggcaggaauagcaccaccgacagugggcuggacccucccacaucggucaccgaggaaaauacccuauaggcuugccuacacccugaucuuauggaggcauuuucuucauucgguuucuuccucucagaugacuuuagcuugugucagguuaacauuaaacuaucuagcacagguagaaaggaauacaguguucuuuauuucaaaaaagaaaagauguucauuuggacauuaacaagaauacucuuugacauguuuguuccuggguaacuuucuguugcccucaucaaagugucugcgggcuuugcuuuuuccuuuaaguccgugcuacuucucuuaaagagcuccucucuuccauuaugcacauuauuauuuaaaguauaaaacacuagcagucuuagaaaccacagcaugcacagaguggauuaaagggcaguggaaucucaaggaagaccuaccucugauaaagggccuuguacuuagagguucagaagugauacuuucauuuagcuaguaauguuuaaaagucacacacugggugacugaauugcccgaaucucacccugcaauaaccacucagccugcucugcuuuugaaaacaaggucaggugucaaucuuaaucccauuuuaccugaaggugcguucauuagcaggggccugacugguuuucuuuguuucuguuaauaguuuuugagguuuuuuccuguugaaaucucuaggucugcuggccucauuuuguuagguuggguuauuuagguuucuuuaacaauugcuuauggaauuuaucuuugcuuuuaguacagcugugauuuguuuuuuaauuuuauauccccuucauauuuuaccauaauuggcucccaagaucccuugugcuuuaauucuuauuguggccaucucuguaccuuuucaagcccuggccucagucucuuaaccuucaugaguccagugacuuuuuguccuccuccguucuagucaggguuaauaaugcugugaugaaacaccacgaacaaaagcaacucagggaagaaaggguauuuggcauguauacuuucauaucauuguucaucaucaaaagaacucggggcaggaaccugaaggcaggagcugaugcagaggccauggagagugcugcuuacugccuugcuccacaugacuuggcucaguugcuuucuuacagaaccuaggaccuccaguccagggauggcaccacccacaauagaccaggccgucccacaucaaucacuaauguuuuauaggcuugccuguagcggaguauuauggaggcauuuucucaguugagguucccuccucucugaugacucuagcuuguuucagguuaacauaaaugccgucagcaguccuauuagcuucuaucucaguagcuugacuagaaacggcuauuuguucuuguuuauauuauuuugagucuggcaaggacuggccuuguaaucuguuugccucuuccuuuucagugcauucauuaccaguauguguacccacagcccagcugcuuuaguuuaagacaggaucuugcuaugccuccuaggcugguguaaacuaccucagccucugaaaugcuggauuagagacaugugucaccaugccuguucagcuaccguauuucugauaauaaguuugcacuucaggauucauacuccuagguagacccuuaguauuucacucacuuaagaaaaauaaaauucaguaaaauugaaauuaaaaaguuacuuuuaauacuucuauauaauauaaaaccaagagcaaucacuauaccuguacauuaagaacaguugaauauuaguacaucuguauuuucuuaaauaugacagaugacuuugaggaauuuauuuuccauuugaauauuuuaucugugcuuuggguuuuuauuuuuauccuugguuuauuaguacuuguacuaucaauuuuaauacucuucuuuccuuuuuaaaaauuaaucuuaaaauaauauauuucauuuagccaaacaaaaagaaagcauaucuguucauugcacaggaaucaguauccgcugcuuacuuuucacgauaugugugugagccuuuguauuuguuuuauacacaaaugcauauauaauuuauauauaagauauguauauaauuuauuauaauauaugugugacauguggaauagacacaucugugucugcuuuaguguaguuguaguauacugacuaccuuaucuuauucauuagcucaauaccagguaauacauuuuuaacugugucucucauauucaugaugaccgaucucaauucaaguacauauuuauguucauuuaguguuaauaaugccuuucaguaaaaucugaauuacugcaaaggagauuucuucuuucuuuccuuuuucuuuccuuuuggcaaaaucucacuauaucacgaaucacaagcucuuucugauuucgcucuucuccaguucccuauuucuuccuuuugcauggguauccaguuaagguaaaguuauagccuaauacagcacuguggauuuauaauuccuauugcuucuguguguguuguuguuguugcuguuguugaucuguugagacagccucacuguguagcucgagguggccuggaacugaaagucccgcucuccugcagugcccccuagagcugggguuucggguggaugcuuaucuuucugcagcuucccuuuggcaggcuucuguaagcaagccugaggacaggaccgaucucacacuucuuguguguucuguuacuaggagagauuucaaauuuuuuaacuuaaacuaaaauuaacaccauuuugagcccuagacuccugccccagaacaacuguuccccuguggggcugggacuguuauucuagaccucuguugcugucccucguggucuuguccuuucaugcucuggagucucucugcgcucucuaucccuaggccugcuuuucugauugugaacuuuccuaauauggacaugagcaucuggcuacauaauuacaugugugcuuuuucgucagucucuugcuuuuauugcauaguaacuggcauggcuaaucuucagauuaguugccuauacauuuaugugauugacgcuguuauuuuuaaauguuugaaauuuggcuuuauuacaauaaugauugacuuucccccuacaaucagauagcaagaaagcggcacaagguuauuggcacuuuuagaaguccucacgaccgcacccggccccccgcuucucugaagcacauucaucucaugccucuuucucagauuaagaaggugcuggacauccgagagacagaagguaagcucauggaggaagcguuccuuaacuuaacucgcuuguccucguugagccuuagcuuuauuacuguaauuucucuauguauacauuaauguauccauuuucuucacacguggcuccccaucagcuccuucccuaggugcagacugaugucuucaugguuucuaaugaaaguguuacaccaucuugaggaauauccucucuuaaaagucaaacaacuuuuacauggcuaugcuuuaaaauagcaccuuagcuugucuuauucccacaucaaaacuuacuaauaauucuucaaaauccaacauaaacgaccaguuuuauucaggaccauauauuuuaauacuuuuuuuucaccaauggugcauuuuggguucuuucuuuuucccauuauguauggauguuuauuuaguguccaugucugugugccucauccauacagugcucacggaggccgacagaggacacacauccccgugggaguggaguuaagauggcugugagccauguggaugcugggaaugaacccagguucucuggcagagcagccuaugaggucuuaaccacugagccauuucuccugcuccaggaaugucuuuaagauuugggaaggggguugugggagugauuacaagacgguccaauguguaaaggugccugcugccaagagugaccugaguucagucucugucacccacauaguggaggaaaagaacucauucccacaauuuguucacuaaaguccacauacucuagcaugagagugugcauaggaauagacaaucacaccauuuuuuuuuuaaagaaaagagagauuauuaguagauguauaucaaauaaauagcccacaguaucugguaacuuggcauaggauuaaguacauacacauacauaugaaaaagaugggugucuuggcucacuccgauccuagcauuugggaggcagaagaaagcagauuucugaguuugaguccaguuauagguacguaaugagucacucaaaaacaaauaauaaaauacaaguaggcauguguacaugugugcuaguuuucucuugcaacaagaguccugagauaaugcauuucuaaagauacuuuggcugaugauuuuggagaguucaauccauucuuuggucucacugcugugaaugguggugacaugguucaucaugucugagagcacaugauggggccucauggcugagcugugaaauggcauguccuuagccaucuagaaccucccacucuugcccagcuggagacugagccuguaaacgcuuuuggugacauccugucccaagggaaaguuuuccuuuuuuaacuugacuaguauuugauuuuucuguaggucugaaaaggccccacuacacaucuaccuuaaguugugcuuucuaguuaagcaguacuaguguuguguggucauggucuugguuuaggaaaucuuuucuuuuuucuuuaaauaaaugaagugcuuuaggugaucugcuccugaguuuguaagacaugagcagcuccucuuucuccuguguguugcuacuaaucagacccagggcuuugcaccuacuugucaauuccccuaucccugagccacuucuccagugcacaguaacuuacaaaacugguuuucaccuguucaauucuguuuuguagagccuaugaugaggcauuuacuuaaauuugguggaguugugguugugaaaguguucaaaacacacgagugaguaucuguaagaugcagaucagggagauagagagcacuugauuaucugaguucagucccagggacccugugcuggagagagcaguccucccacagcugcccuggccuccacauggucauucauuguaauuuuaaaauguuauuuuagcaucucaauuacaaagcaauuauguuuugauauuuguacccuuugaauuugauuuauguauguuagugauacaugcucucauuuuacuuuugaaauuacuagaaugcuaagcaauguuaccuauuuuuuauuaaccuaucagugagacacuucacagucacagaacccugcuuacuuguucucagguuccuuugguugcuaauaugugguuaauucuucccagucuucaaaugacugcacugaugcucccuuugaguugaaaaaagcagggcagagagaggagggaggugauuuugguguucgguggaaacgaaugucuaauagcuaaggacuaacauuguuuaugguuguucuggaacccuagauugucacaaugccuuugccuugcuuguaaggccaccaacagaacaggccaauguacugcucagcuuccagaugacgucagaggagcuuccaaaggagagcuggcugaagaugcugugccgacauguagccaacaccauuuguaaggcagaugcuguaaguucuuaaaccugugucacauacaggugugagcgugcacagugcaaccagagugaaugacuacauuuccaguggccacuuaaucauacaucggagagagccuuuaguuuuacucagaauacugaaaaccuacguuguuuccugaaggguuuuuaaauuuuuaggcccaugaaauaucccaagucccugauucccagauggucaguuuuaacuuucuagcucuguggcugcacuuuuauagugaggcuuuugggcacuuggaaugcacggugugcuuuuuguagaugcuuuuccuuuuaaucagggaguuuaguagauuuauauuaagguaauuuugcauauguaaugucuuuuuguuuuuuggguuuuuuguuuguuuguuuguuuguuuuuugucuuucgagacaggguuucucuguguagcccuggcuguccuggaacuguguagaccaggcuggccucgaacucagaaauccaccugccucugccuccugagugaugggauuaaaggcgugcgccaccaggccuggcaauauaaugucuuuuuuuuuuuuuaauuuuuuuuuauuacguauuuuccucaauuacauuuccaaugcuaucccaaaagccccccccccacacucccccccacacuccccccccccacacuccccuacccacccauuuccauuuuuuuggcccuggcguuccccuguacuagggcauauaaaguuugccugaccaaugggccucucuuuccagugauggccgacuaggccaucuuuugauacauaugcagcuagagucaagagcuccgggguauugguuaguucauaauuuuguuccaccgauaggguugcagaucucuuuagcuccuuggguacuuucucuagcuccuccauugggggcccugugauccauccaauaguugacugugagcauccacuucuguuuuugcuaggccccagccuagucucacaagggacagcuauaucacgguccuugcaacaaaggcuugcuaguguauggaauggugucauuguuuggaggcuaauuaugggauggaucccuggauauagcagucucuagaugguccauccuuucaucucagcuccaaacuuugucucuguaacuccuuccauggguaauuguuuccaauucuaagaaggagcaaaguauccacacuuuggucuucguucuucuucaguuucauguguuuugcaucuuguaccuuauaucucgcuauacuaaguuucugggcuaauauccacuuaucagugaguacauuucauuugaguucuuuugugauuggguuaccucacucaggaugaugcccuccagguccaaccauuugccuaggaauuuuguaaauucauucuuuuuaauagcugaguaguacuccauuguguaaauguaccacguuuuuuguauccauuccucuguugaggggcaucuggguucuuuccaguuucugucuauuauaaauaaggcugcuaugaacauaguggagcauguguccuucuuaccgguuggaacaucuucuggauauaugcccagaagagguauugcgggauccucugguaguacuauguccaauuuucugaggaaccgccagacugauuuccagagugguuguacaagcuugcaaucccaccaacaaugaaggaguguuccucuuucuccacauccacgccagcaucugcugucaccugaauuuuugaucuuagccauucugacuggugugagauggaauaucaggguuguuuugauuugcauuucucuaauaauuaaggauguugaacauuuuuucaggugcuucucagccauucgguauuccucgggugagaauucuuugugaauucucacccgaggaauaccgaauucucaggugauuaaguuagccucuaucagcagaccugggagacuagcucuauccuuaguuucaguggucagaguacucucugcaugcaagcucuccucuugcagggauggugaucagauaucugguguuugaaccugccuccugguagaaguuguguuccacucaccagaggccuuaggaucccguggcugauccuguguggguccuugcggguguccggagacuccccugggccagggaccacggugcugcagugggccggccggaagggacuugagccccauaucaggccggguuaccugcuuccuuaauuacugcagucucagguccugugcgauuggauuggagcaggcgcuguguuccacucaccagaggucuuaggaucccguggcagauucuguguggguccuugcggguguccgcagacucccccaguccagggaccucggugcagcagugggccggcuggaagggacuugagccccguaucaggcaauauaaugucuuauguagcuguuuuacaaguuguuuucuaacuuuuuuuuuuuuaauuaaaaaaauuaccauuuuguguucaccaguguuuugccugcauguauguuuguggccugacuggacuuggaguuacagaugguugugagccaccaugugggugcugggaaucacacucagguucuuugaaagagccaccagugccaucucuucagccccuucaaaugaaaacccuucugaaauccaguaaugaaagucuuugcucagcggugugccaaaguuguugcaagcucucuucauuccuguuuuuuuucuuccugugacuguacuuuugagauggccugccuuugaacuuugaacucaguauuuuauuuuuguuauuugacuuaaccugacauugaugcuuuuuucuguuaucuuuguaacauggugaauuuuuuucugcacagugaucuuuuuuaauugcucccaucacuauuuagugucugcugaguguugaaucuuuucugucuucuugaaacuugaguuuucuuaaaacaguuuuucuuaaguuguagaguguguaguccauccuaguggugaagccaaggcaguaggagcucugaguggcuggucacggccucgcacagugaggaggccgugaugcgugugcucgcuuuuccuucucuuuccauaggucagcaucccagcgugcugcagcagaagagugccacccacaguagacaggccuuaccacauccuaacccaaauaacccuccaaaggccugggcuccguaggaucuggcucagauuaagcauccuggugguagaggcagucuuucugcuguugguuagcaugguucuucaguauagccccugguuuuggaacuuugcucaguauugguuucaucaugguaugcccuuuggugaguuucaaguccagggccugaacuuaauucuuccuaggccagaggcaucuucccccuuugcuucaaguggaggagagagugcugcaccuugccucuugguuaaguuaaaagcagacacuguacccacucgucugacuuuccuuagcacuuaggaugaccuuguuuccuaucacugugccgucuugcuugccaccucagccucuggcuuccuucgcuccuaucccguaauuuccaucggccuucuuagguauggauaguauuggcagaauauuccucuuucaaaaugcuuggaaccaaaagugucucacauguuggcaaaguuuuucagaugugggguaucuguagacuuuccuggucagauauaucucucgucugaaguuaugagacaaguugcuccaagauucaguauuaagugcacacugcuucauggagcauuggauuaugauuucacauuguuagauuaggggagcuugacuguaguaaaagaaagagcauuuuguuuucuuucuuacugaaagcaguaccuuucccgacacguugccuguccagguuucucacagcaacucuuaaaguaccuuuauacuagacagauuacaaugagaugacuggaaguaaaugaauugccaguuauuugagauucuaucguagcucuuggaugaauucaaggccccuuggaagauaacgugaucuugucagguuguuagauagagagcccuuacucugcagaaaugauacagcgaauagaucuguugcugaaagaaauugacacuguguaguaauaguauuaagaguuucuugggccuucccaggggaauaacauuuuaccaaauuuacacuugccuuauaaugauauuacauauaucaggguaaguaacagaauggcuuaugcagucuuuucuagguggauaacuuuguaacauugaaaugcaaagcuaaugaaaaguuuugcuuaaaguguaauuauuggcuauaagaugaauaaucauauuagaacugaacuauaagcaacaaaugcagaaaauuucagauaauauaauuauccacaagauggcagcaaacauuuaccuauguucugauacagcacaaaauuauuccaguuuguugaaauuuuuuugccuuaagauuugcuuaugcauugaaaaauuuggugacaucaguaagcucuuuucugaguuuaaggcuucacacauaguaaaauaauuuaaagccccucauuuaaugucuuauuugagaauauuuugccauauugaagaaaguauguuucuaaauauguauguucaaaugauauaaauauauguacaacuggucauuuuuaaaaaagcaauucugauuuuuuuuaaucaauaguuuuugacuuuaaaaaaaaaauucccuaaauaauagcugcuugcucauuuuguuguugaagucuccuuugguauguaaucccagggaguccucagaccuguuaggauuaccacaccagcuuaaggcuguuuaacugaguaaaauaaguaugauuauuuuauuguauauacuguuucauuuauucugaccauuuguaaaugaguuaacaaagcuuucaggaugaaagaaaacuuuaaaacaauaugugugaaacuaaagccaagaauaauaacugaugguuguauagccaacucuaggacucaggcaucuuuauuuucagucagaccuuuuaucugugugaauuucaggcuguacccuagucccacucuuuucuucucguaccugccuuucacccuuacagccuccccuacaacagagaaaaaaaaaucuugugggagcuguaguuuuucacagugugucucacaguagacucuuuugucuacauuucuuugcuugcaaauguucauuuuaaugacuuugguuugggucaaggcuuuugacuucugcugaacuaucaauauuggaagcacugggacuccucucaaauauccuguugucacccugugucauggggauccucugguuuugggucuauaggacugguccccucaugcacuccagcaguuuauugcugggguagauguuagggagggcaaauucaaaguccuggguugggcccugagcuggccugccugcugacuuuucagucucacuucauugggccagcucuuggccuuccacccaacccucaucagggucagcucuacucuuguagcaggugaggaguagggccagcucuccuuaugcuccuccucuggcuagcuuaucugcaacuacugcauuuuuauggggaagggugcucauccaaguauggcaucaggcuaggguugggggucagcucuuuuacuuucauaacccaaaaaacaguucugcaaacccucagauaucaacaugucccuaagaggcagcccagaucagggacauccaccuggccuuugguaacagaccccugcugcugcaaggccaccuacccccccccccccccaaaguugcagcacuguccaggauccaggugacgucacuggccgcucacaucaggcuguuccuaccccugagucuccaguucugucucuucauugugcccacguccuuccguuucucuuucucuuccaagucuccaccaccuacuugcucuacuuaguggcuccuuggucgcugagugucugggguuaucucugaaguggucucaggagcacgugcucugcccagcucauguguuauagugcugggcagggguccucucaggcauggucuacucccccaggccuuuguggugccagacuggugcucaucuaaggcuagcucccugaccaggcccuaccggcacuggucugguggucagcuugggcucaucuccuuacuggguccaccugaguggccccauguaaggcuaaucugucgugggcucacuccugcccagggcucaugguccuagguguaguucuucuaguauccaguuugcuuuccacccuggaugcccaucugggccuuggaggugccagacuggugaucgucucaagcuagcuccccaucuggcacuggacuggugaucaugccagacuuaguuuuuuucagggaauguuaaggaauguuaaucaaucauuuaaauguucacaaaucagaacagagugaagaaauagccugucucucugccaccuacugaugcacaugugacauagcagccacacuuguaggggcagggcagucaaaucgcuguguuaucucugcuuccuaauuauaugauuccccauguucuguguuuucagaauguaauguguaaaguuuagucugcuuaaaguguuaacucagaauauauacagcaacguuuccagucucuucccaccauguauauuuucagucagggagguguuuuuuugugacacacauacacacacacacaaacacacacacacacucauacacucuacacacccuauacacucuacacacccuauacacauaccuuuaauaccaaugguauaguuuuaugaauacaugaacuuaagcauuguuaucuuuggccaauauaguuaagucuagaagaaguaacuugagaguuaaaugcuguaugccauuauuuaguauuuuugacacuaacucagaguuucuaauaaaaaauaaaaaccguauucuauaucuuggcaggagagguggcucaguggcuaagaguacuggcuguucuugcauagcacucaggugcuguucccagcacccacaugccagcuuaaaacacucuguguccaguucccagggauucaaugcccauguccaucuucugugugggcacuaggcaugcauguaguguacacacauacauuuauucauacaugcauauaggcaaaauacccauacacauuaaauauauucuauaucuuaacuuuaauuauugccacugauugcuuaugaauaacaguauuuugauuuuuuaauaauuuuguaagcagaauuauaacuaaaggggaauagacauaggaacuguaggaagauauuuauucuugugagccaguauuauuuauaaugaaguuaauauaugauuuuuauuaacuauucuguagauuauauauaagaugcauauaucacuuagaauucaaaacuauuggauccuaaauguuaagaucccaaguauuccagauuuuagauuuuuuucuacauuuugaaauauuugcauauguauaaugugauaaauuggguauuaugcaaguuuaaaccugcaguucuuuuguuucuuauagucuaaagauaauuuguuuugugccugugggagccagggaguuaagcuuaaggaagggaaagaaggaggacuggguaacucauguguuagguacuuuuaucguccuuagauaccagaaaugugagaucagucugugugugcacguuaacuagcauuccuguguaaacuuguaagccauaacugacucccuuucacuuacaguuggcucuguaccucaggagaggcuaguguuuuucagucguaaauucagcacuuguuucuguguuccucuggggucuauaggcauugggcgguaauugaaaaacugccuucccauagcuucuucucugugugacacacuugacucaacuguaaauguuuucagaauuacggaauuauuucaggaaauaggagcugagcuuugcuuuagauuucguucauauuuuauuugagaaacucagagaaaacgauuaaaaauaaaggauauuuuugaaagugcuguaauuacuaaugagagguaacaggaucucccccacgagcacguuugccugcuccucucacuuuucuccauguuugagagcugggagagugcuuccuuccuccuuggaucucagcgaacagcuuguuguuauucaguccucuaguggaguaccugggcauuucuccuuugcuucaucuugaaggaaagccuucuccgguugcaaaagagcuuaugguuuaucuucucaacucagaaggauuuauuucuuugagaaaauaaccaugaaacuacuuucccccuucuuaguucuuagguaguuauuauauacucauuaauuguuauagcaaaaagaaaagguuuaaaaaauaaaugaaagaauuaaagaaauaguuauugcaauaggaaaauagaucaugaacuugcuaacaccaccuuuuuuguuuguuuguuuuuguuuuguucuuugagacaggguuucucuguguaguccuggcuguccuggaacucacuuuguagaccaggcuggccucgaacucagaaaucugccucugccucugccuccuaagugcugggauuaaaggcgugcaccaccacugcccggcgagacaccacccuuuucacucacuuauaucaauugcuacaguuuauuauuugugugucaauguuuugccugcaugccugugcaugugugugcagugccuggagaggcccagagaggccaccugauccccagaaguggaguugaaagaugaaagucccaugugggugcugggaaacacuggguccugagggcgaucaguagaugcucuuacugcugagccagcccucagaccccagagucuacaguucccagcuccuccacuguaaagagcaguuuacagaaauggggcauagguggaguuugcuucauuauaugaacugaggcuuuuuuaauucaagaaauaaauuuuaguuauauauuuaugcuaugacuuuuuaaaaaugauauuuguacauaaaaguaaagacaaauaaaauagauacgcugcaguaauacagcauaccuuuucccuaucccauuggucuuuccguucaggagugugugguuuuguuaugcuuuguccuuccagaaacaaaagauuagguguaugcuuucuuugaaaauauauguuuauuagaaucaccugggcgauuuucucuauaauaucaugcauugguaccuagguuguuucugguuuucuuucuuucuuuuuuuuucuuuuuuucccuguaaauaggugaaucucuaauacauuaaguuuuuggccagccauacuauuuuacauaguccuuguucacauaauuuucuacuauucuccauuguaauuuucagcuuucugauuuuaaaacagugcugcaaguugaacaagucaaaugcacagaaauuauauuuaaauguuuggacuucccaaugaagaguaggaauauguguguguugaugccagggagucagucccuggcaucuuuuuagccaguaguacgcugcacaccaucgugguccuucuguaagguagcauugugguuuuguuugcacagcuaugaaauuacauccccguugggaagcagcgcagcgcuucagugcgcacguaauugguggugcuauguguaaagcagggcagggagcagaaccucacuguuaccuggagcaggagguguguggcacucacuuagggugccagucacugcugaggagauuagaggagccucagaccuguuaggaccuucaacuguuugguaaaguagugagagcacacgccugugucaguaguuauccuuaaugacaucucagugucaucuguuaggaaauguguaggaaucgucuguuaagaaacaugcaagcuauuuuaagauguuuguguuuggcuaggauuauaguucagugguagcaauuucuaagaccugcugucaauauccagcauaaaaagaaugaaacagaaaucugcaguauugagcccuugauaagauauuccugagugagaauguuaauaaacagguguugauucaucuucaguuaguuuauggauuucuuuugucucuaaaauccuauagaaaacuuuuggaauuugacagaaugaucccuaagagaauuucuaaagaaaauacaaugauaccuagaaauuuuaguagugcuaauaccauuugaaauaguaacuuauacuuaagguuugauugggacguuuguuuauuugggagaguggauguggauggcacugugcacuggagcaggaagcccagaggauagcuugugggaguguguugcuuuuccaccacaguugguucugggaucgaucggauacaggcaucaggcuugcagacagacgccacacucacugguuucaucuuucuggcccugaaauuguacuuuaaaaagugauagugaucagaguguaucgcccuguuuuaacguuuauacaugaaccuauaggaagaggaaacuuacagaaaguaauuuacacagauggguauuuugccguuugugugucggggcauucagugcacagggaggccagagggggcauuggauccuaggcacuguaguuacccgcgguugggaacugacagguggggguuuggaaucaaacucaggaccucugcaaagcaguccucuuuacuacuguugggccauuucuuuagcuccagaauacauggucuugaaauaaggcugucauauuaguguagacuuuaauuaaaguuauuagcccauggcacuacaacaagaacuuagauguauauccuauuucuuuccacguauauuauaaauaagugugaaaagaugagagaccauuucaaaagcaaauauauguggcauguauuaucucuuuuaagcaguaaguacuugguaagacaggaggaacauaaguuacagaguuuaacaaaagagguguccauauguuaauaaggaauguaaaauaaaaauggacaaaaauaaguaauaaaauacacuuguuauuuuuugacuuuaacuucccuuuaagggacauauaucuacaaauacuguuaucuguuggagauuggauuagucuguaauuuaacagaugugucaaaugaaacaagugguuugaaggcggccaaaugacuuugucuuguuuuuaauuuuaaaagguucaucuuauuucuagcuauaugcauguagggcaaauaugugcgugugggggaggcagaggacagaggaacagggcagaugggagucuuccaaugggugcugaggacugcacgcuggcuucugcuacagcaguguaucaguuaaugccugggcgacaucuucggccccaagugugaagaaacgugaagaaacuaagaaagcuuuagcaaaauaagcuguuuggcugcuaaugguggagagcaaaauaggcauacauaguuaacuuuuguuuuauuuuaaauagccuuuuaaaauaaauagccauuguaauuguaggacauauuguuuaauaauuugcuuguaguuuggcauuucagucaguucugaguuuuaucaggcuuucuccuuguacuuuaaaagaugguauucacaguucugcaguuacaggccuggucaugcuaacuuguggcuucucagugccugaagaaugaggucauugaucuuuuucagucuagauuuauggauuuaaaggggaaacccuucauaggaauaauggguagacuuccccuuugaaaguccaaaguaauauuuguaauuauuuggagaagggcugucugguacuuuagauguugugagaucugggaaaauggagccaauaaaugaggagucucauacaauagcuuuauucagagcaucagacaauuuauaauaacugaagguuaagaacaguccugugggggcuggcgagauggcucagcggguaagagcacugacugcucuuccguagguccugaguucaauuuccagcaacaugguggcucacaaccaaccaucuguaaugagaucuaaugcccucuucuggugcgacggaagucagcuacaguguacuuauguauaguaaauaaaucuuaaaaaaaaaaaagguccugugaguaaauuguacaaucauacagauaagcuccaggaggcaaaaacaugguuuuccauagagacauaaaaacaauagccaguuguacugaaaaaucugaaguaaacucacucaaauccacgcaccugggagggacacggaaacacauucuaagaacaaguccguguucugaagaaacugaggucagaagacucuugaguugcuuucuuggaguuuucucacaagcacucagcauuccauucacaugucuccauucuuggacguguucugacaaagguuaucuuguuuuaaggguaauuuuuggugcaugguucuuugcuugcucuaggagggcuuuugcuccuuggggaauguacucuauaaucugugaacccucuuuuuuggaaagagcacuucacucauauuuacacaaaauauuugcaguuuccaggguguuacauauacccugauaucuagcugcuuuuuccguagggacucaggaugucgggccagaacuucuaauuuagauuucuuccagacacaaacugaggaagaaagucaggugugcgucucuuaagggaagugugugguuuuuuuuggcuuugagggauaaauuuaaaagaacauucacuguuuuaaauaauguucaguuuuaggguagguaguaagauuuuguauggauguauucccuguuugaauuauguggucuauaguaaacuguucguuuacauaauuauuuuucauuaucuccaaguuacuguuuuucaggguagaaauuaaguacacuguugucgauagugggguaggguggcacgauggucagauccaggacauaugugcuuuaccacugagccacauccuagcccaugucacacgucugagguagcuucaucuauaaauguuaccaugugugggaaugggcaugagugcuuaaugguuugauuuuagaaacaguugguuuuugaacuuuauuuuucaacaggagaaucuuauguauguggcugauccagaauccuuugaaguaaauacaaaagauauggauaguacauugagucgagcaucuagagcaauaaagaagacuucaaaaaaggugaguucuagugaaauucugaggauaucucuaaaugugcuuuucacauuaaauuaaaggaacguugccuucaacaccaauaacagaauggucuagagcuguugugaggaccugagugaguucucucuuuagaaccuacggagcugcggcagagucgggagcacuccuggaguuuggugucagcuaguguagccgacuuggugaaguccaugcuaggagagaucccaucuuuagcaagaaaaaaguagaaagcaccugccugauacacaucagggggcccuguacuguacccgcauaaguacacucgugcaugcacguguaaacacacaaacacacacauaccccaguuuacaacaaagcugaccuacaguacuuggaaaugacucacagauuacauuuuauaauggucagugacuucuuugucacagugcuuacaaauagcuugcuguugcauucuuuuuuugguuugguuugguuugguuugguucuuuuuguuuuuuuuuuuuuuuugagacaagguuucucuguguagcccuggcuguccuggaacucacuuuguagaacucagaaauccgccugccucugccucccaagugccgagauuaaaggcgugcaccaucacagcccggcuugcuguugcauucuuguugcagugacuauuguaugaaccagacgugagugaguuguuggugauuuagguauaagugcauuuacauucaucuuaaugcccaaaacaguuuucagcaaagcaugacuugaguuaggaaaucuaggcucuguucauguuaucaucuuauauuaguaacggaaaguagaagugagcugggugugcuggcgcacaccuuuauuaucaguacuugagaggcaggcagaggcaggugggucucugaguuccaggccugacugggcgagguagagagaauauguuucaacaaaaccaaaaaagaguagaaguagaguuucagagagccacagagcacuugcagccuuagagcuguguuuuguucccuuugagagggaggcccuguucuaccuuuacauacacccucacucaacaaugcagcauaggagacgaccuagacaguaugauucagagggagccuucacuugcacugaaggcacuaggguuuaagugguguuggauuacacgucuacacugugccagaguaagagaaaacccuuagcagggguuuagcugaggauaaagcuuuuuagcacacagaauuccuggguccaaccccagcccuacaaacaggaaaacagaaaacaagcaccacagcaagcccuaaguucuugugucccaggcuagcuaccauccuuuuuguggaaagugauagauugggcuuucuuuguguagacacauuuuuauggaccaucuuaaguuugucuagcuauaacuaauguuaauacuuuuaaacuucagguuacaagggcauucucuuuuuccaaaacucccaagagagcccugcggauggcucuuucaucaucccauagcucagagggaaggaguccuccgagcaguggcaagcuugcugugagccgucuguccagcacaucauccuuagcaguaaguauuggguaauguggucaaggccuugcuuagaugcauagguugcugcacuuugauaauguuaagcaaucuauuuuuaaaaaacuuucuaaauuuuuuuaauugaaaguuuuagcuuagcuuacaaaguaauggaguuguuuuacugucuaaaccucuaacuuuuauuuuacuuauaaaagcaauugaaagauccugccccccucccaauuuuuuuggggguggugguggugguagacagggucuauguagccuuggcugucauggagcuacuauguagaccaagcuggccucaaacucucaagaugccugucuaccuuagccuuccaagugcugaaacuaaagguaugcgcucccaugcccagcuaagagucuccuuuuauuggguuagcuacauaccuacuauguagcuuauuggaugugaaacuuuuacuauaacugaggcauucuaauuuccguaagaagagaagcuuguuuuggccuggcuucuuacuuuauaaauguuauauuucuguuugaugaguuccaguaacauuggacuaagguuuauuuuuuuuucaauuggcuugauguauauauacuaaaguauagaaauuucucuggaauccgaagucgggcacauacuuaaguguuucugaacagucugcaauucaguuuuagaaugcuuaaggcaccguccugccuccccagcuaggggcuuuagaauuacuagaggaaaguuacguauugucuuuucuuuuccaaauuucaaaaaaacaaaacaaaaaaaaaaaacccguuagucaacacugacauuugugaagaauuaggagcuauggcaaacaguaauggagacaagucucaugaaguuuaaugggagcucauuguauuuauagaagaaaagaaaacacuuucuagauccaaucucuuucuguggguuuggucuucugaauucacaacuuuacuguugcuuugaauugauaguaaguuagguuaaauagguuuugcauauugccaaauaaagaugguuuuacaaaaauuaaguucacaagaagcagguuuuuacaaaauuucucuuaggagaaggaucaucuaaaggagaaugguauucuagugguguacguccauuguggccuuuucuaguaaaucagaccucugcccggggaggaguuccuguggaagcccuuguaucacuugagugcaaguguuuuagugcuuuuacucgccuggauggggacagagcccguuagcuuacaagcccugaguuuagauauaguuagcuguuuauaugcauuuuaaaaagguagacuuuuaguuuaucuugauuauacccacucuugggcuuuaagcuucugcguguuuugggcguaguuuaagauucuaacgaugauuaacuuugaccuuugaaagaauaaguuuagauugcucagcaauuuaauaauuauuguuacuuagaaugcugcaguucuguucgguuuucauguggagugaaauauacacccaugagaaugcacaccuauacauauaguaguugggcauauaauuaauacaacacucugggaauauaugacuuaauuuuagauuauuuccaugaugucauuuuuauccucucuaauuuugcuuuaaaaauuaagaagaggggucuggagaagggggcucagcaguuacaaacauuuccugcucuuucagaguacccaaguuugguucccagggcccauaugacauagcacacacauacucacacucacacuuaucuuuaaaauaagaauucagagagaaucaauaggaugacucaggaggucuaaggugcugccuccaaccaagccugaggacccgagguuuuaacuaaagaaccuacugacucucacagacuuaacaccaagccaucaguaccucauagaaaagccagcgacuucucgggaaguuaauuaacaucugcugaggccuagucagccaucacugggaggagaggcccuugguauugcgaagaucauaugccccagcacuggggaaugccagggcaaggaagccagagugggugguuggggagcagggcagcgggagggcauagggggcuuugaggauagcauuugaaauguaaaugaaggaaauaucuaauaaaucugcugaaucagucaguugucuagcuuuuguuugagaaugcuaaacuaguuuuaguuguguuuuauuccgacuccauuccucugaucauaaguuauacauuuaaagagucuggaacuguuagugucuugauugucauguuaauaguagaaggggagaauggcaggcauggcugugaacucugcuacaaguuuugagaagaaaacuguaaauucuauuugcuuugucuuuuauaggguauuccaucucccucccuugucagccucccuucuuucuuugaacggagaagucauacauuaagucgaucuacaacucacuugauaugaaacuuaaguccugugggaccuaugcuucaacaagacgcugacuuaagugguacuuugaauuagcacuugguaaaguuguagagaagauuaguaacacuaaccaacgccguuuuauuuucuugaaauacaauuuucaagauggucuauguaaaaaaaauauggauuuugauguaauuuaucuuuauuugaaucucacaucugaagaccagugacuuaaguuauuccugauaaucaguagcuuuguaacccugauacaguaaacaguuggugggugcaaaauacuauuguguauuuguauaguaucuugaauuuuuggaaguacauauuuguguaucucaauuugugcaaagacugaacagcaaugcaacacuugcugaauaaaacccucugauuaaauucuagaggcuuguucaguucgauuguuugauguacuuaacugcgcuuuugcaguuuauuuucuuuuaaaauaagagaucuaacacaugaauuuuaaaggauacaccauuauuaaccauacaauuacgaucguuuggaauuuucuuuugcaaauugagauaagaagagaaagauuacaaaacauuguauauguugcgaagauaagauauuaguauguacuuuauaauuguuucagagacuuuuauuuuuauuuuauuuucuuauucuagacacuagcaaaucuugauuuaguuuugacuacuguauugaauuuauuucaaaggauaagaccacgugaaaacuguguuaagaauugcuucuguucuuuguacaguucugaaguugucuucaguuuugcuaaucgccugugaaaagcauagauauaauguguggugaacuuuuuauuguggucauaucauuaaaauaagauuggaaauuuauugucaaaaauuuugugaaucugccauuaucuucuacugcaauauuucuuuuagucaguaauacagaaugacugggcuacuauggccaagaauauuuuauuucuuacacguucagaggaguguuacaggucuccuuguuacauaauuuucaauaaucugcuuuaauaguuuaacugacuggauuuuuuucuauaccauguauguaccaauucacacguuaguaaaugaccuuguuuugcuauauuuuaaaagcaguuauauuagcaagaacuuuguaaauaaauagcuuuaaaauacaaguau

SEQ ID NO: 1375 - RNA, 2996 nt, Mus musculus
uggaguaccugaagacagguuuauugggaugcuacucucaggcgggcagguucacugaccccagggauugaggccaugggauugccauggggguggggguaggggagcaaaagggagcauuggaggagaaagaagagaaggagaggaagagagagaagggcagagacuaaaugucuggauuauauugggaggagacucuugggggagggcggacaagcaccugggcuggaaaguucccuguugggggcaggguaugccagguagggacugaggggggcgcuggggaaccuggaggccagcucugcuuugguggguaaauuaugcaccuuagucaguuccuggugcuucacgguccagucuugaucuucucuuguuucuacugccucugugcugggauuauaggugucuggauuaguaugggcauuuuaaaaggagguuagucacaguaagcaaauaaaccaguacccgagguuuauucuuuagaaguucaggguuacuaugccaucgagucauuuuaaccuuaucuauaagugugcuaauaaaaagauuguugcuguguagacucaggaguaggaaaacacuugaaaaagcuucagaaucagacaguuauuuuuuuauuacuguucucuuugugaaagcuugugggauaaaagcuaguuccaggaugaggucaagguucuugucuguuccgucucauuccuagcguaccuuacuggacgcuuagcgcuuauugcacaauaacugugaguaaauuacugagaacagcuuuaacuggguuccuaccucugcacacccucugcuuaucaaagagcaaauagaccaugcuuuucuaaaaaggucuacacauuaaaaacauguuuagauuugaaaauuuuauuuuuuguguaugaguguuuugcuggauguauguauacauaucacuugcaugucuaauccucacauuuggccagaaaaaaagaaagcauaagauggaagauccccuggaacuggagugaguuagaggugguuuugaaccaccauguggauacucgaaaccaaagccagguccucugcaagagccacaagagcucuuaacuggcgagaaaccccuuaacccuucccaacucccccccccccccauuaacguaccagugagaggaccuaguguauaaaagcucuugcaauacaaccugaugaccugagccagauuccucaaacccacaguggaaggaaagaacagauucuuuucuuuugaccuccaaguaacuccccccacauacacacuccggaguagggauucaaagauagaggacugugccuuauuucaccaggaucugcacccugcuugguacagauuggcagcaaucaucucucacacaauuaucuaaaaugcuuccugucagcauuuccucaaaaaagaaaaaaacagcacuucccauagaguguuuucuauauuaggcuuucuuuacacccaucuauuauaucugacuuucuuuauauuuuuaugucuaaagaugucugggccucacagagccugggcuggccuggaaguugguaugcacccuagaaugaccuugaacuguagcuccccucucuguggugaugggauuacaucauuccucccagcccccaacucugacaggcugugucuaucccuuauucaugcuuucccccaagcaaauacuuucuuacacuuaauacagauuugccgaguaaauaacaaccugcaggugaagauaguaucucuuguucauuucucaccaaagggcugcccucgcuguaagaggcuaagcuagccuuccugcacugcaauccuacacucucacccaacagacugggaagcuagcucuccucgggcagggcacaaaggaggcggcugccuucuacuuuagugaggagaaugcuuggaaugccagacacaccccaguuuaaauugcaagcacacuucucugggcaagguccaggccgauuuuuccuuucuuccacuccaaaggcuagugcggaauucuagugauuggcaggccauagauacugguaggcaaaaaacccuaaaaaccaaccaaccagacagacaaaacuauagauuguuuuacucauucuaugaacucaccguagacuugucgaacugcuuaggcugucaagaaguucuuuugguuuuaaaguagauuuugggcuuaaagugaguuggcucagugguuuaaagcguuuguuucucacacauaggccgugaguuugauuuccagcacccaccuggugguucaucauucucuguaauuccagucucuggggaucuggccuccuccuauguccaaggacagcaggcacucacaaaugcacauacguucaggaaaaaauaauauguauaggcaaaaagacacauaaaauuuaucaaucuaaauuucaaaagugcuuuaaaaaccucuuaaugagauuuggggccuagcaaccgauccaaacacuugguaagguuuugaaagugaaaaauaauuguuuugaguccuggucuccuauagccuaggcuggucuuguccuccuuaguacaggcuuugagaccacacccagcuagaaguguaugccuaggcgacuguauuauagaacauuccaucuagaaacaaauuucaaaauagcaauacugaucccagggguaaaacaaucccuucuuuucuagacuuccaagcacagucacuaacauuccuaagcugggaguugggguggggagggagcaacccacccagaagcaguuuugcuucaggagauucuaaaaucuccuuauacacuuuuuuauauuaauuacucagaugcaagcuugucuucaaaaauaaaaucugguuaguaguaagagcggaucgguuugcggugcuugguacuuuuucuugaaguuggaggugauggcagagagaccguucaucaggaacugggcuguuuacggaguaaacaagcgguaaccacagaaacaccugcugcauccagaggcgcugcagagccacgccuccucaagcccacauccgggcacuccg

SEQ ID NO: 1376 - RNA, 17572 nt, Mus musculus
gggcgggccggggcggggagccgggugugggaagcguggcggccccgccccgucuccuggaccagccgcggccgccagcgccgccgcagccgcagggaccggcggacgcagcaaaggcgugcggugcggggccggaaggugaagaccuggggccgggucggcggggcggcgggggaugcagccggugaugcugggguccgggcgaggggaggagccgagaugcuugggaacuggagggcggcaagcgcgggaccgccggagcuagggcccuuuaccgcugggccgaaccgggaugccagggcggcgccgcugcggguccuaggcgcacugagggccaggugcaaccggccgggugcuccugucccagucuuccccgaaccugcggccuggcugauaccuuggcagcggggaugggacggagggaggcgccgggccccgcaucccggcgcaggaaggucgugggcacuucuugcgguggggugguggggacuggaccugccggcugggcgcuggugucgccuucacucuccggcgagcucuucugcggcuccuuuccccaccucccaccaagggcuggaaaaguuuucagaggccugaauggcaaaguauacuccacucagaguggguguucuauaaaugcaaacauaacgggcuagugaugcucggcuaccugucuucaaaaugagacauaaccccgccugcaugccgguuauuaaaacgcaaacaaacuuuucgcauaguucccucagaaaaaccgcacaucuccccaguccaccauggcagacgaaauugauuucacuacuggagaugcaggggcuuccagcacuuauccuaugcagugcucagcccugcgcaaaaacggcuucgucgugcucaaagggcgaccaugcaaaaucguggagaugucaacuuccaagacugggaagcauggucaugccaagguaggcccuuccaagucauuuuuuggcuucaccguuaagaucauucguguuccauucuacaucgugagguuucuauauugaaaaauaacuuuuuuuccuuccccucagucucuugaauggucagacauuacucucaguaaagcucuccauuuaaucggacccuuagaauguuucauuaacuggaaacuaaaacuuuuuuaaauccguguuuaguagaaacaagccuguucuucuaauucuaagagacuugguuuucacuuucuguggacucuuguuaauugacuugcugacgugugugguguguugaguuuugaugccaugaaacuguucggguuuuggguacuuacugaaucucguucugugucacugcaacuuuuuuuaaagaaaguaagaugaccuuggaagaggugaaaggcuccauuacagucagagcugggauugugcugcuguguagggagugacauagcugacagagauuaaacauguuuccugugguucucuccucugucagguacaccuuguuggaauugacauuuucacuggcaaaaaauaugaagacauuuguccuucuacucacaacauggauguuccaaauauuaagagaaacgauuaucaaguaaguacugauuucuuuaacagcauuucagaaguguauaaacacccucuuuaguaguaguuugacaagacuugagaguaguuuuauagaguauauuccuuaccaguuacuagacuccacuuaucuuacagauuagagaaauagugcuuuguuuaguucuguuguuguuguuguuaauauucugugccuuuuucuguugugaaguaggagaucauaggucucaggcuggccuugaacucacuauucaaggaugaucuucagucucggacacucgggccucugccugugaaugcugagauuguagguugcaucuuugugccuggcuauccuguguuggagaucaaauccagguuugaaucugguucugguacuuucuagcuagauggucuuuuacaaagugugugucuucucuaaaccucugccuuuccgaacaaaccagggggacauguggguugaaugagagagugugcgcccauaaguagcugugcauaacagcaaguacuauuguuuugcuucacauuuccuauaucagaauccuauuuucauucuucuuaguucauuggcuguagauguugugcauaguagguacucagucaacacuaguuaaacaaauacaccugaauucaguguaguggagugugagguuaacagagcagauuacggcuaaguauagaauauacauacauuggcccaaauggguuucuuuucuuguccugcuuugugagcucuuugaauucucaguacucguuauaaucaguaguuuuuauuccacgcuucuacuuguuggaugcuucagcagucuacaccagcaguucagauaauaauauuaccaaauuaaggagccauugauugaagcuuaaaauuuaaccucaggggacuaacuugguuuggauuuaauuuggguuuuuacuaaggucccagccuacuccucaacuccugugugaaagcaaagcacauucugauaacaacgccaagucccauguuaggcucgggcaaaaggagagguagucauugucuuccugccuccaucucugaguuuuguuuugucacgugaguuuugcauucucaauguuaaauuuuucuggaaguguucugugguugagguguuuggaugcuuccuugugcacaagagggugccuugcuuaguccccaguccuggcccuagaaggccacauggcagaguagauagccaaggauggugucagucaggccgaugggucugggucucugcauugggacuucuaugguauggccucgguuggcaaguuauuugaucacuuuuacuucauaaaacugggaauucugugaaaucaaaccucucgcagguuuguucugaggcucagugggcaccuuggacauuggaaagacuccgcugcccuguuauaaaacugccaucaaauauuuauuucuggucacucauuuagaaacuuaguucugugagcuuucuaguuuauuuauuaugcucuggcggucuuuagccuucuauccaugugccuuuguuaaauccuugcuucuguuauuaucuggcugugugcaguuccuuugcaucugcugaauucaguauuuugaaugccaguuuggcagccagccaaaguggauugugagcaucuauucauuuuaauaauuuaaaaaauaagagaauugggagaaaaauguuaauauuuacagauuuaauuugugucuucuuaaaauaaguucaggauacaagaaagugugucuccugacucccauuccaagauuggcuuagauuugaauuguuaauuuucauuaauuuucucaaaagaaugcauacuugucuggggcuuuguggugguauaaaauagaaaaugguuuuggauccugugagggaguucccaauuuguuaaauguagaaauggcuugcuuggcuuccucuuuggcauauuuuuuuaaugucugaauugcuguacacucuacucuaaauuaaauaaauuaaauauuucuggauuuauugcacuuuuaucugucauuugaagaccauuucuuauagggaaagcuauagaucuugauaugaucaguggauuggcagaacuaugacuucuaaauccaaauuauacaguuauuucauguauauuuaugugccugcaugcacacauacacauguggaagccagacacugaaugugccuuuguguaugugugugcgugugcguguguguauauauguguguguguguacccaugggcacacacacaucuaaaggucagacacuuaguguaugugugugccugcaugcacacauacacaugugcacacacauacacauguggaagcuagacacugaaugcauuuguguguguguacccaugggcacacacacauguaaaggucagacacuuagugucuguguguuccugcauguacacacacguggagaucagaggccaaucccaggagucggcucucauucagggauguggguugucagcacaucaccuuguagguaagcaccuuuacccccugagccaucuuacagacuccauguugcaaguuaaaauaguaguaauaaagaaaauauugaugcugugauuucccugugcuuuaaagccuuuuuaucauuuuaauguguuuaugaaaaucucauguucuuccugggaccauuuuuucucuggguuuuaauggaaaaccaguaaagcagaagagcccaguaucuuagggaggagcagcaaugugcuacaggaucuuuaaggacaacagugagaaggccauguuagguuccuaagucuguguguucuacuuacaggaaaaagaguagcauguacuauacuguacccuguaacacagaacccuaggcccccagaccauuccccagcagguaccgugggucuucaaggucgauccaguaggcaggcuguuuguagagagguagaguucauaaaccaucgacuucucagggcagcaucucacggucucauuacuuugccuguaggcaaguguuuuauucagaaaauaugaggugcuguagcagagaugaggcauacucuaaacccugguggaguuuuagcagaagcaccacaggcaggaagagcaaagccaugugcagacugggucuacugcaagaaguguagcucccugcucugcagugcuaucggguacuagcuguucccacuggggaaagcugccagaucagggaccccgugucauuccuuucugggaggcccuuagugcucugucagccuuagugcgagaaagcugugucauuaagccuguugagcuguugagacagcaguaguaaaaagcugaaugucauucgcuaccuuuuuaucuaauugagagccucagauagauagcuggcacccaucacugaacaucugcuaacauuuggagaggucuaugcacauaccacuacccuagaccucacugacaauuucuguagcuugguuuuccagcauccuugacuuugcaacccagcucuugacucuuuguccauauucagugggaauccacacaguacaaguuuccacacccccaccaccaugauuuuuucauaguucucucugaauagucccucauauuauacauggcgacuagaaaccauucugaucuccaucaagccauugguauaaguuccagaggagaaguacucagugugggagaaagugauuucugaguuugagccauucucaagcuacuggagcuuugggacgcacucaugucaccucuuguauguuccuuccacaugcugaugacguguauugugugcacccagcauagugccuugcugggucagagaauaccccagcugaugggaucuuauuuauuuaggugauguaauaauguucacgaacucacugaaucagggaccaguaacuugugggagguagcugaagagugccaggggaagagggaaaauguugacaggaagaacucuuaagaugcagagugauggcugcuugcuuuggaauagaaugugaagccaaauucagaagguagggcuaaggaagcacucauagugauaaucuuccccuguggucuguaguguauuaguaauacaaacacaggccaaagggaaaaacacccuucccauaaucccugccucuguguuuuuacuuuggccacaucacuggcaggaccuguaucuacucaugccccugcacccucccucuuaucccuucuuucucgguccacugugccuuccagcgguuaguaguuucuguucuuuugcuuucuacaauccugcauccuuuuuuccuuccuuacuguuucauuuuguuauuucugugcauacaccucaaccgggcuuuauacuuaucaauauaugacaaguuuugucuuaucuguacaccacucuuuugaaaaacauuuuaucuauucuuugguaaugucauucacuaaugcaguggaguuaaaugauauccacuccucuccuccgauuccuccugggcccaccccucccacagcuccuuccaacuucacaucucucucgauagauagauagauacauagaugcauagauacauagguacauagacagacagaugauagauagacagacagaugauagacagauagauagauacauagaugcauagauacauagguacauagacagauagaugauagauaaacagacagauagaugauagauagauagacagauagacagauagauagauagauaauagaagacagguagacgguagauagaugauagauagguuaauagauaaguauguauacaauauuauauauaccauuauguuagugcugcuauaugcacauggcaaagggcaccauccacagagucugggaaaccaaccaagguccacccugcugaaggaaacugacuuucuguucccuaguagccaucagcuggcuucucauuuagagguggggccucguuuguucuuugugcugggguguugauggcuugaucguguucaggucuuaugcaggcagccagagcugcugugaguccauagguucaagguuuuuaugcccagaugauacuauuccacacagcagucaucccagagagcugccucuuacagucuuuucuuccucgucuguaauguugccugggccuuaccccaacucuuuuuguuauguuuguuugguuuugagacaggauccuauuagguaugaagguuagccuugaacucacaaacuuuuugcuagcucccaggugccaggauuaaaggcaugugcuuccaugcugguauuucuucauauguucucuuccucuggauuauuuugaagcaaaucucagauacuuagcauuuuaccuauaguuuauuauauaucucuaaagguuaaggacugugaacaaagccagacacacuauugggccuaaagcaguugugaguuucuggagagggucccauuguuguuacaguuugguacuugcuucauguugcuuuuaugagugugauaguuucugguucugauuuacaguguaguaaacuacugcaaggccugaauaaggucuucacaaugaaguugauguguaggacucuugaauuugcaauuucucucacaugcacuauauuuucuucucccucccccgcccucgggacccccauauuaucucccugcagcgucucagugaagagacuggauuguuuguucuguagacuugcaggugucuagauguugcuaacugcauguccucaccaucucaugguccuccucugggucuguaagaccaagaguucagaguccgauuagcucauuuccuucuuugugguuguugcuucaguaaggccacucuguaguucaaguucucuacaccagccgagcaaucccagcacucgggaggcagaggcaggcggauuugugaguucggggccagccuggucuacagagugaguuccaggacaaccagggcuacauagagaaacccuguauugaaaaccgggggggaaaaaaagguaaauuacuuuuuggggguuuuguuuuuguuuguuuuguuaucucuguguagcccuggcugaccuggaacuugcuguguaggccaggagggccucaaacucagauccaccucccucugccucuugggugcugggauuaaggggucaaggacaugcccuccccccacuagaaucuuacauuuucaguaagguuauuacacacauaucaucguugucucacuccgcuaacauaaaggaaagagugaucgugaucggcacgccuccauuucuuugagaggcagacuacugcuaugggaacgccaucgguuguucuguuuuuaccucaaggaccugggcaucuccugaauacauccucaugcauguguguacacauacauacaaggaagucaggauaaauacuucccucugccuuucauuucaaagauuguaauauuuuuuaaaacauucauuuauguguauaugugugcauacacauacaugugugcacagagggccacaaacauauaccguaauguaacuguugaggucaagaaaaaugaguucuuucucauucuacuguauaaauccuagacauugaacucaaauugucagccuuggcagcaaguuccuuuacccacugaagcauuucacccucucccguuaucaguuuugagaugaccuguucccagcacccacugaaguugacuaauaaaucgauauuuuacuaugaacucaggcaacacaacacaccugaguuucagcacauuaucuuugucaccuguauugauuuuuggguuauuuuguuacuggccaaugguagcuuagucaugcuaaucccugaguccuuuggaauguacuuaauucauggucuugauaguucuucauauuccaguaagcagcucguuccagguuccacucuggauguaaaaucaccuguuuucccaaguagcccuccauuauuuuaguaagaccuuucaguaaagaaaagaugcuacauucucaugccaugcuagucaggagucuggaaaggcugugaggaaagauggaauuuuguacaaaacauucuugagaguuaaugguaacaccacuggcuucuuccuucuuuuuuuaagagcaauaguuauagagaguuuuagagaugggagagauagggagacacaaggaggaggaagauggagaaagagaaauacgaaccagcuucucguggcuuuuaauagccacagagaaagugacuagacucuggacaccuuccagcguuaaaugcaugagcuaugacagcgggagacccccugaggaacuggauucaagagacucaaacagaaaaggcaugcugaacugaccuaccugaacuccugaccucauggacuuuuagccagauccagucaggacacagacuucccuaccccaccuucaagaucucucgacacccauauucagcaggaaaagguuaugaagagucguugucccaguucccugggcuugggggcuggaggugguuauucuaaucuugucuuucuggggaauaguaaugaucagacuuuaacaggauauagcuauaauugauucuguagccauaaucucauuugguaaaaaucuuuauaauaguuacuaaguugaaguuaugauuucuuauauugguacauaauuuauuuugaugcagaaucaagguuuucauugguguaaauuucuucuauugauacaaaaauuuuuaacauacagaguuuagacccaguccuucuauaacugccauuacaaacugauuugaaaugauuaaauguaugaaauaagggccagauagcaaguucuuggcucugaguuaauugcuagguuauuuacaagauauuuuguuuagaaauagcugagaguaguugauggacaucagucccgauaucuuuacauagauagacaguuuucaaaaaugucagacauccacagaaugugacauuuaauguuauuuauucauuuguuguggagacaugucugcuccugaccgcauccccuuuuggauucaaagaaggaagugaacaucaauagaguugcuccaguuguggggagauagcuacuagacaggaauugccucaguucaucuacagaccuguacuguucaugagaggacucaaguugcaggauaggacagcuuaguucugccgagacagaauaagcuagucuuuaaaauguccuguuucaaagaucugucagaugauccugggccagaaggcugaagacugaugcuccagcuuccugacauacagggacuguguagguaggcagcugucucgacaacuuaucucaguucuggaagcugugucaggcuuccuguauuuucagacaauauuguuuguucuuggaauucugacuggauugaagacuaguuauagucucauagacaaccuaggcuauuuagcauugaauaaauauauuugagaggauaguuuucagauaguauacaagauaaacuguaguauaaccaauauggaaugauaagccucuuuaaaguuagguuagauaacugaguguucuauuuaauugagaaaaugauggacuggauguuagauauaucuuauacuuuguaaauuacaaaugcuaaucgugguauucaauuucuuuuugagaggaaagagccuuuuaacugaacaaaaagggggaaauguggauugcugucuauauacaggugagggcaggcacaagauaaggcuagagccugugauugggcaguggauaaagaagguuggcugacaauuuuagagacagacgaguuaaggagauacaagaggaaagaaggaagauggaggaagagaaaggugaaccagauccucguggcuuugaacagguagcuaugaccaucuuauaaggacggauaauuacaguacaaucuaggcgagcagcuuagcucacuaucuguuggcucagaggucauuuuauaggcauuuuguggguugagaauuuacugauauaaaucugacugauaaauuggaaaaaaaguuauauuuagacuauaaacaucuugcagauaccaccccaguuggucaaaguuagugucaccauuagugggauagauacauuucccuucuggugugauugguacucugaggacacauuauuuagauaguauuucuuccaaaacacacauuacaugaauuauaaggcaacaaagcagaucuagacugagagacauuuuauaaaccaagugagugucagugccuugaaagacagggugaucaaacuguuccacguaaaagaaaacagcccacaugacagcacuaagccacaggugucauccaggaggcagaucagagcaaccugcacauuuggaaauggauaauagauuaguuugaaaaguuacauaagaguguguccucacucuugggguagccguacuguggaauuuauaucugaaaaauaaugaucagagagguggugccgaugguggagcacuuugacacuccuccugcauggcuugcugccuucugucacucugguuggagacaucagggcccacaucucauuccuuuuaauugcgcuagcagcagauagugugguugaauggguuuugcaaagacucuuggaauugugggcagacugaugguggagacgugcaguuuuccucauuccuguaauaaaagaguuuugggaaggagcuggaggacaccucagcaguuaagagcugggacagcuauucugcacgacccaagcuugauucccaacacaaugccugucacuuugucuccagaagaucuagguacuucaacuacugugaccugcacacagaugcacacacagcuacacacaaauaggaaaacuaauuuuuuaagcauuauaucaaaaaguaugauuucugcagguuagauuaugacuggauuuguuucaucaauaccauaagauaagaucauguuaaaagucugucacuacuacccuucccugagggucuauagauggucaaugggcacuaguggagagagagacauuuucuucugucauauagccacugagaaggugcccaggcuccuguaaaaaacuucucacccagcucccauaagcaacucuaaugaaacuuaccagguccccaagaaauaaagaagacauaaaaauagaagaggcacuaaugaaaaucagcugcagaggagggaccaagagaugguaguguggguaaauaacaaaauauauacuguagauaaguauguguauaauauauaugaauauauacauauguguguauauguauguauguauauauguauguguguauguauguauauguauauauacauacauauauauauauacgcacacacauacacacacacacacacauauauauauaaugaaaacguuuuuuaaaaucugucagcaguggccugaagacuaccacugcacuuugcuuguaaccaaauuauaaaaaugcaucauuuuaauagugaaaaccuaauuuaugcccacuaacaggaaaauuugcucacaguauauucauacacauguguggugguaagaggaagauagguccauauuuucugauuuggaaaguuucuacagcauuuaaaaacuuacugaaauacaugauuuuuucuuaagaauagcucuguguguaucguguauguaauauaaauaccuuggcaaugcagagagugaggaggcugguacugggagugaguuacacaucucugcuagguguauuccauaugccugcauuuuccuguuuguuuggggguuuguuuguuuuguuuuuuuguuuguuuguuugaaacaaagucucacuauuuaguucuggcuuucuggcuuagagauuacaguguagaccaggcuagccucuggcucccuaaugcuaguacuaaaggcuuaaucuauauuagcauuuuuagaugccacaaaucuguuaauguauugcuguguucuuauccgagcuaauguguguugcauuugagcuguguaaccaucacaacaagguggauaugauguaaucaguucauaccuauaauuucuucuaauagcucauaugcauucaggaugguuaccuuucccugcugacagaaacuggcgaaguccgugaagaucuuaagcugccagaaggugaacugggcaaagaaauagaagggaaauacaaugcaggugaagaugugcagguaaggcucauaguaggcuguguaugugugugugugugugugugugugugugugugugugcgcgugugugugaacuauugcauaaaccuuggcccugaacccguuagcaugaaagacugugcgcagacuucagcgucccagugcccgcuacuuugaugggucuuucuuucugugccuuuuugucugugugcuucuucaccuucaaucaaaggaauuuuugucuuuucacaugcacaaacauauuaauauauaaauuucaaaaacugugagcuguaacuuccaaccacugcugaaauguugaaaggaucucuguacucuuggagacaugugaccagagaaagcaucaaguuugggagguguugucgguugguugguuucuuuucuuucuggauugucagcgaacuccauauuguuuuggagauccaccuaugaguuuaagaaauagaaaggcagauggggaggagaauuucuguggaucgcaccuuucccaguucaccauaaaggcccacaaguauacaguguuuugugaacacaucuuuccuguguaugauuaacucugccugcccuuuccccuucuaggugucugucaugugugccaugagugaagaauacgcuguagccauaaagcccugcaaauagacaagcccugcaaauggaccaucagcauaaccagguccauuggucuggaucuaguugucccaaagcuauggccuucauaagaaaccucauguuuguuguuauguuuuuauuguuuuaaaaaagugcuggcuuagguuugcaggcaguuaguaaguuuaaacaaauauaccaaaacguauaauuuuauaaguaucuguccuauaacacuccugugguuuucaucaugugaccauaagaaacaaauacaacagcuucaguaaaugucacuuuucugagcaaaucacuccugaucuuaagugguuaacaaaccaggguuuuaaaucagcaauguagcauguaggcgaauggaaguaucaugcauuucaguugaauugcuuugugcugauuucagacuuuauaucuagaauucauagacuauaagauggucuguguggcagacacacaucuugaaacgaaacucuauuuaucaaacagugucauucucuugguggucagaugucccauauuaucuucaucauguuuaucugugcuguguugaugacgacagaccuacagaguaguuucaguugacggagggaagggaacugcugcguacgucugagcuaguccaccaggcaguggagauucacaggggcagaggcaaagugcugguuaacgcuguagaguugacucaagaccuuucaaccagcacacaaagugacagagcucugguuguauuuuugcuuuuggcuauguccccagccucugccucauuacaggagugaccuuuccagagacgcucacuacuuccagccauaaugccuaagugaucaugauguugcccucccugcaauuuuuuuuaaguaauuuguuuuugacguuagacuaaaaauaggaauuuuaaaguugcuuuggaauucucgacuuuaaauugauuuguuaaguauauguacacuuuucuaaaguguaauagguguaaccauggaagaaagguuaucuuauuugaaaauuauuuuaaguguguauauacuuuuauuguuuugugacuuaauucuuuuacugauguaaaauacaacuaggauucuguggccuggauuauuuuacugcauuguagguaaugccccuccauuuuuguuuagacuucuggauuguguguaaauugugucuaaaauuguagacaugguugugggcuugagaggaacaaauggaaucacaaucauggccuuggcgugcagcuuagaacagaaucccucucagucccaccuugacucucugaugccggcucucggguuccucuucucaugucuggacccuuuguucccagcuaggaaaaauguguaacaauguaacucaccuaaucagcaacuugaaauagcuuuacaaauggaagaccccaagauuuuaguuccuuaauuuguaugcaguuuuaaaucuugucuuguuaucaaaagguaucaucucuuuuugauaacaagauaaaccaauccagagaugaagcaagauacccuaggagacgugccgggaagggaugucuaaagcacaagauauugacguuguagccaguugacuuuagugugacccguuagcuucugcccgugcaaagcacaauuaggaauuaggcucaauuuuucccagguaucugcucuaugcugcuuucgauuccugcugcuggggguuccuugcaggacugauugacauguuagccccaggaauuccaggaagugauuucuuucugcuuugcugucuucuggucauugucuugccaauaaguagccacacugguguuuugauuucauauuucuuuaggaguugcaugcucuuauccuuccuaauuuaucaaauuucacaugcaucucuacuuuucauuguaguauaugcauauaaauuagagcaguguaccucuagcuccguaccuugaauggcaaaaacuacuuaggccuaaguauuucgauuuaaauaauauauaaguguacauacuccaacauguaacuauagacuuuaaagauacaggacuguuuauuuucacauaagucaguagauguuucucuuaaagcaaaauauugcauuuaguaaagcuuuauaaauuauauuaaagggaagcagggguuauguacuuuuuaacagaaaacagaaaugacuucuuuugacaucagaaaaaugcuaccaguugauuccuaauauuuguuguacuuauagcagaucuccggccucacaaggcaccauguugagaauggaauucguucugacgucaccgccaucugcgucuguacacauuucuuucuuucuuugccauuuagacaguauuaacagguugaacguuuuuguucuagaauaacagcuuaauuucuauugugaagauuuugccacacugauaacaauuguguguccucugaccuagaucagacccuuuuggcuuugacuugggcugccagucacuugaaguggaccaagcacuugacucuguuccccuccauaguacagauuucuauaccagugcuuuuauaucagugaccaaaauacuugcagccagaugugauaucuucaagagagcacacugcagugcaguguuuagagaaguuggggaugcaugcuuuucauuagcgcacagugugaguguauauacaaauacacacagcuuuguucauuugucaaguccuuccaacuacuaaauguacuguagucugguagugccucaaauguuaguuugauauucauuguuuuuaauuuguaaguuuuucagaauuugucuuguauuuuuaaggcucucaauuagauuguuucuaguugagcuggacuucaaaugcacuguucucagggcugcuugugcagaaacugaagugucauuauuuuaaagauagcugccuacaaauauauugcaaguuuuucccaagucguaauacuguaauacauacaaauaaaaauccuuaguauaacauauuuaagcuaucugguaaguguuugguuuuuuuuuguuuguuuguuuguuuguuuuaaagugggagcauuaguagcagccguacuggaaucgugcuguaguuuuugcuucagaguaaaaucccaggggucuuacuguggaacccuguccuuggugguguaucugagagcauguuuuuggcacagaugcaaaagaagaguuuuggagcuagacauugauacauugguucucagacacauucaagaacagacaggaaauucuuaacucuuuuggguaucuuacaauguuuacaugcuggauucacacuugcuaugaggaaauauggaugucugguauaagaucaaagcuauuaagguguauuuccauaaacaguauauuauacugauaggaacuuguaaaucuucuaauauuuaaguauacuauuacauaguucucaagacuuuuuucugucaagauuucgaagaaggcaacaaagacuuuuuuuuuuuuaaaucuaaguggauaaaucuuaaaauugaaucuaauaacuuaaaucugugaaauguguucucugaauuggacaaacaacauuauuauuugauuguagagagaacauugggacuuagcuuacggagcacagauguucuguggaaacaggguuuaagucacuauguaauuuaauuuuuccauuaauccaaacaccaacauaacuaccaagugaggucaugcaccugaaaagagcuguaaauauuuaauaaauauguuuucuucaugugaaggacauaucguaggguagugcacacaaggucacccucugcuguaaacauccuuacugccaaacuucuccaucacuacuguccacacuuaaaacaggccuggaccuauauuacaguaacaagggagauucuuuuauguauaugacauucuuagaaaccauuucuagacguuggugggauuugguucaucuuaguuugaaacuguaguuuuaaaaacacugaauaguaaacuauucagcaauggcugaagagccuaugagacgcuguggcuaugcucguccuuaagccgauuccuuauuguggcugaucuacuacaaauaaucccucaucauuauuacaaagacuacuucacauuacuagcucugaaccaugauaaaacaaugacauuucccuauucucuuguacucguaucccccucccuagaagaaaacagauaaauggcauugucuaauccauuggcacuuuguuaauauuauuuuugucuuaaauauaggacacuucuugaauuuacuugcaaauguuuuguuaaaacuuuaaaauuguaagaucugaauauuauaauugugcguuuuacauuuuaaaaguaaguaaacuuugaauguuaaaucucuggcuauacuaaaauauccuugucaaugauaacauuuuguuaccuuaaaauauaugucuguuaacuucguguuauauuaaaugaaaauaaacuuaacagugcacaauucuuau

SEQ ID NO: 1377 - RNA, 1991 nt, Mus musculus
aguugcguauuucgcacgcucugcguaugacgcagcacguuuuuauauaaaagcgugcgugcggcgcaagcccguucucuucccacggcugcagcucaacauggcgccggugagugcgcgcgcgugugcggggcucggguauuacagguagcuauugcgucuagcgagcgggagcgccgcaggagagaaggcggugggaagagagucggccuggcggcucgacugggacgauagaauccggguugcggagccguccgugagugccgugcggccugcgcggcgggagccgggcccgcgacuagcuuaguaucggcgggcgcggucggucucugggccucuggguuucuccauggccuguggucacccugucaacggaagagagccuaaguggccagguccgcgguugcaaugacguuagcaguuugaagagcgugguuuaaacauuuggaaagucacuauaaccaaaauuguuaaaaauaagguugcugaguaaggauucaaaacugagugacgucugauggccccaucgggacugccuguucacugcacggcagugagcgaguccaccccgucauucacucaaaugccaguuccggguuugcgauaauuggaggguggugaagguauuauuaauugguagccauuuaggugacucuguuuggaccaauuacaauaaagcauaaagagacccauuacccuaaaaaugguguuuuaaguucagauaaaacuugaaaagcacccagguggguguuuuaauuugaaauuggaaauaacaucaguuacaguaggaagcaguucuucauaaucaagcaagauuucucuacuaaaauaagcuuacacuuggaagguacuuaacuggaaaugaugacguuucaugggaauugaaacauugguuuaaaccaagcuaaugaguaaccuuuacauagagcacaggcuccuucagguguuggucaagucuguguauaacccauuauaccagauguaugcugaguugguaauuuuuuucuugggaauucagugucuaagcugaauaaacugcuuuaauggcaucauaauuaugucuagcagaaagacaagaagccuaagaaguccaccuggagguuucauuuggaccuuacucauccaguagaagauggaauuuuugacucuggaaauuuuguaagugucuuacugugauugcauaguuguuggcauuuaaauguaguacuugauauuaaccuaagcugugcuccuaggguaccuucccuagugaccaucuaggguuuccuucccuaguuuugcauucuuucuguuugaaaauaggaacaguuucuacgggagaagguuaaagucaauggaaaaacuggaaaucuuggcaauguuguucacauugaacgccugaagaauaaaaucacaguuguuucugagaaacaguucuccaaaaggucuguucuucuguuuuuacguuguggugggaugucucguaggcauuagucugcgaaaauggcuguuagucuguuuaaagguguuugcauaugagucaggaugacucuugcugucuauuucauuucauaaauggggaauauuaguauauuuugagucaacagacagcagauuucaugguguguuguacuaggggguugagaggcugcucuuguccugguugcuucuuaaaaccaaaguccuagugaguaggaguuacaaauguggcagugcguguuuucaugauaggauugaucacacaucuaauaaacucaugguuuugucucaaagguauuugaaauaucuuaccaagaaauaccuuaagaagaauaaucuccgugauuggcuacguguggucgcaucugacaaggagacuuacgaacuucguuauuuccagauuagucaagaugaagaugguucagagucugaggacuaauuggccucugcuuguaauacaaugaaaguauucuaaagaaauauaaaauuggacuuuaugagaaaauaaaagucauuucacucuauaaaaacau

SEQ ID NO: 1378 - RNA, 9068 nt, Mus musculus
ccaagaaauaccuuaagaagaauaaucuccgugauuggcuacguguggucgcaucugacaaggagacuuacgaacuucguuauuuccagauuagucaagaugaagaugguucagagucugaggacuaauuggccucugcuuguaauacaaugaaaguauucuaaagaaauauaaaauuggacuuuaugagaaaauaaaagucauuucacucuauaaaaacauguaugguucaucaguguguuggaugccuagagaaaaauuuggguuguggagugauucaggccucuuccuuaaugaacagaaaggcuccuugugggugaauuauucaugcuuacugccuguuagagccaacaguuggguaccacuaaaaaagggaacuccugaguucuugccuugaugggccauuguuccccaauaagugggauuugaagcaaaauccagauuguggagaugagacagaagucuucuaauaaccucaguauuguuucuacaaaguccuugacauguuuccaacuugguuuguagauuucagugguuggcuuugagugcuuuucuaguuugccuaaacaaccuuaguugacaagaccugugaauuuucuuagcuuugugcccaaauccagcuuucugcaaaguuagauaccugcuuauguauguauuccuuuguugcugggcuaguugguguaagacgauaaaugaaaaacauccuguuugcuuaccccaagaacuggcaaauauuuggcacuacaaaggaaccacuuaaccacauuuuguuaaguaaggcaacaaacaaaaacuugggucuguccuaaacagcuuaggcaaugagggguuggggggguggggaguagauaagggaagaggaauaacucuuaggaugauuccagggugcuggcaucugauagacaugucugugaacugcauugugggagccaggcugcuuguuugaaguguaugcaguguuuugguaaaaggguggauucaauggauuuugagagaauuuacugagacugauuuagucuugcuuugcagcuguaacaauucuguagugcuauaaacaggaauuuaccuuacaacuucuggaggcuggucagaguccaauuucuaguucguagaaccagcugaguauacccuuaacugguagacaauaugaauuuagaguuagguuccauaagacaaauccuaaccaagagucuguauucucguauccuaauuaaucacuuccgaaaugccccaccaccugucacuugguuucaguguggcaugggcccuggaugaagggagaaacaucaacagguaaucuagacccucuuuuagaugucacugccaaaaugauuucauuucagacugaaaugauuguggaguguuucugcaauggccgaaugauaaauccagguagagguuuggagcaguggaggauguaugugaaaagauguaaucuucauagaacacuauggcguggugggccauuucuguuaacuagugcuucuagaaguggaggcaggaagaugaaauguucaggccccuccaucuuugguuucauugaguuugagacaaaucugggcucuaucagacccuaucucaaaaacuagcgaaugcagacaggaucaagggcucccacuuauuaccuccuucaugccugccuuacaaaaagcuuuugaagcacgucugauagucauguauuuaaaagcuuccaaaugagucuuacauuuaauauuauguacuagggccuggguaaacauaaaauacucaagaguuaacaaaauuuauuuacuuaauuugcuagcugcugcuagguauuguuugggauacuaccuuaaucagaaaugucugccuuaauuaagcccaguuuaggaaaaggaaaaaaguaagauuguguauuucauggccauaugcuaugaagaaaaagacagguaauggggaaccgggucugggagaagggguugcuucuguaagugcaagcaggaaggcguuccgggcaagggauccuugcaauacaaccccaagagaugcugcauccaaccaaguagauaaucugaggcauuccagggagagaacagccaaagaccugggggcagaaugcccuugcuaccuccauccaaaccuuuuugaucucaacaggaagccugguagguaggaacuaaaauuugagaauucaaaggaguguugaagguaggaacuucagaucuucacaguugagacucaggaaccuaggcagucuaguugagugguugagguuuugugagugucagcuaagcuguguccucuuacugaagucacacuuaguuguugugccaaaauacagacacacuaaguagauaguaaguauggcuauauugcugggucuuacaggaggcuacugauaauugugagugcccugaccuaacuuuacacuguaaacaaaugauuauaguguacuuuguuagucaagaauauucaacccaucacugggaagagaggccccuugguauugcaaacuuuauaugccccaguacaggggaacaccagggccaagaagugagagugggugguuaggggaacagggugggggggaggguauaggggacuuacaggauagcauuugaaauguaaauaaaauaucuaauaauaaauauucaagacaaggacucacauugauccagagaaagcucucacuugggcugugcauuuuggacaugauauucuugagauuuuuuuuucccccuugucucuagcuacaucaaagaguauuguuuuuuuaaccauugauugauugguuuuugguagaggcauucuccuuugugugcuguuauggaggcugauguguccugcuugaucugaguagacacauguauguugugccagaggaggcugcaaguguguaucgggugaaacuggaggcagggauggcuccaaacccuaguugugguaugcuuguguguccuuugcccaagacggaaauaaagaaaaucugguaggaaaacaaacacacauacacacaaacaccaacuuuuaagcagucuuucuauuuuguuuaaggcuguguauaacaguagaucagagccuaaaacauggaauuugguuggggaggggacuaguuuggggacauuuuggggaacacacuggcacagagguacuaguucuggggugacaucggguauaagguucgaaggacauacagcgggugguuugguaaugacuucaagguaauaagcauuugcucggguuagggcuuccaggaagcacuggucauccgaugacuagacacugcauuagccaggguucucuagaggaacagcaagacaaaaugaauauauauauauuuauauuuauuuauauauaauuauauauauauauauauuuaaaaagggguuauggcuggaguagcccaacaauggcggucucaccccagagcggcugacaggucagugguuucucagcaaaggcugagugucucggccauaccagaggauugaaggauuccuggagagcugcuggucuagggcuaugccggaagcagguaggagccaguucuauuagcaaagagaucaacagagagagcaagagcaggugaauccgcagugagcacagagguaagcacgaaccagaaacuuuucuuuuucuaucuuccuuucuaugugcucccaccacagggcgcccuccacauuuaaacugaccuucucacuugaaauaaucugaccaagagaaccucucacugagccaggcaguggcugcacacgccuuuaaucccagcauucuggaggcaagggcagggagaucucuguaaauucaaggccagcuugggcuagagagcaaguuccaggacagucgggacuacacagaaaaacccugucuuggaaaaggaaaacaaaacagauagacagacaaacaaccacaaaacaaaacaaaaacucucacuggagugccaguggcuagccugauuccagguccagacaaguugccaucaaguucagccauugcaggcaucuuuaugauuuuaccucacagaagauuuuaccucagaucaguccccaaggccauccuccugaagcaacugcagcuccuuauauugggugagaaggaauauacuuuguucuuuuugugggugugucagcauucuugauuuugugcucagacagaauucugaauugcuucgucuuauugcucugcugcuucacaguuaucaugccugugucugcagggcagguuuuaugaaaaaaaugcuguguuuuacugaauauguggauguagcugggagugucaagcuaucuccuagcugcuuuucugucucucaauggcuaagcaccaauaaauugcgaacaguacaaaaacaaaacaaaugaacaaaagaaaaaaaaaaaaaacaacaaccugacaagcaaaaaggaaguucagggcuaaagucuccuugguuggaacuaggccagguguccuucccuaagccaauccugagaguaaccaaugagcuuaauccagugguggcaugacucuggaguagacagggcagguggagugucuccccuacccccaccacgugugaagugggagagguagcccucccuaaggaaacaagggcccauucauuuucacucgaaaaaccugcgaaugcuaaaauuuagaugaaaagauuaaggacucauaacagugaaaacauugaacuggaguacaaugggagaaaacagugugcccaguuucaaaacuuguuacccagguacacgaaucaagaccauauaguguuaguagggacaguaaagcccaaugcuauguauaagauauauagauauagauauagaucuagaucuagauauagauauagauauagauauagauauagauauagauauacacauauauauauaucgauuaauuguauugauauaccauaaauaauauauaauauauugauauauaaugaauaauauauuuacaugauauauauauaaauuuauauaauacauguauacuuuguauauacauguauguauacaugauauaauauacuauuguauauuucuguuugugugcauuuugcauuguuuggauguggaugcacacaugcguaugccaguggacuuauauguaugaacguguguguguguguguguguguguguguacacccguggaggccagagguggaauuugaguauuuaacauuuauguguuauuuuuuuaugcaucucuguguuuugcuugucugcauauaucucugucccuggugccaacagaggccaaagagggcacuggaucccuuguaacuggggguacagauaguugugaguugccacaagggugcucacaaccaaagcugagucucucgcaagagcagcaaguucucuuaauuacugaaccaucugucccgccccucucuacuuuacguuuugaggcaaggucucacuggauuaggagcucaccaagucacacuaacugugagccccaccccgacuccgccaugcccacacccugaugaucugcuugucuccagguccuccauccuccacaccuccacucccacccucccauuccccacugcccagaaguacugaggcuacauccauucacaggcaagucaggcuuuagcacgggcucugggcauccaacuucugguccuaaugcuuaggcgggcgcuggauauucucucuaaugcccauuguccugauggaacagccagccuugcaacgcuugccaucagccugaugccacacucucucuucugcaccucaucucugaggugugaacaaacaggaggaaauagagcugggcguggaaggacuggaagagcauggaaaagguggggaaacccuggcgaguuagcagaaagacagcaagaaagcgaaguggaaauguguguauuuguacaggaaaauguaagacaucaggcugaaaauaucaugcaaaauguauuuguagggagacacuaauuagcaaaauggcuggagaaauuagcaaaggcuaagaaacuugugagccaagaaagaugaaaagagagauaauaaugguuacuuagacggggacuagucagggguuguccuaaaauaucauaaggauggguaugguaaacuuuuguuucuuuuuaaaaauuuuuuacauauuuauugauauguauauauauguguauauauauacacacacagagauugcauguaaaguacaacaggauuugaucaugggauauagagagaaaugaaccguagauggagauaaaauugauuacagauuuaacuucuagauuaagaaaugaggacaaacucuuacaucacugaauuugagcuuugaaauauauauauauauauauauauaauauauauauguauauguauauguauauguauauguauauguauauguauauguauauguauauguauauguauauauggaaaguuuuacacacaauaggguagaagauuggaaagauggcacagugcacagugcucuugaaaaccuggcaucucaugaucucuagcuucuggggaucuagugccucugaccucuggauacaaacugguacgagucccuuuacccacacacagguacuuacacaucaguaaaaauaauaaauaaaaaauaaucaguuuuuaaaauuuaaaguaaugguaugauagaucccuacuaugcaaaugggcaaacuaauguuucuuuggugucagagacuccaaacgccaaaacgcccugacgacagaugugcucaccugcaguggguucugguuuccucugugcaaaugaugucugcugccuuggaauuuacuuuggucuaauccaagaugcacaaugaaaccacuccaagcacucaagcugggccucucccugaugaaguguacaagaauauaucagacaucuuucuuucuuucuuucuuucuuucuuucuuucuuucuuucuuucuuucuuucuuucuuucuuucuuucuuucuuuccucccucccucccucccucccucccucccucccucccucccucccucccucccucccuuccuuucuuucuuucuuucuucuuuuuuuuuaaaaaacauucuuaggugggucucagauacgguacaggaucccucguuuugauaaauccuagugcccuuuccuucccugauucuccaaaucagaaaguuaagcguugaggguuccgguguguaggcaaacagggaccagggaguggacaugagcuuagguagcugauggucagguagggaagaaacuaguaugucauaguccaaaccacggaaaagagaagcucuuaaaagaaccauauaggguauuuuaaucccauauaacuacaaaaaggaggcauccaaaauggcaugaaaauauguucggacugccugcacaugccauuuugcuaacauucuguaaugauuacuccaggauacacaggggaugcaauuacaaguucugucacuagauggggauauagcacauuuuugugcuucagaagaggauauuuuauugagacugaauuuuaaagcaagacaggaaagaauuguuuauaaaagugugugccacuaaaguuuuuuagaauagccauguuauuucagacacuugaauuucgaaucguugaucugguuggcuuuacugcagauauaagcauauuuccuuuuuugccuuugacuccuuucaaaacgucuugagucacuauacuucaagaagagcaaucuuaaaaguauuucaaugaagauacuucuagauacacuuucauaaucccucauuugcaacuuaaaaauucaacaagucauauuugaaaaucaaaaaaauacauucgcguuacaccugaauucaggauauaaauugaucccuuuccguguguuuugcaguacuuaugaugcauauuaacaaauauuuguccccaacccucuuacuacacacaauaugaaucaaacaaaauaguuuauuuauuguuuauaugaaaucuccugauuauuuuuaaagcucuauuaaaggaaugaaggcuuuuguaaacauuugacuguaaaauauaauuuaaauugcgaugaaguccuucauaugcuuaaauacauuuccauugauauauguaucauagcaaagauagugcuuuuuguuaaugaagguauugcucaagauuucaugaagaguauuacaugauuucuuauauuuguaccagagagagagagagagagagagagagaggccuguguuuauauaugaauauacauacaagcuuuucaaaaaacagagcuucuuuuaaaucuauuaaacuuaaaaaauauucagaauuuuauuccuaugcauaaaguucuuugaucacaguccauuacccucccccucacacuuucccaagucuacacccccccuuucacaucuuacuuguguguuuugugaccauuacauuagcauucaauuaggauuaucugcaugcccccagaaguuaauuuacuugagugaggaacuguaccaguggccacaccacugaggcuacucuucuucccugcacacacagacugcccagaccuccuggggaagccuggguccucugcacccucucuccucccccauccaugaugggaagcuggugguccagucaccauauccagugguuccaaaaaugguauugucuauaagcuacaccauagaaggaccaauggggcagagaugaaugccuacagucauuguuucuaggugaccugugaaacagcuuucugcuggccagaagaagccacuucccuugacauauaccugugaucacauaucuaagcccaugcuaaccuccaggcuccuccagcuucuaguaacauguauuugcuaugaauaucaaagccucuauaugcuagucuccugacccugcucucucaccccuacuacacuaguucccaggcugcuccagcuaacucaccuccucccacuccugucacucccuaccucauaggacugacaggacucucccucugucuuaggguuuuacugaugugagcagacaccaugacaaaggcaacucuuauagaguuauagggacaguauuuaauugaggcuggcuuacagguucagagguuuaguccuugaucaccgaggugagaccauggcagcauccaggcaggccgggcacaggaggagcuucaucuucaucugaaggcugcuagcagaacacug

SEQ ID NO: 1379 - RNA, 1769 nt, Mus musculus
guauaggggacuuacaggauagcauuugaaauguaaauaaaauaucuaauaauaaauauucaagacaaggacucacauugauccagagaaagcucucacuugggcugugcauuuuggacaugauauucuugagauuuuuuuuucccccuugucucuagcuacaucaaagaguauuguuuuuuuaaccauugauugauugguuuuugguagaggcauucuccuuugugugcuguuauggaggcugauguguccugcuugaucugaguagacacauguauguugugccagaggaggcugcaaguguguaucgggugaaacuggaggcagggauggcuccaaacccuaguugugguaugcuuguguguccuuugcccaagacggaaauaaagaaaaucugguaggaaaacaaacacacauacacacaaacaccaacuuuuaagcagucuuucuauuuuguuuaaggcuguguauaacaguagaucagagccuaaaacauggaauuugguuggggaggggacuaguuuggggacauuuuggggaacacacuggcacagagguacuaguucuggggugacaucggguauaagguucgaaggacauacagcgggugguuugguaaugacuucaagguaauaagcauuugcucggguuagggcuuccaggaagcacuggucauccgaugacuagacacugcauuagccaggguucucuagaggaacagcaagacaaaaugaauauauauauauuuauauuuauuuauauauaauuauauauauauauauauuuaaaaagggguuauggcuggaguagcccaacaauggcggucucaccccagagcggcugacaggucagugguuucucagcaaaggcugagugucucggccauaccagaggauugaaggauuccuggagagcugcuggucuagggcuaugccggaagcagguaggagccaguucuauuagcaaagagaucaacagagagagcaagagcaggugaauccgcagugagcacagagguaagcacgaaccagaaacuuuucuuuuucuaucuuccuuucuaugugcucccaccacagggcgcccuccacauuuaaacugaccuucucacuugaaauaaucugaccaagagaaccucucacugagccaggcaguggcugcacacgccuuuaaucccagcauucuggaggcaagggcagggagaucucuguaaauucaaggccagcuugggcuagagagcaaguuccaggacagucgggacuacacagaaaaacccugucuuggaaaaggaaaacaaaacagauagacagacaaacaaccacaaaacaaaacaaaaacucucacuggagugccaguggcuagccugauuccagguccagacaaguugccaucaaguucagccauugcaggcaucuuuaugauuuuaccucacagaagauuuuaccucagaucaguccccaaggccauccuccugaagcaacugcagcuccuuauauugggugagaaggaauauacuuuguucuuuuugugggugugucagcauucuugauuuugugcucagacagaauucugaauugcuucgucuuauugcucugcugcuucacaguuaucaugccugugucugcagggcagguuuuaugaaaaaaaugcuguguuuuacugaauauguggauguagcugggagugucaagcuaucuccuagcugcuuuucugucucucaauggcuaagcaccaauaaauugcgaacaguacaaaaacaaaacaaaugaaca

SEQ ID NO: 1380 - RNA, 21314 nt, Mus musculus
ugacaauuccuccugaagcccugggaguuggagucaguguguucaggaggaggggaaaaaaacacaaaacaaaaagccaagaacggaaaccauuuccugagccagcucucaagaaaauggccugcauagaacuuccaaaggugaaacccgguagagacaagccuggagguaagucuuguguugggacuggaaagccaccaaaggaagauuguggacagggaggugguggcucugaaggugcagguuguggauggaucuaggaaucagucucuguaaacguccuucuugccucuuuccuacccaacccacgagacucuggugaacuccgggguuguagggcuguggucgggggcaauugucugguuccauugcuguuucuggguuaucagggcuaagggcugcucuaaccuaaaaagcgaaaagcaagcugagcugggugaggugauguacaccuuuaaugccagcucucaggagacaggcagggggagcuuucugaguuugaagucagccagugagauucugucaggaaaaaagaaaaagaaaagaaaaagggagggagggagaccaggaugguggccuuccuuccuccagauaggcucuguaagagcacuuaagagcaccaguguuucucaaccuuugggucaagaccccuuugggggaucaaaugaccuuuucucaggggucacuuuagaccguucgaaagcacugauauuuacauuaccauucauaacuguagcaaaauucaguuaugaagcggcaauaaaaauaauuuuaugguuguggaucaccacaacacgaggaacugaauuaaagggucgcagcauuaggaaggcuaagaaaccauuaguuuagagaguuccuuguguaaaucguuucuugggccauucuacaacauaguaucacagagaagagauuuuacaaggggaaaaacagugugugcuuucaaaggacacauaacaggcagugguugugugggguacguuccuuuaaucccagcccugggaggcagaagcauaaagauaucuacaaccacacagauauucuucuaugucuuuucuauugugauacagacgccuaaacacauuugugaagaaacagaaacaaauacaugcuuacuuauauuuuggaaugccauuuuuuuuuucuuuucagguucaugucucaacuucaaaaccgcccaauaagguucucucucuuuucuccggcuucauugaucugugugguuuacucccaagcacuggugcccuuugugcagaaucugucucuaaggaaggcuuaauucuccuggggguuccucuccucccauguccccucuuccugguagccugguccauguaaucacggaggugaaggcuacgaugucacugaagagaagagcugucucuuguucaccgcugaaccacucuugacuugaacaguaauugucugacggacuuuucuuuuauguuuacgaagugaaucgauuuacuaccagcaugcuuuuaaagaggugguggcucggagacaagaacagagaaagcaugaaaauaacaaaggggacacagaggaggccaggucaccucuggagacagcucuguagauggccagaccuauuuagaggcacgaggaaauccuucugcacgauagcuuuuacaagggaacuguaaucagauuggacauuuaaaauguauugacauacucgacucccuagccaaaguguuuaaugaucucugugucaugcaguaaaguggggcagacuggcacacucaaaacugccuucaguuuguaucuaucugauacccaucuacugguucccggaugcugggucauauaccauucacauuuuuauauuaauuauuaacaacaaugaaaacagaaagguugagaguagggaaauaagccuuacaggcuugauggucuguuccuucucagaaacccuugaaaacagaaagcacaagaaaagggccuccaauagccugccaccaaacauaggacccucuguuuuacacacuaacauaagagauacuuuuuaggaagggucaguagacuaaaccaaguagaaauguacacugugcugcgauggcaaaggccacucauaaagaugcacucuuuuugacauuuugauaaauauuuaucauguugaguuauuuagcaauuaaggaacuaugaagacaauauauuuuuuuuuucacugaacaaauauuuaccaauugucucucagguccccuggccccuuauuuuguuccagagaaacaagucaggcaugaacuaugucuguuccauaggugaguaagcccaggcuugagggaagugaggugagcuguaucuaccagacugacuuggguuuugaaccggcucuuccaacaguggccucugcuacccacguguuugcuggacugagaagaaaucuacaaaucuguugguucagaggacacuguuggugacuuuuaagacacuacuuggauaggugaauaugucagcuagagguaaaguacaggguaauucuuccagauauuugacagugaagggaaagauuggcagaaaaguaccuggaggggaaaagacagacagacagacagacagacagacaggaaagaaaaacagacagacaagaaaauaaaggcagaaagauagaaagauggauagaaagaaagaaugaaagauaagaaagacaaagagggagaaaaagaaagaaagaaaaagagaaaggaagaauggaaggaaggaagaaagaaagagaggaagaaagaaagaaaggaagaaaggaaggaaggaaggaaggaagaagauagaaagacagacaacuuugguaaggcuggaguucauaaguaugauuauaaguuggacccaaaaugaaacaaaacaaaacaaaacaaacucauacacauaagauaauuaaaaaaaauaaaucuuuaaaaaaaauaacuagagacagcaacaaaauguagcauggagaaauauuuuaagccacaggaguugcacccacaaauacguauaacacacggaggacacuggaggaaacuguucuggauucaaaugcugccucuguuucuugcugcuaaauguuagugcucuaggucuccaaggcucagaaaccauuuaacugauuucugggguuagguuucgauaaggugguggucuuuacuccuuguucccugccccacucaaaauugaaauugucugggggauuacaugcaaucaugaggcauacuaaaaacaauuccuuguuaaucuaaaaucugaguuggcuggguauguguuuuuccuagucucuugacucuaccagcucccuccaaaauaccuuggcuccaaugagccaugauaaaacaacauuccauagggaaaaugugaaaugauguguggugcugcccccugcuguuaggcuacggcaacaccaucuacuuuaacagugugucaccugaugcuggucuguuguuuguguuuuuuuguuguuuuguguuauuuuguuuaacagaaccuccgaacauagacacauagcuaaguggaguuugguuaccuuagcuccuauaauauaaacuuaugacuacauuaguucucacuaacaccaaauacauuccuccuuaacuagguggcuuuacaacuuuuguguuuaaagacacaguucugcuaugcaguccuggcugccacagaacucacuagagaccaaagcugucucaaacucuugguaauccuccaggcucauccuuccaagugauggaauuacagacaugucaccauaccuggcugcucuuaagccuuuuuaugagggggaguaaaaacaucuguacauuuaugacuuaaaauuugcacuggauuucaguaugcuauacuucaguaugcuagucuuuaaaguuguaaauuucacuuaacaaaggccaccauuauguucuuuuguuaugacagaagcauggguugguuuggggaguuaccugcauugcgcuggacagagggacaaauguuuuucaaacagcacaucuuugaaaugccagacuuagcuacucaguguacaaucaguacugaagcugaggagcccaggguuggccaggagaggagacccacugacugccucaggcuguagggugcgguaucugaacacuugguggcaggaacagggaccaguggcuauuccagaguccuaucucccacuguggaguuuccuaagggaauucaaggcuguuaccugucucuuuccccaccuuaucaugggcauuuauaaauuuaacuauuauuaagagcaaauucucugauuuuauguaguuaugccucuugacuuagaaauggaccugaaauccaauauggaagacagugacugguuccugaggaagcuguguggaagggcugcugacacgggucuagacuugaacagcuauggauuaacagcaguggaugugaaggaaacugguguguaugauauuaacuuuguauagagaauguaaggccucuauauggaaagggacagucaaaaccuacacaaugaccuacacuaaggucuccccugagguccuggacaugcgcagaaaguggcagugccacuauuuauuuuaaaagcaaacagacauuguuaguuaagauccuggucuuuuagucucuuacucaagagagagugugccuagcuuucucugagcccgggcuugcgcccuagcucugcacacaccuguauugccacacuuggaacuacaggaucacaaguucaaaguugcccuuggcuauguaggaaguuucaagccagccugggugggacccaugagcucacuacugugaaacaaaacaaaacaaaacaaaacacccccuuagauucuaauaagaaucuaguuugguguguugguucagaaaguauugacaguugcagguuugucucuuguuuuacagcaaaaggcacuguuucuuugaacaaauaaaagcuuucugugguuguuucccuuaaaaaaaaaguuaauugguuuuccugaagcucccaagauuugacuugagcauagggcaucaacucacuuguuuucuuccugagcaauuuuaccuacugagcugcugugucuugcucuaugagauaaaaauccguuccuaagaacuauaaacucacuagucugauccaugagaaccagccgugcagagaacucaaagugguauugcuuuguucagaauuauggaacaaaaaauaugacuucaagcaauuauugcuuuacaagcaaaaguagcaacauuuauugcccuccccucccccacaucacuccuguauucugcuucucagagaccuuaaaaugagcccaaugagacugcauguggucugccaauagagagauaccaaaaaugcauucuaauuaggcguccucaucuuagucuuaaucuacaugggcagugauggaaaauagccuguguggagccgaaaaauccaagaucaaugugacuuggucucgugaggucucagaucccucauacaucacaaguggguucuagcuguauccugccacaguggaagggaggcaguccuuuaagcuaguuccuuucagaaggauagcacacuagccccuucucuguugcugugauaacauauugugaccaagcagcuuucaggaacaagagucuguuuuaggcuuaugguucugaaaggaguccuucgcucaggccucaggacaauagcggacacccaagaacucacgauagaccgagcuuguugcaaaccacaugaggcuuuauucggggaaagccagagcucuggggaugacucauaucccacgcagggguagaggaguugaccuggaggggaaagaggucccaguuucuauaggcccucaggggggaaaggagaagggggggggaguagggaauuuccagaucuaaacaaugucuauucucaagaaauggguaugggagggguacaaggaaagagucuggugcagguguagcaacucaggauuggcugggcugugguugcuggggagauuuucugacucuuucucagcaaccaauaucacaaacaccuggcaaugggcuucaucagugggcacacacaugggucaaggaacggucaaaacauuggcagacacacagguucaagaaguggccagagcauugugcaccucuauuuuucuaaaucagugaagcuaguucugcuaacaaugaaaucuauuuugccaauuucagggcuucugugaccuuuuacguucugucaggaucuuuuaguuccaaaggcuuagagucuguaacuguggaguggagguagcaggcagcagagagacauggaggcacucaagagcucaccuccccaacaaacaggaagcagagagagugcacuggaaacagugcauagcuuuugacaccucaaagccaggcccagugacacaguuccuucaucaaggucacaucuacuaagucuccccagccagggcuauuaacagaugaccaaggauucaaaugccaaagacuuaugaugucucauucaaaccacuauagccacuaauuaugcacagaaaggcuccaccuucauaauuacccaauaaagaucuuuuucuuuuguaaaaauuuuauuuuauaauuuuacaugcaugguuguuuuacaugccuguauguaugugcaucaugugucuagugucaucaaugccagaaaaggauacuggaucccuagaauuggaguuacacaugauugugagccuuucaugugggugcugggaauugaaccuguguccucuggaagagcagccagagcucuuaacuacuaaaucaucucucccacccaagauccugucucuuaauaccacuacauuggagacuaaccuucaaugcuugcacagaggagaagaaacacauauauuuaaaccacagcacuauuuuaauucauuaaaauuaaauuuaauuaaaaucuaugccauuaugagccagggcuacuuaaaaauguuuuaaaauuacaucaauuguuuaauuagcuucucguguguuuauacauguguauguguugcuauaucucauguguauugacaccucaaagcuagucccagugacacaguuccuucaucaaggccguaccuccuaagucuccccagccagggcuauuaacagaugaccaaggauucaaauaccagacgccucuugagaaagucaguucucucuguacaccacacagggguucaggaucaaacucagaucuucagagcaaguggacaaguguccuuacucacagggccaucuucgcagcccuggaauggggcucuuagcagggaacuauaagcccaagcuuaagggaucagagccacuugagcuucugggaacaaagccaaacauuuugggcuauuggagccuuaaguccuaugucccaaccgguccucaggggucucugguggaagcugauuuuaccacugaccuguguuuugaguguaguagucacauuuucuuuaugaaguugcuaccaggaaggaggcuugacuuccuuuacgaauucaaaugaacgugggaaugaaagcaggcagcagccaacucuguguuuggugucagagcgcaagguuuuucuuuuccuguguuguuguuguuuuuggguguagucagugguuuauccuuuacaaagucuggucauggugaauaagaugcaguggcugaaaugauuugcuagaagcacugcuagaagaaagagguuuuugccagaguugugguuucagaacuugugacuccagacuaugugaccugaaaucacagaagcccucuggguagcuuuccagggugacugaggacaggcuccugcagcaugcaagcaugccuugccuccuccacguggccaucuccacccuugcugguccugaagauagaggagauuuuugagaauuuucccacggaggguagcuuuacuuuuuaacaagcuccgauagagacucaucaagguuuauucgcaaaacuuccacaucgaugucuaaguauaagauagcaccaggugugguggaggcaaacauccuggcgcccuggaggcagacgcagauggacuucugugauacacagucaauuucaggccagccagggcugcacagugagauccugucucaaagugaguaauagucaaugcauguaagguagugauggcugggaagggagggucaggaugaggaagaugugcagacuuucccaggcucugcugaccuggcccuggagcaucagccagguuucagacugaaagcccguuagagcaaagggggaugucgggcagagggagcaguaacaguugcaguccuggcagcagaaacagaguugcccauucugccacaggggucaauaacgacauagacaguucuauagaauccugggaagauagcuuuguguuuacagggugcuuuuguuuguuuguuuguuuuuguuuuuguuguuguuuuuuuacagaaauagaaaauaucccaagaaacaggaaaugcaaauggggucauuuccucacuugcuagcaagagaccacugcuuugcuaaaugccaacgugccuacccacugugguuucauauaaucccaaacuaccccccugugcacguaggcacugagcucuguuacaaaucacgaaucacacacacacaggucugcauccucuucugcccacuuuagcuucaauccugccucuccucucagacuuggaagaacuggacguuuccuggaacgauuuugccaggggggcccuccacaugcucacucagcaaaugcauccugucaacaaguuaaaaguccugaggcugaguagcugcagacuaaccacugaggacguucaaacacuggguauggugacccccuccccucaaacgugacugcucuuuguauauaccagcuugaaagauaaguuuagacaggggcuggggagauggcucagcucauaagaagcuuuucuuguaaacacgaggacccgauuuugaacuucagaaugcauguaagcuaaauauggcagcacagacugagaaucucaaggccagggaggcagagacaggcagauccccggggccugcuagccagccggcccacucagcaagcucugggccagggaagacccuuuucaaaacaaacaaaugaacgaaugaacugaggacagaggcaccugaaggaccaaacuagagguuauucuauagcuuccuguuuaugugcacaacugggcaaacauacauacauauuguauauauguauguguauguacauauuguauauacacauacauauuaaaagcuuagaagugaaaacagaaaacaugucuucccucgaagcaucuuuccaagcugaucccucuagggcaaauguugucucuucgagugcaaaugaccaagugcauucugggaaauggugcucccaugaggcaucgaaugagcugaaacgcccugugccuuagacuccagcuugugcugagcucuguggauaaggacgagggcagaggcaccgcugaccaggcaccuugcuuguguggcucuucaguguggcuguuguaaagccagcucacguugggucuuaggcccucaucuauaaaucagaagaacugcaguagagagcaguuaaccuguuuuuaaacuacaaaauaauaccgccuucauuuuucuaauccaccuuugaaaauucaugaaaacgaggggcuuuuuuuaaacuaaaauuugucuuaacucucaacuacaacuaaagccucaauuuaauuaaguuaaacuacacacacacacacacacacaaagaaagaaagaaagagaaaaaauuugugaaaacucauacuauuuucccaagcgcuuaccaaacuauuguuaggggcaggaacugggucccuuucuucuccucgcuccucaucggcuaacacagugucugccccagcuuuuauacgccccaaauacuggcuguucugaucgugaaugacugacaucucuuucuuucugaacauuuuguacuaggaggugcccuugaaaugacaccugaacucgaagaacuaagucugucguggaacagccaggugggagggaaguugccucggguucuccacacauuccaacaagggagcaagauucgaacacuugaacuuguggacugugcccucacgucacaggacggaguguuuguggguaaguggaauuggaggaauuugucccagaaaaacauaggaaaguugccuggagugcguuuucuuuaagcguguuuuuuccuccaguuccaagcucccggaaguaaugacucugagagucaaauauauuuauaaauaccuaggccauauagcuaggcauguuccccaacugguuuauaauuuaauuaucccauuauucuauucauggcaguuuacuugguccucagcuacauaugacugucuucuaugucugggacccuaauccuccgugcuugguucuagcccaaaauccucuuugccuaccggauaucccgccuucuauucuacccuuuccuacaggccauagguuuuuguuuguuuuguuuuuauugacaagugauguaaccauacaguacacaagagacucucugcagaagccugugauuggcagccgggaagcuccuggaugcucugucuccgaggcacagaaagcugcaguagaccuccugcuugcccccugacuucugcauggaugcacuuccuguuuggauuuauucccuuccaggucacuugcuacccaagcugcagagccuccaaguauuugaccuuuccaacaacagaaauauuggcagcugucuagaggucauagcgcaaggauuaagaagugcaucaggccuaaaggaacugaaguugcguuccuguggauuaucccaaaagagcaucagacuacugggugaguuaacagugguuaaggucaagaucauguaaaguauaauaugcagcauauaucaggguuggcgagauggcucacggggugucuccaaguggguaucacucacacauacccacacacaauagacaucagugaaauguuuucagauauauuauauagcauaaauauacagcauauacauuauuaaaaaccuauuagaacauauaaauuugaauauucuuuguucuauuuauuugcuucagagaugggaauugaacccagggcuuuagugcuagcuaggcuuauucauuuaaaaaaaaaaucuuucacaguaaccauacacuuucauuauuaccaaaaaagaaagaaaaacacaaaagaaaaguguacuggcugguuuugugugucaacuuaacacaggcuggaguuaucacagagaaaggagcuucaguuggggaaaugccuccaugagauccaacuuuaaggcauuuucucaauuagugaucaagggggaaaggccccuugugggugggaccaucucugggcugguaguccuggggucuauaagagagcaggcugagcaagccaggggaagcaagccaguaaagaacaucccuccauggccucugcaucagcuccugcuuccugaccugcuugaguuccaguccugacuuccuuuggugaugaacagcaauguggaagaguaagccgaauaaacccuuuccuccccaacuugcuucuugguccugauguuugugcaggaauagaaacccugacgaagacaaaaagcaaagaagccucuuaagucgggcaguguagaucugaaauccuaaaggcugaggaaggaagaucacaaagucaaagccaacacaggcaacuuaaugaaguuaaauacauaaguaaauaauacauagcaauuuaagagagaaguaacaagagagaaggaggaugggguaccucaguggggggcucucucuugcuuagccuguauagggcucuagguucaauuccacacaacagacaagcuucuaaucagacuagcuuuacaaagacugggaaaccuaggguaugggcuggauacuggguagauuuacuaucucaguugaagaugucagcaauauuuugugcucagugcuaggaaggugcugauauugauaaaaccaauaaugacagcuccggagacaucuagggugaaugaagacuuuguguucaugugggguagcuuaugauagggaacgacauugugauuuucagagccuucaauauucuucuuccuggcagccugaguaaaucugauguccuugcucaauaguaguuggaggcauagucaaguguccucauagacaagaguuaguggcagccaauugguaucuuacagagagagcuugugaggucaucguugggucuguugaggccuaguagguagggacucugcacuuaucucccccaucccccucgcuuugccaggaugucaugcugacuugccuccucuccugccugcuccccuccccuccugcacucuugcccaccaacucacaauaugaauuucaggcccuggguugggaccugcuuugcagauggugucuuugcauccuuggaugugcugaggauacuggaccucuccugcaacaaggaacuggguggaggcuuugaggaugugccugcucagcuggcaucacugaagcaucuggaaguccuggaccuucaccagugcucacugacagcaggagaugugacaucauugaguaagugaccccguggagcagaguccauggauaugccugggaaguuagagauuggcagcagauguuuaaauucacuggucacgucaucagaguuuugugugugcacugagcgcccaguaaauguuaaggaauccaggauuuaguacuuggagaauaauuuaaacuucucuugcuuuuuagaaacaaguaucuuaguguugcagccucgaugacauacagagauguagagagaagaccaaaaggagguuuuuaaaaugacauagcgaagucaagacauucagagacaagggcaguuacugaaagggagacagugaugguacaaaaugaacauuaugacuuuaaauaacagcagugauuucuccacuaucaauaugggucugugguuauuaccuguaauauauaaaugcaauuucccauaacaagaaaaccagaaauuacucuuccucccgauauguggccauacugaaccuucaauauauucagcaugacuuaccauuccaaaccucugcuacccuaguuuggggaccugacauccuuugccucagcuguuucaagagcccaaauaccuuccuaucacuuggucucugccuuugcuccccacccuucaucucacggaacuccacugucuucagacaugcaaggcaggccaguucaaacugagacacggagggacagucucauccaaaccacugcagauaggaaagugacugagagguuuauuuuggguugggcgccuuagagggcuccaagauauaagccagcuccguggggcuccugggauaauauuuucaauggugguaaguguuagggagaggcuuaugagcaagcaaguaacagaaagauaguagauuagggcuaccuuuaagugccagcgcuugcuuaccggacaagguuagcugauagggccggugagaagugaaucuucgccuaggcacagguuggaaggcucacagcaagacugagacugugacauguuuuuccaagcaaucagacuucuuauaccuuuaugaaaagcagaauauaauggcaguugccaggaugcaugcaguaguaguugccuggauccaguuauguuugcaggcuauacaagauuaauguccaagaccaguuguccugucaaauuucugaaugcuuuguugauuucuagaacguagagaaucaugagacacacugaaugcucagcuugucagaaacugaaaggcaugcaguaccccaggagcuacaaacucuaaccugaaaauuuuaugaugccugccucucacggcaacuagaccaggccgacuccaucaccaacggcuugucucacuugccuuacugguacuuacauucugagcaaagaaugaugaugucagauguuaauaugugccaaccaugaaggaaacuacaacggacaagccauuuucugucuccagugaucuugugacuaauaaaaauucagaguagccagcuacugcagaaaucauacaggguuuguuauugucguggcuuuugugguccugugguugaaaaccuagcuuacucaaagcuagcaaacacucuccaaccaggcuuuguagugagcauuuugguuucuuugaaagcauagaaauguuauaggaauguauuuuuguuuuaaucccagguauuggguguggagcugcuuuagauugugcacagcugcugacuaugaucugucucgugcucugguaggggcaugguuuugccagcugcagacaguguuugcaaucauauaaugcuuggaauucuggggacucuugagaguguauacaaugcuagcguccugagagaggcuguggcuacuguuucuccugcugugguggcugcuuggagauauucugaugacagagaucaaaauugucccaagaaacucaacaccccuaaccauagggaaguagucuaacaguauugcggcucucuuuccccucuagucuucuuucucuccuaccuaauguugggguugaagggauaaugauagcguaggguaaaguagccaaagagucaggcucuguaccuaguccucuuguuugcuuuuuauuuugaaacaaggucucacuaugcugaucagguaggccuugagcgaucaacccuccuuccucagugucucaagugacugggaguacaggcuuggaaugguuggcccaacugauuacacaguuccuugcuuuugccuucuagucuacagagaacuuugggaauagagagaggccuggggaggaccuggagaaaggcugauuugguaggaguauggucugugugcaaguuccagccagggaggguaaugucauacaaugaguuugguagcugccaggucaggacgccugugggagccagacgcucccaugacugugaaauggugccucauacaucucacgggugauauuucaacagcucagauuaucccuuuacucuccaaccuggaagaacuggacuugucauccaacagagacgugggcggcuccucagagaaccuacucugcaggcuccgguuuuuaccagcacugaaguccuugcugauuaacaguugugcuuuacaaagcgaggcuuucgcagcccuugguaagagagcuucccagcucccagcagacacugcacaguggugagagagagccccacuccccaccaaucauuccaagauuaaggugcagaaaaguuacuaaggacuaauuggaauuuuugcuuguuuguuuuuccagaaaauauguccucuuaaaaguguccuuaaagucauaugaaugacacuggcauuuauuuuacuuuuauuauuuaauugagacaggaucucauauauagcccaggcuggccuugaacuugcuauuuaacugacagugacuuugaacuuguccuccugccucugcuguacccuaaccuaccuuugaguagcauuuuccuuuuaaugaagccaacuguagaagucuaugucugguaacuuguaauuuugcugagagggaaugugaacugagguugcugagucuggugggaaaaugaguuauucagguguacacuuagcccaccauccagcacucguuccccacaggacuuaaugcucuuuuaggaauccuaagggucaugcaucuauccuagccuuaugucauggucuaccagaucuagaauuucuucccaucauggcuggcaaguggaggaaggugcuuggcagugacgggauaucguagaauuuccccaaaugaaucacucagguaagccagcacuuugugcauucaguacugggguccacagcaccauuccaguuuaauugauucagagggagacucaaggcucagcauauagcuguauucauagcaaagauuuauuacagggaacuaugaucaggaauaaggaaaacuucaagaauaagggagaauaagaccaagaaagggaaacuuuuuugauggaaagccccaaggauaccaagaacaacucccaaaaguucucucucaguggaguggcacagguacauugaacuaccccagcaaugaguugugacucauaugugaaauauguucuuagugaagcucaccugaaccugcaagcccaggguuucagacguacaaauauccccucccuagaacauuugagaauuccagacucacagaaggaaagcuaguacaugccaucauuuauauuauuaauacaaacagauuaagugcagcaaguggcucuuguuaguuagggaucugugaaagcacucccuaaucccagguucucugggcagcaucuuagggccaggccagccuuuccggucagccaugggccuuucuagggcaguagucucagucuuguccugcuaacuuuguuaugacuucaauaggggaugccgccccacauuuuauguauugaagaauugauucccacuggagugguaucccgagguggcuggguuccgaggacucuuacuuuaucgaugcaccagccaugauagauaaggagcugagugagcucuuuauugguaguggugggaucuguaggaggcguggccccaccagaggaagguaucccagcguaagccuuugacagccuuaucuuauccuagguuccuucugcuuuucuucuccuuccucuucuuggcugugaggaggugagcugcccugcuccaccacacacuccgaggucugugucaccugagccugaagcuacagagccaagccuuugcucuguaguuaguugucaguuguuaauauuauugcagagucuguaaauuucauuuaaaacaggguuuuaucaguucacaaauggcagugcacuuccuguagugucucagguagaaccuauguugcugaauauaaccuaaagggccagcucaccagcaucucucucuagggcggacugauucuuucugauccuucccucugauucucaucucuggaaugucugacuucuagucucugugcuuucuuaguaguucccacaacuuucaggucuguguaacuguuuaacacagucacuaccuaaacuaggagcuucuucagaaccuuugauaacauuuauaauuaacguaaagugccugccaggaggaccagaagacuggggccagccuuggauguauagcagugucaagaauaagaucuaggaggcuggagagacggcucagugguuaagaacacugacugcuccucugaaggucacaaguucaaaucccagcaaccacauggugacucacaaccauccguaaugugaucugacgcccucuucugguucuugucugaagacagcaacaguguacuuagauaaaauaaaucuuaaaaaaaaaaaaaaaagaauaagaucuaauucaugcacuuauuuguaugguuguauagugucccuacccaaugcacucagcacucucugcguuugguuauuacuaaguaaguagauaaguaggcuucucaaaggaguccguaauucaucaagcaguuagguaaacacacacagugagacauuuuacacucaaugcucauuuggaaaaauuacagaauacacuaagcuugggaacaauaugauguuucauaaauauaccuccuaauugaaaaaauugcucuugagagacagcuucuaucuacuucuagcuguauaaucaguaaagaauaaguaaagaauauuacacaaauaacaucauuaacauaauuguaccagucaacuugauaucacuuuuauagaaaaaaaauagaaaauuugacuccucuuuacuauagaccuuugugccaagagugggcgagauuucuccuugaacaauauuauucuuuauuuuaaaaaauuggacaauuaaaaauacuuacuguacuugggaauaaguucuuaugauuaauuuuaacuuaggagccaacugagaauuaauuagcauuuaaaaacucuacccagaauauguuaguucuuuccuugugccuuaguuacuuuucuuucucuuuaaaaaaaauuauuuauuuaucuuauguauaucaguacacuguagcugucuucagacacaccagaagagggcaucggaucccauuacagaugguugugagacaccaugugguugcugagaauucaacucaggaccucuggaagaacagucagugcucuuaaccacuaagccaucucuccagccccuuaguuacuuuucuauagcugugaagagacacuaugaccaaggcaacuuguaaaacaaaccauuuaauuuggggcuugcuuaagguuagaggaugagucggugcccaucauggcaaggaacaugacggccgaggcaggcagguaggcauggugcuggggcaguagcugugaccuuacaucugaucuacaggcagcaggcagagagaacaagacuugagacuugaaaucucaaagccuauccccagugacacaggucuucuaaaaaggccacaccuccgaauccuuccaccaguuccaccaacugggaaccaaacuuuugaauauaugagccgauucucauucaggccacaauacugugccugguuaauugcaugaaguaaacacaaauacagcuugguguucuugaguugcagagaagcuuggucccaucucugaauuucagcugggaccacacauuggcauacgugccaaccaagccauaccuuggaaauucugaccagcuuuccaaguuccuugacuccucucuccauaaguacaaaagaaaucaaagaaauccuagcuaauggugaauaccauuuaaucaagucuggcuuccuaauguugucaguagugccccaaguacacccuuuucagcccugagucaguaauauauugucucggcucucuuugcacagauaugaagcauauggucucucauggguccacguuacugaugcucuuaucuuuacaacuuuagcagacgccucuguguaccucccagcccuggagauacucaaccuuuccuggaauaaguguguuggugggaaccuggagcugcuucaacaaacacuacauuugucaagguugcuucgagugcuacgucugagcagcugcucccuggugacagaggaugugguucuccuggguuuguauuaacuccuccuuggcacaaaguguggauaaaguggugggccuggggcugaggcagcuuccuuucccuccauauuggcuuaggagagaucugguuaaaacagaagccacuggcagaggaggguguuucuggggaugaggaggagggaggaaggucccugccaggaagcuucugauucagccauccacacagaggccgccaucuacagugcacucacacucaaugucugcacacagcuaccugguacuugucagauuucuagagccaugacuauucuuugagaugagcuggccaagguagaggggagugauuggucggggucacuagaagauagugauggaugguaagaagggcuuccuucuguaagaucagccccacaauggaauguaagaguaugggguggaggacacagccaugguggccuucaguagaggacugucagagggauacuucacaaaucauucaucugaagguugauugaagagacccuuuguucugagauccugcaucucuuaucucuucuccuuaauccuucuuuugguucaguugaagagggaggcaggugccauuugccuuggguauccugacuacuuucuccugcagaagcaaucaucuaaggucaaaguaugugucuuaguuaggguuuuacugcugugaacagacacuaugaccaaggcaacucuuaaaaggacaacauuuaacuguggcuggcuuacagguucagcgguucaguccacuaucaucaaggcagaagcaugguagcauccugacaggcauggggcaggaggaacugagaguucuacaucuucaucugaagggugcuagcagaauacuggcuuccaggcagcuagcaugagggucuuaaaacccucacccacaaaacuacaccuauucuaaaaaggucacaccuccuaacagugccacuuccugggccaagcauaaucacaccaugacaguauaagggcucuucaaagacgaaauuaucucauguaguagaagucucaaaagugaacuauaaacuaccaaguauauuuuauacacugaauuuacuguuagggauggggauauaguucagugguagaguacuuaucuagccuguaugagacacuagacucaaucuccaguaccucuaaaaugaaaguacucuguuggauaauuguugaaucaauaaccagcauuaaacuugcagguuuaaugcuguguaccaaugguccuuaaucaaagccaguaggccaucauucugugcauuaauuaggaaaagucugcaggagaacugggacuccaguggagcaaagaacuugagcuaauacaaaaauggaauucuuccaguugagguuugcaaaagagaggcugggggaaucucuuuuuugggcuauguaugggauacacagagauacauuuucuuacugaaauacuuucagaugccccaaauaaaacagcugguuaaaagaaaguuauuaucaauuguuacuaacaucagaagugauguguuacugaaaaggggaccaaccuagggagagaguauccuuacaucuuagacugauuuuguuuuccagccucugucauacagucaggucauuuagcgacacuacagaagcuugaccugagcuacaaugacgguaucugugaugcaggaugggccauccucugccaaaaccucugcuuucuuaaagagcuaacugaacuagacauuagccuucgacccucaagcucccaagauuguggacaaugguuuagccacuuacuaugugcugugacccaacuuccugugaucacugagauagagaugagaagaugggucaucccagcccuccaggaaagagaacuagacugcuucacccaggaccaccaaagggagauucgauuugaccacgguggguuucagcgugcugcuuuguaaacaaugaacaacuccccaaaggagaacacugugaacgaauccugccgccagcugugcucagccuguaguuguuuaguagcuuuuguguuguaaaauuuuuguaauuauauguacauaacagugguucucaaucaaggcucaugauaccuuugagggucaaaugacccuuucacaggggucacauaucacacauccugcaugucagauaucuacauuauaauccacaacaguagcagaauuauagguaugaaguagcaauaaaauaauuuaugguugagggggucaucaaaacaugaagaaccuguguuaaagggucucacuaggaaauuugagccaggugugguggcgcacgccuuuaaucccagcacuugggaggcagaggcagguggauuucugaguucgaggccagccuggucuacaaagugaguuccaggacagccagggcuauacagagaaacccugucucaacaaaaacaaaacaacaaca

SEQ ID NO: 1381 - RNA, 1029 nt, Mus musculus
ggauucgagcgccgcgccucccucccuccuuccuuccccggacgcaccacagagcccucggccgagcggccgcuaacaccgucccgccucgagaccaucccggcgccgcgaccccgcggagacggccuccgggcguccggccgcucgggacgucucccccugucccuccucgucccagcgcgcccgagcccguccccggucccacggccccgccgagcuaccuggauccgcuucuugugucgccugcguuccgccauguuggccgcuccgcccgguuccuucugacguggagcgagucggggagggggcggcugagaucucgcgagagcgcggcggcucgcggcccguuauguaacccgccgcgggcucugggcugggggcggccuccguggucuucccgccguccgugcgguggcggacgacgcgggcugcuucugcuucuggucccggaggccggcgccacgugagucagagcgcuggaggcuggcaagucgcgucggcucucagcccugacugaacgcccgagucaccuggcuggcguguaaacacagauccccgggccccgccccucagagucgcugacgccgccgggaccaccggggcgcacagcgucaccuguggcgcuuccugccccagcgagccccguggcaccccacuucagucccgccaaguuccccuuaaaagguggaaaacaacuucagagucugacuccauuaaacacagcucguccccaaagccuuggaauguccgcuccucacgugacaccucacaacccauccuuagacuccagaaggcuggaugagcccagggaaguuaagguggaaaggagcaagacuaguugggaugcaguagacugcaggccacuucuauaugacuauucugacgaccugcuauaugacuauuauuccagaacuuucuagaccaaagacauggguaguuaagugcuuagguacaaguucugaugacauuguggcuguaagaaaguugaaaaaaugcagaaaagauaaaaccaauaaaguuuaauucuau

SEQ ID NO: 1382 - RNA, 70127 nt, Mus musculus
cacuucguguuagugauggaggagagaagauggcggaagcggagugagugacuugcuggugacugaugucguaaccggggggcgagugagggcugcgacacguucccccgaggcagcucuuggggcuccgaggcuggcggugcagggcggaggcgaggcgggagccacggcgugguggagaagcccgacugugggaggaggauggcagguccagccagccuccccucgggagugcgugcugcgccgugcggucccggggcugugugguccuaagcgcacagcuacccgggggacccuagucuccgggcucucccgggacgcgagcccugcggcgcucggccggggcugucauuccagccgcgguccccgccgagguguguccggcugggcaggcgccgccgggccuccgcgcuggcuccugcgggcccguagccgucugucuguccguccguccguccguccgugcggcgggggcgcggggaggcgcagggaggcguccggacagcggcugcggcccacggccgaggcuccccaccuccccggccuuuccuugcagucccccuccgggcucgggcugcggcggcgagccucccucccuggagggccgcauucuuggguagcgcugugaugcuaugcucaguuggcgacuugaaacuucagguucccggguaggccucuggagugccagagcugaacgcggcaaguauuuccgugccaagcccgugcgcuccccgaaaguguucuuuuguaccaggccucgaaauguaaagcgaugguuugcccaguugcacacauccaauguuuagaauuacugucuagguucccugaccauuuuugguucgucagaacucacugucuucuucgcccgccuuugggcuuugagagcacagcugagcagaauaagacuuugaaaggccaggguuuacggugguggcuuggaugccauuggucccggugccaaaguguuuugacacgcaguaguuucaagauuuuaccuuacugcugauugaguguaguauugagcaggugccauaugauacugugguuugcugauuggaaggaaaugaacagcagaacgucuaaaaaugugauucagcucccacuaaaagaaguuagcagccccaucuguuuuuccuuucaccuuacuuucucccuuguauauuggagcuguuaauacagccuaugguggcuggagacuccugagucucauugaggccagccugagcuacguagugacacccuauuuuguuuugauuuuuaagaaagagaaguaaauguucuuguuacaggcuugucgacggugggaaugccagccgguucaacuuuuauuucucaggagaaaaagacagacaaggaaggaggaauccaguggauucucauggggccuucugagccuggggugacagcuacugugguuuuaguuuguaacagcauggaagcccuuagaggcuuggcuuuauuaaaguauagauuucucaguggguaaaaauuuguacuacaacauaaaugacauaagaucauaauacuggagggaaaagauuagaaaguuugguacaaacguguacuuuacugguugugcauuggaagcugaauaaauuauauuccacacccccaaauuuuagagcaauuuucugugggggggggauuuuuguaaagauguaagaaguugcuuauauuugcuacuuuauuucuuuauuucuuauuuauuacuuaagugggcuaauccgguaucaagcuaaacuucugacacuagaguuaguaaggacaauggugucgucuaagaaaagcuacugagaauugaaaaaaaugaacuuaaaauuucuuacguauagguagcugcguauauguguguacauuauugccauguaugugcccagucccuuggaagccagaagagggcaucugauccccuggaacuggguuuuggaggguugugugggugcugggcaucaaacccagguccuuuggaauaacagugcucuuaaccauuugagccaucucuucagucccacuaacauguccuuaggaucuuauuuuuaauuuuaucuauuuuuuuugaaacaaggguguuguguagcccaggcuggccuaucacuuaguaugauguagccaagggugaccuucuucaagugcugggauugcauguauaugugccaccgugccagguguacuaagacacuuuaaauaacugcacggcagcuacaguuaaaccaggaaggaagcuacuccuuaggaaucuucucagaaugacucugaggggcggagagauggcucaguaguuaggugccuuuguuccugcagaggaccuggauucaauucccugcacgcacaugguaggucagaacuguccauaauugcuuaugugcagggcacacagguacauacacacauccgcucuucccccauauacccaagaacacaguaaggacucugauagugcucaagccccacccucuuaauauucucucacuacuuuaucuuuugguuucaaauuugucuuuuuuuauugaaaauucuuuuuuucauacaacauauuuugguuguguuuuuucuuuccccacccauaaucucuccuagcuucuccccacuuuccuaccuacccaacuuuaaguucccuuucucucuuuuuuaaacaaauaaacauaaaaacaaaaacaaaacuccagaaagaccucagugguggugauggugguccauacuuuuaaucucaggaggccgaggcagaggcaggcagaucucugaguuugaggccagccuggucuacagagcauguuccaggacagccugggcuacacaaagaaacccugucuuggagaggaaaaaaaaaaagaaaagaaaagaaaagaaaagaaaagaaaagaaaagaaaaggagaaucccacaaacaucuccccaugaaaaaccccauuaaaaacaaaaauccaaauaaauaaaagacuaauucuagacaaaaauugucaaaaacaaagcaaaaugaagcaaaaaguuccuggaaauacuguugaguucauuuuguguuggcuaacuauuucuaagcguggguugauauauccagugagacuccauuggagaaaacugaguuuucccauugccagugggcaucaguugcagauagcuucuugguaggaauaggaccccauguccacuuccacauggcuaaaagccgucccuuuucaaucaugcaaacaaaaacuucaauaggcuucaccucagguacuguucugagucauuugaguucaguuuaacaguaacuaucaaauacucugaauuuaagggaaauuuauauuucucuucuguuugcugauugagugcuagcuuuauuuuauugaggccuuccuagaaauuuaggcucuuucuuuuuccccaccccacccccugaaauuuugggucuuaacugaucauuucuuuguagcgaguauucaucaaagcucauagguagugagugguuuuuccugguacugauaguuuguguucucuaccagguuuaaggaccacagcacagcuauggauagugagccgagcucuggaacauccgugucaacaacagccagcaguaccaccaccaccaccaucaccacauccuccucccgaaugcagcagccacagaucucugucuacagcgggucagaccgacaugcuguucagguauuucugccacacacgcacgcacgcacucgggcaguuaaggccaaagauggcauacuguugugcccacgucagcugucuguguugauucauauccucggauagucggauuguagaaguucagccugggaauggagcucagugaguguuugcuagucuguguuuaaucuauucagagggcuuauauuugucaacaggaagcuuauaagguuaugugucagaaaaaaauauaauugaaugccucuagaugcagcuauaagagugaaguuauuacuggugggauauuuggaauagcugcuuuucugacuuacuuuauaucugagugcaacaucacgcgguguaagaacagugagcaggaagguucuacagccucuuggaguagagagggagagaaucauuugaaagauuuuuaguguagucauuuacuugagaaaguaaaguugauuuagcugagcuuuauaccaguagagacaagauggcguuguuuuagaaagacaugagugcugucauaugauggcucuuuguuugaguucaguugucauuauucuuuguaucugggugcccuugggcggaagacauaaucaucuccuugagucucaggaaacaguaaaauguggauaacacuguguacuuugaucaguuacuaugagaauuaaagaagcguuuagaauugugugggagacauuacaggucucuauaaaugguaguagguccauugaacaaguuuuauguuccgggcauuuaaugagugcuuucuuuauguagauuauuuuguuuaauccucccagaccucucuacaguagggauuuuacaaauaggaaaaccaguguuuuaaauaagcuaaguaauauuuccaaacucacauugcuguuggguugucugacuucagguucugccaguaccuacucugaguucuugcugcugugugcuuuuuuauuugccuucauuguuuuaggauucucaauucuuauaauuccauuuuguuuuguuuuuuuaaaacaggauuuuucuguguagcccugguuguccuagauuuuucucuguagaccagacuggccuugaccucagagauccaccagccucugccuuuaauuucaagugcugagacuaaagguauaccacuaccuucaggcuuguaauugcauuuuuaaaguuuucuuaaaauuuuuuauuuuuauugaaacuucugcuuacauauauguuucgugagguggucagauccccuggaacuggaauuacagacaguugugagcugcuaugugggugcugggaacugagccuagguauuuuggaagaguagccagugcccuuaaccacugagccaugucuccagccccucccccagcugcauuuuuuuuuuuuuuuuuuuuuuaugggcugggauccaaauguuguuuuauuauugcagucuucacucuuugugcuacacucauucaugccuuaauuuguuucuccguggaagauauucagugugacaucuacguaggucuucugugguuuggaauuuaguucugacuucacugugaagaacugcuggaggccuuguuggcucagcagcaaugcagacuugaaugcacagggagaacauacagauaggaugauauuugacuaugccauuuauuuccacuuucacuuaugcuggauaaaguaaacaguguaauguuauuagagacauugcagguacugauaugucucacaagaagcucaaacucuaguuauuacaggccauugaguuuucucauuuagaauauuuucaaagcuguguucauugaaccacuuaaguaguucuuuaacuuucaagcuuuauauuuuagucauguggauuuucuuuacccugguucaguagagaaacaaaauaggaaugcuauauuguccuuuuguaaugccggugccagguaucugguaaagaacaggagaucauguugacacaggacauuacucagugacagaaaagccuugaguugcuuauucgcuuguuauggaguuuuuagaauuuuguuauggaauuagaagaucauauauggguuuaucugaccaaagaggaguaguguaguucugagucacucaggguuucaucccuagucuuuugcugugagggcaucugugagaagaguucacagcagugaacucacgcaacucugaggaaagggguccaugacuuuauguccgcuauccugacuucuuaugggcuaucacacucccacuccauuagaguguuuguaacucugcugugacgcugagauuagcgcucugugcugcuagagucacagugcaacugaggcacuuugacguguuuugaacagauggagggaggauuuuucucuugucuuuuuagaaaucuugaugucucucuuuaggcuccgauucuacaucuauuaauaauuacucacuauaauuaaugauuuuugaguuuauuuaaaaauuacucuauuaaaaaucauuuuggagccaaguggaugcaguauccaugaagggcagcagagggcgucuaguccccuagaacuggagcuaugaaugguugugagcuauguagaugcugggaacugaauccugguccucuggaagagcaagcguucucaaaagcugagccugcucuccaauucuauauauacauuuaauagauuucuaauguguuuuuuugccugccuguauguauguaugcauaccauguguauccuguuugccugcagagaccagaagauggcauccagugcucuggaacuaccacaugggugcuggaaccaugcucagguccuuaacuaacuccccaacucuagggguuuuuacaguaguccaccagugucacaggagcuggcacgguggcucagcagauucugucuuccagccuggcaaucugaguuuggguucccaagcccacaugguggaaggagggaaccaacuccuaaaaguugucuuuguuuucuggccucacacaugcaugccaugguuuaccaauacacaaauaaauaaauuuaaaaaaugauuaagagcuauguggaaacaaagaaucagauuuuuuuuagaaauucaaaaauuauugagucauuuucaaagagaaauaucucuuuaauuuuauauaauguuuaauauaauacucauuguagaacuuucagacauauguagauaggacaaaccagacauuaacagucauccccaauauccuugccuuauuauuuccuaaauaguaucuuauucaaaaugauuucuucaccuugagauguauuagucacuaggucaccucuagcaauuuauauuaaaucuaaaauucaaggucaguuuaacccacuucuuuacccuagccauuguucugugccugcuugaucuguggcugguggucauugcguuugucuguauuaccauguguaaugggugcgugguagaacuauccaucaugcaucuccuggcaucuaccaagcugucuacagaaagcauacuuuuuucuuaacugcuaguguaggaaggcuuaaguuuuuggauucuuguuuaucuacaaguugugaguuaccguaucccuuuaauugguaaggguuuugacuacuaaugagaguuaagaucucaucacauauuuguccuguucuacuuuaagugaauggucuggguaauuuaauuuguauuaauguuguguaauuuauauaauaauguauuauuauuguauaaugagcaaauccuagugguaugcaacaauagguaacuguguuaauaagcuuaaugacauugacuguuaaaguaguaaaaacuuaaggagcuccuuuuuauacuaacguuuuugacuaaguuaaugguugaugcagaguuaaaaugguagagccgugcaaagccucagcaccagagugagaaaacaauuuugagaugguguuugaccgaggcucucuuaccuuaccuaccacagguaauucagcaggccuugcaucggccccccagcucggcagcucaguaccugcagcagauguacgcggcucagcagcagcaccugaugcugcacacggcugcucugcagcagcagcaccuaagcagcucgcagcuccagagccuugcggcuguccaggugaggccggugggcagugucuguuagauggggauuacuggauucugcaggcagguguucuccgagagcuuguuguccccgaggagauggguuccuagacugacagauacaaguucacuuccaggcgaauagacaugugggcguguugcucuuuauuuaaguuggguaaauauucuguauguggugugcuuuugucucuaaaauuuuagguacaacacugaauguuuaagguuauaagaauuauauuuuuaaaaccaaaaguaaguuuuuucuuccauagguaaagcauaucaagugagauaacaugaaugguagaugaaguagacauucuucuacgccugucaucuccugaguuuuagaggugccacauggcaggacauggguguguguguguguaccuuuuuaaaaucugaaauuaggccuaucaauaacauaauuuuauaauuaauguuuuuguuuaaaauaaaauauuuuucagccuagugaugguggugguacaggucuuuaaucccagcacuuggaaagcagaaacagacagaucuuugugaguucgaggcuagccuggucuacgagggaguuccaggauagccagggcuacacagagagaucuagguccaaaaaaaaaaauuuuuuuuuaaauuaauauucuacaguuuaaacuugugagauuuaguuauuaaucuuaaaucugaccagaaaauaaucuuaauuugcaauaccugaaaaaaguauuucuguuauuuauagauaccagcucuuguuucuuuucaauaguguacuauuguauguuuguuuguuuguauauguauuuaagaaagauagggucuucuuacuagcucuagcuggacuagaagucacugucuagaucaggcuggcuucagucucaugcagauucgccuguuucuaacuuccaaauucuggcuuuagagguguguaccaauaugccaacuucgauagagaauuaaaaauauuuuaaguaacaguuauguuuaugauuuaaggcaacggaaaccuacuggcuguugaaauagcucaaguuucaguccuggcugucuggaacugacucuguagaccaggcuggcuucaaacuuggagaucugcccgcuuccugagugcuaggauuaaagaugugcacugccaccaaccugcuucuuuuucuuuuuuuuuuuuuacaaaauuauuaaugguuuugaugugcugugugugguuacacaugagugugugacuguguguucccacgugugcacuuguggaggccaggccaagaugccaguugucuuucuucaugggcuuucucugcagcucucucuccugagggccuugaagacagggucugccaggaaccagaagcucacuggcacgauaggcugccgcuugcaggaucucccugccuuuguccuucagugcuaggcuuaaugugaagcuaugcauggcuuuuuguaugaaugcuaggguuucagauuccaugugcccaggguuacagagcaaguguuuuuacccacagccaucuccccugcuuaguuucauuuuccugguggaguaggaagagugagagcuauuuuguugugguaauaauuaaucucaauuagggguuucuacccugccuuagaucauccaguucccauaaaagacacaaagccuuuauacguaggauaagcuuuaaucagcacuagaguugggcaggaaucuacccucugugcuauuguguuuacuucccugccaauaacccugagcuauggcuugucacauucugacuggggcacucuuacuccaacuggcuagcccucuuugcuguguuuucaugauucaucuccuccauggggcuuuucucuucccuucucccuccucuccugguccuaccuccgaccccaacccuaggaacugaaaccuugcuaccucucuucugcccagcuguaggcaucuuuauucaaccaacaguuuuaaauuaaggagcaaggcuacauaguaucauaugguguaaauuaagauuuccucaucccugaggcaucuccuggcuguccuggaacucauucuguagcgcagacuggccuugaacucagagauccaccuaccucugccuuuugauuuaaaggcauaugccaacaccauccagcauauuuuuuguuuugaaugaaugaguuuauuaaguacauagcaaauguaaguaaaagaauaauagaaagaaaaaaaacaucaaaucagauggucaaaacagacagcagcccaagacccagaauuggaguuccuagagguuauccuggauguccccucaggcacggcuuccaaguaccagcacaaauaacagcagaaaagugauaccuaccaucaaaccaggggcuuucuaauguccagcagaaacccugcugagaaagucuguuaaggcggcuugcuguuguuuccaguggacaugcccaguugaagcagaguuucccuuugggugaagcuuccaagucauagaaugcauggcagugucgagagauaaaagcaucaaauggaugcuuauagccuccagccaaagacaaacagugggcaguuaucuagagauaucaagugagcuuuccugcaugguugagcuccauuuguucucuccccugagaggcugaacuuugagcuuuuuuucccuuuuauuuuauuauuuacuuacuuuaagauuuuauuuauuuauguguccuguguguguucguaugcacaccugugugcuagugccuguggaggccagaagagaacauuggaucuccuggagcuggaguuacaagcaguugugagccacuugccguggaugcugggaauccaacuuaaccagugagccaucuuuccagccccagggcaggcaccuguauuucaugggcuagacaauaauaauaucaggugggaauggcuuuaucuucuagcuguuuuccaggacaugauguuuuuauacuuggacaauucugcuuuauuccuaugugucacagcuaguggugucuagcacauucccaggcaaggggucucuguagacacuugacagaauaaacaugcuuggaacugagauggggggggggggcgaucccacuucuaguacuagcugcucagugagaucagauaacaugugacaguuuaccaauauaacugcauuaugagagugcagcuaaugaacaagaguggggucagugaucuggcgcagaggguaaaggcuccugcugcuaagugugccaacagaucugauggacugagucucaccccugguacccacauguguuggcugaagcacaugcauacaauaacaaaaggcaaauacauguagaaauguagacauaggggaggggaaggcuuaguuuuaaaccuuucagcuucauuuuuccuuaaaaaaaaaaaaaggccaggaucaagccauguugucuauaaaaugauuuguuuuauacauagacuuuagaauuuuuacuguacuuuuauauuauuguagcucaaaaaaguggcuuuuguuuuugauccaccccacccccccacccccugcgcauguuuucuguuggcugucaagcacuggaaacagaagggagauaaggguguuuagccauaagcugucucugucaagguucugauugcucaaggaaguuugaacuuaauguuuuuacagacauaauacaauaguucuguuauuuuaggcaaguuuguccaguggaagaccaucuacaucccccacaggcaguguuacacaacagucaaguaugucccagacaucuguaaguauacuaacacuucuccuggauuuaaacauuuuaauuguuguuuuccaaaaguaaacuuguuguucauaaagcugcuguucaguuaaugagugccuggaaaugggaguaauuaaacuuuuaaaaaucugagguuuuauaaaaggcuuauuuuuauuauguauuuguuugugcuaugcaggucuuauaaaucuuuuuuaaaaauuuaucuguauuuuaugugcauugguguuuugccugcacgugugucugugagaaugucagaucuuagaguuacagacaguugugagcugccaauguggaugcugagauuugagccccauuccucuggaaaaguagucagugacuuucaccacugagccaucucucuagcccguauaugcagcucuaaggaggccggagacaucagaucccucucgaauuaaaguugcaggugucuauaagcugugcacuguagguguugggaauuggcucuaguuuucugcaugagcaguccauccagccauugaguugucuuuccagcucuugagaaucugaauguuauuaaagccuuuuuguauuuuuauacaucuuuuccauugagucugcuuaaugucuugugauucucaauucuuuuuuaguuucagaauuucuugaaagcuugaaguacugaaaaguguuucaugucuuugaaugacuuaaaaacaacaaucaaucaaucucucucucucucucucuuccucccucccucccucccucucccccccccccccaauugaaaauagauucuuagccaggcaugguggcgcacgccuuuaauuccagcacucgggaggcagaggcaggcggauuucugaguucgaggcuagccuggucuacagaaugaguuccaggacagccagggcuacacagagaaacccugucuuaaaaaauuaaaaggugcuggagagauagcuuagcuguuaagagcacuggcugcucuuccagaggaccuagguucaauucccagcaaccacauggcagcuaacaagucuaacuccaguuccaggggaucugaugcccucacaccaaugcacauaaaauuaaauuaaguaaaaaauuaagagauagauagaaaggaaacagauucuucucuuacacauccugaccaguuucccuucccuacacuccucccagcucugccccagcuccagcuccccucucccccacauacacucccuccauuucccuucagaaaggagcaggccuucaagagacagcuaaacaagauaaaacaggauacaauaagacaaggaaaagguccucauacccaggcuggaaaaggcagcccaauaggagagaauaaaagaguccaagagcaggcaaaagaaucagaggcacaccugcucccacuguuaggagucccacaagaacaccagccuaccagucguaacauauaccaaggaccgagagcagacccaugccugacggcacuuacguaacagcuaauagccacuuaugagagaauauauagucgugguuuccuuucugggucuggguuaccucacucaggaugauuuuuuccucguuucauccauuugccugcaaguuucaugaugucauuuuuuuuaaaaaaaaaaguugagcaauacuccauuguguaaauguacccauuuucucuauccuuucuucagcugagggacaucuagguuguuuccaguuucugguuauuaugaauauaacugcaaugaacauggcugagcaaguauccucgugguaggauggagcugugucuugagguagaucaguucccaaauuuucugaggaaccaccauauugauuuccaaagugguuuuacaaguuuacacucuugcugguaggagugaggaguguuuaccuugcuccauauccuuacaagcaccagcuguuguuaugguauuguugaucuuagccauuuugacagauguaagaugaaaucucaaaguaguuuugauuugcauuucccugguggcuaaggauguuaaaaauuucuuuaaguguuucucagccauuugagauacuauagagaauucuauaccccauuuuagauucuaguuucuugaguucuuuauauauuuuagauagcaguccucuauuggauguggaguugguaaaaucuuuuccggcucuguggacugcuguuuuguccaguugacaguguccuuugccuuacaaaaggaagcuuuucaguuuucugaggccccaguuauuaauuguugcccguagugccugagcuauuggugcucuguuuaggaaguguuuccugagccgguguguucaagacuguuccacacuuucucuucuacuagagucagugugucuggguuuuaauuuuuauuguuguuguuguuuguuuguuuuuguuuuuucaagauuuauuuauuuuauauaugugaguacacuguugcuauuuucagacacaccagaagagggcaucgagucccauuacagauggucgugagccaccaugugguucauggcaauugaacucaggacuuguggaaguucaguuagugcucuuaaccacuaagccaucuuuccagcccaugugucugguuuuauuuuauguuauuuuuagagauuuauuauuuauuuauuuuuuauaugaguacauuguagcugucuucagacaccccagaagaggccaucagaucccauuacggauggcuguggcugggaauugaacucaggaccuuuggaagagcagucggagcucuuagccacugagccaucucuccagccccugucuggguuuaugaugaggucuuugaucgugguuuuucccuuuacaacucaucauagaccuuccccuacuuuccagccucuuaacuuuauuuucucucuuccuccucccaaaaacccaaaucaaucaaacaaacaaacaaacaaacagugcccccaacacaagagacgaaaaaaaucacaaaaacgaaaaucaagcaagcaaaagaccaauaauacaaaaaagaaaucaccaaaacaaagcaaauugaaacaaguccacagaaguacgauugaguuguucuguugguugggugcucuugagcaugggggucuuguguuggucagcuucuccugggcauggcgauccgaugccuccuuuuggcuucuguaagcacugaguucaccuguaaucccccuuccuacauacacacauacacacgugcacaugcacacacauaauuuaaaacuuuuuuaaaaagaauuuaaguuaugagcauacccaguaauaucacugcuccuaagauguauucugaaagcuugauugcaugcauguggguuuucauguuaaauucuguaaguggccaaugauguaacuuagggcaagcaagccaguagguugccugcacuccgagccuuucugauuuucuauguagacuucuagcuuuuucuucaucuagauacaccugcauuuagaugaaaaagagaggauucaguaaaugaugauauggucugaauugugucuccccaaaauugauauguugaaaaccuaacuagaaauagacuuuguagugaacugacuaaaguuaaaugagguccuaagagugaagcccuccuaugagaggaccgaugccuauuaaagaggaaacguucucggagaucccuccagcaugggaggauauaggaaaagguaguuaccagaagagaccccacacuggagacuuggguuggacucccuuacuacucucaacuuaaaaacaaaugucugucuuuaaaauuuguggugcugggaauugaugcaggcccccacacaggcuggaugcagcucuaccacugagcacgggccuguccuauguuucuguugcucaaguuguccgguugugguuuucuguuguggcaggcuaagacagaaaaggcuuugcaugugaaaguuggccaaacaaaucaguuuuugaauuauucaguaacauuguauuugaagagcggguuuguuaaauaguuuguauacuagugacuaaauguuaauuuaugauucucugaggguuucuuaacuaguuuacauguauaauacaaguaugugugacuuauguugcaggaugaguggcaguaagaaugaacaucagcuagaauaugaaacauaauuuuaauaaagggugggcuuuuguuuuuuuguuuuuuucuuugagacaggauuucuuuguguagcccuggcugucauagaucuaggucugcagaccaugcuggccugccucagucucccaagugcuggaauuaaaggcuugccccacagcggccuacaauauacuuacaagcaagcaaacaaacaccccaaagauauguugcuagaucaucuguaaacagaauccuuuuaggauacagccaaauugcccaaaguugggcaauagaauagggauugaaccugagcuaauagugaaguuuugggauggugguuaugggaagggagacaguuuuuuauuguuaagaaucaugcugguugcccugagggugcacucggguuacagagcccuccuuccuucaugggcaguguauuccuuugcagaauugcacccagacauagcaaagaucuuuuuuuuuuuuuuuuuuuuugguuuuucgagacaggguuucucuguguagcccugguuguccuggaacucacucuguagaccagguugaccucaaacucagaaauccgccuuccgccugccucugccuccugagugcugggauuaaaggcgugcgccacuacugccuggcagcaaauaucuuaauagaauauaaucaaauaguaauugacuuucuccauaacugguaugguagugaacaggaaagaauuugaggagacuguaauggauacauuaguuuuauaugggauguuaauuuuuagaacagagcucauucuggaacagcuccguuucaggcaugcauuauuguguuggauucugcguuagucuuucacucucaugaggaaaaugaguuccaguaccuuuguguguacacugugcgcauccugaagacugacaucuacggaggguaucugcugugcucauucugagacaggguuacuaacugaaccuagagcccuuugccugcuugggaguggccauccagcaagcccauggacccucacgccugcugucccagguuuaagguuguggaugugggccauugugccccgccuuuauguuggcccugggccaaacucagcuccuccuccugugcgaugagcacuuuacugacagaaccgucucuccagcccauguuucagaacgucuuaaugcuguugugcugucaguauuugguacccaguauuggguaaguaagccaucagaaaggaugccaccaaacagagcagccgccauaauguccuaugacuguguacuugucuguauccucagggugcuguaaaaaucuguuuccuuucaaguuuuggugcaaguugauuagccuuuuucaggaucuucacucaaaaacagggaccucagugccagccuuacagccuggccagccagauguggcccuucuguggggccucgguggcagcuguggcuuacugccuggguuugcacuuuguacugauaccugggcaguucccucccaccccgugguuucguuaacgccacucucaucuucacauugaggaggcagugcagagugucuuucuuucugacucagaagcucacuuucugacucaggagucuaaugauucuuuuuuuuuuuuuuuugucuaaugauucuuaauuuuauuuucugcuuuguuccacaaaaaggauuuaaggugagguuggguuauauucucuguuugaaauuaucaagaaugaaugauagaugaccaugguuaugaauuggaaugaugaaaaaggguguauguaucucucuucucugcuucuuggccuccccguuccauuuccccuuuacagauccaagcagguuaccaguuucuaauguguuuuccauggauuuaccaggcuacacacuagucuuuacucuuuugagcuaggaucuuauuacauaauaauauguaauaaacuuaggcuauccagcaacuugaaguguagccuagcucagacucaccaucaaauaacaauccuccugccucagucuuucuuaugcuuggaguacaggcuuguaccacccucucagccauaugcuauuuuuuuccuauuuuuuuuagaccagaucucauguacccuaggcugaccuagauccuguuccacagcgcagagcuggcauuuagcccagggcccucgucucucuaccuuucaguacuggguuaugagucaccacagcuuucuaauuaguucuuaagcagugacuuuaaacuuuaaaguauuuaugcauuaauuuugucgccaauauuuuuccaucuguuugacagguaacaauuauacuuucuuauguuuugugaaugcacugcacuaauuuuguguuaaccuguaugcuuuuuauauaggaauggauuauuuguuuuuuaauuuuuacucacuucagaagcuccuuaaaaugugagugugagggcuggugagauggcucaguggguaagagcacccgacugcucuuccgaaggucuggaguucaaaucccagcaaccacaugguggcucacaaccauccguagcaagaucugacucccucuucuggagucuggagacagcuacaguguacuuacauauaauaaauaaauaaaucuaaaaaaauuaaaaaaaaaugugagugugagaaaauaguguacuaaaguuagaauuuugaaguuauuuacucuguagcauacuaaaauaauugaacauuagcccagauuucagggagguaguaguaaugacauuuuaagaugcuagaagucuuacuggaaugugauauguuaaaaaguugucccaguuacuaagcagccuguguuggguuuugcuuguauggaaauaguugcccacaguagaggguucugcaaagaucagagccgcucuuugaggcuucugcuuggugagguugaggagcacagaugcaaagcuggaagcaucugaccuguuacguuauugucuuuagauccuguccgcuucuccugcaccugcucagcugaugaaccgcucccagacguccaguucuaccagcggcaguauuacccagcagacuaugcuacucgggaguaccucucccacccuaacugccagccaagcccagauguaucuccgagcucagaugguaagauacaaaauaccagcuuuccagugucuaacugcuggagaguugaagugugucuaagcuggauaaagcgaggcauuuuuaauacuggaacaggaguuaacaagugugugcauaugcuuagccuuuguacauuuauaaauguguauaaaauuccaccuugaaguaggaagccuucuugguaaaauuauuuuuuaauacuuaguaauugauuuuaaaaacguucuugccaucucaacaauugaagagcuuuuaauaauuuuauaguuuuaauacuuacaguaauauauaaaauaauuuuauucugcugacauuaaaaauuugaggaaauaguuggaaauacuaaaaccuuaguuuuuaacuauaaggauuuguccuuggacuuucuuguaucuggauuggaguuugacacuucagauaauucauagcuuugguuauaauugucucaaauuuuauaauguuguguucuuauguguaauucaaguuuuuuauuaauauagaaauauugauugauuauucuauaaauagguuccuacugauuuccugaauuaauuguugaacuuguuuuaaggaauguagacaaaguuagacaaauguuuuaguauauauauguguuuuuaaauaagucauauauauguauuaguuaauuuugcaguaaguuagagguugaauccaggccuucaugcauacugggcaaggguccugucgacauucaccaucuucaaccuccuuaauaugcagguuucugaccaaugagcugaguacacaucugaccccaggucuucauuuagaguuggcugggcaguucccaguggugauuuggugggcagugaugaugggcacagcucuuauucuguucaugaauuguggggcacacaucaccuuucuugugguuacuuuucucccuugaaaucgucuuuaaugauaugguuuaaaauuugguugaaccauuugauuuuugugugugugugugugugaugauuuggaccuuuaaaaugggcaguucauaugacucagucuaauggaauauauuccuuuuggaggagagugauuugagacugcaugcaccaaaaagaagaaaauuugugggugaauuuacguagacugaguaagugaguaaagaaugaaaguguaaaaggucuagaggaaggaggggcucaggggcggggaggggcgguuaggggacagggacagugaauaugaucauuauguaugugcacauacacacugaaacccaguacuguccauuuaauaccuacuacuaagaauucaaaaugaggaaauaccccuaguugguuuaguuuauguagcaguaaggugguaguuccuggaaugauuuagaauaguguaucuaagcacugaagccuacuguuacugacuaaauucgguucgguugaguagauuguauugucuuagaaauuaaugauacuuguauaauaauaaaggccugaaacaaggcgaggauguacagauuauguuuuucuuuuuuugucauuuugugugaagacauuuuguugcucuguuuuaacauucugacauuuacguuuagaauaaacagccuuuuacagacaguuuuaaaaucaggagcaaccguacuuuguucuauagcuagguuccuuguaguggagaaacuguaguaugguauguggcauuguuaucuauguggaccaaagagacuuauugcuguuucuuuuccucuuucuuaccagaaauuaaucuauauccuaauaaauuuuuauuuucacuuuccaucuuaggaauccugagauaguagcuuuuauuugaaacaaauuugguuugaggauuucauaucaccaaaauccauuuuugucuuugaguagauuuuuuuuuuccuacucucagaauugugagguauuuuaaagcuguugauggcuucuuugagcucugugauuacaaccuucucuuugucaugugaagccuuuugcuuaggaggugguccuaacuggcauugucucucugucacaggguucagugucuugccugcuugcugcacauugugugugggacguguucuuuagucucaggcuguuacuuuugguuuucugucuguacagcugauuuucacaccugcuaccacuguggcugcuguacagucugacaucccuguugucucgucgucaccgucaccuuccugucagucugcagcugcucaggugagacugucuggcuucacaguaugccccugagggcugugucucuucggagagacuggcacugcgcucucggcucagccuccacugcagagugcauggccaugccuuucaggggaaauucaugcacgacugagaaauuggagaacaugguuguuuguagaauugacaauagaauugaacagagauuuagcuuacuagguguucacuaagguuaaugaggguuuuguuaaugacauuguauuuuuaguuuuauuauauacuagauuccuuuuuuaugggaauuauauuauuuuuuguagacuucuuugcaagcaguuauauaauauauaagcugaaguggaugguaguuacuuaaguagaauauuacuuuacuugacacuauggaaaacaaugaaugcuaacuucuaucuuauucacaaaaauuaaauaaaaguagaauauaagccuaaagauagaaguaaaaacuuaacucuccaggagaaaacaggacagcaucucugcaagucuagucaaggcuuucuugggguguacaaagagcauuaacuacaaaacaacaauagugauaaauuagacuuuauuaaaacuauaaauuauucuuuaaagaaucauuacgaaaaugaguacacagacuacaggcugaaaaaaaacuauucacaauaaauguaucugaccagggugcuggagagguggcucagugguuaagagcauugacugcucuuccagagguucugaguucaauuuccagcacccacaugguggcucacaaucaccuguaauggaaucagaugcccucuucuggugugucugaagacagcuacaguguacucguauacauaaaauaaauaaaucuuuaaaaaaaauguaucugaccagagauuguaccuagaauauguuaaaagaaaugccuauagcuuaauaauugauuaugagguuaguuuggacaaaaaauuugaggagauagucuaaaacaagacaauauauaggccaggcauggcauaugguuuuaauuccagcacuuaggaggcaaauagaucucuuugaguuugaggccaaccuggucuauauagugaauuucuuaacaaucagaaccaaaaaguaagacucugucucaucaucaucaacaacaacuucaaacaaaaaaugagcacaugaaaaacauguucaacaucguagaucauuauagauacacagcagaaccauaaugaguguuauuaguacucaccuggguggcuggaaugacuggugagcuacaguagauuaugacagcuaaauagucucuaagugccaaauguguaagcagaugguguuguauucauacaguggggccauauucacaggugggggagcaagucacagauaaacccauaacagcaugguuaucaugaagccagacacaagacgugcaccugggauucugcauuuauaaaauuccagaauagggaaaauucccauagugaaaacauuagauaacuggucccugaggccgagaggaaagguugagcgggauguuuuguguguuggugggaauggugguuauaugguauauaucugcugucaaaacucauggaacgguuacauccauuauaagugauaccucaguaaacuucacauaaaauuauuuacguucaguaaacuuucagcuaaacaguugagcagauauuacuuugugugaugcuauuuuuagacuucauggcagacucucauauuguaucauuuuuggccuuuuauuuaauuacauauuuauaauaucuuuuguucguuugggguguguuuucgguuuuuucuuuugacaggguuuugcuguguagccuuggcuggccugguacuuggugugggcugcaggccuugaacucaaggcaguguucuugucucagugucugucccagugcugggaucucaggcaugagucgcugucccugcugcgcugugucucauuucauguuucacuuucuggcaaaauguaagaaaugagguaguaacagcauucuuugccuuuuuuuuuuuuuuugagagccucuuuguguauuaacauauguaauaauaaagacuaauuuucauguauuaguuguaaagagugugguuagauauaccagaguuuuccuaacucacgccuguuagguagcggucagugggugcuaagcuccaacuucuuuacuuacacuggaagugacaccucgguuguuaaauggccaacuaggcagucagaaacuacuuagccuuacagugccugccacauaacgagguaucauagcuacugauuaguguuuucauuugaccuugugugcagacaaaccacacauuugguucuuaguuuucaagaagcuagaaaugaagagaggaacauaacuauuuaaaugauuucuaguuuacgcacuaaaccaguaucuuagagauugugacuguuuaacgugcucuggagcagagcuugcuuaccuguauuucaugaugaaaacguucuuacgaaucuuugauccagcucguauagcuuaugagaguggccucugcugcacuuggaugugagcugucuguguggcugugugagggccugauauagcuaagaacuggaggaugguguuugggcauuuucugugaccucuacgcuugugaaggggcagugagugaagcuggcagugguuggugccaccgacccagcgaagguucagggcugcugcuuuugaaccuuuuccgcuacuuaaaaagauuuguaguuuaauaauuuaauuuaaacuacaguagucaguagauauuaguuaauuuuuccucagugaaauacacacacacacacauacacacaugcacacuauguauguauguauguauguauacacacacauauggucuagucucauuguguacuucuagcugacuuagaaaaguacauagaucagguggcuucagauucccagagcuccacuugcguuugcucuggagugcugggguuaaaggcgugcaccaugaugacuggcacuaaggcaucuguguagaagaguaaaaaaucguccuuaugaaggggcucuguggggaaugcugaugugaggagaagugaucucuuugcacuaaacagcugggagcuaaagaucuacugugaccagcacgacacugacuccccaucucuugggcagagaacauaggacacugugacagugauucaaguuaaaggauuuugagauuauuuuggcagugauauauucauuauguaccauaaaacauuagagugaaguuaggaaaaauauguuaugcacaaugugagaagauuuucauaauaucauaggcuugguucaggggaaaugaaaauuaaagccaggcucuuagcaagaauauuuuuuuuccucaaaagugaugaugucaagggcaucucaauacgaaucuuuccaacaguaaaucaauacuaccuuuggugcucuaguuucuguauuguaauuuauuuaaucaaguugguacaugagugaugauggcagcuguuaguuacaaucuaaaagcucacauugaccauaucuuacuuaacuguggagacaggguauugccuuccagaauugcaggaaacagcaagagaguuagagaaaugacauguguguguguguguguguguguguguguguguguguguguguguguguauagguguagguguaggugucaagucucugcugaucacacacuucauucugacucacucauucaagauuuccagguuauucuugguugucacuauuauaugguccacugcauagaucauucauggaaaagcugauauucuuuauuauauugcccuccucaggagaguuuauuguucugcuuauuuguuuauuuacguacuuuuggagucaaggucuugcugugugaccaagauugugcuggaauuaaugaugcaucuuaggcuggccuugaacuuuuuugugauccuucugcuucugccuccugcaugcuaggauuauagucuugggccauuaucccugauagcuguuuuuuccuuuuguaauauuggacauacugggcaaagguucucucaccuagcuacaucucuguucucccagagacauuuuaauguaccuccacccagacacugauggaguuuguuaguaaauaugaacaaauuuuagugcuagcauaagagccuuacauggaacagaauaaccuuucaaauagcuuuaugauguauauuucaaagucaaauguaagagaauaucccagacuuaggaagugucuguguuugugguucugagugaccguuagggaaaugucagugcugaggaugagagccuguuagcucaucucaccagucccagaugugcaugcugguaaugcacacaccagcuagacauuaugggaacguucugggcugggggagggaaauuucucacagaggaguucaggaagcucuucugagagaggggagggcauuauuggaucaggacuaagggcuugagaaagaaugacgcuuaggugagcagggccagaacaaaugaaggauguacgugguguauacaugagggccuggugagagcaguucagcaggaacguaagaacuguagaccagagaggagaaaguggggucaguguggucugggccgauaucacgagcuuuuggauggcaaccuaaggaguacaguacaguuuacuugugugaaacuuuaauacuaaugguuauuaauauaugccggcacacaaugggaaguauguugggaaaaucugagaagcuccauaugaucucauuuagaaaguuuuucugaugguaguguuagucauuuuuuguugccaugacuacuaaccuaggagaaacaauauaaaaggagggacauuuguuuuguccugugguuccaguucauagugggcccuugcuguucuuuuucugggucauagaggcagagcaucauggcaggggguaugugggccaaagacugucuugguagggaguguaugacagaccaacuugcuuacuuuuuggcagacaggcagagaagguggcaggaagggaccaaggccccagaucugcucuccuacagaucugccuccaguagucuauucaaaccuuaaguccuuuugcugaguaagcagugaugaaggcaggguccuccucuaucaguucccacggcagcugccuccgagcagaugaguguggcaucaagacuuuaauccaucugccucuuugugggcuugacugggaagggacuucauuuccacaaauuaacgguagcuacagaauuguugacgauuaccuggcaugagcauuuauuuguccucuguugacgcuguuuggcauuuggacagggaguguagccuugaguaccagcugagguggauauggagucaggacccugagagugcagaacauaggacuuggcagcaucuuuagucuugacauguuggaaccuccugugacccucugaggaccacugcuagcacuaacugcguuuggugcgugugucacuuaggcgagaggccacgcagccuuuggagaggcauuuucugcuuugcuguugagaaagguauaagcucaaguaggaugaaaugggauaaucccaucuguuuacaaugguuagaguggccccaggauaggcaggauaccacacagacccauuucacagccguggaucaugugucagcucaaaaaagccaguucucaaaggcaaagaauggucagcaacauuauuuaaauuucaguuuucugaaaaugcuucucauaaguaucacgauggaguaguggauuggaugaaucaggugucuugcagcacuaccccaacacggcuaguuuacaguucauugcugucagcccuucccccucagucuuugguuuucauuuagcuccucuuguucuuccuauccucuugcucuucauucacacuggccuguaccugccuuuacggccuuuaaaaccugccacguaacauuuaagauaugcucacuuagaugggaucagugaguugucucaggagcuuggcccuccuuguguaggcauaauguuaauugcuguuaucaucuuaacaucgcccuucccauaucugcuaaagccaucuguuuuuaucuuuacuuuuuguuaugugguucuuagguucagaauuuaaccuuacgcagccagaagcugggugucuuaucuagcucacagaauggcucaccaaaaagcgcuggucaaacccaguccuugacaauuugccauaauaaaacaacagugaccaguucuaaaaucagccaacgagacccuucuccagagagcaagaagggaggaagcccaggucuggaaucucggagcacggccgucacucggacaucaagcauccaccaguuaauagcaccagguggguacacagucauggcaagcaguugucucauacaaaggugucugcuacuugaguaagaguagcaguguucaaacauuuuaaaaugaggauuuugauaaguuaaagaagaucucacuaaguagcuugaaaacaacaggaagaaagccuaguagcuaaaacagauuauaacagcagaaaagauggucuucuguugcuguuacucgauacuugacuagaucuuuauuaugugcuggucucccuuuauaucaguaaaaccuuuuaguacuuaaaaaaguaugucuuagcuuuagugaaacgguuuuuaagcucuuagaagaaauuaaguguauuuuguguaagucauuaggaggaauaauuuguuacuuuuucaaaacaaaagauugugcaaauaaggacaugauuuuuccaaccccuccuccaucagcaccagugugggacuucaucugggagcagguuauccgggaauugcaucuuuccuuucuuaucaagcugucauggucucuucugcagguaacccugcuccugguucuuaaagugaaaaccuugcuugggcuuuccagagggagccuccugucucuuguucuguacuauugaaaucuacuuccccauccugacagacgucucuguguguuugcuacuggggacugaaucuagagccuugcccaugugcuacacaagcguucuaacauggaguuacacaucccuguaacuuggcaucgucugauuucucugaguugaaauguguccugacucugaccuuucauaacagcccuuguuuauauacuuccuggccucaaacauccuuccuagacuccguagugaccugagcaucucugccugugagagcguggaucuuuagcgcucuacuugacuaugucuugucuucuuucagauucaccuuuucaucuugauagcacuaaguugugcuuuacauucauuugccuguaaaggguagacagcuauguauucgaugaguccaucccucaguuuuccacacuuagacuuuggaaauuaucacaccauguuucucuuuagcauuauuuagcuaucacagugcuuagauuguuaugaaugaaucuuacauaugcacuauaaacuuugcuaacaaauccuuucaugcuguaguuagaaaugguuuguuucuuucuuucuuucuuucuuucuuucuuucuuucuuucuuucuuucuuucuuucuuucuuuuuuuuuaauaucuauguccuggucuguguugucucuagggccagaacuggguuuuugcagagcauugucuggagucuucucagccucaaaguaccauccugccaggauugugagagccaguggggaacagcgcuggccccuaagccugaagugacugggugcuucaggggagaguuucuagggagaccugccaucuuauuuuuccuuagcuagaaccaugccaacagucauuuuaaaaagagaaaaggaccaaacccucuauuuguagucuaauguaguugccaauaguuacuacaguggacaugguuacuguuuucuuguauguauuuuuaggguguaaaaauaacuugauuuucuuuacuauuuguccucaagaguggaugccuucacuuguugguaauucuuucuauuuauuuauuuauuuauuuauuuauuuauuuauuuauuuauuuaaaauaacuugauuuucuuuacuauuuguccuuaagaguagaagccuucacuuguugguaauucuauuuauuuauuuauuuauuuauuuauuuauuuauuuauagcucaagcugguguugaacucaugauagcucuccugucucagccucugauauuagcccaacugauaauucugauaguuuugucguuaauauauaaagguaaaaguucacuuuuaagcaguuuuuagaaggcuucuuucuuuuuccuuuuuucuuaucuagacaguauuucagcguauagugaaaaaguccucuacugcuuugucagguaccuggacgucccaggucaaagccugaccaugcccagcucuaacaaggaugucuuuuccccuugucccuugucuuuguccucacaagaacuucccugugagugcacagggguaggugagggaagcucacugguacuucuuuaggaacauugugugugugugugugguugcuuauuuugugugucggcagcaugaacauuucacagugcgugucagguuagaggacggcuuguaggaaucgguucuuuccuuccacuguguggauuccagggauugaacgcaggucaccaggguugucagcaagugccuuuuccuguugagucagcccuggguuucuuuuuauugguauagaacucucugccuugucagggccuucuucccaggauuccaugugaccuuaauuuucuagccucaccaucucuaaauauagccacuuuggggguuugguuucaacaugugaauuuggggaaaggggaacaaacaguuuauaauagagcccucgacucaggauuugauuuuaguuaaucugucauauauugcauuaguuuaguaccauguagacuucaugggguuguaguaauuauugaauaaaaugauauauuauuauaaauaguaagagaaauugugucagucauuaaucuuucaaauauuaggccacucugacaacaauaaagucuucauuagaguugaagaaagucaccaguaaggcacagcuuccuagacauggucagcuuucuugcucacaguccuguccuccauucuaggaucauccuugcgcucggacuucugauccgagaagauuuuaccuuaggugaagaauagacuuuccuuuacuaaaauaucaguuugcguuaguguuuccuacggcuuaccuaccagaucacacagagcuuauccuaguggaugcgucagcuguguucaggaacaugauccacgugggcugcagagacacuuagcaguuaagaaugacuguuguucuugugaggacgagagagcuguuccuuggcuccauggaggaugguucacagccaccuguagcuccagaucgagggaaucuugaugcugccuucaggccuucucagggacucacacucgugcacacaccacacauagacacauaacuaaaaaucaaguguguggaaaagaugaugaaauuaaauuauaacuugguuuuuuuuuuaaauggaggcaaaugaucuguuuccuuauccgggagaaggacuaacagcacucacucaccagcuguuguccgagcacugaugagagacuuaaaagcacuuacaguacggccggacuuuacucacgguucucuuuugaauacuguauaacauagcuaucaccacauuuguauagagcuggcagucuuaauuugaauuacuagcuuaugugaaaaaaauuuuuuuuaaaauauagccuuuguauuuuauuuuauuuuuuugguuuuucgagacagggucucucuguauauauagcccuggcuguccuggaacucacucuguacaccaggcuggccuagaacucagaaauccuucugccucugccucccgaauaaagaugugcgccaccacugcccugcgaaaauauuuuuagauuaagcaucuguucuaauacugagcugaaaccacagucuuccauuuuugaaacaauuaguagauaucgauugaaaauucuaaauacucuuugagauauuaauuagauguuaauuucuuuaaaggacugcuauaguuuuuaaacaaaucauuucauaugauuuuugccucuguguauuugugcaccucauguguuccugguaacacaggaggcugaaagagggcauuggacccccugggucuggagucacagauaguuaugggcagcuguguggauguugggaaccaaauucagguccucccucuggaagagcaaccagugcucuuagcugcugagaagucuuuucagccugaucccuaaauuuuaaauuuuaaucaaauacaaaaauguuuaagaaaaaaaguuauucaaaguuuauauaaugcuuuugucauaaaugugguuaaauauaaaaugauguaagauguuacauaacuuuuauauuuacauugcaagauggaaaauucugucuuuagacuugauauagaugacuauuucguuugaggugggggccagggguaaguagacuuugacauggggucuccuuauagccuuggguggccugggacucacuauguagaucaagcuggucucuaaguuagagauccgagugccuuugccuucugagugcuaggauuaaaggugugccugucaugcccagcuuagauguguuugcuuuugugcagucugaagcagucauuuccguugaccuuccaguaccuucaguuuuuaguucuccauagggaggguuucaucagcuucugcccuguaaagaggcaucacgauggcaaccacgcacagccuagggugaccccugucuaaguguguccuuguuaagcaucucuguggaggagaaucugauagcagccacugcuucuccuucauucccgggcuuccacugaguggaaagggggaagcaccauccuuacuuauguagcaugaucucauuucuucauucucugcgagaaauagacugcucacuuagauuuggacuggcuugagcacuacaggauucagcccugggucuugcagaauuggaguuuuaugugaaacaauuuucuuucugaucaaacaauuaagacuuuaucugagcuaaaacacuuacuugggaagcuuucuagguaacugauuuugcuguuauuuugagacguguuuuguccuagauaggaugagcucuuugaucucgaagucacccuuguguguacuguacuuguugaaugauggugcuucuucagagaagagacacacuccagugcauagacccagugcuaaaaguuaaugcagccguuccgaugaagggaggaguagaacaaaugaaggccucuguaugcgaugguacauaugugauuguguauaugcaguuguacaaugcaguuguacauaugcaauuguaauaggcgauuguauguaugcgauuguacauaugugguuagguuguuuucccuucagcauuucacaauauagucacuugauccaguacuuuuagcuuuguaaggaaaauaugugguuacagaauuucaaaauaauuauaacuaaaagacuuguaauagacugcuagugacucugacucugacaugaaagcucuccuccuuuagguuuauguaaaacuacucuguuuugaaaucaguacuaauugucauuuuuuucucucacagcuucauauucuccaauucagccucauucucuaaucaaacaucagcagauuccucuucauucaccaccuccuaaaguuucccaucaucagcugcuauuacaacagcaacaacagcaaauucagccaaucacccuucagaguccaagucaagauccacccccaucccagcacuguaucccacucccaaaccauggccuuucuccggcucccaguaaugcccagccgcagcauugcuccccaguucagagccauccuccgccuuuaacugugucucccaaccaggcacaguccgcacagcagucuguaguggugucuccuccccccccucauuccccaagucagucuccuacuauaauuauccauccacaagcacuuauccagccacacccucuugugucuucagcucuucaaacagggccaaauuugcagcaggcugcugcugaucagguacaguccaccgcacagcugaaucuuccaucccaucuuccacuuccagcauccccuguuguacacauuggcccuguccagcagucugccuugguguccccuggucagcagaugguguccccaacaucacaccagcaguauucagcccuacaguccucuccaauucccaucgcgaccccuccacagaugucggcaucuccuccagcucagcucccaccacugcccuugcagucuaugcagucuuuacaagugcagccugaaauucuaucccagggccagguuuuggugcagaaugcuuuggugucagaagaggagcuaccugcugcagaagcuuugguccaguugccauuucagacucuuccuccuccacagacuguugcgguaaaucuacaaguacagccgccagcaccuguugauccaccagugguaagcccuuggcagcucuuugacuuucuugcugaacugaacguaaaucuguuucucccacgcuaugguguacugcuaagucucaaugacuauggccuuuuuaaguuugcauuuuuccugugucagauucugacaauguauuguaugagcaaaggaaaaacugucguuuguuuugguaugguugcaugcuuuaaguuuguaugguuaugaaagucccucguuaauuuauuacuauuuaaacaaauccaucugcuaucuuuacagaguugauuuuuuuuccccaagggaaugcauuugaaccagugucaucugcacaaaguuuuuucucuuaaggugauuauccuucauagcucccuucuguuggcuuguauguucuuaaacgcaugguuuaucuagcuaaccuuuuagucgugugcauucagaaguccugggccuugagcagcucuucuuugauggaagagguaugauuguauguguaacuuuucugaugaaauuauguucuguaauuaaaacuguuaaagaaauuuauucuaugguagaguucaacuuuauaaaaaacugacuguuuaaaauuucuauuauacuacgagaaaaauauauacuuaaauuaguucucaguuaaaaggguaaaaguuugaguuucugacuuugagaaugaaagagcuguaacacauggaguaaaaguuuugaguaauuggguuucaguggaguguuaucagaaugaaccucuagaaagggucacggugcugaaaaaguaucuugaaaauauuuuucuuuuucaaaauuuucucuaaaagaauuauuaaaauuuauaagaagauuuauacaaaaauugaaauaagguauuuaugaguuuaaucaaaaaugaccaaauucaguuucucgcugagaaaaagaauuuuucuaaaaggaaguuuugugucgaacuuugaaaaucacucaaagucagacacgguuugauucucuugucaucccaguucuugggcagcuggagcagaggaucaugcgugugggccauccuggacuguccagugaguuuaaaagcagcccugcuuacagaguuccugcagaguagacauaaguaacgcugauugcaggaaggaaagggguugcagugucuucauuaguagagacauuugacucuuaguccccaguuuauccuucuaagugaucugaauaggaguagaggugcugcucagcccucccuguuacuacccuggaacgccagagcccaagagaaagaaacacuagauaaauuuaccauuuaauuaugccucugccuuuuccuuuaauagguuuuuagggcacauaacaacagguuuugucuuaaggauguagcucagugguggacugcuuguucagcaugugucaggcccugguccaaucccuaguacugccaaaagaaaaccaugaagaacaaagguuuagggaaaauacaguacuuucaaaggaaucaaauauaauuuaauuuucucaacauuuaauucaguguuugguuuuuaaugaguaaacaauaaaauuucuauaaaccauauuauuuaaaauuauuuuuuauaagaggacuuugggucaacauauuuaggguagaagugccaaaaauaaaaaaaaaacacuuagugagaaauauuauugggucucuuuugcugacuuugcuuucuauuuugaaaacacaaagccacugucauuucuggaaguuuccucuguugcugucugccugcuaguuuccuuuccauucuuuucauaucagcuguugacuaaguggcuguuuuguucuuguuguuguuacuaaaaggguuuuuuuuuuuuuuuuuaaaucaaaaccacccuugauuauuucaagugcuuaaauacagauauauuucuuuccaauaagauauaaacauuugaaugaaaaaggugaauuaucaaacuaaaucaguauguuuucagaaaagauauuucuaaaaaagaaauagguuuguuuuuuuuuaaguugagauuuagguguaagucagacauguugaggguagaugauuuagaacuaaugaacaaauuuccucaguuuauuuaggaaagggagacagauuggaauauggacuuuacugagguaaguuugguggucugcguuauauuuagaauaguuauaguuacgagcuaaauagaacuugugcaaguuucguaaugaucuugugagcaaaaccuccagcuaacugccuuucccaguaguuuagcugucguguugugaugguuuuugugcugacuguaccagaugugugugacauuucuuuugccuccguuauuuaccuguuaacuuguuuuccuuuuuuugggagauuauggagagaucucuguauuuaaccucaucuugagagaucucuguauuuaaccucaucuugagaaugaaaacuauuuuauaguguuccuugauggaaauuugaaaagcagugcuauucauguuauagccuuuuauuuuuuaaaaaauacuuuucaaaaaucauaauucuguucauggucaagcaagcccugauuccuuaagcgauauuguaaguagcugguuagcaguacauggcagugucaagggugaagagagcgguggcagcuuaguagucaugcucuuuguagggaauguaauggguuagauggcacuguuaauaaagccaguugucugggucccacucgugugagcugacacugugccuuccuggaagcaggaaggucugcuuugugguugcugauuguugucucuguuagcccuggcuguuuagggcagugacuuagucugugcugaccuuuacccucacauuaaacauggcugucaccaugagcagacacuagugaccauucacugugugcuauacagugccggugaccacuuccacuggugagguuacgcuuuuggugaaacuguuuucuaguuucuggguugugaaaagguaucuugcuaauuuuuuuuuuucuugccuauuuagaacuugauaauaguucaagauaucauguuaaguauaaaaugagucuagugggauuuuagaaggaauuuuuuuuuuugagggaggucauauguuuguuuuuucuugcugcuguuccuauucgguauugcugugugcccagguuggccuugagcucaguguucugucucaggcuucuaagugcuggaguuacaaggcugugccaccauuccuggacagauguuuacuuuauucuaaauagauguuuagaguuggcguuuguuuuuuuuuaaacuaguaucacuuguugccguguauaucuucauaaauaaaacuucauaguacuuuacaugguuuaugccagguucagaaaucaugauuauuuucauauuuaauucuagacaccuaaaauuaucaaacuuuuucaacaauuugacuaaaaauguaacacuggaugccacuuaaaguuauuuuaugaauguucagguuuuuuuuauuaagauuuauuacaguuuuaauuaguuaaaucuauuuuuaaaaaagucucaaccuuuguaaauuugagagaaagcuuuggcacagggaaggaaaugagcuguuugacagcguuguguuaguagagcaucaucuuucauaaauaccaagcaggcaaaguacuuucaucuguuauuuuccagaggcacuuugaaacuuaauccuuacauuuaauaaaguguuagguggguaauuuuguucuaauuucauggucucauggcucccucucugugauuuugaugucauaguacuucaggaaaucuucacacuuggauaaaaggggcuaaaccuucccauggggacccaaaauagaucguauguaucuuagggugugucuacugugguaaagaaagauguuuucugcauauaucauacuagcuucuaaaaguucauuugauucuugaauacaacggaaagggaaugaaaaaaucauugcuggcuuuacugugguuuaauaguaauuuucauaacagucuuuaauaaugaguaaucuugcauauaauuuccuuggcaauauauuggccugacauauauuauuuuggaaauuuacuuugaguguaaaaagcgcuggcaccuauuuugauucauaacagauagaaaugaacagaaucaaugguguuuuuaaaauaguuauuugauuauguaaagcaaaauacccuuuuuuugaauuuuuuucuaaaaaaucuguucagaugugaccagugucacuuuggaaagcuucuguagcuggcucacagcuugcucuccgugacacacuacggggucucaaaacauucuugugagugcuuccaaaguucuccuuucagguugucagcauugugguuugcuuugcuucuaaauuuagugcauuuagaauuaaaaauuucaaaauucagaauaccucauuaaaugcauuuuuggaaauauuucaagguaguauggcuugucauugcagguuuaucaaguagaagaugugugugaggaagaaaugccagaggaguccgaugagugugcaaggauggacagaacccccccaccccccaccuugucuccagcagcugucacuguggggaggggagaggacuugacauccgaacauccuuuguuaggugaggaaauacaaaguacagaggauucuauuugauagaugucaguaauaaaauuuuuuuccauuagagauagcauuaaacuaaccauuacuguuguuaacuauagcaaaagauagauuauauuuaaaaauuuaaaauguaugaagaauauugucuuauuaaaaaauaaaaauucuuguuuucuuggaaaauucuuuaacagcaguguaaaguuauugguuuauaaaaccuuuacuaccacccaaagaaaacgugauguuucaagcauuauaauuauuauuggcuaauacagauguguuucaugugccaacucacauuccuguuuuagcuauuucuuauuuaaaaauuagaauaagagacuggggagauggcccaguguguaaagcacuuguugcucaaguaugaggaccugaguucaaauccccagaguccacauaaagcuaggcacagcagcacauaccuauaaucccaguguucccauaguuagaggagacaggagaauauccagaaacucgagggagggccagguagccucauguguauaucagcaaauaacaaaaacacucugucuaaaaauaaguagaaucagagauccacauccaggguuguccucugaccuucacacaugcuuucauguaugugcuuguauacacacacacacacacacacacacacacacacacacacacacacacacacacacaguauaaaucagacuagcaggagauuauguuaggggcugaguacuugcugagcaugcacagagccuugguuucagucccuagcaccauauagaaagccccaggcaugauggcagugccucuaaucucagcauuaagugaggugcaacaugaaagcacuggccaugacaccaguggucggcaagugacuuuuguacgcaugccuucuuucuuccgaguucugcucucacuaaaagccuacauauuagcuguuccaccucucugcguuagcgcuacagucaaggguggaugcuacugugaguagugacuccuucucaauagacauuuucagccaagucuacuugggccugcuaugugcucaugcagcguuucccuagucaacacacagcaacacaggagcugaaagcagcagccucugagaggauucacaacacaggagcugaaagcagcagccucugagaggauucacaacacaggagcugaaagcagcagccucugagaggauucacaacacaggagcugaaagcagcagcuucugagaggauucacaagagccccugcucugaggcugcagccguaaccugcccaaaucacugaaguuccuacuucuauggacuuggggguccuuuugaauuuuuuaagugaauauauagccaucugaaucauguggaauagacaggaaaguaagauauuuauuaucuauguagcuuaaaagcagauagaaacucaauugacaacuuuuguaguuuuucuugagaugauauuuagggcauuugcagguucuauggggaaaauaagaauaaaauauuaggugcuaauuuugagcauauuaguguagucuauagaguggggauguuguauggauugaaugagacagcagugcgauguucuuggagagcaguagaugugcucacuccuaagcccuuucaucucuguagggcacauggcuaaccaggaaauccccuuucuuucagagcaaguggaguugccugcuguggccucagucagugcuuccgugaucaagucuccaucagaccccacccaugccucugcuccugcaccuccccucuuaaucccugcugccuccaccaggagcagcagcacuucucuggccagcagcacucccagccuggaaaacaagccuccacaggcuauugugaaaccacagauuuugacccacguuauagaaggcuuugugauucaggaggggcuggagccguuuccuguaagucagaagcuuauuuguguuuuuaaaauuauuuuuaguuacacaacacugucuuaaaacaauguucuacuauuguucucuaagaaaaugcuuguaauuuuaaguuuaaagauggacuuguuuuuaaauguagaauuuuagcugucuaaucuuuuaauguauuucucuguacagguucugagacuuuuucacccccuuugguuuuucaugacaggguuucucuguguggcccuggauguccuagaacuuucucuguagaccaggauggauuuuaacuuauagagauccaccugccucugccuccugagugcuguguuuaaagauguguaccaccucugcuuggccugagacauuuuguacuagccguuucugaucuuaacucugcuugccugucugauggggaugcuuuuaugaugugucagaauuaaauauguuaauguaucuagauuuacuagccauagcuauuacugauugucaccauuguaauaucaauuacagcuucacuuuuucuucuacuuguuuguuuguuuguuuauuuuucuuuccuauuuuacauccugaccacaguuuccccaacucuucuccucccaguccuccaccucuauccacuccucuguuucccuucagaaaagagcagccaguccucccagggauaucaaacaaacguagcauaucaaauugcaguaaaacugagcacaucaccuuguauaaagacuagacuagggggcuggagagauggcucagugguuaaaagcaccgacugcucuucugaagguccugaguucaaaucccagcagccauaugguagcucacaaccaucuguaaugagaucuaacacccucuucuggugcaucugaagacagcuacaguguacauagauauaauaauaaauaaaccuuaaaaaaauaaaaaagacuagacuagguaauccagcaggaggaaaagaguuccaaaaacuggcaaaagagucaaagacagccccugcucccacuguuaggagucccacaagaagaccaggcuacacaacuaacacaugcagaggaccuaggucagacccguaagcuccuugagucaguucagucucugugaacacuuaugggaccagguuaguugauuguguguguguguguguguguguguguguuuugaccccucuggguccugcaauccuucaucccucucuuccacagacuucugagcucccaccuaacauuuggcuguggguuuccgucaguuuccuguuuccgucaguugcuggaugaagcaugcuagccuccuuuuuccuaggacuauuauuagggaucauuuuauugacauucuuuuuucccagacuuguuugguucuguccuagguguaugugcuacucguuccuugguauuuaaccucccuggguuguugcauuauagcaugauuauccuuuauuuuacagcuaauguccacuuaugguacauaccauguuuaucucucugggucuagguuacucagggugaaauuuucuaguucuguagugugugggguuugcuuuaauccaacauaaacccaacauaacucaaaugcaagcucaaugaaguugacaaaaaauuggccacagaacagacucaggagcuaaacuacgaccuguagaagugcugcacagcauacuuaaaggauuaaagcaugacgcguuaauaaagcaagggggagcagggugggcugaaguauuguccaaucacauuuugauaugagagguugagcaagggaguuuucaccagucaggugaggaguggguuccugggccugggagcaugaacuugugggacccugccaucaagauggacuaguugcccuugagaugucugcacucagacgaugucuccuuagaaguuguccuugagcuaccuggacucugacgacuguuuucuuacaacagaagcuguuagcuauuggaaaguccccagcuccccugggacuugggaccuugaauuuagcuucuuccuaugauugaauggagucuaaaaaugaaacgguaguacuuagaauaagucucuuuugcuuguucccuacaguaccauccauuuugccugcaaguuucaugaugauauuuuuuuaacagcugaguaauacuccuuugugugaauguaccacauuuucuuuaaccauucuuugguugagggacaucuaguuuguuucuauuuucugguuauuaugaguauaacuauagugaacaugguugagcaaauguucuugugguauaguggcacaucuuuuggguauauguccaggaguacuauagcuggguuuugagguagaucuauuucugguuuuccgagagacugccuaauugcuuuccagaguggcugcacaagugugcacucccaccagcagugaggcaugcucccgugcuccacauccucaugaguguuugugaucuuagccauuuugacagucauuuggauuugcauuuccucaguggauggcuaaggauguugaacauuucuugaagugcuucucggccauuugagauuccucuguugagaauucucuguuuagaucuguacaccauuuuucaaauugaacuuuuugguuuguuggugucuaguuucuuaaguccuuuauauauuuugaauauuagcccuuugucagaugugggauugguuaaaaccuuuuucauucugucguuuuguccuauugaaggugacuuuugucuuaacagaagauguucaguuucaugaggucuuauuuauuaauuguuuaucuuaguuccugugcuauugguguucugcucaggaaguugcauccugugccaguauguucaagacuaauugucuaucagguucaaugugucugauuucauguugaggucuuugauccacuuggacuugaguuuugugccaggaucuauuuacauucuucuacaugcagacaucugguuagaccagcacuguuuguugaagauacuuuauuuuuuucauuguauaauucuggcuucuuuguuuaaaaaaaaaaaaaccagauggucaaagauguguggguuuauuuuucuuuauuuuuuaaauuuauuuauguaugugaguacagugccuugucuucagacacaccagcagaggauaucauauuccauugcagaugguuaugagccaccaugugguuacugggaauugaacucaggaacccuggaaaagagcagucaguguucuuaaccacugagccaucucuccagccccuaccugucuguuuuuaugccaacaaccauauaguuuuuaugacuauugcuuuguacuagagcuugagaucagagaugauguugucagaaguucuguuauugugcaggacguuaaagauauccuggguuuuuuguuuuuccauaugagguugaauauuuuucuuucaaggucuguaaaaaaaaaagguuguuuuggaauuuuuaugggaauuacauugaaucuuuagauugugguaagauggccauuuuuccuauguuaagccuaaugauccaugagcauaggagagcuuucaucuucugauaacuucuucaaaggcuucauacaggccuuucacuugcuugguuagaguuacuccaagauauuuuauacuauuuguggcuauugugaaggguauuguuucccuaauuucuuucucagccuguuuguccuuuguauguaggaaggcuacugauucuugugaguuaauuuuguauguagcuaccuuguagaaaauguuuaucacuuauaggaguuuccugguggaauguuuagggucacuuauguaugauaucuguaugaauguauaucugccaauaaagauacuuugauuucuuccuguccuguuuguauccccuugauauccuucaguugucuuauugcucuagguaagacuucaagacuucaauuauauuguauaguauggagagaguagacaaacuuguuuuugauuuuaguagaauuguuucugauuucucuccauuuaaguugauguugauuguggucuugcuguaaacugccuuuauuuagguaucuuuuguaucccuaauaucucaagaccuuuagucaugaaggggugcugauuuuguuaaaggucuuuucugcauuuaaugagaugaucaugugguuuuugucuuucuguuuguuuauauggugggcuaaauuuauugauguauguauguugagcuaucucucuauuucugggaugaugccugccugaucauggucgaugaucuuuuugauguauucuuagauucuguuuguagucauuuuauuaagaaucucugcauuuauguuuauaagggaaauuggucuguaauuuucuuucuuuaucgagucuuuaugugguuugaguaucauggugaccguagcaucauaaaaugaauugggcaaugcuguuucuguuucuguguugagaaauaaauugacaaguauuggcauuaaaccuucuuugaaagucugguaguauucugugcuagcuccaucuugcccugggcuuacauucauugauuggauggcuuuuaacuacugcuucuaauucacuagagguuauaaguuugucuaaauugcuuaucucauccuuauuuaacuuugguaagugguauguaucaagaaaauuagacauuuuuagauuuuccuauuuaauagaguacagguuuguaaagccuuccuccugauucucuggauuuccuuggggucuguggguguguuccuauuuucaucucuacuuuguuaaacuggaacuucuuuuucuaccuuuuaguuaauuuggauaagggcuugucaguuuuacucauuuuugcaaagaaucaacucuuuguuucauugauuuuuuuuuuuuuuuuuuuggguauuuuuguuuguuugcuuauaucuuacugauuucagcccugaauuuaaauuuuuuuucugucuauuucuuuugggugugacuucuuuuuuuucuucuucuagagcuuucaggugugcuguuaaguuacuauuauuggcucucuccauguuuuuuuuguuuguuuguuuuuuauuuauuuuuuauuauuuuauuuuauuuuuuugguuuuucaagacaggguuuuucuguauagcccuggcuguccuggaacucacuuuguagaccagacuggccucgaacucagaaaucugccugccucugccucccgagugcugggauuaaaccaccacgccuggcuuuuuguuuuuguuuuuuaauauagacacuuuuuagccuuuggcggucagauaggaugcagggaguuuuuuucaauuuucuuguaucuguugagacuugcuuuaugucugacugugucuccaguuuuagagacaguuccauaaggugcuaagaagaagguguagccuuuuguguuuagauggaauguucuauaaguaucuguuaggucccuuagguagaugacgucggucagcuccaguguuuuccuuguuuaguuuuugucuggauaaccugcccacuugucggaaggcaguauugaagucucucacuucagugugugacaggcgauacuugauuuaagcuguaguaggguuucuuuuauaaauguaguugccaucauuuuucaugcauagauguugagaauugcaauguccucuugguggaguucuccuuuguuuauauagggucuuuuacuguuuucugacuaguauuuuguaagauauuaaaugcuacuuucuacauccauuugcacagaaugcguuuuccaugcuggacccugaggugaugucuauugcugauauuaauguauauuucauggauguagcagaagaaggguggauccuguuuucaaauccauuugucugugucuuuuuauuaugaaauuugagaacuuugauauugagagauaucaaugaacaauauuuguuuauuccuguuauuuuucuguugugguguguguguuuguauguguguuucucuuuugauuugcuggucugggauaauuuauuccuuguguuuucuugcuuuaaccacuuuagguuggaguucuucuucuagcaccuucuguagggcuggauuuguagauagagguugcuuaaauuugguuuuauaaugaguugucuuauuuucucuacguauugugacugaaaguuuugauggguguagaagacuauguugaaaucuuugcucuuuguagucuucagcuucucuguccagaccuuucuggcuuuuagagucuccauugagaaguaagggguuauucuaauaugucugcauuccuauguuacuuggucuuuuccccuugcagcuuuuaauauucuuuuguuguucuguacacuuaguguuuugguuuuuacgugccaaaggggauuuguuuucugguccagucuguuuaguguuacuguacuuuuaaaagccaccagcgagauggcacaguagguaaaggccauuuccaugcuagcuuggcaaccugaguuuggucuguggaacucacauaaagguagaaacagcauacuuaacuccauaaaguuguucccugcuguccacaugugugcggugguacaugcuuuccccuucacuuagcaucaucaucagaguaauauuaauuuuacaauuuuaaguugggccugguggugcaugccuguaaccuuaguuaauuaggcuguugauguuggauuucaaguucaaggccagucuggauaacuuagcaagcuuaucucucaaaauaauuaauaauuauuaauaauaauuaauaauaauuaagaaaaagauauaggaaaaaaagucugggggcaaugugaacuggggagaaggcucaucuuguagguaaaguaucccuaugcaaguuugaacacacucaugacugaucuucacuaccaaauuacaaaaugucuggauacaaccaugaauuagagagcuagucuuggguauucaagguacuaggaaaaagagauaguugcugaauaauauugugaaacauuaggcuccgcauggauguugcauaggaauauaaacccagcauuggacagaggcugagcaagaggaucuacguagugagaagugaucugaaaaacauucuaaggcaacggaugaggguauagcucagugcaagaccuuggagucaauaccuagaacuacaaaauacaucaauucaaacaucagcugcuuccccuucaacucccaaguacacugagaguuagggccuuugcuuucccuuggugagggggucaucugaucacuucucuuucaauauuaaacaugcaaagagucauuugauuguaaggcuuuuuaaaagcuccaugccuaaagcagcaguacaaucuauuugacagacccugcagcauauauucuacuggcuagcaguaguguguguguauagacuaccuuuuacuugagggauaauuggucgcuuuaaugauuggaucugaucaccgaguaaguaaauaucacagauagcauucaugccaaaggggucauuuuaaaauuaaacucauuuauuucugaauuauuuuuagauauuauuuuuauucucuuuuuccauuuacaggugagucgaucaucacugcugauagaacaaccugugaagaagaggccucucuuggauaaucaggugguaaacucuguguguguccagccagaguuacagaauaacacaaagcaugcagauaacucauccgacacagagauagaagacaugauggcugaaggucuguggaucucaugaacccuuuauucaaucuaggcuuuuacuucuugaaauaggguguggcuuuuuagucuccauagauuugcacuuggaaagaauucagauuuguuuacauacucacuguauguauuugacuagaauaaugggcaagcaaaccagucuuauaauuaaacaacaaaaaagcccaacaacauugauguugauuugaugucuagguagggcaagcucuaucauacacgagagaaaguauuuuaacauuuuuuugaaucaggacaaccaauucuugcuuuuaaaaagcagaccuaaguaacaugaauauuuuauugaauuugcuuaaaaauaaagaacaucuguguauuugguuuuagacuuguuacugugaugucugauaugagauagagauuuuagguuuuucuuuaacaagcauauguagguuguguaaagcauagacucuuaaucucaggguugggguucaaacuccacacugagugccaaaauguuguuuuuaaaacaaaaucccaaauguuugauuuaccaagugaagacucaggagccagaugcuguggugaaagccugcuagcucagaggcagagaaagcauccagcuaaccuuccuacucuaccuaccaguguuccagaaggaaacaacuccucuuacuccuccuccuccccccuuucuccuucuccuccaugcugucuuaaauauccuucaacucaaaagagccugcuuucucuuuccugggcuuucuuauguucacucuaucagcugguugcuugcuccaccucuugacugaucuugacuuuauuuagcuuuuguuuacaggaaguucuuagauuaaagcugugugcuggggcugagccacaccacaacaagaaacagguuuuuccaguucauaaucucagguuucgcaaugugaucaaauauccuacaaccgugcuguccuuauuguaacuagauggauauuccaguuacauuaaggauguucuugucagucaauagaugauaacaucuguuuuaagaggaaaguacugggcuggagagauggcuuagugguuaagaguaccaacugcucuuccgaaggucccaaguucaaaucccacaugguggcucacaaccauccguaaugagaucugaugcccucuucuaguguaucugaagacagcuacaguguacuuagauaaaauaauaaauaaaucuuaagagcgagagagagagagggagagagagagaaguacugcugggcguugguggugcacaccuuuaaucccagcacucaggaggcagaggcaggaggauuucugaguucgaggccagccuggucuacaaagugaguuccaggacagccagggcuacacagagaaacugugucucgaaaaacccaaaaagagagagagagagagagagagagagagagagagagagagaaaaguacuguuaaucuccuuacugugaaagacuccuccucaacugacucuauuuuaauacugaauaucccuuauaaauccaagcaauaaaaugucugaggggaaaacaaacaugggaagauacaaaaaugauguucucugccuugagucuccuguuuaacaccagcaaaugcuuauacuguguuucuuguuuuguuucuaaugaggcucugaaugugguuaaaaagaaagacuaaccaacaaaacaaagcaaacuagcuguaucauguaggaggaucuucaugagagauuguucuugaucauuuugaucaugauccuacaguugcuguugcuuuguuugauguauuuagucaggacuuaaaauagugaacucauuaacaucuuucccuuaguaauuauccuuacuaugucuaaaauucauuuauucuuuuacaaauauuuauugagcuuguguuacuauauugugugucuccaugcauuguuaaguuuagcaaaauggcaagucgguaagcaaauacccacauucccuuuggcucugacaggauggcaccugucaguugguauuuuauaaacuuuugcaaaguauucaucauuuuacuucuuauuugaacaaccaagccugugauaggguaacacuugacuuuuacuaacuuuugguuauuauuucaaguucaguuugauucuuucugauguaaaagguuguugggagccgcccucacauuugccauuauaagauggcgcugacagcuguguucuaagugguaaacauaaucugcacacgugcaggggcaguuuucccgccauguguucugccuuucuugugaugacaacugggccgaugggcugcagccaaucagggaguaauacguccuaggcggaggauaauucuccuuaaaagggacgggguuuugccauucuuucucucucucuuguucuugcuuuuucucucucuugcucuugcuuucuuguucuuguuccuguucucucucuugcuuucuuguucuuguucuuuuucucucucuuguuuucuuguucuuguucuuuuucuugcuuucuuguucuuguucuuuuucuugcucuugcuuucuugcucuuguucuugcacucuugcucucuugcucucuggcuccugaagauguaagcaauaaagcuuuugccgcagaagauuccgguuuguugcgucuuuccuggccggucgcgaacgcguguaagaaaagguuguuaaccaugaaaugcugcagacauaccuggggagaagaauccucguuacaaggcucaugcaggacuguggcccagcucagcugcgcugccacccucaccucgugcauccuuugcuuuucucccucccacccuuccccauggccacugucuucucauuccuccuccuuugcucucucuggauuguagucauuuuauuucaccgagacagugggacaucuuaaaagcagguauuuucuaaaauaauuaaauagcaagauucuuugguguaauaccugagccauauucauauuucccaguaccugaagcaugcucugucacaguuaucugauuaaaucaggcccaaacaaggucacgaggguggcuuucauucaccauggugauuaaguuucauguaauucucagauacacguuuuuaguuguacguggauuacauguguggacacgaguuuuagaugagaagcaauagaggaggaggguuagguuuuccuucuccuuccucuccucuguaaaacacgugugaaugaagcuaaaaugugcucaccauuaccacccuggugagcaccaacaccagaggaacacggaacucugggaacuuuauaacauguuucaugauaguugcaguuuauaauggacaagaaauaauauugcuggugugcuggcgcguggaggguacauacaggaagaagugaaauuguagccucugcacuggcuggauuucugugucuacuugacacaggcuggaguuaucacagagaaaggagccucccuugaggaaaugccuccacgagauccagcuguaaggcauugucucaaauguuaaaaauauauccaaacauuagaauaggaauuauuauucucaaucagucuugggguuggaaccugugcuaggcaaguagcuaacaacuuaguucuaucccuagucucuuuguauuuuaauuugaggagauaggguuccaugaagguguucagguaggccuugacuugacaucuuccugccucagcuucccauguaacugggguugcaggccugcaccaccagccuggcuagaguagacauuccuaagugcugcuucuuuauggagaauaaacugaugcccugcuucaaugguaugguauucuuaaacagcaucugcuuguguucuucccuuucucaauagcaacaguaguagcauguuacuagguaauuuacacgguuguguaaauuuuuaaaagucucugaagcaaagcuuagagacgugcagaauggucucucgguaguuccaucagugguagugguugagugagucugucucuggcccaggcuuuccacaucagcucaggugcaggcgacacuccugagagucacuagcaaauuccaaggguagacgugaagguuaggacugacaagcgccuuuguuccagccagcucuagguuuuuggaagggacagaauauuucauuuuuuagaaacuacauucaaauuuguucuuugaaaauaucauacauguauauaaugaguuuugauuaaaugcacuccauauggucccuuucagcuuuucccagacaguuuccccaucauuuccuucucucaacuuugugccccgccuccacugaguuaaguuagugcuaccagcauguacaugggguuggaauccauuggagcacgugcaaacuaccaggggccacaggccugaggaaaaaugacucuccuuacccagaaacuaucugcugacaauugcuccacagcugggacccuguguaagggacaaguuuuuuuuuuuaaagauuuauuuauuauuauauguaaguacacuguagcuguuuucagacacaccagaagagggcgucagaucucauuacagauggaugugagccaccaugugguugcugggauuugaacucaggaccuucagaagagcagcuagugcucuuaacugcugagucaucucucuagcccgaaagggacaauuuuuacagguuuuacaguuuuauccacacuguaacuaaaucaaugauccuugcauacauaccaagguaguugaguacauauacauaccugguuacauacauacuugcaaacauaccaagggagagaauuuccuuuaaauggccacuccugggcugaagauguagaccauuugccuaggaugugagaagcccuaagucucauucccugcacuacauacaaaauacagaccaagaaggccacuuccugcuccgugaugucauuaguaaagaggaugugccucgagcccugcccgagccagcugcuucuccacuugcuucaguucuuugggaaaggucaugcagauugaacuguuugcuuuugguguuguuucugaagcaggagauaagagugaaggugaggguugggguugggguugggguuagauucuuacuuaguagggaacaccguggaaaacacaccaguaguuggacuuaugagucuguuugagauuuaaaagcagaauuaauuuuauuuaauauuaaaaggaaguuuuguaaauugguuauacauaccuuuauaauauugguuauacaccacaggucccuuaguuaaauacuuuaugugucccacuaaaauaaacaugaguuucuccaauuggaagccauucuccucuccauuaggaauuuaaaggguuucccugaucuucuauccuguacucuaauaucugaaugucccuucuaguggaugguguguauauggcacucaccuucauuucucagaaccuagccaaguagcuuuggaaucaaaaaaggugaagaacuauuggucugacuguguuacauaacugaauuagaggcugaaggaaaguuugacacacucaaauauuuggccuuucuccuccuuuuuuagagacauuggaagaaauggauagcgaguuacucaagugugaauucuguggaaaaaugggauauccuaaugaauuuuuacgguccaaacgauucuguacuaugucaugugccaaaagguauguuggagugcuugguaauuucuuagucguuucugcagaaagucaagacagguuacaguugaacauagguaggagugaggucugacaacccagggaaggucaggugccgucuacagcaguuuacucugcuaugucauuacuagaauucauuacgugauaaguuguauaauacugcaguuucauaauauccuguaucgaaguagcaaucaucugguguaaggauaugguguggagaaucucuccuguagcaugauuaguauguuauagaaucuuaguauugugguuuaaaaauuaauuacuaauuauuaacuaauuaauuaaaauuauuucuauguaggaucuugcucuauagcccugccuggccuggauuuauguggaccaggcuggucuccagcauucugugauccugcuguuucuccucucaggugcuggggucauagcauggguaccagcuugccuagauagucuauaaagauuaauauuggggcuggagagauagccuagcaggugggaauaccugaugaucuuuuggaagaccuagguguguuuagguugauuauuuugaaauuuacauucucuuaagaaaccagugaauuuccugcuugaacauaccauuuuguauaguugcugcagaacuacaguuaguugaacuuaccuuuagaauaaguguauguggaaaggcauagaauaggagcagguuucuuucaaaagugaacuuaugguuucaguccacugcucagauguuuauucaugaguaguggcaggucugucauuggaugauguuggauuuauauuuuaacuugaauuucaguuugcauaaaacacgcgaaagaacaguaguuuucuaauacuguuuaaaaauacuuggaaguuuaggaaauugucuuggaggguauucuaacccucuugacuauuuagaacauacuaggacacuuaauauaccugucgucccccugcucccagaggcacauaguauacgucuguauacuagaggcacugcuaggcacauaguauacgucuguauacuagaggcacugcuaggcacauaguauacgucugaggauccuccuuagacaauugggccuagcacagugaagcagggcugagagaacaaggaagagagacugucaggucggcgagucaccgcugggcuuuacacgguuauguagcucucagucuuggagagcuaacuguagaacuguguuaguaaguuuggucacgugauguacuaauuagaaaucaaaacauugcugagcccacagguaagcccauaaugcacacagcaggagugucagcuauuuuaguagcucucagggcacauuugucuauuaguccucauaguauucuuuauuuccaucucugacauguucauaaaacauagcaaacuuacuuguauuauucuagaauaguuaucaauaaaauuaaugugugugacuguuuuaccuccaagaauauaugugcacugugugugagccugcugugcaaggcagaagagagaacauuggaucccugcaaggggguuucagaugguugugagccuccauugugugcugagaaccaaacccuggucugcacacauaugugcuacuguaucugcaauacacaucugcauacuccuuuccauauacacuaaaaagaauaagacaaaacaaaacucuaaguauauuacuugaaaauaguuugaauaagcauuggaacuauuuauuauaaaguaucucuucuggaacgaugaacuuucuugcugcuuugcaaauuaucuucugcauuuugcagguuucucauuauuuuuguauaaucaggagaaaauaucauuaccuuguuaggggugucuaguauuauguugagggauauuuuaugauauacacaggggucauuuuugaccugaagcauaacuaaauccauuuaauaagauggguguacugugugagguacuaguacuagauacuaaguaucuaguacuuacugugucacgguuguacuuuaaagguacaguuaaauacuaugggcugucccauauauugcuuaauuuuucuuucuugaauuucuuagguacaacguuagcuguucuaaaaaauuugcacuuagucguuggaaucguaagccugauaaucagagucuugggcaucggggccgucguccaaguggcccugaaggggcagcaagagaacauauccuuaggcaggucuguagaaagcuugcuucaauguacaauguccuuuucagaacugcaagggaagugcaaugcuguauuauacuuguacugcauuuuccagcuuccaauuacuuauccaucugcagaagaagacguggccucucaugaagauccugugccuucugcuaugacgacccgucugcgaaggcagagcgagcgggaaagagagcgagagcuucgggaugugaggauuaggaagaugccugagaauagugacuugcucccagucgcacagacugagcccuccauauggacagucgacgacgucugggccuucauccauucuuugcccgguauguaacucaccacacgagccuggauguuuuucuugugccuucacaagaaaaugauguuaaaucuauccacaccuuuggcaguuaaggcuagagaaacagugcaugugaaaguuaaaaugguuaaauggugaccgucuuccucuuucucauucccucagcgugacuguauuccuaaaaugaauaaagacuggcuaauucugcuucuucugagaagcccagcagacagcugggucuucacugccugacucucaggaggcagcagcgugaagcaaacacuuccccucucccuccgcuuugcuguguugcuguuguaguuccucagcuagcuccuuuugaaacugagacaagaaggccauauugugcauauuucggaaagcuaaucaauacuauagaguaggguaaaauuuugguuucuuuuuagaaagcuauauucauuuguauuaggguucucuagagucacagaacuuauggguaguaaacugcaguucaacucccaacaauggucagcaguagcugugaauggaaguccaaggaucuagcaguugcuccaucccacaaggcaagcaggcaaagaagagagagaguaaaucuuccuucuuccaauguucuuauauaagucuccagcagaagguguggcccauauuaaaggugugugccaccacaucuuuaaucccagaugaccuugaacuuggagauuuuccugucuucaccuucuggaauccauagccacuaugccuucagaucucuaugccaagauccgggucagaaacuucuaucucccagccuucagauuaagaucauaggugagccuuccaguucuagauguaguucauuccagacacagucaaguugaccaccaggaauagccacuacauucauccuaaugcuaaggguagccguaugcuuuccuguugucuuucugguacaucucucaccagcuucagcuuccuuuuucuuuaagcaacaguuuuuuguaucuacauuccucuaagggguugacagccaaagaaaauggagccuuuguuugcagugagagccacacuaaauguauguuaggacacuggguuuguuguuguuguuguuuguuuguuuguuuguuuguuuuuauuuuaauuuguaaaacacugguauuaugaaccuagaaaaugagauuugaaagccacguuucguuuuaguguuauugugaguugacguaaaggcauacaucucacuuggguuauucaucagacacuuuuaaagugauuuuaaauugagcuaacuauugagaugucgcugucuuccugugaaggucuuagaagcaaacuuaggaguugaaggaauacaucuagaaauaguaguuuaaaaucugcuacuguaaauuuuaccucacuuaaugaauucugaaguuuuacuauuguaucauagcuguuccaaaugcuaauuuuuagcaaacucaagguauaguccuguuuauaggaagaaagaauuguuuaaaggaagaauguuucauguaaauuuguaagcacuuguguaagaaaaccaagguguacguuaacagcggaccagugugcuuagacucugaacuuguucuccuagcaagggcugggguggugaaacuucacugaugauugucuuaauauuuaaacaaacaaaaccaaacuuuaguuucagaucagcauaauggucuugagguuaacuuguguuuugccuccgugguagucucuucccuuguguuugugagccuggguucugacuggggcagagaugccuuuuccuuugggcaggggaguuuuagaccuaauacaauuaauugucccagauaaccagcacgcugcccuuacugcugaguugggucauucaagggcuguucauuauggaguuucugagcaucuaggagcuugugcucccucuggacugcuucaguagugucguagucaggguuucuauuccugcacaaacaucaugaccaagaaacaaguuggggaggaaaggguuuauucggcuuacacuuccacauugcuguucaucaccaaggaugucaggacuggaacucaagcaggucaggaagcaggagcugaugcagaggccauggagggauguuucuuacugacuugccucuccuggcuugcucagccugcucucuuauagaaccaagacuaccagcccagagauggucccacccacaaggggccuuucccccuugaucacuaauugagaaaaugccuuacagcuggaucucauggaggcauuuccucaagggaggcuccuuucucugugacaauuccagcugugucaaguugacacaaaaccagccaguacaauugaccccuugucaacuuggcacacaaacacaucgcuauuaagucucaacccuuacuuucuuauucauccccaagaucuaaauaacuuuaaaagucccacagucuuugcaaauucuuaaaauuucaauuccuuuaaaauaucuuuuuacaauuaaaaaucucuuaacugugggcuccacuaaaauacuuccuuuaagagggaaaaauauuaggacacagucacaaugaaaagucacaaaaucaaacuccaacuguccagugucugggauccacucacgaucuucuggauuccuccaagggcuugggucacuucuccagcucugcccuuuguagcacacagcucguccucuaggcuccagaugccuguacuccacugcugcugcugcucuugguggucauucaugauacuggcaucuccaaaacacugcugucuucugcuguaacuaggcuucaccaacagcuucucccagacucucuucaugaugccaagccucaacuccuuugcaugacuccuucaaguccugagccaccaacuguaaccaaagcugcaccuucaccaauggccuuccauggucucucacagugcugagccucagcugcucuccaugaccccuucaugccaucaaaaccagugccaucugggugacucuuacacauuacccuaucuagcuacagcacgaaguacaaccuuggcuaucucuggaacacagccucuuugugcucuuaaaaaagcacuucccaggagaugucaccucaaugaugcuggucucuucuuaaucaccacuaauuucuuagcuccagcuaaccagcaucaauagucccaguaaugcaaaaauuucgcuuucguaguuuugguaucuuguuaaucacagcugauuguucagccccagcuaaccagaacuacagaaucuucauaaaacggcaacagcccugauagagucuuuaaucuucccucugaaauuucacaagucaggccuccaucuucugcccuguucucaacauugucuuccaagcuccuacacaacaucccacagaggccuccuugcuugaucacuaauugagaaaaugccuuacagcuggaucucauggaggcauuuccucaagggaggcuccuuucucugugauaacuccagcuuaugucaaguugacacaaaaccagccaguacaaguagaucacaaugggcucaugggcuuugucuugcucuuccuucauuugaguucaacacccauuccccagccuggacauucuuggcuuacugaguccaccugcguuuaagaacauaauauaucauuacaaagaggcaggcuugauuggcuguacucauguauugcugaugaaguaggaguauuucugaauugcugugacagaccaaaucauacuauuugugaagucuguuauuaccuuucuaaaaauuguccucagaguagugcaagugcucuauagcucaagguaaaucuuacaccagaaaaauguguuuaccucucuuucugccucuauggcaucuauaaauaacuuucugagaaccuucaggguauuucuuuuuccugaguagucucuuugcaagcuuuucucagcuuacccauuuucugaucucuuacauguuucuuccagauaggaugugcuuucuaauccgggcgcccguguuuaccacugggcuucuguuauuuugguguaucauguuaacaccccuuugggaacuauguuaaagcuuccggguagcaaacucgcaucucagagcuguuaccagagugaaaaggaacacaaccuugagugcauuaacccuuuuccacaagaacacuucugcuuucaacaguugcaggucgucgucuuuagcacccuucagugugcugcccuuuuggaaagacucuucuguauugcucuguggaucuguaggaaugccaaggaggaauuguccuuuaaaggacagcugugugcugucuuuggggaugugauuccucugacguauugaguggcacauggcgucuuuucugcaauuucuacauaaaauuuguacauaaauuuuuuugauuuggauuucaaagugggagaagugauuguggacacuggagaauucaggugggaaggcaaaggcagcagugucguuccaagagcuguguggacccuggucugggugaguggggucagccgagcuaccuacugcuucaccuggucugugucagugcucggcuucuggcaggcagucaggaugucaggaacucacagagcuccugcuccaggacaucuugaauacuuaaacuuaagaaaaaucuggguuucccccucccccacagugaguuucuagauaaauacuugcuuguacccucccuuucuguccuaauguaauguuacuuuuuguguuuggcuugagaaaacuaggaucuaaaaauaugacaguaauguuauuauuuaaucaagcaguuucccaauacacuuuagagauguuuugccaauuuucuugcuaucuacaucugaaaaggaaucccacucaggaggaacagagagcaugcuggguauuuccucaaggggagcuccuuccuucuaucccacauguagcuccuguggcccuuacuacuugcuccuccugauuucugcaucuaaguaagcccuauccuuucuuucucucucuucuuuccuuuccuggggucuuauaaauaagacuggagagaagaacauuaguucuuccauaaaagaaggaugaagucacaacuagaugcaagauuagucaguuuuguugagagcuaccucugggaaaagaaaaagggcuuuuuuaauggugaguaauccuguuucaucuguaugguuucuuaugugugguacaugggcagagccauauaaauuuuauacaggaucuugagauauaaauuguugaaagucugagaaauuaccagaauagagacacugaaacacuguugugucagaagcagugaggaagaaagaauggagucacugagugacacugaggaaaguggccacacaagggagcacaccacugaagggugucacagccagagugacauagugucacguaguaucuccccaaugccuuacguuucuucaguuucucauugcuucacugauccuauguagucauacaugugccucacuguagugcuucaggaugcucuggguuagagguuggccagagggugaguuuacaguggaaaggagaaucaucagggaaagcggcuguauuccaggguacgggcuagccgcuucucucucucuccucaucugaguccuagcuuccuuuggaauacugauuugaauauaacaaaaaaggcuuuaaagcuguuaggugcuguucuuaagcuaacuuccauaacuuuacuauuuguaaggaagccgucaugucuugcauuaucucuucuuuggguucuguacuucauuaccugaccuugagguucgcuuacuaugauaggggagugacggguaagguggcugagcacgugugcuguagacaagagaagcagucaagggucagguggcgagcgcuugcccuagguugagggcgccggucccuggcaggagacuacccugcagcuuuguaauuccagugacagcuuguuuucuuuccaaaagucagcugaggagagccagagaugugcugaaguguucaggaggagagcacuugccagccaucccuagagcucuggguuccguucccagcuccauuuaaaagaguguguguguaugugcgugugcguguguguguguguauuaugguacuuuccuguaauccuagcauguaucgggaaaucaggauaauacguuuaagaccacccugggcuauacagauuguuagaaaauagaaaugaaaaauagaagucuagugauauuaaacuuugaaguugauguuauaaguugagcagcaugauguaugucagcaacauuauaacauguuaauacagcaauccugggggaacagugaaaguacuguuagauauacaugaggcaugcaaauucagaaaagguauagugggaaugaaagcuuaaucugaaguuugagaaaauauuuccagauuauuauuuauagcaaaacauuuuauuccucucucccuguauguggaacuauguuaugcaaagaugaguccaugagguguaaaaccuagcaaugcaguucuuuugcaugagaaauaggauauguugccugauuccucuuguguaaugguuuuuugacuucuucaagggugagcuccaggccuuguagcacauuggcuucucagccucuguugugagcucucacacccagugacaacagaacucuaauuguguguaacucugucuucucauggaauuccaggcugccaggacguugcagaugaguucagggcacaagagauugaugggcaggcccugcucuugcuaaaagaagaccaucucaugagugcaaugaacaugaagcugggcccagcccugaagauuugugcacgcaucaacucucugaaggacucuuaacaggagcgaggcuuugugcuucucagcccauuccucucacaaggugaagguaaagccucgcugggauucucuccugagaauaucagacugauggaggaaggccgagugcacugggaccgccacggccagugccgacguuucucuucagauguccuaacucaucauacauuuucauaauuagugaacaucggugacauuaauuuuaccacuuacaugcuacacugaaagacuuguuacagaggcccauauuuuucaaagaaacauguuauacuagauaauuuuuuaaagguaauguuuaucauuaauauaaaaaaaccuuuuaaaaauaauuauugauuuacacucccccuccuuuaauucucuuuucuuauacguuuuccuacccaguuaguuuucuaaauguugucauagagauauaggauaauuuaggagcccauugacagaacugaaugcaaugaaaugccagucuguuuuaaaaagcguaucuuccagacaaaugcuuuggcugugaaaagggauuguguuuuagcauaaacaguauuuuugaaguucucaagagucucuagucuagccuuuacccagguuggcaugacugacaauuuuccuccugguuuguacauuaagagcaauaguucucaguggagaacuuguccuccaggggacaauuggcaauaucuagacacauucugguugccauggcuugggcuugaguuuugugagggugguuauaggaacugaggugugacagccaguggagauguugcugacuacccuacaguacauaggaugccccucugucaccaggaacgauguauuauggaugccaguggugccagugagcacagugggcagccuggcugagcagagaggcauacuuaagugauggcugugaggagggcgaugugcagugaaggguuagccaguggcaccagaguucugcagaagcagguuuugguuuuaccguauacuagaaaggaaaggaaauccauaaaccugggcuauaaaaccaggcuaacucacagaccaugugacucugguguggcccuggcccauugucaccucuuccugacucuguucugugcaccgaugauggugcuugaugcagccaugccucggagccucuuucagcagcccaguggcaguggagguggaaucccuuccuugaagcaacccugcugagucuggcuagaaugcaguucuuucucccuuacuaaggcuguggauucuucccacgaaguauuuaaagugauuucucuuaaucagaaguuuuuauucaacaguuuucuguuaggacacuaagccaaauuuuucuguggaugcucugaaaucuuuguagugcugggcaucaaaagauuugcugacauuguuugcuuucucuaucuuuuugcuacauguuugagaacucugaacaaaugaagggacaugugcauagccuuggcacagauggaaaagacagcagagucugagcucagucaucuuuauggcgcuuuucagagauuggguugaguuaguagaagacuaaaagaugucacaaagacaucacagauaaauuuaucuuuuggcuuuguguacauuagaaaauguugguuauuuuuauacagaaauauaguggauaauuuuuuuaaucuuuagaugccucuuguuugaauguaugcuuugugagauuauugcuguaguaguuuuaagagcuguucacuaguaguccuguguagacucagaauguguaaguagcugaggcuccuguuucagacuacaguaguauaggcuacguucccuauuucuuugugucacauuugguuauucacauuucaaggaaggcagguauucuacagucaccugcauauauuaguacugagucaucauggcagaguugucacggacguuccugucuccaacagaggcuggcuaugcagcacuaaggacugccugccauaaugaaggaggcacaaggcacauuuccucuggaaugaaaacuaugguguaguuaguaauccacagugaauaugggauuguccagaauagaccuccagcaauaaugcuucccuccuacaaauacuuacaucuagccuuuaaggcauuaacucugcacuuguacuaaaaccagcccaucgugugcuuaugagaaaccccugugccuagcacuguccauaagcaccccuacacaguuuacacgaaggguuucucuuggaggaugccuucuuguccuucgucuuagaaguagcccagaucuucuguugucugcacuuaaauuuaacuagcaaauacacuuuuuuuuuuacaaguggguuauuuuauuuagaaguggcucauuugguguuugguaguucucccauugcuguagguacuucuuucuagguaauuuuuaauugugcuaauuugaaagcuucaauuacauuaaauggggacacacucuguguuucucucuaucuccugaguauuaggcuguucaaugugacauggacaggaagaacgcuaguuucauuuccuuucuuauuacuaagcacuuaagaacuuucuuagaggaaaaaaagaaaaagacaggaagggaacaugguuucuuccuauuguugcuuucugaguuugccuugccugacuugaaacccuucaaccacugugggacacacuuuucacauguuauuuguuuuaaguucuguguucuuaggaaaauaaacagcuggcuuguaaaaguuacuuuaaacuuagacgcuuugcauacacacauguaaggcacagugacacagcuuuaucagcaaagcagggaaugcugccuucgcaccugacaccuuccgugacagugacuaauggaugggcagagucacuaccugggaguagagaugccagaacaagaggagagcguguugguaaagcagcuagaguguggcagagcagacggggccucuuccucugcucaguucauuaaucagggcaaccugacuuucuguguuucugugcugcuuuccucuuuguuucuuguguuggaagacuggugugugagacuguauuguuaccaugccuuugaguaacuauucacagucagucuucauauauuaagugcaucuauuuauaaacacaaaucuuggauugaaaucuuucagaggacucauuuucucacaagcuuguuagguugugugucucagcaccuguguccaguauaugaaaucucugacugggaauacucuaaaagcacuucagacauguucucagcuagagaggcugacuaaguguuguaguuugaagacuuggggaaugccagcaacacuugcugcugacugguacuuucagcaugugauggccucaccuccuuuccugcacugagucccaucuaccuccaaccccaccuccaaccccaccuccaauaaaguacacagacuuucuuaguuuuuuacaugggguuggguugcauccuggcuuggagagcuucaggcuguuguacuagggcgggccuuuauaacuucaccaguuguauuucaaucaaagucuuauccaucuaugcaaucauuuccuaguuucuuguguaccauaugucugugugacuuauuccuugaagguuauuugagaaggggaguggaaaggggaguaagcgacagauaggaagaugauauugcgaccugaaugaagacguuuagcaugaugaugguccuuaguagcuagauauccuuggugauggauagcgggacaagguguguuguuaguuguuuuguuuguuggugcuagggacugagucagggccucacacgccaccugagauugcauacuguauuuuuuuucuuguuugccuagacuaaccuggaauugugguccucugaccuucucucaagugcuagaacuuaauaucugugccaccaugccaaaccuagccccuaugguuuuaacuugucaagauuugguuaaaaucaaauuagguauuucucuuuaucaccugucccugcucugaggaguguugauauuaauaguaccacugguacccaaguugaguaauccuggauuuuugaagaugauaaucagagggagagaaucugucaaaauguaggaguuuguuaugaucgaguggccagacuacagaggcauauccagucagauaugacaguuggcucaguuuugcagccagucauaaagggaaggaaggcacugcaggacaguugcugacugguggacuccaguaagcccaagcccacuuauuuucuuggcguaaagcagaaugacccgugacaugaacuguuccaacuccaggcuucaguacugauaugucacuccauucagagcguuuuguuucauaucaaagcuggguuuugaguuuagcugaguacaaauaaguauuaggaagaguaaauguguuuuguuauucaaauuuaacaaauugaacucauugaaccaagcccuuaaggaauucucugggaagauauuucugguguuagauuuuaaaaugcauuaccauauaguuuauaguugaaauaaaagcuguuuuccaauuaaaaauguugaaaaugauauugacauuuuaaaaaguggccugaaaugguuagcaguuguauaugcaguuuuagaguuaagucuauuuauuuagaguuaagucuuaucaguuguauaugcaguuuuagaguuaagucuacuugacauuauacuaagagaaaacuuuucuuuuugaaaguuacaagauaugaguuuaucuacaauuauuaccaucauguucuagagaaaaaccuuaggaggccccgcccucuguugacacgcacagcuucucuacagcagagucucauuugcacacacucuggcgagugccauaccuaagggaaauuauuuccacaagggcuuuauuuucuuucuccuuugauaacuuguggaccuuuuauuuuauuuaaaaauacaauuugaauaugguguuaggcacaaaacgagcuucuauauaacuauauuuuaggcagaggucuuucugaagcuuuucaaguguaaaccuacugcugucuaugauauuccugauauugggcauaaaucuauaggacgagaaaauuuaaaguaguauguaaugaaugaauuuuaauuuaaaaaaucaguauaaaucuaaaacaucauuaugcuagcauggcaugguuuuaaugaaauguaagagggauguaguuaaguccuuuauaaugucuaacuuaguuucagucaucaucuuagauauucauaguaucuauugcuuuuuggcuuaauggaauacaucaguguuuuguggaccuuucucugacaguggugaacgaguaguggagauuagaacaucauugaggaaaacaugaacccacugaggggacuuuuuaaaucuugccucaacuaaacuaaauauguacaguguuuaaauccuuauacauaaugcuuguguuaaauguuuugguaguauuaaaagugagcaaauuacaacuuuucuucaggagugagagauaaacacacuugcugcugcauuacugugcugaguggagagggaacagagaggcugggagaccugguguuacuccagauggccggcagcccugggacucgaugggcagcuauuuggcuuuuuaucucauuucaacguagugugauaccugcacugccaaauaggcugguuuuguuguuguuguuguuguuugcuuaaaucauuuuuaaaggaacacccuccccgagcuuuaaaguuacaauccuaagcuacacaauugggauucccacggggcugaccgacuggcaagugaauaucagcacccaugcacuugcuccuucauuuguaaacuaucugagcacuuggcuucugugugcaauauaugaccaagaaaauaacaaguaaagucuucccaaacaaacucagugcugcuucagcaucuauguccgcacagccaggaaugaauggcaauuaaccaguaacgcccugcucucugggaguggggguuuaauaacauccaagugcuaaaccgcaccaccacucacauuguucccaccugugggccaucuccuugacuguugacaacaguaagacugcuugcccugaccggcugugaaacucuugugacaggcacugucaggacagucccuuuacguggucugucuguggcaggaugcaagaagucaaugugaaaucauugugcauuuuuaguugcaaaaguuuauauccaguauugauaguggaagaguuuuccaaaacagaaucaucugaaacgaggcagagaacagguugcuacggcugcuuucuccacagugcugacucuauuguaguguguuagagacagccacuucucaaagacagggucugcacugcagcuugaaaaugcagaacuggugacagaaggcaguuccuaguugggugguggcucacaccuuuaaucccagccuugggacacagaagcaggcagaucucugugaguccaaggccagccuggucuacagagcaaguuccaggacagucaggcuacacagagaaacccugccucgaaagccaccaccaccaccaccaccaccagaaagcagauccugcuugugcuagcaaguauuuaaggagugagugaagauggggucaaagucacuuuuaauggugugaauuccggugucacucuggggcucugugaaucagguuguaauucuuguuuuaaaugcuaacuaacaucaguugcuacucacauucucuauaaagauauaaaaauauauuuuaaaaacuuuauguaucauagcuauagguuuuuaaagcggggaaaugcccaaauaaaguguuaaauuacaauauauaauagaugcuuucaaauuaagguuuuuguaaguuauaauaaucuaaauagcccacuaaucugaucuuuguaauuugucucaugauucugguuacuuuuaagguguuuuuuaaguuuuugaaauauaccuaaguuguaaaauauccuguguuguuuagaucucuguugcauaaaugcuguucuugugucuguauucuuagaccuuaagaguucagcugagaauacaggguguaauuuuuguguaugauucccacauugauggaauugacugccaauaaccucauucagagaugggucuugguuuguacaguaggggauuaaaaaucaaaauucagaaauuguuggaaagugcagggauuaugcuagaaaugaggguuguacauuacagacagccaugcacagggaggcaggggagggaggcugcugacuucaagccucuugaauuuggugagaaugcuuugcgaauggcacuuaaaauuuguuucacaaaggcagguuguugggauuaucuguuuuuuaauauuuuaagcacauuuuuagaaaucuugcuuuugguucugaccauuguucuaaagucaaaguuuuauaauuuaaaaaaaaaaaaaaacucaaaacaugauucaucaaggaaaaaagcaucaccaagggggaaagaaaacauguucuaaucuuagagaaagcaaauguuaggguuauaauagcugugucuuacauuggauguuguauuagagaccuccucacaggaaaugauauaguucuagcacccuuagcauagaguuccuagccuggcguccauagcuacaguuuuacaguguauaaccugagaaugaaguuaauuuugcauuguaagagcacaccauuaucuguguaaaaaguguucauuugcuguauuuuuuuaagaaaagagaaagcacuuucauauuaaguagcaugugugugaacuuuagacuuccucugugugucuagucagugaaguucaaggagcaucgaugucugcuggcgacguuaacugcuaacggaagcaccuuauccucugcugcuuacccuugcuuggauugcaccuuuguuaccugcacacuuucacauagaguauuguaacacggcuucgagugggucugggcggacggcuaguggugggccuacaggaucuuuuauuuauguuguuuauauuacaauaauauauuguagaccaguuguaacuucaguucuuuacaaauaaaagccugacugguuauugaauuuuuauuucuuuaagcuuuugagagacagggaaagcuaauaaagaccuuaauggagggcuggacugacuauacau

SEQ ID NO: 1383 - RNA, 57234 nt, Mus musculus
gagcguggugggaggagccgcggcgggaggcguguugugccgggcggagggaggagcgcuggggcucgggcuuggcggcgaagcgaccccuugcucgcuccgcgccgcgggcuaggcguguuggucggcgaggcgggcggccacggcuucccgacaggcucgggaggccgagacccucgcggcgcccggcgcugccccggcccccucggccuccugcggcgaggcgggggagugaggagaugccgacccagagggacagcagcaccaugucccacacggucgcgugcggcggcggcggggaccauucccaccagguccgggugaaagccuacuaccgcgggugaguguuggcggucagggacccgagcgaucgugggggcggcgagaggugcgguugguggcacccuggacguaugaguguaggucgccaggagucggcggaggagagugggcgcaaccggaggggaggacaaaucagcugacggagaaauuugcaacuguuucgggacuggguggauugaagauuucgagggaagccucuguucacucacuacugugggcacgcaagccuggacugcuucguuagguggcuccuuucauugcagacaggccugaagccuccgucuuauaaaucagguuuacaucuauccuucgccgugggagaguucaugaaauaagucuggacuauggucagagagccgcuauagguguuagaguuaguaccaaagucgauacuuuuuaauaggaugugcacuggauccuggguggucagaauuaaggugcaaaugugcugacccacauuuuggaaguuagggugagcuaucgaaaggugagaagccaaggcuuuaaauucuagaaacgaucuuuaccccacuugauuaccaaacguuuaaacuaaugucucugccaaaaguaauccaguucugagcauagcccaaaucauuuucuaucgugacuuaucauaaaguucuuccucuccuuugacuucagugugugguuugagauaauuuaggaucucugcugaggugaaaggccagcgugagcauaaagacuggagagcagggauuaacagaagaccucucugcuugucuaggcagaaauaaauugcuuuuaaaagcuucaagugcuacaagguuaaaagagcugugcgugcuuucacauuccugaggggaucagugaagauagcagaccuucccgguucuuucuuguuuuccuuucaagagaacugaagcugcacaugucuuaauguguacauguaaggccuuagauuuguguguuaucuuccagccucugacauugacugauuugggacuaauucguagaauuugcaguagacaauguucuuuucacuuaaaacagagaaaaugagguuaaaauagucuccgcaaacgcacuaauuuuuuuuuuuuuugaaauuuuuaaaaaguugguaguugucauaauaauugcuuuaggcauuuugguucauggucagccaugaacaaacuuugcaagauuggaagagccacagcccauccuuccgaggacaaacacacaacuuucugauaauuugagagacauuuguuuuagagcagugguucucaaugcugcaacuguuuaauacucuuccucauguuguggugaccccaauuuauuuugcuacuaccuguaacuguaauuuuucuacuguuaugaauguaacaugaauaucuguguuuucggaugcucuuagaccccucccaaagggaucuagaucuacggauugagaaacguugcuuuugaguagguuccacuuauaaaguuagcagccuguggcguauuagguguagaggaggaaaugccguggauucuaaagaagcugucuaguugacagguuuacagacgagaguucaguguaaaugcgugugcuugguaagagagugcauauuguguacaugugucaguagcacuguggcuuuucacccuccagucuccaaaggcucuguuguggguaacuucuucugcagcuugcauuuacuguuuuaaagguuguacuuauggagcuggagagagggcucagccaugaagaacacucgaugcucuuccaguguauccagauuguguuugaagaaccuguguuaggugacccacaauacugcaauucuaguuccaggaccccaauacccucuccuggccacuguggcacccccaccccaccccccauacauaucacaugugugugugugugcaugugugugcgugcacacagacacaucaaucucaaaaaaguugcauuuauguuucuuuauuuaaauuuauuuuauuuuuaugaguacacuauagcugucuucagacacaccagaagagggcauuggaucccauuacagaugguugugagccacccaugugauugcugggaauugaacucaagaccucugaagagcagucagugcucuucaccacugagccaucucuccagcccacauuuauguuucuugagagaucaucuguagauaguauuuaucgauuacuuccacugaaagaugaacauuauguuguauagugccuucugucuccuguuuccugugggucuuaaauguugauuguucagcgauugauuuuaguuuuugacuuuauacuuagcuuccagugacuuggugaaagaccaaggaauuaaugcuuuuucauuuuuccauauuuuuauuaguaaauaggcgcaucauauaaaucauuuccaaaauuuccuuggaaagaaaucaauacgucgaacucuagaaauucagguauuccauauggauuuucuuuauuuauugcucuaauuauuaagauaaagaaaaugagaauauggauauacgauuuauuuugucuaaaaauuucucgagguacuuuaauauuaucuuuuaaaguuuaggaaauuuuacuaaagauaggcacacauaaccccaugucuucaguagucaguggaaccguccuaauacuacaugguuuuucaagcuuccucugaggacagccucagcacucuuaaccgugccauuuucuuuuuucugaguuagacguuaagauuauauguuuauuaacaguaaucuaaacugguaguuauauuacagccagcugcuuauuagcguugaugagacuaaaaugcgucaccagcaaggagagcuaauaaauguguugguuaacaagucccauacaugacuccaaaguagacucccuuucccuugugcugggaaacaggaggguuugcaauuggaaaaugugguuuggggcuggggaucugguuagaggagugcuugcuuaacgcgcacaggccaagguuucgucuccagcacugcagaaaccugguacauggcgcgcuguaauccuccacucagaagguggaggaaggaagagcagaagggugaguuugggaccagcuugggcuacaugagguuuuuaccuuagcaacaaaaacaaccucacagagaccauuuucuuuucacccccucuuucuguagcuuuccccugccuccuccuaacaguaguucuucccagugaagcuugacuaugaauauuuccagugaaugaacuauccucuccuuuuaaauagguuucauuuuugggaaaguauuugucuuccuauauauaagaggcaugugauuugacuuuuuuccaguuuuuaaaagcaagagacuuuucuaguuuguaaaggcacugagaaucuggcgugaguagagugccugucucauggucugcgccccuuuuucccaacaugggaacucuggagucagcggcccuuuuccuuacagugcuguuagguuggaggaagagaaacagguuuuuuugguuagugauagauugccauugugugcuaaucccuguauaaagguacuugugggauagaauuuaaugagguaaugacugggccgcgcauaccuugacauuguauguguacaggacuuuggcagaaagcuuguaaaaaagugaguuauaagccauugucguugaucagugaucgcagcccagaggauuccuucugugaacaguaacugguuuggcagcacaagggauccuaccccuguuugcagccucucugcugcugagcuauguccacagcccaggacugacucugcauauucggaaugucgaguuguuugcauuuuuccucuuagagugaacaagcccugucaggucuuguuuuuuaaaguauugcaaaaugaguugugugcucucgguuguuggagcugaguguaguucagcuggugcagugcuugccuagugugcacaaagcccuggguucaauccaaaccccucauuaaaucaaguaugauggugccugccugcaaucccaguacagaguggaagcaggagggucaggacuucucaagcucauccuuggcuacauagucaguuagaggacagcacggaccguguaaaacccucagaaagcuugacuuuguaaugcugagcucaacagcuggccagcagcacugaggccugaaagugaggaguuggaggaacuggggaggcccgagaggagcucacugaaaggcugaagcagcagcagaaggcagcagcugcuuagaaacuccccagagggagaggugcuuccugccucccuaccccuccccuccuugauggucuuuaccugguuagcaggccucaaacucacuaguaacccaggcuagccuugaccucuccuccauccucugggcguggugccugagugcugagauuauaagguguuuggucacauuuuugguauguguucucucaccuucccucccuccuucuaccccugagccccccccuucuuuucuuacacagggucccauguuacaugccgacucugacauguaacuuacucugaacuucugauguuccugccugcaucucacuagaggugggauaacaggugugugcuaccacaucuugguuuuaugccauguugggcauaacccgggaccucaugcaggccaggcagucauuucuccagcuuagcuauuuuuccuuuaaauuuguugaugacacauugauuugucuauuaaaauuggcaggcauuucucaaucuauuguuuaccugaagauuuuaagauuuauguaauuaaaccuccuuuuuauuuuuucugugagugugguuccuugguuuguugccuuagauagaugaguuuucauuuacaaguagucuacaguucuguacugugcagaguuuuaaguaaccaucuucucaauauuauguuuugagguauagucauuaguaguuuucugcuaauauuuuuaaaaaagagguuucuuaucacuacuuguuugaaauaacuuuuacacgcuguauuucucauaguguagauagauaauugucuauucugugccauuguuuggggagagagcuuuuuguuuugguugaauauugugcauuucaccaagaauuucuugcuuuuacaagugggaacuuuuauuuccuguuauuuguaucacuauggccaaaauaucugaccacaacuccagggauaaguuguuuaggcugcuggucucagaggguucagcucaugauuucuuggucccaugcaauugagugaaacaucacuguggcagaagauuugaggcaaaggacagcugcucacauccuaguguacccagaagcacagagcaaggcuagaagugaccauagauaaacugucacacagaucucuuccccaacgaccucuggguaggggucaccuuuuaauguucccagaacuggucagaauggugccucccgcuguguacuacacauucagacugugagucuguagggcgcacugcuguucaaacuuaacuuucucuuaggguuacuguauccuuucuuauguugguggagucuugcugugcucccugacugcugcacacuccuagccuccugggauuuucuugccucaacuucccaagcugcuggaauugcagggcaugccacugugcucagcuuuaugucaccagcuuucuguuuuuguuuuaaagacaggaucuuacuguguagaccaugcuggccucaaacucaguuugucuaugucugccuccuaagugcuggaauuagagaggugcaccaccaggccuggccuaucagguuuguaugcuuacacugaauugucauuuauuaaccauuucuuaguuaacuauccuggaguuuauaggauaauaacgucucugacugacagucuugcuggggguuuguagacaguguuggauugcaguaaugcuuuuaucuuaaugaaguauaauugcuacugagaauguuuaccaacuacuuaaaaaauguaguguaccuaugccuuugaagaauugcagauacauuguaaucgcuguuuuuaauauucacaacaguucucagggaguuugucaugauguccauguuauagacaauauugacacuuagaaaacacugauacaaaauugaguauaacuuucaaagaacuccuuucccuuuuaugugcuucuuggcuuuaugcuuuucuugucaacuuuuuuuauuucaguuguugcuuuuauguucauucucuauuuuaugaaaaauggaaauugcuuugugaguuuuuacuuaauuuuuuuuacuuaauuuuuauuuccuuuuaagguugguuuauuuuuguauuguauguaagauguaugccuacauuucaguauuuguaccauguucgugucuggugcccguggaagcuaaaaagagugugucggaugcccuggaacuggaguuacugauggccaugagcguccacgggggugcugggaacugaauccugguccucuggaaggacaacuggugcucuuaaccacugagucuucucucagacuccucugcuuaauguuuagaauuaggauuuaacagaaugggucuauuacggcauuuucauacgaaugcugucuguguuuuucuggauugucccccucacuacccucucguuccucuugcccuucccugcugguucccuuccuaaagucacugccuuccuucucaucgcucuugacuucuaugacacauaccaccccaccgaucacauaaauuaaaaauaaguucuucauaugggagaaauuaugaguuaauugucugagucuuacaucuuucccucaguguaguaauuucuaguucugucuauucuccugcagauguuauaauuuccuuuuucuuuauggcuaaguaaaauuucauuauguauauguaccauguuuucuuuauccauucaucuguuacuggauguggugguuagaauagaaauggccucuauagacucaaaaaugcacugcuuguagggaggcacuuuccuaauccaaaguccauauuccuccaaaccaaagcauggucaggccuaucacagcaauuccccaguuccugguaccaacuucuaagacaugaccaaggcagcucuuauaaaggaaaacauuuaauuggggcuggcuuacagguucagagcuuuagaccauuaucauggagggaagcauggcaacgugcaggcagacacggugcuggagaaggagcugagaauucuacaucuugaucaacaggcagcagaaggggacuaugagucccacuagguguagcuggacuguccucugacaaggccacaccuucuaauagugccacucccuauggcccaagcauucaaacacuugagucucugggggccacaucuacucaaaccaccgcaggcucagaaaugcagugucaugagggagggagcagcgcugccugagaggguuaggagguguguguuggcgauugguucuaaugcucugaaucaaccggaaucuguguccaaacccuaaaggucccuugucugcaauuguuuuuugauggaucaauaaagaugccaacacggccaauggcugggcacugggcgggacccuuacaguugggcuggcuaggaugcagcuggggagaagaaaggagggucaccaugacggggagggaaauggaugagauuuagagcugcaggagagagagccaaccagccauguaagaauucacuucccugauugggccagggguagcaggggaagguuuaggaauguccagucuuugagguagccaaggcauuuuaaaauuaacuggugugugugggucuuccauucuccaauccagauaguuccugggcaguugcguguauaugauucuuaaggagccaaagcaguguagcccaaacucaacgcuacagguguggccuuauaggaggaagugugucacugggaguggucuuuagggauuucaaaagcacaagccaggccucuuuuccugcuaccuauggauccaguuggagaguucuuagcuccuucuguaccaugucugccugccuucuuccauguuucccaccaugcugauaaugcacuaaaccucugaaguuguaagacagccccaauuaaauccuuuuccuuguaagaguugacuuggucaugguaucucuucacagcaguagaucaguggcuaagacaguggacaucugggcugauuuccucccuccgggacuuacuuucuuuucuuuuuuuuuuuuuuaaagauuuauuuuauuuaucauauguaaguacacuguagcugucuucagacaccagaagagggaaucgggucuuguugcagaugauugugagccacauugugguugcugagauuugaacucaagaccucugaaagaacauugagugcucuuaaccgcugagccaucucucuagcccccacugugacuuucuuuuucugauugauaacuguuauaagcagugugcuagugaacauguaugugcugcucuuccuguggugugcugacuuagacgccuuuagguguacgcccaagcaugguggucauacccuaguucccuuuugaguuucugaggaacauacugauaccuguaguaucacaccaguugacaguguuaucaguaguguacaaggcuucaccccccccccacacacacacacacacucuaacagcaguuguugcuuuuuuuucuuuuuuaaaaauuaauuaauuaauuaauuaauuauuguuguguuugaaacagaguucuguagaccaggcuagccuugacucugccugguuccaccucccaaguucuggguguggcauauuuauuauuuauauauuuuaugugugugagugcugugccugcaugggcccacagaggucaggagaggucaucagaugccuggaagaugaguuaguugugagccaccaugugugugcuaggacugggacccaggacuucuguaaaaucagcaagugcucauaauggcugagcuaucucucucuccagcccuccggcuuguuuucuugaugguggcauugcugacuggggugacugggaucucaaagcaguuguaauuugcauucuccugaugccuagcaugcugugcauuuucuguguacuuauugucauuuugauuucuucugagaacuuuguucaguucguagcuccucccuuucuugauggggugauguuuugaaguuuaauucguguuuauccucacauauucuagacauuaaucuccuguccuguccuguguggucagcaaaggcuguuguuuuccacucugugggcugugucuucacucagguauuguuuccuuuguuaaagagguuuuuaauuucauguaucccugccuaucaauucuugggauuauucccuguguuuuuggagucuuuuucagaaaguuuuugcuucuguguauauuuuaaagucuuuuucuguagcauuuuaagaguucuaggucggacauuaagguuuuuugauucauuuuaaguuaauuugaaaauguuuacauuuauuuuuugucugugcgguguguguuguuuguguguugugugugagggaguacacacaugcuaucacagauguguggagguagaggauaauucucaggaguuaguucucucuaccauguggguucuggggauggcauucaggcuuaggcuuggcagcaagccccuuuaugugcugagccaucucacaggcuuccauuuucaauggaguuuuauacagaauuacagguagagaucuuaguuuucuacuauuuauuauauuuuacuacaugcuaaauguggaaauacaauuuccuaggaccauuuuaaaauuuuuuucuuaaaauuaaaguuuaauuacaucauuuccuccuucucuuuacuucuuccgaccaguaccauguuucccacccuccccucuugcuccuucucaaaucuaugaucucuuuuucuuuguuacuguuacacacacacaauacauguauacauagaugcauuaaauauguaauaugcugaaucugcucaauguuacuuauauguauaagguuuccaguuugaccacuuuguuuuggauaaccaauuagagccucaucuugggaagacuacaucuaccucucucagcaagccuuaauucccuaauugccuguaguucauuguucugggugggcucagguaagauuucccucuuccaugcuaacauguugguagcguccuuaaggucuccguuggucagccauauuauuugagguuuagcuucucugucauuuguaggaaagagcugguucucuggacuugagucuuuccaaucccucuucugucuucuguggugguguucccugggccuuuggccuaggaccacuuggugaagaggcuauccuuucccaguguauguuagacuaagguggcaacugcugugagagcucauuucugcugucuugguucugucccaguaacuauggucugcugcuguggcucugugguguguaguguagaggucagacacugugauacaguuauugucauucucucugccuaggacugcuuuggcuauugcggggggcggggagggguguuucuguaugaauuccaggauuguaauuucuaguugguugagaaauguaacuggaauuugaugggaauucuguugaaucuggauauagugauauagucauccuuuauuaauuucgccaguuuuugaagauggaagucuucccgucuucucaggcuaccuuuaauguugacuguagaagucuuuuacauucuuggcuaaaauuacauuuaggauuauuuauuuguuuacuuauuuagaagacacuauggaugguuuuuuuuuuuccccuccugauuuauuucugauauauagaaaaaccgcugauuuuguaguuguuuuucuucuuuuaauuucugccaguuugcuguggaaaugcuauaauuuauaugauuuugacucuuggcucgccugcuugagccacuuuuuucucuuaugacuuuugugcagacauaauguuauugugcacuauguaaaguuuacccuugcguuauucaaaugcugauuugucaugccuugcugcagucugggcgcagcauuguaaugcuuaugucaagagucuccugucccaaguuuguguaaacaauucucauuaugcucugccuuaucaguaaaagcuggaaaagccaauaacuaugcaauauaaagaauagggcaguacuucugcugccaagggcggugggagaggaagagggaugucacugugaggaagggguccagagaggcaucaaagcagaacacaccugaagcccagagggacaaaacaauacaaaaaugccaguaucucggggauuuuggcugggagguagccagauuagaggauuaugauauaauuauaaugccuaguuguugugauuuuaaguugaagauaaaucuuggggcacuaacuaggauaaagaaaaacagccgcuguauuaacuuacuguguacauuuauuuuaaaguuaccauuacagcucuagcuuaaagauggaauacuucuaaauaggaauaugagcauaugucuuguucuuauuuuagaggaaauguucucucuauaauauugggugauuugucauacacagccccuuuucauucuuuguuuauucauuuauguguguguguguguuguauguguaaauguaugugagggagugcucaccuaugcauguacacauggaucagaugaugucaaguggcuuccucgauugcucgccaccucauuuuugagacagggucuaaccugucucaucuugagacuagagcuuguuguuuugguagagugguagagcagcagacccuuggacccuccuguccaagggugcuugguccucuucuccacaggugcuugcugucaugcucaggguuuguuuuguguuguuaacauggguucuggggauuaaaauucagguccucuuacagguauggcagccaccgcugagccaucuucacagaacccauuuacaggcuuguuauucacuucugcuccuaguuuccucagggcuuuuaucaucaaggugcguuaaacuuuguugagggccuuuuuuaugacuauugggaugaucaugugacuucuguccuuaagucuacuuauguguuguauuauaguuaauaauuugggugugcugaaccaacauugcaucuuugggauuaaaccagcuuggucucagccucugaucuuaauguguccuuaaauucaguauacagguuuuuuguuggaaagucuuaugucuaugcucaucaaggaucuuuagucuucgcuguugcauccugauugucaggaugguccuguggugcuggccuccuagaaugaggaugggagcgcgccauguuuccguuguguaagcagguucugaggguaugggggacccuccuuagagguucgauaggacugagcagugaauccauccacuccugagcuuuucugcugcuucagccugguugcuuaagucguucaugucuucuugauuuaauucugauaagucauguguguguaguuauccauuucuuguagguuuucuaucuuuuuccaguguauguuucaaaguacucucuaaucaucuagaucucuaggagagucuuaacugcgcccugcuuuaucuccguuuuauuaauuugaggcuuccuuugguuaguuuguugucuuacugauuuguucagauugcuccgauuuuuuugguuugguugguuugcuuugguuugcuuuuaguugagacaguuucuuuguguagcccuaacuguccuggaacucacucuguagacuaggcuagccuugaacucugccuccugagugcugggauuaaaggcauguaacaccauugucuggcagauaguucuaauuuuuaauggcuauagacuuccuuaucucuuuccuggaaguucugguaaaucgugcuuucauuuuuaaacaucaccuagauuuccucaguaucucacuggucauacaagaguauauuguucuguuuugaaguaauugaguacuuuuuguaguuucaguugcuauugauuucuacuuucuuccacuaugauaugaaaaguaaauaguauugccuuuucuuuuuuuuuuuuuuuuuuuuccauuuuuuauuagguauuucgcucauuuacauuugcaaugcuauaccaaaagucccccauagccacccacccccucuccccuacccacccacuccccuuuuauggcccuggcguuccccuguacuggggcauauaaaguuugcguguccaaugggccucucuuuccagugauggccgacuaggccaucuuuugaugcauaugcagcuagagucaagagcuccgggguacugguuaguucauaauguuguuccaccuauaguguugcagaucccuuuagcuucuuugguacuuucucuagcuccuucauugggggccaugugauccauccaauagccgacugugagcauccacuucuaugcuugcuaggcccaggcauacucugacaagagacagcuauaucaggguccucucagcauaaucuugcuaguguaugcaauggugucagcauuuggaagcugauuaugggauggauccccggauaugguagugucuacaugguccauccuuuuaucucagcucuaaacuuuuauuguauugccuuuucuaagacuugcucugguauggauugugcuccguuucugaaaaugcuuuucuuuucuguucaaugggauagucuguacaucugcaaaggccauuuguucuguagucuaguuuaauugaaguuuauuuauugguuauuuuuaauuuguauggccucucuaaagaugcaauugggguagugaaguuacccucuguuggcauucugucuaagcuccuccccacaguuaccuggcaacagccagguaugccugacucacuauaaaaggggcugcuugcccccuccuugcucucuuguuccucucuuacucuuggguuucccuucugcucccguuuucucaccauucucuuccccucuuucuccaugugcucauagccugccucuucuccucuauuccucuuauucucucucccuccuuccuccccucucucccuccccccaucccccuuucuccgccucuccuacucucuugacuccccuccccauguccuaaauaaacucuguacuauacugucauggcuggucccccauaccucaccacaccuccauagaacauacucccccucucuuuaucuuuuuauaaacacaucauacucuauuguauccggacuucugggaccauuuguaaccaauaguauuuuuuauaaaauucggaaccccaguauuuaguguauaugcaacuacaguuuuuccauccauccauccauccauccauccauccauccauccauccccgcccgguuccagguaucccagggugaucuggaaaccugcuguagcugcaggugaucuugacucugaccuuccugucucugccucacccaccauaccuugguuugagugguaugguuaccaaauccagggcuuugaaaacuguuuuuaaauuuuaugaguauuuugccugcuuuguauauauguacauaccacguuugccucuuguacaaagggaggccagaaaaggguggugucagauccucuagaucugagagucaccugguauggguauugggaacugaacucugccccucuggaagagcagcagaugcucuuagggcagagccauuucuccacucaaggcuuagugcaugcuaauuaaacacuaucaacucaacuacauacccaaccucguuuuauccuuuugauuaguuauuccuuuuauuaauaugugguggccuuguuuaucuuuaauuuugcuuugaagucuacuuuaucugauaucagaacaguuguacccacuugcuuucaauucauuugcuuguuaggucuuucucagucuguggcgucuacacacacacacacacacacacacacacacacacacaccucaccucaagcucaaggccaccaagcuucugaccuauucucuguuggugaaauccgcauucagacugaggcugugucuaagcuugacagcauccagccuuccugcucuccaccacugagaccugagguuguggcggguuaauccccggcuuucugauugugggguccaggucucugguguagauccccaggguaacucagcauucaucagcaaauucccucuugacauagcaucuuaccucugcccucuaaaucaugcaaacuguagagagauuucugauguaauguagagcugaccugucagccauauucucaccuguuugaccaaaaccugcaagggauuugaggcuugugaguggagccugugggcagacagccaguguuuucugaauggagcuuguuuccucucuuccuguuaggaguggcacuagccuccauaccuuucuccuauucugucacuauuuaaauuuuuuauuuuuuuuguuuuucgagacaggguuccucuguguagcccuggcuguccuggaacucacuuuguagaccaggcuggccucgaacucagaaauccugccucugccucccgaguccugggauuaagggcgugcaccaccaccuccacccggcucuauuugaauuuuugaagagccucuuccacuguuggaacagaguaaauuuuauuuugugcguguauuuugccugcauguauuauguaaguggcaccacgugugugccuuauaccuacagaggucagaagagggcaccauuagaugcccuggagcuggggcuaugguuggccaugagcuuucauauggcugcuaaaaacugaaucugggucuucugcaagggcagcaaguacuuuuaacuacugagcuaucuugccagccucuuauuauuuuuuuaauccaugugugguugcauauauauggguguaugcugcaauacuccuuuggacaacauugggugucaguauuucaacuucauugcagacaggugcaccccaugcuggucugcaacugacagagauccaucuuccucugccucccaagugcugggauuaaaguggugucucuaaguggacacuuagagagacagagucuccggaucacuccuguguacccuggauccugccagcguccgaaguuucucccaucuccccuccagucucaauauagguuaccacgaccugcuuuaggugaaaucuggagauuggaacuucuaucugagccaucucccgagcccucgucuguugcauuacuucgaagacaucaaugacauuuuacauaauuacuaauuugagauuaugugacucuuuucuacuuugaauacuuugauccaaugauuuuaccauauuuggguaauccugugaggccaauuauuacugaugaauucaaauaaaacauuuucuaaauaauuuauauuucagaagaaaaguuuauauuuaaauagcagaacucaauguugcuuuuaagcaaagggacuuuuuuuuuuuuuuaauuuauuucacguaugugaguacacuugucacugucuucagauacagagaggagggcaucggauguccauuacagaugguugugagccaccaugugguugcuggaaacugaacucaggaccucuggaagagcagucagugcucuuaacuguugagccaucuuuccagcauguugcuucuugcauuuacuuuuaaaaucagcccccaggaaagcuuuagcuuuauauuuuacagaauaguuuguugagcgccugaccaguuagucugaagcccacuaacauaguuaaugaugucccaccuuuuuuccuuuaagaauuaaguuaaacuaugccuaaauuuaccauuuagggaaucuuugcaguaaaacacuuuugaucuguggccaucaauaaaauaauuuaugcuaaugacagagugaagacagaagaaucccgaguccaaucuguuuucuaccuucugagugcagugucuucauccgcagccugugccugacuugguuauuguaauagcgaucugggagcugaggaguauuguagacauggugcuuucuuaagcagagaaguguuuacacagacguuccuuaaaugcuuuaguuccugggacuuacggaacgacgguugauaaaccaccaccuucauuuagucucuuaaggaaguucguacuuaggcuuucuaaauauuacacauacaguaugugguauugugauuaucccuaucuguaaaccuuucauuugggaggcucagcagaaggaucaagaauucaaagccagccuggguuguuuuuuaaacaugauuuuuaaaaauauaucggauaauugacuucugcauucugagugcuggugugacuugcugagaggaaggagugcuuguguccgugaaggcucuccgauucuucucaccuggaugguuuggccugcucuaaucugggcugaauguguccuggcuagcaugagccguccagaccugucucauacucuccuuugaugcugguacuuuuuaguuuccugcaaccuugcuaauuauugucuccuauuucugucacacgggggcucugaggggaaaaguggggaauacacacauuugcauucuacuaacuuaaguaggugcaucccucuguuaaccuuuccgaaggugggguacuuuuuaaaaugacguuucacuuguuuaaaguacuguauaaauauguaauuaaaauuauuaaauacauaguguguuauaucuuagugguauuuuaagugcuaacauuaauuacagguuggaauuuauaccugagugauagagugcuugucuaccauguuugagaccuuggguucaaaccccagcacaauaacaagggaaaauauucuuuaauuuaaucuauuaaaucuauaacaucaucugagguauuauuaucccauuuuauggaugagacaagucacagggaaggcaaauaacuugcuucaggucacacagcaauauggaaaaagauagaguuuagauuuaaacauagucuccuggguuugcaugucaaggucuuaccuguuuuacagugacuacguacuguguucuagucauucaguauggagcacugacaccuuuguuuguucaacauuuauucacuggagauccgcuauaggcagacauugcuucagguguugguaauauacaacaaaaugcuguccuccuugauagcauguuuagucaugggagacacuagaaacucuguauacuuuauguguguuuauauacauauauguauguauauguguuuaugugugugugugugugugaucacuuuauuuuaacugaagaauaaagauuaacaucauguauuuaaauggacuaaauuauuuuuuuaaaagauuugcuuaaaacacuuagauuuacuuuauuuuauguguauaagaguauauuugccugcauguauguauguguaucaugugcaggccuggaggucagacaucagcuuucccuggaacuagauuguaaagauaaucaugugguuguugggcacugaacccaaguccuuugcaagagcaacaagugcucccugcugagccaucucugagcccuaauauuuauuugauuauuuauguauguguacauaccuacaugaguuuaugugugcccaugaagaggccagaggcaucagaucgccugggauuaguuacuggcagcuuugagucaugggaaaccaaccugaguccucuggaagagcagcaagugcucuuaaccacagagccauggcuccaugcccaaaacuaagguuuuaaaucaaggauuaaauuauucacuagccaggcucuuaaaaacagagcuguauccauugcgcuuuuuguugacaaauauaaauauaaaucuuuuauauacuguaguggucuaaauauuuguguccaucccccacccccagucccagcauuuauuguagaaauugacauaaaaugucuuagaaggugaagggucuacuggaaguugcauuggcucucaugaaugggauuaguaccuguguggaauggcgcagcuaaggccuguuucugaggacacaacuagaagcugcaagucuuucaaacagaagguagcuaaggcgcuuucaucuuggacuugucuccagauagacauaauaaacucauucuuguuguuugugaguauugcauguguggaguuuauuaaaccagagaacuaagcauugccuggcaucugcuguggaaaggcauggugcaggguaugagcgcggcaugggugagugcuccuaugauugacaguuauggaggagaagggaagggagggggcuuugagagucugucugugcuuccguagcaauauuacagaaagcauaagcuaugccggacaguagugucucaguucggaagcuggaagguauggcaccaacggguuugcuaucuaguuaaaggccuuauuucucugugcaggacagcacuggcuugcucuguuuuccagugaaagagauauccucacauuagugguaggcacagaggauguguaggauagcugggugaguaagguguacuucaggguuaaucuguauggaguuuucuuuugguguuuugucuugcugguuuuuggucuugauuuuugggguuuuuuuuugugguuguuugaggaggggugggaaacuuaaagagcaugacauuaggugggaaggaucuaggggagaggaaacaugauccagguauaguguaaggagaacuuuuguuguucguguuucuuugauugaaaauagacccuuuaacaagguacuuagauuauaguccggccccccccccccccguucuuuccuccuuuuauccagauccauagccuuucugucucucagaaaacagccaucuaaggaauaguaauaaaauacaguagaauaaaucaaacaaacaagucaaauaugacaaaacacaggcaucccaucagaacccaaaccagaagccauaacaguauuggcagagggucuguaaguguaaacaaugaaagcccugcuuaaaaccuccagagcggcucuugaguuggguuguauuucccucuacugucggggauagggccugcccuugagagugcuuucccugugaaaaaacugauuuuuccuucacaagcagcuaugaguuggagcuagcuucuggguuagggauggggacgggcucuguuccuucucuuucagcucuaggacccaucgggugcagacccaugcaggcccugugcacgcugccgcagucucugggagcucaugugcgugccagcccuguugugucuaggucuugauuucuugaugccccccacucccucuggcucuuacacucuugcugucuccucuuccucgguucccugaguucucagggcagggauuggacggaggcaucucauuuagggcugaguuccaaagacucccucagugccuaaugccuggcuguggcacucuguacuuguucugucuggugccggaggaagcuucucugaugaugacugagcagagcacagauuuaggaggaguugagggaggggaaaacaugaucaaaauauauauaaaauauuuaaguaaaaauagugucuuguguuuuguuaauaaagacgggagaguaaguguuuagacuacuagcuggauugccaagaagcaagcacauuguuagggaagccauggcgagaggcgugcgugugaccgucccugaagaggcaauccaguuucucuguccucuuggcuaucugcuuaccuucuguagcuccugaagacuacaggcagcugucgcuucuuuggcagagagcacguggcagcucugcgguuccuuggaggcaucaguaggccucaacugcccaagucuguuuuucacguuuccuuucugucgucauuuccucccuuucaccagugaacaggcaucuauugugugagugagagagaguuccuggaaagagcaguaccuuccaccacaccuucugcaagccuguuaauuauuggugacccucagugauaguggagagguuggaacacugcaggugcagagcccaauaguuuauuuggaacucuuuuuagaagcucccuaagcagccauuccuugcccaucucuguaucugaccucacguccugugucuagcaagugaaacauuuggaauuuauuagcuugacugaccacuaacuuugaucauccagaaggcuaagaaugugcucagcuggaaucugaagccaagagaaggggguggcccguuuuguuguaagcugccucugugaugguccucugguguauuugaaaagugcauuugauugaagacuuucuuucuucuguuacuaagagaauuucacgaaaauguuaccguguugaaacauggaauuugggguagcuugaaucugugaccccuggucauggcacucacauuuagcuccagauaaggaucucuuacgaauuuugaggugagagcuguguuuugacaguaaaguauuauucugugcuaggaacugcauugaccucuaggaguauaauggggaaaaaaacaacaacaacaacaacaacaaaacaaaaaaccacaucucugccuucacuucaccaaguuucauuguguuccauuugggacaggggguaauacaagcacacguuugugugccauuggagaaguaggccuggcagguagccagggacagcuccugaggggccuguagaccccgauguucaaaucuucuucccagucgcugagaucaaauccuccaauaaaagcagccuaggggagaaggggcuuauguuagcuccacuccauugcagaggggucagguuaaggguggaccuuccaaccucaguuucuuccaccucaauuaacuuaaagacaauaccacacaggcauguccccagaccaaccuaagcuagaccucacucugcacucuuuccuggugauucuggacguuaucacauccacagaaaagcuaacccucccaccugccuagggacauuaacauuuacucuguaugauagagccguguggguuacugcaggaagcgaauaaauuauguugauuuuaucaauggcuuacagagaguccagcuccuccagugcugaguagaaguggcuccuguguagaggucccagggcugcuuagcugcaacgccaggcaucugcuggacaacagcacaaggcacacuggaucugcucaucuaauggaaggaaaggaagugugcauucauagauauuauucacuauuuuauauuccuuauugucacuuucaauaauaaaaauauguuccuguguuuggggagggaaauuuauacuaaaggaagcuacuuuaaaucaauuuuuggaaacuaucuuugggggaaagcuggaaaugagagaagagauguacaacucgugcucuacagauugaugcuggguuauuugugaaguuaagggagccaggguagcagaagcacgggucuucauggggugcgggaccuggggaaagcauugaaacagauuuuccgugaguacagggcuagugcuuguagagaguggaugugggguugcaaggccucccgcaggagauggagcaaugaggguggcuuccucagugagaggacauggagguucauggguccagcuuauuucaucaacauuuuaauguuucaugcagcacagaaugaccaacuagucugucgcauaggcguugagucacacggagcucaguaugguuuuaaacauaaaagucuuucuuuuucagggauauuaugauaacacacuuugagccuuccaucuccuuugagggacuuugcagugagguucgagauauguguucuuuugacaaugagcagccguucaccaugaaauggauagaugaggaaggugaguaacggggcgggcgggcgggcggggugggagcgggcgggugcucugugagcuugugcuuuaagauaaaacugggcuuccaggaaauucaggaaacucaagcaggaaggguaaaucagaaacuuaaugccaugcacauagauuaagauagaagauuuaaaucaaagcauacaaucuuuguuuuuugccucuucaaaaugaagcaaaaguaguccuccccgccccuggcaguuaagguggguguuucaucagugugaugucuuaacuuuuauuuauuuauuuaucagaucucauuacagaugguugugagccaccaugugguugcugggaauugaacucaguaccucuggaagagcagucagugcucuuaacuacugagccgucucuccagcccuuaacuuacauuuuaauauaagaguuuuccuguucuugacugaaauguagagcaguccuagcaauuguguucauuuagggugaugucagagccuuaaucaccuagugacauguacucacaagcauuuaugaccugucugaggauaguggggccuuguuacccauaacugggaguauggaacaucucagagauacucaguuuccacuggucaacucagucuguuaacaacagcccuacuaaguuauggggguauuagaaauugauaaccauaggagaagauccuaaaagacauaaacuccauuaguuagcacuuuuauaaaucucuucaaaugccagcacucacaugguagaucaccaccaucuguaaccaguucugucagggggacuaaacccgugcaagagccacagugaguacuuucaacugcugagucaucaucaucucaccagccccuaagugggccuguuuguuuguuuguuugcuaaaagcaggucuuguuaugugguccuggcagaccuggaacuuggagugacagguccccaccccucacccccaccuccaccccacccugcuucuuuggucuccuaaugugagugaacuaguaggccacaguagcaaaccauuuuaggugaacaguaaacuaucacuaaguauguucuugcacaggacagggaaugauggauguaaguuauuucucugauaguuuuaaagguuaguucuaacugaaagugauuauaagguacaguaugaugcuuugucuuugguguguguguguuuaauguauauggguguuugcuuacauguaucucuaugcaccauaugcauacagugucugagcuggcuagaagaggguuuuggaucccauggaacugcaguuacauuuuuagccacuaugugguuacuggaaauagaacccagguucuccaggauggggcuguuucugugacaaacugaccuuuuuuuuuuuuuaaagaauuguagaagacuuugggauuuugaaaaguuacauuugaaugcuguaagcaggguuaaguaguccauccuagaagagcuuggaagacagcagugcugagagcagugugggcuguguaggcccugcucaaaaugguucagagaagcacuauuagcaauggcgccagcgaaacuauuccuguggcuggcugcuuuggcaaagaauguggcuucuuucuucuguaguuccaagaauuugccugaggcucacgugaaaagaaaacuuguuggaggaugagguuucaugacgaccugcucuugugcaggucucuagugaaaagagcaagugggacaagcaagagaaauacauaacuacaguugaagagaaaaacgggaggcaauguaauguuguggccaaggcuugugcugaaagaggagagaggauuaagacugcucuuccagagguccugaguucaguucccagcaaccacaucauggcucacagccaucugugauggguucugacgcccucuucuggugugucugaggacagcaacaguguacucacauaaaauaaauaauaaauaaaucuuuuuuuuuuuuuuuuaagagaggcccaggacccaggcggucacccgaccuuccagcuuuagaguaaugaaaaaaccugaggaaggguuauggaaacuucuccacaguuaaggagaaccacugagggcacuggggcaagagaguuaguuccggcauggaagucacaagaugccauugugugaaguugugaaagcgacuggauuguuagagaccccuagauguuagaagugccagagucgugggagaucugccaagggaugugcacacauggaguggagccagccugggaguaucuugcaggcaacaaagcuaaaagggcggacccauucaagacuugcaguuugcccugcuguaauuuagucuagugguuccucucuaugcccucauaacuaccuuuuugaaugacaauauauauucugugccauuguauguuagaaauaugcaaauuuguuuuauuuucuagaggguuacaguuaaaaguuugacuugagucucagaagagacuuuugacuuuuaagcaguguugaacaugaacaauuuuggggaccuuugaaguuggacuaaaugcauuuugccuuaugauauggccaugagcccaaggggggcagggaguggaaaguggauuuaaauacagugaacuguuucugcaucuugucagguuauuuuacacaguuggaucuuucauauuaacauuuuguuugaagccugcugcuuauuugcuucuuuuuauagcuaaaaacaaacaaacaaaagggcuguguggaaaauaagaauaagccuacuggucaauauccagauuuuauuaauucuuuaauuaccucaaaauuaacuacaaugagcaaauacucagaauguacuuguauuuuauuuuagacauuuagaauuugguaauaguguuagcuuugaaaaauaccuuuccuggucauuuuuguuuuguaaugacuuacauagagugcuuuaugcaucaaacauauggucgaaaaaggucacauguaucacgcaggcccucaauccaagaaaaacagaacagguucaauguguguggugucugugcagggguaaguuaauguaugguuaacuaacagguugaauguguguggugucugugcaggaguaaguuaauguaugauuaacucaccgucuucucacaaacccccucagagccuagcucaucaugacauuagguccacaguccaaagauggucaucuaauccugugucuugcccaucuaugguuuggguuccuugacugccucucugcuaguucuaaagauccaugaaauggugacaggauaguaaacuagagacaggaguaguauaguagcuaccccuagucaccaagaggggaagguucugguucugaacuauaauagaauguauugucauucccucaggaaagcucacugcuacucucugggauuggaucccaugacucuuaacauugaugcucugauucauccuucucucuuccuaggcucuguuuuguaguucacuaauuugccuagauucucucccacaguugaaagacauagcucuucauuuugaacauuguagaccaccuguguauggaguuguaacuguucauuggacaaaagccauacucacaucagacucuucuagacaaggacuacaugugucugagguuuggggacuagagaaauggcucaucaguugagggcacuggcuaccuuacagaggacccagguuuaauucccagcaccuucaugacaucucacaacuaucuguaacuacaguuccaggggaucugacacuuugacauaugcacauucaagaagacaccacaccaaugcauauaaaaauaaaaauaaauuauuuuacaaaaagaaaagccauuugcuacuuuggcccuucugcccagucuucugaucuuuguauuugcagccacugauucuguagaugcguuuucuguuugcuguauugccuucagugagugucaccacacucgcucauucauuuugucuauuguccgaaccguuuucucugucuucuggccuucacaagcaguccguggcugccaucuucugccuuucaugaaauagaaaaggccacguaagucuucuuuuugugccaguucugguuagguuuucuauuucugugcaacuuaccuuauaacuuagugauucgaaaacugacuuucacaguucugugacuuaucagagcuaauguuauaaauguccacagaacauaaaagggagugaggacuuggcagcugaguuggagaaaagaacagacacuguuuucuuugagaccauguagauaggaaaugguuucucucaaguaguaagcuggguucugugcacuguguaauugaagauuagucagagccaguggcauguagcaugcaggaaugugucauaaaaccacaggaaugagcaccagaguagcagaggggaggauccaguucaagcccagcuuugcucuaagugacuuguucauugaggaaugcaccucggauuuccagggaucacucugcacuucgccugcuuaguugagagagguguguccuccuccccuucuguguguguaacuaaaauucaccacuuacauuuaagaguagcuggagcugguguccagcccuagguaggacauccuucccaccaaaggcucggaacacgucagaggaggggcaucucagaggagggcuucaaagaaugugagagaugcaggaaggcgaggaaugcaacgcugccuuugggcugugcuguggccucugcagccgaggacucacugcagcugugaccagugcagggaggucagucaucaucccagcagagagggcucagugggcagcugugaacaaagaaagaggcagaaggggagaaaggcucguggggugcuucagaggagugggagggaaaguggagcugggguauacaucaucaggacgcauuguuucuaucuaugcaguugucaaagaguaaaagaugcuuuguuuaaagagagaagagaaacaaaaagaaggugauggagaggugggugagcagugaagaacacuugcuguucuuuuugcaaaggacccagguucaaaucccagcacccacaagguaccuuacaacugucuggaacucuaguuccaggggaucugaugccuucugaccugccauagacacacacacacagugcacagacauaucugcuagcaaauauuugucaaauaaaucuaaaaaaaauuuuuaguagcucaagcuagacuauucuuaguccagaguacuuuagugguuucuuucuugugacuuaauugaccaagguuguaauaugauacaauauccauuacagucacugccuguguuaggguccaagaaucaccaaggaaugauaacccagacucaaauaguaugcaaaagcaaagagcauuuuuuuuccagcggaauuuccugcaugcaggggucuuuucauucaggaauagagacaccgagugggcucgcaggcccagcuuuuauugucaagggaauuccagugugugugugugugugugugugugugugugugugugugugugugguaugugccccuuuaccgugauugguuagcucuacucuagggauccuucaggccaaaggacaagguguccucagauuggcugcccauggcugcgguuggcugaccacagguuccuggaucccaguucuguuugugggaaacacaaacuuaggccuagucucccaaacuguuugcagccugucauggagucagccuggcucuggcucaguccucucaccuggaagcccuacccauccauaguguggcaguggaacugcuuuagcuccuuuuuaaaagaaacuagcagccaggucugguggcauuagcuuauaauaccaguacuugguagacugaggcaggaggauugucuguuuaaagccagcccaggcuauagaauaaguuccagagcagccugaguaaauuacugagauccuauccccaaacagaacaaaacagggguggggcuggcucuaugcucuccguguuagaaugcaugccaggccugguccugggcuccauccacaacacugaagacaaggaaaagagcugaaaacuuguucuuaaccauacccaugugagugagccaugccugucugaaagugguuagaguacauuugcuucucucccuccccuucucucacccucucccucucccucacccucucccucgcccuggcccucaccuucucucgcccucaccuucuccucacccucucucccuccccuucucucgcccucucccgugugugugugugugugugugugugugcgugugcgugugcguguguguguguguauuaggaguagagugguuuuauauguagaagauggugcaucugcgucccauguguccuuuugugcaacuagaaauggaugugagaacaucugcagagguaaaguugccuaggguagugucuaagcaucuguccagguacaugcucccucagucacagccuagcgaauuugcuuacuguuaucgugcucagagguuuggggacugagcuuuccguuuuguuuuuaggagacccauguacagugucuucucaguuggaguuagaagaggcuuucaggcuguacgagcugaacaaggauucugaacucuugauucauggugagagagccaucacuugacucccaaagcucuaauuaagacauaacucuuuuauuaugugugcccuccucccuauguaauuggccuucagauucuuuuuccuggaguagagcaaguaagacgauuaugcgcucuauagucuaggagaacuguauaucuuucuauagucuuuuaggauacuaaagugccgucucccauugcuucacaacuuagacauuccugcacagcuuuagaagucuauuuggggugggggcaguggccacccuuuucuaguguaaaguuuuaaaauguugagagaaaugaucaguuacgcaggcaggcagcaccugccuaucguccuacagcuugggaggcagaggcaggaggagccaagauaggccacagcagccugagcuacauagugagaccaugucugaaacaaacgggagcugagaugaaacucaguuguggagugcuugccuggcacggugcuaggacuggaauccugcucuguucuguguacucuuccucaguguggcccuugcuucaccacagagcacauuaguuaacaagauagucuucguuaugaaaugcuuuguuugguguguugauaaauuuccagccuagaauauauucuuauauuggagguugguacuacuccugguauuaauucacucucuaauugaaugcauaucuuuuaaaaacugauuuuugccauuuaauucuuuguuguacaaaaguucucugcaaugaggauuuuaaaaguaguagugaguuucuuugaggaccaguguuuaaaaagugauuauuuacaggggacuagaauuaguaauuuaagcuucuaauguauuaccuauagacacauuuauuuucacagaaacuuacuuuauauagacuugguaaaagcaagagccuuuaguagacuaauauuagccauauguuggaauucugccucuaguaucucagggcacuuuaaauuuguguuaauuuuaauuuuguauaguuuguauuauguaaauauucugcugauuaauuuuaguuuauuuucuuucaguauuuccauguguaccagagcguccuggaaugccuugcccaggggaagacagugaguguucuagugcucugcacacuuauuacucacaguggaaaacuaagaacuuuuuguuuuguuuuauuuuuugagacaagguuucuggcugucuuggaacucucuuucuaagaccaggcuggccuccaccucucagaucugccugccucugccuccuacgugccaggauuaaacaugugugcuuccacaccuagcuuaagaaacagaacuuuugguuugugugacuuauucuguuuuucacucuaauuuagaauauauuacaacugccuaagcugugcuuuugacagaugggacucaccuaacugucuauaucuuacaugauggucuguugugcauaugaaaaggcauguggcuucauguuuuucaauguugaauguuuucaaaucugugggaaauuugaaaccucugagaaaaaaggauaccuccauaucaccagauuggacaguacuuccucagcguuuuccgugugccuguuuguuuaccugugcauguuuucuaacucuccugacucacucagcauauucucagucacuguuuucuuaugcuugcuauagcaugugagaauaauugacuagacacuccacuucuaggcaccuuuguagaucgcacauuguuaggaauuguuauggaaucucauuuucauuauaguuucacuacauauccuucagaaggaaaaguaguaaaugcuuugcuuugaauuacaugaaauuuccaagugucaaauuuuuuaaaaaauuuauuuauuuauuuuauguauaugaguauaguuucgcugcccucagacacaccagaagagggcaucagaucccauuacaggugguugugagccaccauaugguuacugggaauuaacucaggaccucuggaagcacucagugcucuuaacugcugagccgucucuccagccccccaccccccaguauaaguuuuuaauugugcugauucuaguggaaggagaguaaaagccaugcuggcuggcuguacagagcugcugcagacaguggcugucuucugugccuagagccagaauuuugaaagauaccuuguagcauauccugucuaagaguuccauguccaccccagcccauuuuagguuuaugguguccuucccagguaaaauacaguuccaagucuuuccacuauacugcacacucuuuuccccuuuuaaaauuuagugguggagggccagcaucaccuucuccccagcaaaauaaauauuaaacuagaguauagaggaaaauugauaaccaugacuguggccucuuagucauuuaaauccuugacagcaguaaacuauuuaaauuugggagauauauacauauauacauauacauauauauacacacauauauauacuaguuuauauauauauacuaguuuauaagagugugugguaagccaaaaugugcuggcccucgaagcauugguuuuugcaaaagaaugucuaguguuagcaguuuugcacaaggcuucuaguguucaaggcuucguuccccagcuccgcaacgagcaaaaagauugcuaagagcacuguagcugggacuuuguacuuuaacuugaaauagugaacucagugcuacgucugcuugaacauaguuuagaaauguucccuacuauaguuaccacugagggaagucaccaguacacaguacagugucugcagugucuaggggacagugcguguaagagugcuggguagccacauuacgaaggauuagauuugauuauuuggaaccucugccuaugcguuuaggaaugagacauggcucagaaguuaagagccuuuguugcucuuccagaagucccaugugguggcucacaguaacucuaguuccagggauccaacuuccccuccucaccuccacaguccuaggcaugcacaugcuauacuuacauauagacaagcacuaaugcacaucaaaaguaagcaggaauaauaacauucauacacagcuuaggagcgggcuaggcucuggcuaagaguagaaugcuuauguaacuaacaugucugaggucuuggguucaacaccuaguauuguaccagaaacaagccaaaaaggauaaacguuuguuguagaugaagugauguaaaauucacuuauaaauaacucgcaugaaguaaaauuaaaauguaccucacuacuuguaaagguaauuaucuguagugggugcucacauucugacauuuguaugccucuuugauguaauaccauaagagaaauauaacuaucuuaucuguauuuuuaagaucuauuuuauuuauuuauuuauuuugugggugggugggagggugcaugcacacacgcgcacauacacagaugagugccuaaaaguuugagagcaucaggaccccgaccuccgucgucugugugccugccguaacuggaguuagagacgcuugugaacugcuuuugauuaggugcuagaacugaacccaggcccucugcagagauaguucucuagucccuccucccucuaaagauaucucuacuauuuuugccaaaaguauuuagcacugacucugaucacccagagacagaaaaccuggauguggagcacagacacacugccuaaggugugaggaagacacggcggagcgagggcuuugauaaugcgaagaucagccgagccuggacugcagcuugcuccucuuuagaaaaggacagcuuugaaaggcacuuuugggacagcucaaucuugaacaugaacuuuccccugagggaugcuaaaguucauucucuaaggcacagcaguuacguuguuauuguagauggcuagagcggaugcccgagaucuuacugucaaaucauucugaggggagagggacuuuuguuggucuuuguucguauuuguuuguugggaaguuggcuagacagaagaguaguggcuguaaacucaggugaaggaugcaggcaggcauucccuuccucagcuuguccgugaguuuccguuuuucucaaacauuaaaggugagucccuuuaaagaaaagcgguacuacucacugacugcagugugggcacccuggugcuugcucucauccggcccuuuagcgaauccauuuuucaguuucuaguuuguguuucuguauuuuuuuuccagcaguaaguaugggaaacucagauuuaauuaaguggcuuuauucaaacuugcucuuuuuaaacuuucaaucucucuucagaguccauuuaccggagaggggcacgccgguggagaaagcuguauugugcaaauggccacacuuuucaagccaaacguuucaauaggguaaaccuauuuuauugaauucuaguauuuugagacgucuauuuuuuuucuuuucuaugagagaaagauaaguuuguuauuaagguugauaguccuuuuaacagagguaagcagcaaggccuugcaccccggugcuacggccccuugcguccugcugcgucagcgccuccaguuuucacagcccuucuucucagugcccugcacucugcuucacucugcugcacucauagccuucucucuaaaaauaccucagguuuuuuaaaaaggucaggcccuuuuuaaauucgaugaaugacugucauuagucuuagguuaaacuccuaaugucugcuccuuauugucaaaugagucugaaaaaauauauguuuuuagaauuacaaaaaaaaauuauguuuaaaugcauucaaauuggcagaaauuaucagaguuuauuguguaagcccuuuaaucucacuguuuggaaaacagugauaguagcaaacacuuggccagcucuaacucuguaucaguuuccugaggccuuuaccuguguugguucacuaaauccucacaacagcucugugacauagguacuauauauucccauuuuauagaugagaaaaauggagucuugccuuagaaguuucagccaguaagugcaaagccgggguuugagagcaugcagugugcuggcauagccacccccaccccagcccuuuucugacacaaugcuuccuuccuauguugcugcaguugcccugaugcuuaguauaccgcuggaguuagccuagcacucauggcagucgcuccugagugccucagugcugggagcgccugcuccuaaacaucggugucagcacgagugcaugccgggggcccuggcaucacugagauuugggcaccaggcucuaggagagcagggcuuuggcuugcccucuccucagccugcaaggcugcaugcuuuaucagccacucuguucuguguucauuacuaggacauuuuuauaagaugaggcuuucuugagugugacauuggaaagcggcauggcuguacauucacugacucuuugaaacccagucuuguucauuucucauugguccgcaacaaccuuugaagacaaauuaugagggaggagauuuuauuuuguuugaguuuugccauaggcugacaacugaugucaugaugagaggauuuaauuagagaagaagaaaagccacuuauuuuuaaauaucuuagguuuauuuguuuggcuuuuuugagacagucucacucuauagcuuugacuggccuggcaaucacuauguagaccagguuggccuugaacucugugugugugugccucugcaucaugaaugcugggauuaaaggcauagugaguaaacuguugggaaauaacugggagacagguaaugaaacccuggcgggccuggaacucccagugauccaccugccucugucuccugagugcugggauugaaggugagggccagcacgccuggcugugauaaaguggucuugaauuuacucugcagcgcgcccacugugccaucugcacagacagaaucuggggccucggacgacaaggauacaagugcaucaacugcaaacugcugguucauaagaagugccacaagcuggucacaauugagugugggcggcacucuuugccaccgguaaggcaugggguucuguuaguuauauacacgugugggugcuucaguuaacaaggcugaaacaggaaggcauuguagaacuacaucucaggaagucuugaaacugucuauagccucauuauuuuagcauaauaaauaguauaugucuugaccauacauuguuuauucuguuguugaacauuuagaucauuuucuagguuuuccuauaaagaaaaucauagugaacuucuggcaaauaaaucuuaacuccuuaaagguccaguaguagaguuacuugguuaaaggauacacauuuuuagaaaaaucaggauguauuuuauauuguccaguagaaugaucaccccauguuuauuccuagaaccuuguucuaggaaccuuucugucguguugugccaugacuaaaggcugcuuggggaaggagaggacuuaguuggcuugugcccacaggugacaauccgucagggagggaagucaggcaggagcuccugggagaacucagaggcuguggagcggugcgguuuacuaccucucacgcgcaugcucagcugccuuucuuaugcagccaggcccauuuaaccaggguagcaccguucauaguggaucagucagcagucaggaggaaccccucggugauguccacucuggcggagacaguucuucaucacaaguuccaucucaccaggugucgaguuggcagccagccuguuugggaaauaggucauuauuuuguggguagcucauuucugugaggauaauuuggcugauuuguucaaguuuuaagugaauuuauaguuuggggguugggggguggguuccagguuuuagggaagaaaagaaauacuaaaaauuguaagcauaauuuacccaacuuccuguuuguucugguuauuaacugucaaucaacacaaaguagaauuaccugggaagucuucaugaggaauuacgucaaguggauuuuggguggugagauugcuuugcuccguaauugagguagcaugacccucucugagagaggcaguacccacgcaggagcgggccugggugcaugacuagagaaggcugcaggccugccuguguccauuccucuuaugcuuucacugugacugacugucauggcacuagcugcuucgugucuuccuugacauguguccuccauggugaacggacacagccuggaauucauuguuacccuucucagcugaggugcucguuugucaguauauuuuaccacaggaaugaaaaugaguuuccuugaguagucuuaguugguaugcacauguaugggagggaggagguggccagggugagcgaguguaugagaugucgggguggguacugagcgcaugcuuaguuagcgugaaggcauccuagaguuagaacugcauaccuaacccucaucguaugaguuagggacaguuggccuggggaagccuugucccuagggugcuggcagggccuugcuugaguccaugucccagagguguuuguuccuguuuucuggcccauugauauuuuugagaauauauagaaaaauaggaaaccuacaaaauauuguguauagauuuaagagguuuauagacucuuacagccaaccucuggaucauagcaagaacuccuguucuaaaccuuucugccagagauuuaaaaugcagcucagagaaaaaaagguaauuuagaaggaggagucacaguagauaguucaguuuuauuuucaauugaccugaagucacuguguuuuucuuuuuuucugaaaaaagugcaaaaucacaucauucauaggaguauuguauggcuuuauagagcuaaguauuauaaugauaaugucauuuagaguuuuucacaguuaagucuugguaggauacaagucauugaaauacuguauuucuggauuuauagagguuuggggaacuuaaagaaaaucuucuaagucacugucuuuggcaauguuuguaggaacccaugaugccaauggaccagaccaugcauccagaccacacacagacaggugagugggagcagccgccccaggugcugugggugcuugcuuaaaguguccuuucucauaguagggcagcuggcuuccuuccuuccucccuuccucccuuccucuuguuuuuugagacaggguuucucuguguagcuguggcuguccuagaacucacucuguagaccagagauccaccuaccucugccucccaagugcugggauuaauggugugugccccgccaccuggcucauucuuucuuuuuugaauuagcauacagaguauaagauuucauuauagcguuuucagauaaaacugguugcuucuccucuccuguuuucuccuacauguccccuauccuaagcccuucugcccccaggagccuccucuccacuguuuugcgguaacuuuuuuuaagucuaaguuuaaaagcauauuguaccuaaggauauuuuguggugcuaaaacuggucacaauauuuuaguauacauauuugaaaaaccaacuguguaaacuaacaguuggcuuucucaggucaaaaaaauuauuuugagaauccuuuaaauucagcaaaccuaguuccuuuuucacagugagaaaguacagagguguuuggagccaugugacuguucuggaaaugugggguacagcauagcagacugacugugagauggguguaguguuaagcaggaauaaaccuuaaacacgugcuugggaaacucugaagcuauaagaagcuuucuggaagggcagacggguccauuggucauagaagaagcuugaagagucugagccaagggccugucacucccggcaucagcagccuugaggaguagagccccgccuugucagcccuucaucucugauggucaggggcucuuaaaguggagacaggagcugaagaccaugggcucaccguugucuuggggugugagagcauuaaguaggacguguagucacaugcacagaccagguuauucauaaggaggaggagcagaguugacugcugagugggcacccuucucugcccucggggcccgggaggguguuucccuggcuguccuggaacucagaucugucugccucugccucuccaaguacugggacuaaaggugugacccaccacugccugggccacaacucuuaauauauaauuuaggacaaauauuaaacuuuaauuaaacuuacucacauguaaaaacuaaagaaaagccaggaaaagaaaaauuuuaaauaaaauucauuauuaauuauuuuucuuuuuuaauauuuggguuugaauuuucaguaauuccauauaauccuucaagucaugagaguuuggaccaaguuggugaagaaaaggagguaagauaauuugucuaacuguguacagugucuuuagcucuuuagaaagacauaauucuuuaagaauauaacacuuuggggcuggcgagauggcucagugguuaagagcgccaacugcucuuccgaaggucccgaguucaaaucccagcaaccacaugguggcucacaaccauccguaacgaaaucuaaugcccucuuggaguaucugaggacaaacacaguguacuuacauauaauaaauaaauaaaucuuuaaaaaaaaaaaaaaagaauauaacacuuugaccugcuuagauaauagaucauaauaguaaaauaugaggauuguauuuaaugauuuuagaguuuuauuuugauuuaacuuuuuaauuaaauaauuuuaauuaugaaauaauuugaaaauuuaucacuuuaagauaguauaaacaaaaauuacaaaauauaugagacuagcauuuaguaauugauauuauuugaaacauauuguucauucuuccauuuuguggacugauagcuuauuuuaaguauaaaugauugaaugucuucauuaguaucugaagcaucgucuguguaugauauucagggguggggugggccugcugcucugugcuuguggaggucaaaggucagcuuuguggaguagcuacucuguccaaccggcuccugggauccaaaucaaguugcgaggccugugugccagacacuuuuuauucugccugcucuaaggccacuugccuuuuuuuuccuuuccuauuaggcaaauuguuggguuuuaauauguauuuuuauguguaucuauguaagagaaugccauauaugugcaggcaguuauggauggcagaaggaagggcaugucagaccaauuugagcagucgcuaugcugcugggaguugccuguguggcugccgagcucugauccuguguaagaacaccguggucuuaacugcugcgcugcuucugcagcccaggccuauuuauuucuaagacagaaauuaauuaaaacagugaccaguuuagaaagacuuuugguaaagaagucaugucuuaccuauuggcauggaggcagccuuuucagccauuuuuaguugugcauauagugcuuauagcucugcuuuucagauguauguguuuuuggccauggaaaaugacuccuuacccuucuccuuucucucucuaguguuugauggguauguuauuuuggguuucucuuguuuaacuuucaacuguuacuaugaaaauuauggacagaauauuguaguaaaguauuauuaacuucuuuaugaacacauagugguuaaucuuguccacgcacuugcuuuacuccaucauaauuuugaaguaaaucuguugacccaauuuuuuuuuuuaagauuuauuuauuauuuuauguaaguacacugugguugucuucagacacaccagaagaaggcaccagguaucauuacggaugauugugagccaccauguggcugcuuggauuugaacucaggaccuuuagaagaacagucaguguucuuaaccacugagccaucucuccaguccccccaauuuuuaauaugacaucuuagacucucuuucuaauuuagucaauuacuuuuuguuucuuuucuucuucuuuuuuuuugggggggggcgggggagugucaaguucuuauguagcccaggcuggccuggagcucccugcauagcugaggauggcucagucucuugauccuccucacucugccucccagaugugggauuacagauaugcagcacccugcccagccagcugcacacauaugaccgcccugcuuauuucucccucccccuuuccuccucccuccccccuuccucucucucucuccucucucucucucucucucucucucucucucucucucucucucucucucucuuucuuucuuucuuuuuugguuuuuucaagacaggguuucucuguguagcccuggcuguccuggaacucacucuguagaccagauuggccucgaacucagaaauccgccugccucugccucccgagugcugggauuaaaggcgugcaccaccacgcccggcuucucucuuucuuuucuuucuuagaccacauguuuacuuuuacauugccaggguuguuagcacuauaggccaucccaccacuguagcaaaaccuuucuuguuuuguuccuagugagucagacaaagggagaaaacccuacuaauaaggccugagaccucuguucugagcccaugugcugcacaugcuucucugaccagcuccucgggguccuuuaguuccuuucugcuccuuuuaaaacugauggcauuuuuaucaucaucaucaucaucgcuauccauacugcgugguugcucacuauugagauuuguaagaccuuuuaaaugauaggcgcauauauagcaaacacccaaacgauggcauacagcuagaugaauuuccaagcagugagcacuauguaauggccuggcuuguagcuucugguccccggcagucccuucuccccugcccuaaaacuaagcauggucuguaccccuuggaucaccuuugccuuccuuugcucuccucccagcuauagaaacagacucuugggacaugcaagucucugccguccugcauggcacguagaugcauaaacagaacagucucccuucguuuuaccauuuccauugucuguccacugcucagucuccccuuccgguggcguuauuaccaugcguuaugaggagacaacuggcccugcugcugaaaggcugucaucccacccccucaggaggcugaggcacaaggauaacuuaaagggccuucuggcuacugagccagcuggcucagagccugccuggcaaccuagugaagaccuguuucagauugaaaauugaaaauuuguuuggagaaguguuuagugguaaaacacuaacuuagcauacaugagauccuggguucagucuuucauaucacauaaaauacauaaaaaucaguucccagcauugcaugaaaaugugacaauguaaguaaauaaacaaguuaagugcaugaccagucgccaugcggagucacauguaacuuucacuggaagagacagugccaguuuuuaaucgugacuuuacacugccaucaacaguaaaguucaucaugucucuuaaagaucgaauguuuuggaauauauaugcgagaaaagaguuaagaacugaaaauaucuuuauguuaagaaaauaccuuaaaaucauccucauuagaacaguuuguuagaaguaaaaguuuuuaaaagguuguugcuguaaaugcucuccacaggcaaugaacaccagggagagugguaaagcgucguccagucuaggucugcaggauuucgauuugcuucgaguuauagggaggggaaguuacgccaaaguacuguugguucgguuaaagaaaacagaucgcauuuaugcaaugaaaguugugaagaaagagcucgucaaugacgaugagguaaguguggggcuggggguggggggggauggugucacuguuucuagacagaccucacgugcgcgagacucuuggugcaauccagaguaccacacauccauguacacaugcacacgcacacacacacauacuauuucaguguuuguggguuacuuucuaggcacaugcuuuagguaaaaguaaagucagagcauauuaucaucaagggaaguaucauuugagcuuuccuugcuuucuagacuauuucauaauacuggauauuugucaaugguauucucucuuuguauaagguuuguuucaugacagugugugguuuugauauuuagucuguuugguuaacacuugugaucauugacuugcuaggaacaaauuuauuauuaguuugggucaucucauuugacacagauuucucugauauuguaaauaggauaucgauugggugcagacagagaagcauguguuugagcaggcguccaaucacccuuuucuugucgggcugcauucuugcuuccagacagaaagcagguaaggcuaaaggauaacaagugucauuaggugucauacuuuuuggcauguuauauaagaagacucuguuucccauaauucuugaaguaggaggacuacuuauaauuuccugcuacaaucagugauaccaauuuaacaccagucacucauagacauauaaggaagaaaaagggagcggggaggggcucuucagaagcagcaguagcuagccaacccuuuacguauccuccggauucucgccuuaugacauaaugucucauuaccugaagugacauuuaaacaugacucaccuaguuccuaagauugcagugaaacuccuaagagugggaucgauugguguagaaguagaaguugggucacaccgggucacauguguccacuaagggcaaagggugagucaucucaagagccuucaugcugcucugugggagaugccaggagccguacgacuaacugacgugugcuucuugccucuucucagguuguuuuuugucauagaauauguaaauggaggggaccucauguuucauaugcagcgacagagaaaacuuccugaagagcaugccagguaaguguuuuguuugaguuggauuuuuuugcucagggcugccugaccuuuuaugucugcuaguugaaaacaguacauaaacaaguuaucuuguuacaguuuauucuuuguaagucaugagguaguuaaguuacauaauauauuauaucuaccacauauuauuauaaucuguuguuuguguuuauuauguguuuaggguuuuacagaugguuauuauucauagcaaggccauauuuuuuuuuucaauuuaagguuuuacucugcagaaaucagucuagcacugaauuaucuucaugagcgagggauaauuuauagagauuugaaguuggacaauguacugcuagacucugaaggacacauuaaacucacugacuacggcauguguaaggugagagacccccuggauggcuuguaaccugucagcuaaguaacuucacacuuagaugggaagagaucacugccuuguugaggaugucugagaguucuggucugaagacagguguacucucuggccauuuggccacguggagaacuccaugucuucugugauguguguuauaaaugggccacuuuuuaaaaauugguuguagcuuuuuuguuauacuuuugaagaaaauuuggaaauaacauuaccuacaguccuguuacguuaacacaguauuugcaugccaccuuccaagcuuuuaccauuuaucagaccugaaccuacuuucacauuuuuccuaggcaucuuuuauauuuaacuuuuaaaucucugacauacaaugugacauucaaucaaguaagcauuuuacuuugucucagaauaugucuacuaaucucgcuauuuuacuccuuuggcaacaguguuuuacuuagagguuugaucuuuucccacaaaaugucuagagaacuauucuacuuauuaacccuguccuaacaaaacaugugcgagugugugagugugcgcacugcauccccauccaucaggaggagguaccguaaacacacacaugguaaugaggauuuaaugucacccugcacaccuuauaucagguaguaaagucaugcaguguauacaacucaagaccguuuuccugucaugcaccuuaagucauucucuuuguaacuagggaagaggguuaagucacuggacccccugcaugccucauuuguauucacgaugccuuuuugcucugucaugguuuuccauaguguucuucucucugguuuuaaaacucaucacaauaauaauggauucuuacaaguuccaagggcaaaugaaaagcaugcagaguauuaaucugcaaguuagaacaguguuuuggauuuuuuuagucacaaucugaauguuaguuaaaauuacagguagcuugaggaggcagaggcauggugacacaccucuauagggugaagcagggugaucaugagcucaaggccagcguggacuggacagcaagaguuugcccaccgagccaucuucccagccugggaggaaccuuucuuucaugacuucuguccuucccuugucccccaaacauguauguccauauuuauacugugaugugaguauaugggacacauuuggugguuggcuugguuuuauuuugucuuuguuuugguagguguuucuguuuggcuugguuuuauuccuuagaaacaaaauauugguguguagcugagauugacccugaauuaacaauccuccuguuucagccuuccaagugcugggauuacacguggaccaccauacuuuuuuaagucgucuaaaaaucacuguuuauuaguuauugguguauaggguauguuuucugaauguugaaaccucauaaucaaagaccaugaaauuuuccuacuguguucauuuuuauucuuuuuuagaaaauguuaguagguauacagaaacuuauauuuguuacagcucuugauggguguuccauuuauuguuggguuuucucuacuuaguuuauuugugcauuguucaccuuccuacagcuauuaaaauaucaaagcagaagacacagucgguaggaaagaaaacaucacaaugucaacagucaugaaguagucacuguagucacaugaucucuguuuucauaguaaauuuuaauaaauguuauuuuaaaagcaguuuuauguuaacugaauugacuuuagcaacgucuaaagugaauacguuuucuuuuacucuguuuaguagugaucacuguuccuagugacgcuguucagguuuaacauauugcauauacaugcugaguuuagacacaugaaauggaagaggugaauguaaaaugguguugucucuuaucuuuuccccgucuucuccuuuccuuuuuccccaugaaaggaaggauugcggccuggagacacaaccagcacuuucugcggcacucccaauuacauugcuccagagaucuuaagaggagaagauuaugguaauaaauuaauaggugguauuuuagguguuacuauaauugguaccaacuacaacauaaauaguauagcauuuuaauauucacuaauauauaagccuuccuuaguucaguuaaccuacguggagacccucagauucugaaacuggacccauccauaaaagguuugacauuugggagaauuacauuuaaauaguauuuuacuagugacaagaacuaaacaguggcaagaacuugguaagcaguucacucuaaauucccucacaagccuucugagguacauguugacuuauuugacaaagaagggaagcaauguacagaaaagcuuaaauuauaugccugggucacaaaagccaaggcagugcccagguaugcagguacguauuaacucaucggcuaugugaauccagggucacgaacuucagaagauuguucagauucaggggauauuucccuuaguguucuaaaaguuccuaaaggcugggggccugauagguaccaggaaauaccuaccuuccuuccuuccuuccuuccuuccuucucuuuacagaguuagggugucucuacauaacccugucugcccuggaacuugcucuguaaacaagguuggccucuaacucaguuccuccugccucugccuccuuagugcugggauuuaaaguauggaucuuuggcggccauuacuuuucuucacauuuauuuuuauuaguucuuuugagacuuuccuacaauauauuuugaucacaucuacccuuuccuguuccuccuguaugcccccacugccaacuucccuaauccagcuuugucuccuccuccuuuuuacccagcuaguccaugcugcccuuguguucuuggaucuguggacuuccacgggagcauggucaacuugcagggaacaacucuuuuagauaaaaguuccucuccuguagcuaucacuugccauagccccgccuguccaccucgcuuaccaugcugggauuuggucugacuugaauuuacacagggcuugugcaugcuaucccaguuuuugugagcuuguguguacagcugcccuacuaugucuggagacauguuuucuuauguucacccuccaccucugguuguuacagucuucccccuuucuacaaugucuccguaugcuugggagaaggaacauauauguugggagaaauauuaaaaaaugaaccggcauguucccauucuugugccucugccucagcggccugaccagcaaaaauaucucguggagacucucugaccuggaguucccaaaacaucuucacccagcucgcuaaguucccacuggcggauaucuaccaugacagcccuaagcuucaauccuccaaggccuguguaguacaccucaggcaaaccugugcuuugccaccagaagagccgaugcuugaaggaaaacgcaacacaaacuuaguucagaaacaauugcuggcacaacaacaaaaauccuaacuuguaagccuuauuaaaucuaaauccuccaguggcaaaauccugacagaucugccauugaaucugggagacacuuguaauuacaucuuguccucaugguaucccuguccaaaaagaccuaacucuuuccugcuuccucuucuuccuccauccaacucggaagucccuccuacucgcccagugauuggcuccuuuaaucauuaggggguugguucacaagaagucaccugaguaugacucacuccucccaggagaguggaauuagcaucaacauacaaacagcaccaggcucauccacacacauacagauagucauuuuaggguugcuuggaccaaguaucucuguaguuuuuagugccuaccauauuauuuauacucuaauuagacuuugcuuuuccauuauguuuacauuuccaucucaugauaaaauaaaauuucugggaggcuggagagauggcucagugguuaagagcacugacugcucuuccagagguccugaguucaguucccagcaaccacucacaaccaucucuaaugggaucugaugcucucuucuggugugucugaagacagcuacaauauacucaaacacauaaaauaaauaaauaaaaucuuuaaaaaaauaaaaaauaaauuucugacugcuggauguucacacaugcagagaagguuuauuacuuuaaacuucucucuaaaggcuucagcguugacuggugggcucuuggagugcuuauguuugagaugauggcgggaaggucuccguuugauaucguugggagcucugacaauccugaccaaaacacagaggauuaucuauuccaagguaauuugcaauacuucggggaaauucugugaauaaccuagagcaaaguaagggcucucaaauuaguauucucaguuaaaaacaaggagaguaauuuggacacacaccugacuucaugauaguuuggagaauuuuuagauagucccuucccacuucucuagccuguagcuucgucuguaauuuccuucccacacucaauucauaacaaagcauuuaaaugugucgucauacaugcuagaacagggaacuccuggggagauggaggcaucuguuagagacuaaucucugcacaugagccccagacuuagugcccggguucaagaaaaguggagugugauugugauccaagagaucacagagcuuugcuaaggccuccucagggagggagugucauggugaggagugcugacagucaacagagcagagggaggaggccaagcacaggaccucuaccagaaagugugcagcagccacagaauucugcaccuaauaguuaagacccucacaggacaugaggaaguguuccauagaauaaggaaccagagugccugccauuaagacuauagaaagagaaugcaaagugcuaaugagcuacuguuuccugccugugccccugacagagauuugagauugagaguaacugccugguacugaugaagguucggagcagugggaggucuucgggacugcucguggggguugaaguugacaggagcuuugcagaauaauuucacauuucccaguacaguucuguguuacauauauaugcaaacacuuuacaguacuaacuuuuguaccucagaagagccccgugaagcagggauuguuuuuauugaggcacacuaaguugguaaaaauaaaccaggcuuguaaauaauaaaugcaguacuaaggcaaggggccagcucugagaaggagagccaaaggcaaugcaugaaguguugcacuuaugcagaugauguauauucugcuaggaugccuuaaauagcuugggauuuaaagaaaaaacuuagauucaagccacauaaacacuaaaaaugauacugugauucuuaucuuuuuaagucauuuuggaaaagcagauccgcaucccgcguucucugucuguaaaagcagcaaguguacugaagaguuuucucaacaagguagggaugauguggacacucuucugugcuuucuucccugaggaagcagagcgccuugucggcggaggcucaggcgcugggauguuucagagcagggauauguaacuuuccaguuagaacuggaauuuuguuucauaaccagacacagggucaaauccugaccugauuauccuugucauguggccaauaucauugauuuaccuccagcuugaccuuuaaauauaaaugauacacacauaugcucuccucagugaaggaaaauggagucuguaauuuguuauaacugcauuuuuagcuguguuucuguaucuuuagccauaaaaccgauuucucaccaaguggccaagaauguucucuauccauuucauaauaacucuguauuuagauaaaauucagaagaaauggaaugagauccuaaaauguaagcaucauucaguugcuuguggaaauugguaagccagaagcauuuagguucuaagauugugaauuugggauucauaaaauuuauuccaaauaaaugaagguauaaaauggguuaccucugugggcacauaaggaugaaauuaauaaaauuggaaaauugcaccuagugaagauggcuauguuuuuaucauguguauguguguguggguguugugccgguguguaaucuguagcacaugcgucacuggugcccaggaaggguagaagagggcacuggaucucccgcaccuggagguagacaugguuguaagcagcuguggguguuaggaauccaaccugaauccucaggaaggagccaucucucuggccccugcuacaaugucuuaaauaucuuggaauuuaaagaaaaaacugaaagcuuuaagccacauaaaagcuaaaaaugauacugauucuuaucguuuucaucguuuuggaaaagcagauuugcagauauuuacacgagggaggguuuaaacugggacgcuucugcacuaugaaaagugaaguugagagaugcuaauguauaaaauaaaacgccuuucacccagaagaaaacauuguaauccauagagcaaaagcuaaguuccagccucugccucgguccagugaucagauaauucugugucauugucuuagacaaauuaggauuuguugcugcagaggcuuuaacgaugagcuaaacauaagugugcuguaacguccagagguugcuguaauuauuaaauuauuaugcugcccuuguuuuuccacauucuuuagcaaagagugaugaaguacucuaccauuuuaaaacagggucuuauguagccuaggcuugcauucuaagauucuaagauucuaagauucuggguaugccccaccagggcuggugacguggugaguugauaagagccaggaggaaaccuuaccugcugugaccucugaauuacucacuuggcucuggaccaugcuuucuagaaauagcuagacauuucaacuucacaaaugaagccaucauaaaauaggaauuauacuugucuaauuccugaacacuacucuugcuauaggacccaaaggaacgauuggguugucacccucaaacuggauuugcugacauucaaggacauccauucuucagaaauguggacugggacaugguauguaaauuuuauuuuccuagcuuggguuuuaguguaaucaaaguccaauuuuuaucauguuuaucauaaguuauugaaaaacuaagauauuauagcuuaaguaacuuaaaacuacucuauagcacuuauauaaaacuuaagaaacaaacagaauaguuaauguacuggaggaggucauacuggggccaauagcaauguuccucuuacuaagauuuggcuguggcugcugaucuuguguagcagcauacauggugagacaucagagagcacaucaaagugugaggggcagugucccaagugcacaccucggcugucgugaggggcaaugucccgagugcacaccucggcugucgugaggggcagugucccaagugcauaccucaacugucaucugcaugucuuuuagauggagcaaaagcaggugguuccacccuuuaaaccaaacauuucuggagaauuugguuuggauaauuucgauucucaguuuacuaaugaaccaguccagcucacuccagaugaugaguaaguaauuauacacacuaaaaguguucucaaguuucuuuugaaaucucugaaaccuuaaagcuauuuaauuguuuaugaaauuauucuaugguuuauacguaaccauuacauugcuggguauuugaaucauuagcuguuaaaaucucucuagcaacgauuguaucuacuaacuuguaugguuguuccaguucucucagcagccucguaagguggguauugucaucuucacuuuacagaugaggaacuaaggcucagagagagagcaagagcaggugucagggcucacaccugggcugacugaccacggccugugggcugcauggcuccauucuaaauaugccaucuccucuaguuucugggugucccuuguaagagugacagcaaguuucucagucuagccagcaggggucagaauggugucucugucgcauccuuuaaaaauguaauuuaaagugauuugagaucauuuugauucauucucuuucucccucacucucuucccccaagauauauucucuuauccuaaggggccucugcuccuuggcauucacuuucuuuacuuacaucuuaguccuagcguccuucaaagcuguuccuuauuaucucagguucugaagccuucucucaguggaguguauguaaucauuccuugacuuuaacuguaagaaucgagacuucucugauguggcuugcucccuucucagaugaacucgggcaacucugugucucaggacugucccuacuaucuauucugggccuuauuucgccuccugcuggggaagagcacucuucuggaagcacugcugucccaccaccaucagccaccacaccauuugcgucugccuucuccuuugccagcugucucauugcuuuaccucugaacacuuucuuccuaccuaaaagcacgcuuaguuuugcuuuuccacagaaucuuauccccuuuuuguuauuuaauucuuuucauuuucagacauguaaagaaguaguuagugauguucuuacuaaagagggguaagcggugucuaccagacucucucucaucaggccagugagcauuggcugccucauauguucuuaccacagacgcuugccucuuaagcuuugccagaucaggcuggcuucuuacuuuccaaguuucaaagcacuguuuggcuaauccucuucuccccuggcaucuguagaagguuugacauccugagcagugccaguuucaucucuauaacaauugccuguuaucuuuuuccccuuuguaugucaccaggaugcucugggcucaguaccugccaacccucuuugcaauauucaguuuguaccuuagaggcugcagcaggcccuguaugguagauacuagcuguuuagugacuacugaguaggcaaaugaagcaaaaggcauugcgcuaagugcuagauguucacgggugaucaaaauagugugguuucacacaaagcuuucugucuaguaggagagcuguagcagucauuccccacagagcugugugcuagaaagaacagggaguucauaagagaugcucaguccauguccuucuugccagcugugcacccugcuguagaauuguauaacuucucugagccuguuccuucucauugucucuaccucacaagguaccuaugaagaaguaagugcaagauggcuucugaagccuccuacugccccuccgcagcucuccugagcacuuccaucuguuuagcaucuccccucagauagcuugagucuaagaaccuuugucuacuagccuuugucucucucuguucuuugccacuccucauguccgcccauugccccgccgccgucugcuccuguaguuguugacaucuuucacuccucagauucuacagugcccacugcugaugggcuugcgugguuucccuuuaacacuugaucugagcuuccuuuucuuaucauguugccuuaacccuagauccagacucuugcaaaucaaacuaaaaauguagugccuacuagcugauugcuucaugccuuuaccauguuauuagggcuuccguucuucagcccuucaucagaaaccuuccagguaacagcuguccucuugccuggcauuuuaaccuacucaugccaacagugccccggcacugguccugccugacuuuuaggcauaucaccaagagacaaaagauguuuggagcaguccaccauuuaccauucccuuacagcaggugucacucucucugucuugugucuauuuuccucuaucguuuuaucaguugaaaugaucucauuuauuucagacaaaccugaaauacagcuaggucuuugauugguggaggugaaauaccuuauauaagcaucauuagcgguuuuuaaucuagccauggcguucugccugguaucaccuaccacuuagcacccuucuguuccuaaacucuuugauuuucuugcauuucuaacagucuuucaaauuccacuucuauaaugaaugcugauuuccuugauuucugcagcuaaaugucacccucccgguauaggugugguuagcucacacuguaugagauuuagcagacagugggguuugggagaugggcagaugcuugccauguaagcaugaggaccugagcucagaucuccagcagcuguguaaagccacgugugauggugcaugccuguaaugccaguacucgggaugcgauggaguucgguacccucgagugagguggagagugaucaaggaagacucuacaaguguguguacacagauguacuugcauauauaugugcgugugcacacguguacacacacacaauuuaucagauaacugcuuucucuuaagacuuuccugcaugaggggccaugcugucuguagcucugugcuuugcauuucugccuuuuaaaaacccucagucugauucuggacccucucgguuauaagguugguugcuuguagggcucuuagucuucuugugaggcuauuguuuuuccugauucuucuagaacccacuuugugauuaagaacucauuuuuccacaguaaugucauuuagccuuauguuuucaguuguauuucaguuugaaagaugaagauaucuugauuaugauaaauauuuguguuuuucuuucaacagugacauugugaggaagauugaucagucugaauuugaagguuuugaguauaucaacccccucuugaugucugcagaagagugugucugauucugcuugccgccauucagugcauggauauccacccgucagccugcucacaguuagcauuuuauguugccccugcagaagucgcucucgguauccuguuggagacuaggaaucauacagauaaauagaacuaagaaacagaagcuagcuuccugacaaucaugucgacccugcuuaugcuugcucuccagacacuccuaaugaggaaggacggucuuuguguaaaggaaacaacacagcuugucaaagaaagccucugcugcguugugacacucgacgggaugacaucaucagucucccacaguuguugucacuuuguguuaagucauugaaggcuuaauugcgcaguggagggccaugcagaguagugcaucugcuaguguuacugguugccgaggucccucaguuuaagauuuccuccuauaaauaaaucuucucauuacuuuggguaauuaauaauuaugaauuggguucuaaauuauuagcuguguuucaaaaacuggcacagugauuuauuuauuuguuuuuaauuuuuuaaaauuauuuuuacacuaagggguuagcuucugagcuugccuuuucagugaaaacuagcaugcugauguguguucagaggcaggauucgagaguggcagcugcucacauacaggaaaaaguagacgucuaaaguagcuacagaaagaacgauuguagcauuuucuuucuuacuguagaguaaauccuacaguugguguuuaagauuugauguaaauaaugaggaggcucucacuucuuagccagcuuagaaaagcauuccguuuauucaggggaagcggagugaauauauuuuuauuauuauuuaguauaugggaaaauaaauuaucuucugaguagaaugucuuaacuacuuuugguuccuucuccagaguacauuaucuguacuuugaccuuucguggagucugcggugaaauucaagaccaaugaugaugaccacggauaacuauguaacacacacacacacacacaguuccagcucuuccugagcuccuaugucauagcuaacaugugauacagagugaaauccauuucagggcaggguuccucaguucucuacacuauuuuuauuaacaguaaguaguauuuagcaaucucuuauuuaaagaaguaccguuuuaagcaccauucugcuguuuauuuuaaauauuuuuauauaaaggacuuuaaaaugaucgucuaaauaagcuacaguugucaaaucaguaaauuuaacuuuaggaacgccgcgcagugcugagcuugugaugauuuaaaaccuguaggcauuugaaaaucacuuggagaaugcuacguuucauuagaagugugaguugugucaaguuugugucaugcauuuucaaguaauguaagacagagagcagugagaacccccauugauaaagccaacaaggggccaucgaggccacuugccaaaaccugaagaccugaugaugccugcagcccacgggcugguggccauggcgcgcgcagcccuccccugcaggacauaaaugcgagggagcagaccaauaagugcagugcgugcgcugacacauuucauguugaaguguguguuuccccuaagaccuggaacagcugucuuaaucuaaaggcagcauucacgcccuaagcugcuaggagcucggggguguguaugcugugaccuaaguggugcucucccuuggggcauuuuagacugagagcuguugaagugcacaguguccagccugccugggacucuuuggggcuuuguauuccauuuugagaaacuuuuucuucagguuauucuuuuucuuguggccauauuucuuauuggagugugagucuguguuuuuuugugaaaaacauuuuaagaaaggauaaccagugaauuaucaugcauuugucaacaaacuuagaugaguaaauucaaguuguaugucuucccuacccucacccacaacaaaaccuguacauuuucugccaauaacauuuaaaugaugaacaguuuucugugauaagguuuuaaccauaauuaaugguggucuuuguuuuuaaaucuuuuuuuuuucuuauuguuguuaacuaauaagacuuacuauguguguuuuauacagaauuauuacagaugauuuuaauucaguucuaguuuucaguccuuaagugccaugcaaacucucuguaugugguggaagccuccuucucucagagucuccggggagacaggcagagggaugggcgcuuggugucuuagacaccacuuauguugcauaagcuugugaucagaucgguuuaucacaugcagcuggaugggugucuaguuaucugugucccuguugccaguacuuauuuagaaaauuguuuuaauuuuuaucauguagaacacugccuuguucacuauaauguaaucuguauuuguauaauuuuuuuuacauuaaaaucuuuaaauaaaauguuuaauaccuaugaggaguggaccauuuucaacuuaaaaacaaauguuccgggcuagagagauggcucagugguuaagagcacugauugcucuuccaaagguccugaguucaaaucccagcaaccacaugguggcucacaaccaucuguaaugagauaugaugcccucuucuggugugucugaagacagcuacaguguacuugaauaaauaaaccuuaaaaaaaaaaaaaaagccguucgugguggcgcacg

SEQ ID NO: 1384 - RNA, 27868 nt, Mus musculus
agcgggacaaccacaaaauucugguaaaaguuuguaauuuuuaauaaauauuucuuguaauaugugcguaauaaaguacagagaaacuggggcuagagggagaguugagcaguuaagugcacgugccugcuauugcagaaggcgcugguucaguuccgggcacccacauggcaccucacaaccaucucuuccauccucuguaggcaccagccauucacaugguaaacauacacacaugcaggcauucgcacacauagaaacagaccugcuaaauaaaugaaaggaaaauguccaucguaggggaacaggaaaguuagcaguugauaucaagaugacuugaaccaaacuucauuggcauuaaaaguuuuuauugggaauaucauccaaucuauacaaguuauguacaaggcaugaaaauggcaaacaucucaaaauacaauugagguauaagccaagagcacaguaugucauguuucaauaaauauaauccaaaauuuguaaacuaaguaaccagauagaugagucuuuuuuuuuuaguaaaaccauauaaaauauuuauuucacgugagguagaggacaguuuugugugucauguaaugcaaccaaccacagcaauuuuaaucauaaaacuauaugcauuggcaaaauuaucaauuaugcucaauguagcuaauuuguuucaguaguugcagaagggaccauucacuuacugccuucacagguuagaaacugaggaauaauugaacuauuacacugccuuaaaauuaccaagguaaguccuuccagcagagaaacuaauggugacuacauuuaucccaaacucuaacaacucaaaagauguccuagguuuagcaauuauuuuaaugggguuuucaugagaauuacuuuaaaugugcugugcuuucuuuauucucaagugagguaucuuauauugaagaaaaaaaucuuauaaauuucuuuuauacuaaacuaacuuuaaacacuauuuuguuuucugggcuuaauuuuaaaauguuuuauaguugaucacuuucuaauuccaaaacuguagcacuauauaagacauuuaauccuauuucuaaacaagcuucaaauuguauuauauauuuuaaaagccauuuaagugggaagauuaaaaaagacuguccuuuuaaacaagauacaauacaaaauguccauauauguuuuuucuuccaauaguggaaaugcuuaaguauuuuacacuagaaaaaaaaaaaaaaaaaaaaaagguaagcucuguuuacauaucucaguuccacaaguaaauacauaaugcagcaguucaugucacacacugcugauugcuuccauggaaccauuaacaaguagauccaaguucaggagcacauguacauagcaugaacacaauuuaccaucaguuuguaacguccugcccuaaagaguaaaugcauaacaaacaaaaacacacauccuucccuccucacucagagcacggcauguggggcaggccuuccagaggggaugcagacccccaggaccagcuuugcagcuccugcuagggaaauaccucgggcacaguuccuauuacuugugcuuccuuuucauuuugcuuuucugcagacaggaaccagagacacacagacugggcgcuucacggacucugaaggauguggagagccugcaaacaccucaguuacugguucacugacuucggucugcacauaaacuucacuauguacaaaucagguuuuucauuacuccuucccaccccuguacaaaagauuuuacauauaaacagguuauauauuaaauauguuauaaaauuagcucaagaagcauaaaacauccuuaucuucaaaaaacacaagagauucaagcuaaagacuauacuucaaaacuguuaaagcccgagccaaaccuaaguugguagaaucuuucggugcucagucucagcugugauuggcaggugguuuguuuaaacuccuccuugauggcacaggagcuuccacacuuaaguacuuggugcaaagcccucagucuggaccacagagagagaccacccauagcaacgucagucuuugcucaguaugaaagcuaacgcuguguuucuuccacuccuaaacauaguuucucagaauaaauggucucauuccucccuaaacagaguauggacucugaaggaaaaucugcuugccuagugaacuuggcauagcacacgagaccucacaccaaagccaaccuuacgagagcaaccagcacacagaaugagcaugcacgaaguaagcuucaucuggauauuuuagcagaggucacuugugggguauuacagaaugucaaaggugguuuucaagcuauaugaugcaauguaaauuaaaguuacuuucaacagcaguagauaugcuauuuacaguugauuaaaaauuguaaggaaguuuagacagaaaacgauggcacaucauuucaucuucuggaaagugaagacuaccgcucaacaaugucacgaggcaaguuucaagacuagaagaaucacacuuauaagcagcacccaagcagaacacuucugagucugucagaaaaauaaauggugcgaguccuugagugugccucccacgcagccaagcugggguacaauggacugacuacuaagcuaaggcggcuuuacaggugcccguggcuuccucccuccagaucuaaauacaaugacauacauggucccugugccaccuaucgugcuucucccaagguuacagaagucaccacacuaaauuauagagcagaguagaauaaauccacaguaaggucacaauauauuuagaaaacaaacucccguuuggaaaguagaaaaguaucuuuuaaacaaguauuaugaaacaaaguaugaccauaagcagguaugauaacccagggcuccgaugucuuaccgcauggaggacagugacagccaaacuccaaguuguuccuaagcacagaucucaagugcauguagcgcuaugagacagcccggggcacacgcaacagaagauaaugccagggcugcuuucagaaacaucccuaaaaccugcacagggccggugguggcagagcucaggccugucgacccaguacugugggcagaggcaagaggaucccugcaaagugguggccaaacagaacaaaaccaaaaaauuacaaaguuccccgaaaauuuucccuagcaaauuucaagccaagcaucugcuaaugugaaauucggugauaaaaacaucagacuuuaugugcaaaaaacaaaaacaaagaaaagugcaaaggcugcccuuccccaaaucacggaauucauuugucaucuaaaauuccugcuaguagcagauacuucaauuguggacuguuaaccuaccacauauucuuagcugacuguaaauuccugauuuuaagauuaaagagucauaaugguccauucgugcaaguuuuaagauaacauuuaaacauacaaaaguccaaaauaaucuucaagauauuuaguauuuuauaauuuaaaagaaaaaaauccauuauauaaauuucauaagaccuuuguaagacuacauauaaaacuguacaagaagauuaugaguuacauaggaaccaacguacaucaguggaauccauuuuccucgugagcaugaaugaguacuuccacaccacuguuaacaggaaaaguucagaaaucauuuuaauuuucugaagucucacacacacaaucuagagauagucacucuuaaacagaaagacaaauuacaacugcuucuugugugcagcaucagggcacagcaaaggcugccccuccccuccacacacacacacuguuuguuagggaggugguacuaucauuccaucaaucaaauuccucuaggaggaaacagaagaaacccacucuacaaccugaacaaauuaacaaccggcuucccaagagucuguaaugagaaggauacaaaauagcuuuguaucauaaacauuaccucuguaucuaagcugagccugaaauauugcauaccauggacacagguacucuccaccacagacugcagcuuuggaaaguaugcaacuguuagaaauacagguagacugaccacaggcucaaauuacacagguuauuauuaccaagcccacuggaaaaguacaaagaagcauacauuuucauucauuuggaaauggaaaauuuuguauuaauauauaaucuucacuuuugcugccauacaaaugaacagaaugccuagcuaccuucaugcaaauaagauguuagaauucaauuuucaaagcaagcgacaaacacaaagcccugucaaccacacacaggugugucuucuucagcucuuaguccuuggagggcuuggacgacuugccaaucugcagcuucagcuccuuuaucaucaucuccagcuucugucucgccucccgcuccugucugaguucaucuuggaguuccugccugucggccucagcauggucuagucuuugccucaguucugccagcugugugauuuagaagacuauguuagcuuuccaucacugaguuuuucccauuuaaucauccuaccaugguuaggaaacaaacugccauuugcuuuuuacaaaacaaaccauuuuccugcauaucuuggaauaccuaguacuugugacaacugacaggacaguggacuggaggacugggagcaucaagaggaaggagcaauguagcucacgcucacaaaggcuccuggcgucacucugacucuccacagccgccauguccacaagcucaccuucccggacuuguaacgacaguaacacagccuuacuuucuaugcuuggcuccacuuccaaacacaguaggcaauaguuuaugguugcuaauucgaaacaaaagcucaucuuacucuaucaaaagaaugaaaaacuagauucuaguuacuuguuuauccauuuauaugguaccagagauggagugcagggcccuugcguguuaagcauaagcuuuaccaaucagcuucauucccuagcccaaaacaaaauacaaaaucuuaugcagacgacuagacauuaguaaucuagauaacuaaauuacagaauaucaauuacauaauaaaaguuauuuauucacaucuaaucccagcacacaggaggcagucagaucucugauuuugacucuacagagauacccucuccacacccccccccccacaaugaaaacagaauaaaggggcaagagggagggaaagagaaaaagaacacauuaccuuaaugaauaaaagcugugccugcaacaaucucccauccugaaaccuagccugacuugacaaaagcaagcccuugacaguaaggcccagcccgcgcuacgggcugccacucaccugagccgcauacucggccucccuguccuucuccaagguugagucacaggugcauuucugcugcaucaccugcuccagcuuuuucucuaagucucucuguucaauauagaauuccuccauccucugagcaugcucacucuguaacgacucaagcucuuucuguagauucugcugcucuucagugagcuccuucaucgccuuugaacugcucagcaucuccaccuccuguaacauaaaggaauaguccuuuaggaaaaacuaagucacaaggcagcugaacuucagcugugcuaucaugucuauagagaagcgacugucaugaagaacugcuccucagcacgaaacagagcagcucugaguccaucugcagugucuagucuggcucucucuuaaccaugacuacuucuagccgggcagugguggugcacaccuguacucccaguacucagcaggcaaaggcagguggaccugagucccaggacagccagagccacacagagaaacccugucucauggaaaccacagagagaacuauggcuacugcuuaggacagcuuaccaucugcagcugcugcuuccucugcagaauggaguucagcuucuccugcugucuuacauagguucucaucacgucuuccaugaucuuccccuugucgucuucaccaucucugaccagaaguggagaggaaucuucugaaucacgcuugcuugugccucucacuaagcugcacacagcagacucagauuucuuucuacuuguagaauuauuugagauugaugaaucuuuagaaaaaaauaggggggaaaguauuaauaccacugguaaaaaggucacuggaacaauccauaaguauaauuuuuaaaaaauucuauguauaacucaaucaaaagcaaucaaauacuuagggaagaaaauuaacaaauaaauguagugccaggugacaacuacaaaagaaacuaacauaugaagacaggaaaugauacuccaugcucauggacaaaggacuuaaucuacucaaugucuccacaucaaauccccagcucuuauuucugcagaaaguaacuagcucauucuaagaaucacauugaaauuugagaaauucuaaauaccuaaaacaaacuagaaaaagaguaauaaaguuggaaagacucacaaagccccaacuucaaaucuuccuacaagcuacagaaaccgcaauguggggcuggcugaucguguuugccaugucaguguggagaccugaguuugaaucccagaacacuuguaaaacuaugugcaguagcacacauuguaauuccagccuuccuaaggcaaaaauaacuguagauauaguugaaucccugaagcucaaaagacaaaugaccaaaagacugugucucaaggcaggaggcgaagagcagcacucaaaguuguccucugaucuacacaugcaccccacacaaauguaugcaucuauauguacacaaacacacaucgcacauacaggcaaaacuguggucccgacauaagacuaggcauuuaaauaagcaaaagagagcccagagcccaaaucccacuuccacagacauaugcuaaaaguagaacgauucacaauucuacauggccugaccaaggauaacaugcaaacuuauaaagccuuaccuauuuuuagagcaaaguauauggauauguauguaugaaaacauaauuacgaagccuauugcuguguaugcuaacguaaaaaguugacaaaaaaauucggaauccaagcuaggagugguaggucacauacaccugugaccuuaacacacaggggccgaucuaggucaaacucaagaccagccugggcuaccaacaaggaucuggucucaaaaaccuucaaugcucuuuuuauggcgccaagacaauucaaucaggaacaaucuuuucaaaaauaaacagcaacacuaacacacaaagaaaaaaagcaaaacuccuauuaauauaaauguuaauucaaaaugaccuaaauauaagaucaaagaauuaacuguaaaagcuaaaaccauuaaguauaaaucucucuggccuuggacuagacaaugcauuaguagguaacacacugagguaagaaagcaaauuaaacagacaaacugaacugcauacaaacugcgaccucacuaacaggaggagaaagggaacugagccuggcaaguccuaugucuaaugaggaucaaucauaaagagagcucuggaacucacccaaccuaaaaacaagcacggguugugaguuaggcuuuuucuucaaauaaaauauccaaugcccagaaaaucauguaugauuuuuauaaacguucaucagucauaaguccaaauuacucgagacacuguaucauaaccacugcaaugacuguacucagaauagacagguccaaguguugacagaugugcagacauggaaaccucuguggacugcugagaaauucacaaccguguaccuacuauggaacagccuaacagucucucgaaagauuagcaguuauacagcccaacacauucuaacacuaaauauagacuaacaagaacuggaaauguauguccacucuaaaacuugcauacaagcuggcaguauucuucauaauaacugcacagggaauacaaugcaaaacaucuacugccugaagaggggcuacacaaaacacacauagccacagaaaacuuuaaguucuuuucuuaaaagaaauuguuccugccagaaacacaguagagaaaaccauccuaguaaaagaagucagcccucaaagccacacauuguccuucuuguuaucuacacuguccagaauaggcauauccauaaagaccacauacagucacagagcuaaaggggaagaagggcugacugcuggaggguggcaggaaucaguacaggagccaggacaaugcucugggacuaaagagcugugacgcuguucacgacauggcgguuacacuaaagacaaucacauuguacacaaauguaccucagucaaguuuuuuugguuuuguuucuguuaguuguguuuugccugugugguguauauugcauaucacguguacacacaugugguaccagcaguggucagaagaaauugggucccuugaaacuagaguuucagguaaguugugagccaccgugugggugcuaggaaccaaacccagguccucaccaagugcccuuaaccacugagccaucaagccaaucccuuacauuucuuuuuuaucauuaaaaaaauuaauuagaagucaaacagaaugcaaauguuauaauaauauaugaaucauuacuaucauaguucaauucagaggaaacugagucacagcaauaacaacucaaauacaggaagcugucacacuguaugaagacaggagacagcaggacuacaggauggagacccguggggaugcuaaauuacuuccacugcacugcacugagcaaggccaauggcccagggucuaucuucaugcacaccucuccuauggucuacaguauuugagaaagcauaggaaacaugcaaguuuucuccgagguaccagccagcaccagcaccaaugucaucugcccgucccaaccuugcuuuacugucuugaaccacgaguccaauguuaaauacaauuaacaucagguaaguggcaugcaucuccguucacaggaaaaaaaaacaaaacaagaaggaaaacgagaaacagcaaagcuaugggauucuaccaaggaggcagugagacaucacugcacugaagcuguuccccgcccucucauggcccuccauaggcugacagcauucuagaaagcucaaccgaggugcagagaaaccacccagaguuuucaaaguuagaaccguuuuaaaguaaaagcugugguucuauaggggaaauugccuuaaauauaaaaugcuuuaaaaauacugaauaaauggguuucuuaacuagcugauuuuaaaaauauaacuucugaauacuuaccuaaacaacuguauaauucucuacugguuuuuaaauccauuuucuccugcuccucaagugagacgucuggguaagacacuguuuuuugaugcugacuacucucaugaggcuuuucugacuguuuggagguggacuuacuugucucugccuugguggccucuuuagacugggacgcagcagaugugagcgacacauucggugcaaccacuuugucacacauguacagguaguagcuggggcagaaaggaaaaacaaacacacauuacgucauacugaaauuugaauugagacuugacgucguucugaccucaguucucagcuacuagaauaaccaauguaaacauacaaagaauacaggccacggaaaagauuucuuagaaaacaaaguucauacuuaaggacaguaaaacugagggauuuuugauaguuugagaguaauuucaaacacuaaaaaaaaaaaaauuagaaagcaaaagugagucucuuccccuuucccacaaaccaccugacaauucaaagcaugaaacacccagguaugauaccucacauuuauaagccaagacuuaggacugccacgaauucaaaguuagccugggcaacagaggaagcuccaggccugcuucccugggcuauauauaguaagacccuuucucaaagcucaacuaacuacaggcaugaagcucuggagucucugcagcucggcuggugaggucucagggaccauaucuaccucagagagagaacagguucugggaauagugcccuugcaucaaaacucauagaaugaucuccuaaaaguauuaauaaaguagcaauaguauuaaagcuaaaaaggacaacuacugauuuuucucaaaguucguguaacuuugagcuuauuggguuaucuguaagucucacauaacaaacuugaacuauugaacacaguuugaucuauaaaucuagguaaccuuccaagaaaggaggcagccccuuaucuagcacugccaccccuuuuacagcucauucucuuuuucuuuuucuaauucguccccacucccccucuauuuuccuuuaaaggggguggggggcgcagaccucccaggguauccacugaacgugguauaacaagcuacaauaagaccagccucacauccaggcuggacaagacgacccagcagaaggaaaagggucccaagugcaggcagaagaggccgaugucccacguucucuuuguaggauaccuauguuacuacucuuuauuucugggucugaacacuugguauucuaauuaaaaauuaaacaaucuuucauggacuuaauagugcccaaaaggcuuauuaagaaacuguaugauggugauugugugcugugugaauuuuacgguucagacugacaacuaggauuuuuauugaaauauacgcucuugauugugaaggauguaauuacuauaaaaucuccaaguuucacaaccgauuguuuuuaaaauuacuaugcagggguaaacaucuuuaaucucagcacucagaagggagagacugguagaacucugaguuugagaccaaccugagcuacauaaggaggccagucaggguuaacaaacaaacaaacaaacaaacaaacaaaaagcaaaguaacacuuucaacucuugaagagucaauuuaccucuuaaagguaaauaaaauaaacuauucaauuucuacuucaagauagaaguuuuauauacacacacaaaaggugcauucaaucccaauguucuugccuaaaacaauucugaaucaucaaagguaauuaguuaacaaggaaaaccuaaagggaggugacuuaagucuuaauucccagaauugcauccguuaauaaacagauaaacaagccaacugagaaacaaagaagcaaaccaccacuggacaagcaaacaaaugaagaaggcucacucaccugggguguaaaaaugaaugugucuggggaacauggucaccuuccuguuuuauaacaggauaccaugauggcaauuccauucccgaugguguaucugucuguaggaguacauagaaagguacauuauugagaggaaaagaugguuucucuuuguugaauaugguucaagggacagaacccagggaguaaauccagggccuuguccguguuaggcaaacacucuaaccacugggcuucacagccagcucuccuuuggcuaaucuucugucuacuugauagggcugcagaacaagcagucacauuucuaaggcucagcuucuacuaagagcgcucccacagugcuaugucucacucugaaacuuaaagacugcuacuucuggucacaacucacaauacgcacauucaaauggcauggcuuaccagaaaccauuucauacuuaggaaaccaauuucaaauaagguaacacaacccugaaaauacacagcauggaggaccucuuucucuuggugccccaaucaaccucccucuaccccacagccacagcacuuacuaaacuuuugacuagauaccauucuauagcaguaaguacucuggccaauuaagugggaaacuacugggcuugcuaguaagaauuagcaaaccauauuccucauagauauuaaaagcugguuuuuaaguaccuauaaauaaaggaacaggggaauaauaacuggugauuucguaaguauuacuggcuaagaauuuuacacucugauuaacucuaauaaugcccuuccacuaagcaggggucacucucugcucacaucuuagaacaacacugaaagaaugaauugccaugguuccagcagcuuccuuguccuggccugguuuauaacuuguccuccucacauacuuccacggucacuccacuuacgugagggagcgagguucccugacagaaaaguggaggagcugaagguaccagaugaaggcagacagcagagacgcgcuauccauaggucccaguggguuaaaggacaaucaccuaacgagacaccuggccaccuagcuaggcuccgagcucucggcucugagaggcuccaaucucaccggcagucaggaggugggcggaggccagcaagcucaaugaaacccacaacuguggguacagcccagugcaaagacuugccuggcauaacccaggcccugaauucagucuccagcacaagucccucauauagggaugggcaccaaacacuaacaauuagggaagcuggcuuacaugucccaguauuuuaggucaagaaagaacacaaagggaaggaugacacgcaguucuuauuaaaaguaagauccacuccgaauggcccaggggaggagacaugcugcuagugagagaacccagugugagugaagaaaccuuggagaagcagcccagugccugcaaccaaccaaccaacaagcagacaaaaagacaaggaacaacuccuagagucagcuuuauacaacuucacaaucuaaaugugacuuuauugccaggaaaagguuuuaaaaaagacaacugaaaagcaauguugggugagguggcucauccguuagacacguaagacacuugccagugagccggacacccagaguucaaucucuggaacccauacaguggaaggagaacugacuccuguaaguuauccucugaccucaacauauauguuguggcacauauauguucccccccccauaaauaaauguaauuuuuaauauuuagaaaaguagaaaaaauaaaauaugguaauuuguauugcuguguguaugucuguguuugugugugugagagagagagagagagagagagagagagagaaagagagagaaagagagagaaagagagagaaagagagagagaaagaauaugcaagugagaccgcaccagcaguaacagugcauagugcaugcauuugauccuagcucacaggaggcaaaaguagggggaucucucugaacucaaggccagccugaucuacagagugaguuccaggaaagccagggcuacacagagaaacugucacaaaacaaaauaaaacaaaacagaauggguuauucauggaagacuucuacaggaguaggucauuuuucuggaaaaaaaaauuccacaaacugauaaaauacucguuaagauucaagugaauaccacaacucugauguauuauucagaaucuggccaaacucaaccacuuacaaaguaaagcaaucagcuguucacagguucucagccuaaaaagaacugacuucuagcaauacauacuaaauggcaaguguucauagaccacuaauaacuugggagaaagaggaaucacagaguagaaccauauaaacugcuauagcaauagacaaucugagggugucagcauagaccggagcaagucauucacuacauuucaauuguguaugacuaacccagaacuuugaguuacuaugguaacuggugcuuaagucuugagucuagaugacaucaucaagcuauauucugaauacuaucuagauauaaacguauuugaaacauuuaaacucgcuuuaaauauuuacaauuucaggaaucugaaggguggcucuuguggaggaugcagggucaguccccagcacccacauggaggcucauaaccaucugcaacuccaggucuaggggaucaaacaucuuuugaucuccaaggguaccaaccacauaaguaguauguagacauacauacaagcaagcaaaacacagaaaaauauaaaaauuuuaaagacacacauggcguauuuuuuuuucaaaaaccugacuucuuuaaaauugugaugaugcucaaggguagcuuaaccccauuugauaagaggacauguugagaaaaauaauccagggaaaucuaagauuaucuugaacuaagugaaacauuuugguuaaacucacuuaaaaaacaaaacucuuuaauuggucuuauaucuuaaacaagucuagauauagugcccaauaaaucauuucaaacuuuaaaguuaauaaucacuacacugaaccacgcauuaaaaaggcuuuccuaguauucccacuagaaucugaaaucuucagaaucgcuugcaagaauuuuucaaaacuuugacuuggaauaugacuuuaaucauuaauuucauuucaaaagucuacuuugacuuuuguggucauuguauucauaauacaagcacaauguguccuuuuuuaaaaaacuugaggcagugucuuguuguauaaagcaggcugaccuugaacucagaaaucuaccugccuuugccucccaagugcuaagacuaaaggcuugagccaccaugcuuaguuaugcguuuauuucagcaauuucucuacauuugaaacaccaucuaaaguagcugcauuuauuuauuuuuaagcauucaucuuccucaguuucuauucuuuguuucuuauucuuacaucugucaacuaaaagagucacagagcacagguucuaguuugcugucuguuguugcaauaaauaccaugaccaaagcgacggacguggggaaaagggcucuguggcccacagguccagcuaacagcccaucagcacggggagucagggcaggaacuugaggcaaacugaagcagacacccauggaguaagguugcucagguagcuuucuuauauauagcccaagauaccuauggcugauaaugccuacacuggggucagcccuucuacaucaauaagccaccaaauaaugccaaucugaucaacccaacugagguuuccucaggcaacuguggacugugccaagcagacaacugaagcuagcuggaacacucccuguaacaaugaccuaauacugucccuagccaauguccguauucccuagucaacaccaguaaguggcuaucccgccucucaacaguaacuugaggucaagagcauguuuauuuuguauucucaguagcuagcacugugccuaccaugcaguacuugcugggugauuuugaaugcccaggaguggcaaugguuccacggcagagccuuucuuugcccagcauaugugaagcugcgggcucagucaucagcuccagcgaagagaacaggaaaggacaaaagaggcaggggaggcugguacacgguuacuggcuaccaagaaacucaagacacucucauauuuggaucuuucuccuccaugaagcacaagggaagcugaaccuguuuggcugcacuauugaugcaaauccugcagaaugcacagugccaaccgugaaagagaacugcaagcucauuuugccuaaaaugcugugguaaacuauaaaacacacuccuaacaaauuauccuaagugcauguuaaaaacaauuaagcacauauuacaaaaugaaacauuaacagucaugccagauuuucucuucuaagccugcauuugugucaacauacaaauuggguuuuuagaaaaagaauauaauuaaaugguacagcaguaauggcccugaucaaaaauacaaaugagauaccagaaaccggagcaucuccugccuuugucuuacacucagugugggacaaucuaugccuuugugaacucaaacauuaaaacaugccuuuucucacuuggcaaguggagaagaacaucacucaauaauuaaaggcagaggcucacuacuuaagugcucuaacugcugggcugccccgccgucaucuacgucagaauuaacagacggcgcccuuucacaccugugagcaaauuucaaauacauuauuucaauccaaagguuccuuuucuacuaaacaucaaauuaacauccauggaaacaaaauuuaaagguucccaaaauguacaguaaauuuauuuuuaauaaauaacccuuaggaaacaauguucaaguuuucguucauguccacaucuuaacucgggcaccucgagcacacagcccuuacauaaccagauggccuaggaagcaucuauugguuugggugacacauccuauucaguuucacaaugacagaguuuagggaacuugacuucauuuuuuaaaaagaaguuuugguaacacuuuaaaaacaaaagcacguccacccgcuccaagcuauuuguacucaaauacuccaaacugcauggacguucuguguguguguauguuugugugugugucugugugugugugugugucugugugucugugugugucugugugugugucugugugugugucuguguuucgagacaggguuucuuuuuuuuuuuuuugguuuuucaagacaggguuucucuguauagcccuggcuguccuggaacucacuuuguagaccaggcuggccucgaacucagaaauccgccuggcucugccucccaagugcuggaauuaaaagugugcaccaccacgcccagcuuuugcauugauguucuuaugagugccaaaauuacacucaagaauaaacuugguuuuuaagugguauacuuauuuuuaauuauaauaauauuaugcucuuuaauuuguagugacaaaugcuuauuauauaaaaaaaaaacugauacgucuuaacaugcuggugaaucuuccaaauucccauuaaaauuaaaauuaagacauuuuaaguuuuuaaaauguuuuuacauuuagagugaguauauguguucauaugaguugaauguacguguguggcugaaagaacgugugcacgccuuuaaucccagcacucgggaggccuggccagcacucgggaggcagaggcaggcggauuucugaguucaaggccagccuggucuacaaagugaguuccaggacagccagggcuauaaagagaaacccugucucggaaaaaacaaaacaaacaaaacaaaaaaaacaaaacaaaaaccaaacaaacaaacaaaaaacauguguaugugcgugaaacaguucucuucuuccgccagaccccugaggacugaucucaggucaucagaauugaugggaacgcccuuacccacugucuucuaccucacugaccccuccagaaaaccuuguaaaagcagaauuuuuaaaaaugcuaaaaauaggggguagaaagggcucuguagauaagagacugucaucucuugcagaggaaccagguuugauucccaaacccacaugguaaccuggaaauaucgaaaacuccacuuuuaguagcuaugacagccucugcuaugauuucuuugcaggcaccaggaauacaagugaugcagacauaauucagacaaacagccacacacaucaaacaacaguaaaagugcuacaaauaauagucauuuuuaaauuguguucaaaggcagcugaaugccaguugguaagucuaacagucuuaauggaaugcuuauaugagaacuaaaauauaauguacauuauuauguaauaggcucaacauaaaucaaaaaccuuaccaaggacacuauuagauaacauagacaguauugcuuaagaaauacccccuuuaguaugaaaugaugccccuggcucugagucucuuuagcauauguaacacuaagacagucaaguggucaauaaaugacugcagaaauacacaaagcaccuccuacccaauagcugccaacaacuuucacgaaaagaaacccaaccccucagaugguaucugguuuccucagcguggccagcauauugugaaugaguaugucaacaacugaagugaaauaguguuaugagggagcaaacagcuacuuaagagcuuuucagauuuagguuuaggccgcacuuacugagaacuaacuaaccuaaugcaagacugaggcacaaugaccuaagcugcucccagggaucacggcgugaccuccgugccggcugcucacacugaaagacauaccacagaggguccagguggaaagcaaaggcuacacuucuuauaauaaauaucuaucuuaaacuucaugugaagaacugauaaaagucuuguugaggaauuaaagaaaugaggaagaaaaaaaaaauuuuuuuuuuguuuuuucgagacaggguuucucuguguagcccuggcuguccugaaacucacuuuguagaccaggcuggccucgaacucagaaauccgccugccucugccucugccucccaagugcugggauuaaaggcgugugccaccacugcccggcuagaaaauaaaauguuauacuaugaacuuuacguaagaaacugcaaccaucagugugcugcuuuucccuccaagugcuuaggaucaaagcccagagccuuggacacaacagucaagcauccagucauggggccacauccucagacaauuaagcagagcucuaguuugcuuucagucacagugacaaaacacugaccaaaaaacaacuuggggaggaaagaaagaguuuauauuuacaugacuuuuacuuccuagucacuguccaucauggaagcgaaaucaggacagcaacucaggcaggagcugaagcagaaaccacggaagaaagcuguggugugcuuagcuugguugcuucuacaaaccaggaacauuugcccaggggguggcccucccacaucaauuggcaauaaagaaaaugccccaagacuugccacaggccaaugugacuucgguaauccccccaauucagacuccuuuagauaacccugcuagcugaagucaaguagaaaaaguagcuaucuuaaugccauaaacauauuuucccugaaauaccugucaacuauuuaacauguuacguaacauguauaaaucuaaggcuuucuguauguacagauguguaccagaagggcaaagagguaauggguaauggguccuauggaacuggcuguaaaucacaucugcaaguaaccaagccuggguccuuugaaagagcaguaaauguucuuaaccauggaggcagcucuccagaucucgugcgugcgugcgugcgugcgugcguguguguguguguguguguguguguguguguguacaugcaaugcauugagaugcauaugcauauauauguauguacacauauaucacguauauacauguauguacacauguauauacauacacacuuuuuguuucuucagauuucagagguggcgccuuuuuccaagcuucaacuuuuaacuuugcuaacucuauaugugggacaguuuucuuuugagcagcauggaacugcuauuuuuagccaaucugguaaaucuggccauuaacugggggguguucagaccauuugcacuugcuguuguuauuaauaccacugcaugccaucuacccuauuauuauuaggacuccaugugucuccuguucuuuugaaauuaaaaaauuaaauauaaggcuuuauuuuucuaccuuauuuggaaacacaugcaucuuaaaaauauggugugaucugagcuuucaaaaaauguucacuaucaauacaaaaagaaaaucagcuuucuguauuaauacucucaauuuucuauuuuauucuauuuuuguguuggcuuuauuuaaaugcuagcgaccuacgaaaaugauuucaugcuccuucugacccuucucagcgugguaaugaagagaguuaaagaugccaagccgcugacugcgugugauggcuggacugguacuguccguggaaaguggcaaagggcuuacuucucucaugaagccccacaggagacaaaaaggacagaugaaaaguaacucaagauaaaaaggaucaauaucuaacuuuuuacugugucuucuuaaaaaacaacaacaacaaaaaaaaccacuagcaauuccauuuuagauuaagaaaauuaauguccuauauuaauuaagacauacuauuccaaaagcauucuaaaacuuuacaauaaaaccaggcaacuucuacuacuaaaaaacccucuaaagacucaaguaccauaacucccuauuaagacccacugugaaagaaaacgguauagcaaaagaacucuggcccaauccaaacaagccugcacuaggcuccaucaucugaaaccucacgguggugucaccaccucaccucaaggaaaccagucagccuaccuguuuggguuguugcagucuaauaauuuuaaaaugguucuuauuacaaaccucucuccuacauaagugguggaggaauucccauguacacauuaauauuucaguaaccauucaauaccaucugucaucucuacauaaaagacuuccaauuuccaaacgcuuucacaucuauccucucauuugacgaauuauacuaagcuguauauauaaacuauauacauaaaagguuaagccacuauuuaagaucagaaaacaaaaaaccugcugggcuguguggcacaccuuuaauucuagcacuugggagacagaggcagguggaucucugaggccagccuggucuacagaaugaguuccggaacacccaguaauacacagaauccuugaaugcguugugccuaacaaggggaaggccuuggauuugaccucagaacuuaaaaaaaaaaauuaauaaauaccauauauuaaaagguauuugcuuacagcauuaggauuauaacaagaagccuguguccuacaaauauagcacccugccagagaagauaaauaugugucccauuguuccagugaucacugcagaaacaaaacugcaaaacuaaagggagugaaaugguuaacuucuuugagggaggagaagcaugaacugaaucucaacagagggauaacacuagcuaagcuaaguucuccaccaacuuagagaaagcaucuccaagguguuuaucguagggacgucugcaucacagaucacuaaaaaacaaugcagccccuuaaacguauaaaguaaaccuacuguacuaagaguagagaaaucuaaguguuagaaaucuuaauucuaauaaguuuuaagagcauacaccacccuucuuuaaggaucuucauaugaaugaguguuuauuuggauauauuuacgugccucuugccuucagaggccagaggaggacuuuagaucccccuagaacuagaguuacagaugggugugagcugccaugugggugcugagaaccaaagcugaguccuuggcaggaucaaccagugcugagccaucucucccucccagcauacaccauucucaccucagugaauuagaaauugucaggccuguguuaacaaugaagaaccgccgacaauucuguuaucagcuaaguauaaaugaccuucucuacuaugcuugaaaauaaucuuaagcaucaaccuugaggcuugucugccaauaauguacuugcuuagccuuguucuagaagcagaauuucaguugcuccgauucuuaucuggcugaauaucuacugauaaggugaaaaucugcauauugagcauccuaaaacacaacagccauuuucuaaauaaaauucacacuaauuuuuuuuuuaaaucuaucauuaaagggucuggaaauacccauuguauugugcaacccaagaauaucuaaaauuaugucuuuuuucuucuugagauaagaucccauguggcccucaaucucucuaugaagccaaggaugacccuucuacuuccauuucucaaauacaggacuccagguacacaccaacacccauggucuacacagugcggagaugaaacccagggcucugugaaggcuaggcaggcucucuaccaacugagucccguagagacccauuaggaauuuuuugaugaccuaagaaaggcuccaaaacauugugguuucuaccaagaaagagcugagcucuucacuaagaacacuuagcauuaccucacguauucccagaaucuaaacauagcuaacuaugcaaauuaaauauguuagcuacccaaagaaacagcuuguuggucauuacugauacaauuucuguucuuuaaaauaaguugccacagugacuuggugagauggcucagcugguaagagcuggcugcccuucaagaggaccugaguucaauucccaacacccacacucacaacugucuguaagucuaguuccaaaggaucaaguacccucauagacccacaugcagggaaaacaccaaugcguauaaaauauggauauguuauuuuuaaauacaguaaguaaaaaguugcuacauuuacaauaaaugccuacauuuucagauuucuuuuuauuugaauccaaaaugaguauuuuaacuacauaacccauaucaaauuacacuggucacucuuaaguauaaucuccuucauuuagaagguuaaaguaaucagcacagccuuugggguaaacaaaaguuugauuugauucuuuuacaaugaguuuccucaucaauuugguuugccuggcaaccaacaaguaaaauucugacucucugaaugcccuaaaaaauaucuucuccaacccaagacugcuuucccuuguaaguacuucaguuucgugcaaucaauaaagaauuuaagagccauuauguuaaacuaaucacuaauacuauuccgcuguuucagggaagauuucuacccuuaaagucagaagacuaccuucaacucacucuaccagcugccaguuagacagcagacacgccuaacaggaggaaaucgucuacgucacuucccucacagauccuugaaaacuaccuauguuuagaggaaauuuaaaaauguacaguaacuucacuuuuaaagcugcuugcauauguguuaaauacccaguuuucuucugaagguuugacuggaaaguuuccugaacuccccugacuuccuucaacuuacauaaaguuggaaacaacacagcacaagaccuccagcaaacucugaggaaaacaaaagaaagaaggggucucgcauaccuuccccaaaucaaauaaaaaguguuaucuguauuacaucccaagagacggagaguuucaauucccucucuauaaauuuuucguuucaaaccaaacugggccauauuucucagauggguuuccacccaagcacagaacaggugauucuaagaaugcugucaagaguaaugaagaccagagcaagaagccccagcaaauaacauagccacugucaaacacguauggagagugacucuaauaagcugaagcagacagagguauacacaucucugaauaagacuccagcacugcacaaacagagcuaaaggcaaguuuuccacuuugaaauaauggcaucaagucaauccugcuuuaaaaccaguucacauugcaccugaagaacuuaguagccaccgucgaggaaugucagugauaacuuuuaggaaagcagcaagcagcaagcuauccuaaggaaaagucuaguucucuccauguugcgcuucaaccgaaaacuacuggcucagaagacacuagaguucccucaaaagcuuaagugcagaacacccaauauuaaauuauaauuuaaaccuaccuaaaacuucuauaaacaacccugaguuacuuaauaaaguuucucccauuaaacggaaagugguaguucaaaggcaagaaaaacuaauaauggaaaacuuuaaguucuuaaaauguagcccagcuucuguucuaaaaauuaauuacacaaaauuuacaugaaaaacagcucuagaguaacgaucaauacauuuuaagcagugcuagguauauuacauauuaauuucaaaucaaguagaaaaguauauaagauaaccauauuaagguuuaauacuucaaaccuuugucuuucaucagacauucaaacucuucauuagaaucaagacauuaucuuagccuaccagacaguacuguggaagggguaauacuuuuaagauuucuuugcagauagcuuuucauagcaguauuucacuaaauugaaauaaccuuuauucuaccucuacaucacaaauguucaaaagcauuccuuucuuuuauauuauaaacaagaucuugguuacuaauaccaaauuacucagacaaaugucuuaauuggauaugaacacugauuaauccucaauccaagcacaaaaacaucaaaaaccagugguauuucuucaaaaagcaauuuugagccugucaccagacagguuugcaaauggagauugcaaauggagauaacgccacaccaaagugugaaccaucuugagucccaggcaacagacugagucaagaagcaggaugugugaaagagauuggccaaaagaauucccaaugccugcaguuuuagaaguaucauuuuugacuggaggcucauucucuuaucuguaaaaugggaauaauccuacuuuucucucagaugaaaaacuacaggaaacauggcuaaacacaaacauggcacugaugggucuuuguuguuacaugaacaagccgaagcacuagcuucacaauacaaagcuauagacacacagaauuagaauaccauuaguauucaaaaucaacacuuaaaaaaaaaaggaacuugccuuugauuggauucucuuuccauuucucaugcuaaacuucuccuucauuucuucuaaaauuaucuucaguuucuuuucuucgggugucccuagguauuuuugguucacaugaagguaacagugccacuuggcugacucaaagccccaauggcaaguucucuugucaggggaucugugcgaaugcaugacgaacgucuggggagcaaacauuccacagcacuccaggcacuggauacagggagcgucgggcugaacauaaaacugaggcgcaaagagacccugacauuugcccaagcauucauguuccacuucaaaggcacugccaguuuccuucaacugggccagagagcuuuuagcaggaaguaugcuaccauuuugaggaaaaguucguggccgcaguaaagcauuacagagucuuugugcaucggucaacgugaucagcccacaggauggagcauuaaaugggaguaucccuaagaccuuuaagauaugaagcuggucugaaguacaccuugaacaauagauguacagcucaucacauacuguguuuaucugcuggagugaaaauucucggaggacagaguuuaagacuuggggcaaacagagucucuuuucuccuccaacuugaaaacaagaaauagacuccccuuccaaaagagucugagugagcucuguggagcuaucagaaggaaugagaagagggccgggaagaaccugaggagagggaagaggcaggaauacagucggugacaugcucuccugggaauaucgagcagaaaaugcugcugguccacccaaagagcucugacugcuuaaguggaauugugccagcguguguuucagacugggguuuaaauuuaaaguuucagguagagaaacacgguuucgcuuggcgugcucgccauccggcuccacggaugcaucuccauagucaucuaagugcuccuucuucaccuuggucaggguuuucccauuggcaugaaugucggucaucauuuuuuucacaggaggacugccaucauccuccaugccguucagcuuuuuauuugaacccugaacuaaggagaacuuagacuggagguuuuccauggccacacuggugcuuuaaacgauuaagucugcaacuggcauguuguucucaguuccuaaucugaagagaaaaggggaauguauacaaauacuuaugacucacuuagaaauguuuacuuuccaaagaugaauuuucuuacucaauagauuguacaacucuguuuugguuuagcuguacuuuaagauauaauugaaaaugcuacaaaacuucucaguuuuguuugcuucuaauaacaaauaagaauauaaucguaagcacacuucugagaaaaucacuucagguauuuauauuaaaauaaagcucaauucaagaaguccaaaguucgguguaaugguugaguuugguugguuuuguuuuuuaagcaaagcaugugggaaguuuauaccaugacuguauccugaaacuacacccaaacaugaguuacaaugacgcaauggguuuaauuuuugccaagaacaccaaaaaagaagaggcagguaucgucccugaaaauggugaucugcugcucaguacugauaaacugaagacuccaccugaacuuuuauaauuaaaaauauacauauacuaaaugaaaaagcuguccaguuuuaucuucagggauuacagcucauucuucuuuuaauugaucuggaagagaaagggguggggaguuacauuugaauuagcuccagaggccaaagggucuguuuaaaaccaguuucuuaaucuucaacucaguucauuuuaccaaagguaacacuugggugguuucuuccaaccuaacaccaguuaucuaaaagaaacuucaucuaaauaggaagcaguccagacgguggguaacagaagcauuaaauaaugccucuccaaacaaggacgaguacacaaauuuagaauacgaauaaccaaaccucaguaccagaggcuuucucaacuaugcaugccauuuaaauuuuaaaaaacaauccuuucucguuagaaaaaaaaaaaaaaaaaaccuguaguuucuggucuccccaccccccaagauacauguuaauauaccuaccauaugcaacuaaacuucaaguacauucauacauacuaucuuuuuggaaugaagaagaaaaaaaaacuuucccuuuaaaagguuagcgaauuugccuaauggaagccaaaagcuguaagacuccacgccuggaaaucuccauccaugagcaagacuaauccgggacaaaaagcacaaggcagacagaccucacaaagaaugcaaauggaggcagaguggcgaaaaagaguauucauccacuucccucccuggagaaaacccaguaaaagccgacaaauaaaaagcuuugcuucuaaacucccagcaauuuauguuaacacaaacccagagaauuauggacgaaagccaccuagccaccguacugugacuuucgccacuacagggacaccucagccaaggcgagccaaggaaaagggcagaaggcaugaccuagaccaggggcgcccccacagcccugcgcacacgcagagacacccacucaucaucaacccaaaggacagggaagcaggggacucccggcgucuggugaggugagagggggcagaggaaguaggaguccucccaacccccaccucugugacugggaucacccuaagugcccuccccacaucgccccacugcgggggccgccgguggaaauaccccacgcccccggcccgcgggaaguucucuaggguuaccuaggcgccccagggcugcgccuccccccacuugacccacccugagccguggcacccacaggggcgcgggcagguuaggcgccaagcccggaagcccgcgucgccggacgcuuagagcuggggccagcccggggcauccccgccgagcgcagacggccgggggauggcggcgaugaccaggguccaggucuccugggucccggcggcucgggucaagugcaccgccauccccucccagcugacccgucccagaauccgcgaggccuguacacccgugggacccccgccgcgcgcccugugcccgcgaccccgcccgggacccccacgcaucccggacgccccacucaggcccuccgcgcccgggcagacccccgggcucugugcccuccccaucacccccgccgccgccgccucagcgcccccagaggccgcacgccccucgcguccccucgcgaccugcggccgcaccugugcccgccgucgccgucgccgucgcucgccagccgccuucgcugugccggcgccgcuccgaaccccacacacaucgcuacacacagccucugacguca

SEQ ID NO: 1385 - RNA, 31225 nt, Mus musculus
cuuuugagacaagacucagaaacuguuuuauugaacugaacacaaaaagcccguuacaaugucaucaagccuuuaucagaaaucaguacauacaugagaauacacagccaagaugagccaacguaaguggucuaagcuuaaauaacauucagacuucuguauuuauuaggcugaaggaaauaaaaaccaaaagagcaauuucaauuucacaauucacaguugauugguuugaauccugugacgucagucagcucuguagccccagaacauagacuggcccacugcccgguggccugcucagacacucaacggccaagugacaaguggggagcgugauaugacacagccccacuuuccgguuuggacuggcauuucuuagcugcguucuuucuagugaaacagcaaaagcacauuuucgguuugccacacugaucacgugaaagguucacauucucucggcuuccugcuucacuucuaacuuaagacaauaacugaauuaaaacgcacccuugacacugaaagcaagaucagcuuugcuucuggaucaagagcacauaccccagagaggacauguaugucucagcagacagcugggaugcuugacagaguagccuggcauacccaauaaggcauuucgaaggcaacacacaaaacccaugccaggucacuacaguugacugggggugggggguggggggccacaggugagcagagucaacgugagacuuacaaagugacacacuggcuuacagaaccuuuggugggugaucagauacugaaagaaggcagaacaacgaccagccacguccaggaggguuugcucccgagagggcuuugcccugccuaagacaguaucgcucacccugacuuauggagucauuucuuaaaaccaacaaaaaaagcaucagguagagagugcaugagaggggucagugauggagaacaccauuuucacgaagggguggggggagggggggucacgugaccacuuacguagccagaguggucauaaaagccauuuaaagacaaaaacaaucagacagacccugcaugaguuggugcucaacagugcagugagauuuuagcaauugcuuuggacucaauuagaacuacaauuuauauagcuuggcauggugguacaugccuguaaucccagcaccaggagguggaggcaggaggaucgggggaguucaaggucagccuuggcuacauaguagaagugacucaccugagcuacauggaacaucacaaaaacaacaaauacccacaggaauaucucuguguuaagagaacugugaaaugucuaaaacuaaaauucuaguugguaaaaaauaaacacaguccuucuaagggcacaaaaggaaguguucgguuacacuggaagccuaagauuacaacuuaaaugcacucagguuggauugugauuugguucuccccauccaaccuauccaaccugagcaaaccccuucagcucugcagcgcuggccacaggaggcgggcagaggauggaggcagaccgcaguucucuccgacaugacuggagggaggcuguagacugccuaaggcuugcccagcccucaguagacaguacuguugucucagaguuuaauccugcuauguacaggcauaggaggcgagugguuacagcgccugggaguucacagcaaguccugucgggaacguaacguuugugggccacguaaccugguacggacuuguuggaaacccuaagcacacucaagaacagaaacaaggaagacugcuauccacaggagaguacagagacugcuuacugccucagguuaugaccuacacaugcugucuuccuaagacauuaacaugugaauauuaaauccuaguguaugacacccaugguagggacgcugucugaaauguauagagccaucuguccugaugggcagacagaagaacacagcgaugggcucaugggagucgugaggaaacccgaguagggaaaugucaacaguaggagauagaguuaggugugcuccaaaauguuuuccacuuugacaaauguccaaaauucuucauaaugaaauucugaggcaaauguuacuauuucuacaugaaaauugguuuaaucguauguucagaagguuguagagaccgcaggaaauuuaauauuuucagcuaaucgaaggaaggaaacugucauuuucaaaggccuccaacuugcuuaaaaaggucccucuauccacgcagagacgaaguacaacaccacccagagcuacagucuguuuguauacauaauucucuccacucuacagaagaaccaagccggagcgcggucacuguaggacguuugcuuccacaucagcaucucaagcucugaguccucaguggcaucaaacacaggcacagagaugacuacugccagccucagcagccaggcucccacccagagugcacacuucacccaaaagcaaauugagauugcacuaggaaauggagagagggaggcagacacagagcagaauucacaaggaccguugauauuucaagcuauuuaaugaacagugguuaauggcaguaaauccugucuucucuacccucugugaaaugcuaacacuugcuaaaggcacucauauucuggguuuaacggacacaaggucacaugggaccauaagccaggacuuuuuuuuuuugguagcuacagagaaagggcguucacaaagagucccuauugauaauggaaggaaacaccacacagcuauccauauaaaugucucaugagaagcuauuuacacagcuaguguucacucagcuacacugacacggcagcucacaggagacucgcccaaacagaacccaaaagcaacaaagcauuuuuuucccuaaucaaauauaaaacuccuaacaaagguuuaagggguagggagcaagguagaauuuuuuuucaaacaccuguucaaauaucuacauuaaacuucugcauccaacaaaaauguuuccccauuucuaaagacacuccaccacuuggguacacaguccaccaauuucucugguaaauuccuucggcccaaguucugccauuuacacaacauuccaaaccugcuauucuugagccucucugcaaagaaagcacuacgaggaagucacuugucugcccuugggcugccauugcucacacucccuggaaacacaggcugggacaguuccaagucccgcuguuaacucuuagauccugucuacacaggaagacguaaucagguacauguauguacguuuaaugguuuucuccuauugggauugcaagguuguagaccgagggcuacacaaagcucuguaggcagcucugugggguaaggugggagagucaccucagcagaucacaggcucucagccaccacgguccuucauccauuuccagggcuucaaaccuccucacuaauucuuuaagcccauggcaaacuaaaaaggaauaugagggggagcuuuuuaucaaggcaaauaguguggaaaaacuguggaaaaugcagaauucaguugguaagaggcaagcagacaggcguaagacaauaggcaugcauuuacaagcggcaggacacagaucaacucagaccagcaaagucucgucucaauguaaagucuaaaaggucaaagcacacagggauuuagcugaacuucaaaagcuaaugcccucugaaggcaugugggaugcagaccaucugacugaaaccagacucuuccugaagccugggcucuggguguucugacuggcuucaucaugaagcagagagccaccgggcggugguggcacacgccuuuaaucccagcacuugggaagcagaggcaggcggauuucugaguuggaggccagccuggucuacaaagugaguuccaggacagccaaagcuauacagagaaacccugucucaaacaaacaaaaaaacaaaacaaacaaacaaaaaaaaacccaaaaaacaaacaaaaaaagaagcagcagcagagagccacaagaacagacuucaaugcuacaaauaauugaugacacugaaaucuccuuaauuuuggacuaaggucuccauuugucuacacucuguccauccaugacuguaacacaccauaauauacaggcuuccugggggacggggguccaauccuacagcaaaaugaagccaacagguagcucgccugacugacucugaugccgccauagcuugaucggacaaggaagggacacuguccagacagcauucgcuuagugagaaacugcaccgugcaguucugauggccucugcccuacccaccgaauacaaguaaagacaacagagccucagccagggaacuuccaagugcuucggaaacccacagcaccucuaucaaugaccauagcagcuacuuaaagacuugcagaguucagaaacaaaccgaguucucacagguagccuggcacuggagugucauaaaaccaacgcaucacucucucuagugcaaagaaauacagaagugacacuauaaaucuaacguuucacucuaaaagaaaccacgccuacacgucccuaacauccauuaagggcacugggagacuagaaaccugaauucacaaggcuugagaacacaccaagcccuuaaguccacuguuuucuguauauacaggagggggguauuugggggccggggagaaacauccuuugacuugauucccagagggaaaaaacucaaagcacaugaauaucacuuuuauaaaauguaacuccauacccagaaucuuucaaugguaucugagauaaaaaugaggugaaauucucucugggcuaucauguaaaaggggggggguuuggggggggaggguauguaucuucagacacauacagagagacacacagacgcauacccugcagagaacagaugagacaguuaaacaaucacagaaccaaguggccagcaguauauuuaagucuaacgaagaauuauauuuugcagcaaaaugagcaaccaaauggcuaacaagauacacccuaagucgccuuaaacugaccagcucuguagauggccgcaggagggguuccuggugugaggaguugcgaauggagaucaagucugaggcuaacacugcucugucuucuguuucugaaggggaaauacuuagccacauagcucuaccguuccagaagccagcaaucacaaaauuaaccuuuaauuaugggucucgacuacucuaaagcagcaauggagagagaagaggcagcugagcauuuccucccucuccaucugcccggagaauucucaggugacugaguaaugaaauauguauuuguuauagugcaaaauccugcuugcccuaagccuucugcagacgcacgcuugcuucccuaaggagcacgggcaugcuggucuuacacaugugaaggaaaaaggacaaaggacacacagugaacacaaguucacauauaacacuccaucagucugucuagacauacacuauggcuuuuuauuuaaaaaauaagaaucccauuauaaucauuagacaccaaagucaucuguguuuucaaagucucuucaaggaggccaaggagaagaugcaaugguggcguuuugcuauuagaaaugacacugagacuugaucagcuuuuaaaagaaggaagggagggagggagggagggaggggcagagagagagagagagagagagagagagagagagagagagaaagaaagaaagaaagaaagaaagaaagaaagaaagaaagaaagaaagagagagagagagagaaagaaagaaagaaagaaagaaaaaggcagggguauuuuccaggcaugcccauuaccugucagggcauugucaggauacaaucgucaaaagccacaaaaugacuaucccaugaggucacauaaucaucagugaaaauagaauuccaaauugaaaucucaaacacauccucgaaucaucugaaaauauauuuucuaaaagaauauccaucuucaacucauuagacagucaaaucugggucuccaaaacugccagcaagcgaggccaugaggauggggugagcgaguggagaagcugauccaagcagggaaagagacggacgagaauuacauguguaugguucacaacuggagaugaagucacauguucagaagaacacaguauucuggacguauaugaauucaaggaaaccuauguguuaauuacggaggggggggcgggaggagggauaugccacagggaaccaggagcugcugggagacccaggcacacacccuaacagcacaucuuguagacaccacacuguggugguaaugguucccaggagcaucagaaaacgggaaucucuguuuaccuguuuucucuauaauuggaaguaagaacucaagucaauuccucuaaugugcguaaaccuaaaaccgcaaaaguagaugccauuuuuaaauaaucguagcucuagucaggcuacugcugcuuaaccagaacuuggccaagauaagaaguuacacccgauggggcagaaagcucacugugaguuguuugacacaguuggcccaaaagagcauccuggugaccaaagaaacgcaccucccuccccgaccccgaccugacggcucuggcaccgcugcagguuacucgcacuaagcagagaaaugaggaauguacgcauggaggaccacaaagcaaggcaggucgacagaaggcaaacaggcaggacaggcuucucugugaggacggccaucacugaacguagcccagguucuccaucucgcuccuguaccgcugcucggacaccuugcuuuugugcugcuugcucucuagaugcugccggaacuccaccucuucgccagccccaacguuacacauggagcaguaaaacuggccacuuggagucacgcacauggcgagaucucgcgggauccucugccgggagcgggcauugaaguaagggccugcugacgcaagagacagaagugagguagucaagguagaaggcggcuucuccggcacccacaaaaaagcguuguggcuuggcauugaaaccacagugcagaaggcagagacaggaggguccuggggacagaguagccagcuagccuagucaaugcgugagcuguagguucagugagagacacugucuugaaauauaaggugaggagcaagagaaagcuaccccaaaauuaaaccucuagucuuuacacgcucaacacacacacacacacacacauacacacgcagauccuuagaauguccauuuagaaaaaaacacuccaccaguccucacguaauugauaauucuaaauucuaaaucagacucuaacugaagaguuuaaaugaaggagaggugaauggauuuucuuuuaaauuacauguacauagaaguucaaccuacacacauaaaaugauuucccaacaagugccagggcagacuacagagcuaagccuguacucaaguucuaaaugcucgugacucuuaaaaauaaauguuuaaagacuguagccaagcaugguggcuugugccuauaauucagcacuugggagccuaaggcaaaggauugugacaaauuugaagccggugugagggacagaauaaagcccauggcuccagcccagucucuguauuuggauuacucagagagccuaaucugugccauccccauccuaaauguauuuauuuuccuugacauuaacacagcuagggggacguuccuucaucucagcuggcuuuuuaaauccagccugaccaucuuuguccuuugguuaacuuuggucauaacuaauaauacacugagauaauauucaucagacaaaagguuucucugacuuucuguauuuuguuauuuagcugucucuuguuauucggcgaacucuguuuuugcuuuccugcucauauaaacagccucugcgggcacacauagcauuggaggcugugguagccaggacuagaguaagcagagaacacuuccauaaacacacggcucucugcugaaugcacacaucacaagaauucccuagauaacucucacucauuaccuguauaaagaccacacugaacauggugugacuuaaaaucaggaagcaugagugggcaugcgugcuugaacguguccaguuucuuccuuaaaaacucucuacuuuauauuuugagacucucaagagccugaggcuugaugauucagcuaggcuguuaggccagugagcuccaaggaccucccaucuccaccugagauaagcggugugaauugcugugccuggcuuuuuccacuugacauuggaaucaaacucaggucuucaggcuuguauaccugcaccaucuucccagccccugagaggcccauuuucuaaugggcuuuacauauuucaucugauaacuauuuuuuuaaaaaggacuuauaagagacucuaaaacacuaaaaccaaaauaguauacugaauaggauauaaagaauaccagaaauaaacagcagccugaacagcuagaagagcaacucaggaaagcacccacuaccuaauucccggggccaccuacugcuaucuuuuacagacgccagacucguguaugcuuuguacacccaggaaacacaggcuaccugaauugcucuggacuggauacauauuccuccugguggccaccaucuuaaauucacucccuucuuuccgaguccgccguugcccugccucugcggagucccuggugaaaggaauuugaaaugagugagccagucgaacaaggcucccuuucagcuucuccucugccacagucucucucacauaacagucuguccucagaggcaauggcaauaccuacgagaaugagugacucugagcuucggccagacggagucucuuggcaugguucuuccccugguagugcgccugugccacggcaggggagcugaaggaggcaucgcacagcuuacaguagucauucucuguagccaggaucacccugcccccuggcuugcaggagcccaccugccagcaaagacacagaagaacaguuacaccuccccucuccuccacgauccuucagagccuugagaccuaaccauagccuagggcauggccacagacacugaauuuuauuagaaaguaaauccccgcaaagagagacugggagacccuuugucccacuuuggauuacaauuuccuaugaaccaaagcacuaacuaguauccguugagaaaauggguuuaaaguguggacauuuaggguaggaaacaagugaauagguaaagcuaaaaucuucuugccaaggaaggcuacucaaaauccaccaauaagcaaugagcaccuacuguguauugagcaaccuaccuuacugagcaccacuguguacugagcagcccaccuagccucaaagccacuaaguuuugaaaguuccagucccacaaccucuccaaaccaccugugcauacauaaccagggacuacaccucacuaaaccaggaaaacaaucacaagauacuaaacugcacuggacuagcaaaagcuacaaaguaaacucuggauagaagaaagguuaagauuuguggaaaccauaccuuaucuagaacaaaugggggggggugggggacuagcauuuccugaccuagaagagaagauucuccagagacagcaugguaucuucauauuucagaguuugugcuaaacaaaauagucugugcuauugucccaagaggaaagggauggccacccgacucucuacagcaucccuaagaaacucguaauguaaaaaccacucggcuggaagacuucugcugccacuucuaauauaucucuuucucccauaaaucuguggagacucagcagggguaccuauuugaaggaggaaaacacuccagaagguaacguuauaccuuggugguugggaacaucaggcaggcaugaaacaaaauuuugcuuugcaacauuuuuaaagaugcaacccagagaaaguuacuuagcuuucccaggcuucuaauaaagaccccacaaggcucaugcugccaguccguggacaaagcuuugaauaauaaggccaacacuuccaaguaauagcaaauacuaaaugaggccaggguccaagacuaggaugaggccaauuauaaaaucuauuaaaucuagugugugggguuuaagacaguaucaaagcaaucaagauaaauaauauuuuaauggaauuuuuucgauuuauuuuacuuuauacaugucuacauguacguauguaugcacgacauguggaccugggacccucaggaaucagaacuaaguccccuagaacuggagguacagaugauugugagccaccuuguggcugcugggaaaaaagcccaggucucacgagagcaguaauugagcuuaaccacugagccauuucuccaguccuuaaauguuuuguuguugcuguuauugcuguuguuguuauugcuguuguuguuguuguugucguuguuguuuuucagagcaaaauguagacauuacauagccauuuaaccuaaaucuggaggcacagaacaauggaccuaacaauacuguuccaucaucccacacaucacugccaaguccaaugggagaucccaaggcucaaaacuuuuggcagacacagcuacagucguuaggaagaccaagaagcuuucaggguguggcccagccugacccugacagacgugggcacaggccacuguacucaugaccacguguauaugacagccucuugguacugcacugccucaccugcggagggacaggaacgagggguguggcuacaggcucugccaccacgcugcucacccuggcuggaggaggacagcuguuagcugcguaauaauuucguaguuucuugccaugguuuuuacccuagagguaaacacaaagcagacaaucacaaagaggacacuuugucagauggugaucgucgacgcacccacccagcagcacacaggacaacagaccacuggccaguucuggcgccaucugaaagaacaggaguccgugcuugcucugugucuuguugcuguggucaacggcaugaccaaaagcaacuugguagggggaaagguuuaguuuagcuuacacuuccaggucacuaagucggagcacaaacuuaugcagggccagacagaacucaagcaggggcaguggaugagcacugcgucccagcucacccacuggcucacacucagcuggcuuucuucaacagcccagacccacccuagguaaagauggugaugcccgcuguggcccagacccucugacaucaacuauuaaucaagacaaccucucacacacauggccaagaccaacucgauugaagagaucauucaaaugagguucccucuucuugagggguugugucaaacugacaguaagaaauuuaccauuugguucuaagagaaccauugcauuuaucuggagaaggucacagaaugcagccaaaagauauuaauuuccucuaaguuucuagagaagguucgcaccucccagugcuguguccugccuaaagcuuagcgccauucacacaacugcuucaguaggaaucuugagaugcucugaucuaacuggcuucugaaucgagcaaugagacagcuaauccaaccacuuuuacaaaagcagcccucacacagggacacuucauaccgaggucaaugugcacgagccucgguucacucacugcucacaaauccuguaacaagcugcugauaucgcccacgccucacagcggaggaacugcugugggagugggcacacaccuucagaagggaacauuagcagagccaugacuuuaaaccuucagcgcagcccuuaccacacuaugaacuucuuccaagucggaguggccuuucucaccaaguuuuaaguuauaaaucacagaaguauauucccuaagcuaauaaauaaaugcaaacuggugggaagaaucagaggcauucugacgggacugcagagaugacccagaaauuaaaagagcuucccacugcuauagaggaccuggguucaguucccagcacccacauuaggcagcucauaggcaccuguaauugcaauccuagaucgaugccuucuuucagccuccguacacuccaaaauaaaauuacucugaauguggguaaaacaguucauugcuuuuaaaccauguuguaaaaguuaagccuucauaccaacacuaccagcuaacuccuaggaaugaacuaaggaccaacagacggccgaaagacagcuaaguuccauccccugccauccaaauguuccagccacaccauuuccaugggguuaccagagagucaagcuucugguucccucuaugaucuuacgcgaacucuaagcaauacaacaccauggacccucccucaguccuucucagcauguucugccuuccauggcucccucuuaucuccucccaccucucuucuucugucagaccuuaagcucuacggugcccacgguccacccuuggacuucucuaucugugccacaacucuaguucacuuuacuuggcuucuuauagacaaugaauaaauguguggcagaugguugugauuguauauaccuuuuaucccacccagcacugaagagguaagagucagguggaucucuaugaguucaaggccagccuagucuccagagugaguuccaagccagcaaggcuauauagugagggucuauaccaaauaaacaaacaaagacaugguaguacacaccuauaguuccagcuaguugagaggcuggggaaggagggucacacaaguucaagaccugccugggugacaaagucucagaacauaguacaagaauacaguauaugaauggagugcugugagaauucugaaugcuugugagaaaacucaaaaaaaaaaaaaaaaaagccacagucuugucaccucggugucuuugaaacacacaacuauucuuacaaugugcuuccacacuccucccaggugcauguaccagacaggaguggguuuacuucagcugcuguuauucguaugccucagccaaaaaacacgcuucaccacgcugggcuugucccugugcuuguacacuuugcuccggugacucuuaacccucagagcauaaagugucugauacucugaauaaaguuggcuauugcaugggacugcaguccaccucauccucacgucccacugucccagguucacgacaccaccaagagcaguaauaaacacaggacuaucucaaaauuaagaacugagaaggggugaggggcacagcucagggacugaacacaugccuugcaugagcgaagcccuggucccgugcccagaaccaccccuucccacgcucuuuggcaagccccacuguaauuaauagucacugcggaugagaaacaucacuaacuaagcaaaagugcgaugagaaauaaaaacacaauguggucucaaaauaucuguccauaugauccuuacucaacagggaaacaguaucuuuuccaaggagauccuuguagacaccaccuuaacugagagauaauuacgccauggaagcacccugacucauucagcacaaaggacacagcaucaugucugugguacucuugccaaaacccauauagccuaaacucaauuaagccaggcaaaaucugcaacacucaacaaaaccauucuucaaaaaccaguaagaccauuaaagaagacaaaaaugaagaugaggaggaagagaaggugguggaggaauggcuugccuaaguuaaagaaaacauuaaaauuguguguagauuuuaguuuuggacuagucaccagaggcaaaagggguagacaguggugaaaugacaacaguuuccaaaggauagaaagugcacagcuuccauccggugcuuuggugugcuugggguggguuuauuguuacaucuguuuuuuuaagcagagucuaggcagcucaggcuggcuuagaacucaugauaaaggcaaguggaacaccugaccauccuaccauccucccgccaccucccaagucuugucuacgugccaaacacucagcacaggaucugggucugagggcugauaauuguacuucuacguagaccauccauacuugggaaacuggaugaagcucaagucuguaagucuaagacaagaagcaguaaucaaguuuuccaaacccuuaagaaagugccauagguuuggagagauggcucagugguuaagagcaucgacagcucuuccgaagguccugaguucaaaucccagcaaccacaugguggcucacaaccauucguaaugagaucugacacccucuucuggugcaucugaagacagcuacaguguacauagauauaauaauaaauaaaaauaagaaagaaagugccauaacaggaaacagucauccacuugcagaauuuguuacaccuugccaccccacuuuacccaggggccauucucaguggccaaagcaacaucaggcacaaggaacuguuuggacuaccugauacguguugacaugaagguucugugucaaaaaucacuguucucaaaggcaaaaacagguuguauuucuaauauugcacaucaggcaagcauaagacuaccaaguaaauacucagguucaugacuucauauucuuaauugacuucccauuuuaaauggaugcucugaaaggaguaagaaaucaagaacccugcugcuuaaagaacagcuauggaauuaaaacagaaagaaaaaauagcagcccgguguggugauacacaguuuuaaucucagcacucaggaggcagaggcagacugaucucuaagacagaaggccaggauggucuauagagugaguucuaggacaacuaaggcuauuuaaugacugagacugugucucaaaaaacaaaaacaaauaaauaguuaaaugaaaucccauaguauuucaaaucaaagcuacuucuaaaauuaaaacugagugaacuaauaauuagaagggaggagacagaagcccacccuccccucgccccuuggaaugagcaauguggaggccacucucgccccucgggacaggcagugcagaagccacucucgccccuuugggacagguagggcagaagccacucuaaccccuugguuucacuucuggagccacacuguauaacacagaaaacuccagaaauaaagauucacacauuuuggccaggcauguggugaaugccuuuaauccaggcacucaggaggcagaggcagaagcagguagaucucugagagcucaaggccagccaggacuauaaaucaaguuccaggacagauaggguuguuacagggaaacccugccuuaaaaacaaacaaacaaacaaacaaggcaagaaaagaaaaaaagaaucaugauucacacauuuuaaaaacacuuguaauucaucugccuggauaugacccauccuuucuucugguauacccaugcucaaccugcucucaccucaguccuuagucaccaccaggagauggaugcuguuguaugacaacaccugugugcuaggaaccaccauuuucuguaaagauggugccaugguguaagugcuacaaugcuggcauucauacaugacacagagaaaaugguaagcacucccuugcaguaaaaagguaaaaguucccagcuuaauaaagaaagggaaaauaauacagaggugacucgugucuaugcugaagacagauuuauccaugaacugugaaggauagaaaguccaugcugggccguggccacccucagaacacacacauuacagccaugugcacacgugcuugguucaacuugugaaugcauugggugggaaagcacaacaccuacaggagugguacccuccagagugucaggcaaccuccggaggaaggucacaaaauggcaggcagucccggggauaagacgaaauuacuauguaaaaguaccagucaaagauccaaaaucgugucuaucauuacaucacucuauuucaauagauugcgcaggagcaaaaagaaaauuagucaagggucaagggauagggauuguaagguuuccagauaugggagugggggaggcacagaggauauuauuuaaaaaaaaaaaauuuuaaccgucuccagaacuuagauaauagaugaaaacagacaaaguuuucuacuaugugcugaccagaacaaauuuuaaagacccagagccagacacauccaucaguaugaaauuucagacucaaagaauaaacgaggagccuaaaaccuuacagggaaggaaacagagggagagacaauuaaagcagguugccuacaaagaagaaaaaaaaaaaaaaaaaacccagaggaagguuucucuuccacauuaggugagucuagacaauggagaacaguaaauacuaccuagagcuacgcuucuaguacagcacaaugcagacacauucuugaaguguaagagacaaauguuuacuuccuguuacuucuucauauuauuuaaaagugagguuugcuggugucuuaguuaggguuccuacuacugugauaaaacaccaagagcaaaaccaacuaaagacgggagcauuuacuucaacucacagcuuauaguccaugacuacaaaagccagcagaagugcagccaagcuguggagggauguaguguguguagcugagcuguggagggaugcugugugcuggcucagcccgcuuucuuauaccauccaagaccagcugccuagugguggcacuguacacagugggcugagucccugcacaucaaucaaucaagaaaaugcccuccuuccaugaguucucuguuccacagacuugcucacagguauuuucucaauugagcccccuuuaccaagugagucugguuuguguugagacaaacacaaaguaaccaacaguuagaauacacaauuacauuuguucucucuuccuuggaguccuguguccaagcugcauucugaggaaacauaaaaggggguuagagggaggacaaggaaaaagauaacaauguuuagaaaauggucacccaaggaauagugaacagaaguacaaaguugcacauguaaaacgagccagagggcaaacagggggaaaugggguaagaaagagagaccuaagguacaaaggggcauuucaugugaugauguggguagaagucuguggaggaggguggugcuauaauaaaaaugauauaagagaagauaaaguacccaaggagcugaaggggucugaaacccuauagguagaacaacaauaugaacuaaccaguaccccuagagcugguaucuccagcugcauauauagcagaagauggccuagucagccaucauugggaagagaggccccuuaguauuguaaacuuuauaugccccaauacaggggaaugccagggccaagaagugggagugcauagguaggggagcagggcagagggaggguauagggaacuuucaggauagcauuugaaauguauauaaagaaaauaucuaauaaaaaaugauuuuuuaaaaaaaagagagagaaaggacaagaaaagcaacugaaauuccaggaagaaaaggcuacacaaggaguccugguccaacaugaaaaacuaacacaggagucagugggcuucaugcaugcaaugcauuaugaaugcauuauucauaaugauuaugaauaacaaagagacagacugaagagguaauguggggaggaaagacgguaauggguuucuuuagggcaugugagucuuccuccuguucucagaaacccaguagaaagucaagaaaaagcagcacaauuucaaguuuacaauccacguauggaucacaauaaagaagacuugauucugagcaacuguaauguucuccguguaaacacccauguaccugggaucacaaccccgguguacacagaaggaaacaacuguugcgcuggacacuguuucucuucuccugaggacccgaaggcccaauggcagucuucaacaacuggaagcaacagaguguggaacuguaaaaccauagcaaauccuagcugagagccagaaagaagacuggagaagaaaagacacagcgcaugggaaugccagcaagcauccgcuguaucaccaugaguucucuguuccacagacauuacuuggagugacaagauacuuucuuaaguuguuuaagagggaaaauguuaccaguaucaaaugucaccaagauggcaagagagacacagcuagauuuggccuaccaggucaauggugaccccaagaggaccagagaacaugguggaaagggggacagaaaggacuugacagcacagaaugggaggugcugggccucggaggucccaccucuagcugaggaacuauuggcagcugauaacuucugggggaggggaacucacuuuuccucaaaggugucaagugccaguggaugcaauggauggccccauacucauacauagaaucagacccauuuuuaaugagaguagugacucauagaaaaaaaaaagggggggggaggaaggaggagcuggaagagaaaaugagagguaaauauuuucaaaauacacuguauacaguugagaaauucucaaagaauaaaagaaauaguaugucuuaaaaauaaugagcaggucguggugguguacaccuucaaugucaucacuugagaggcagaggaaggagaaccucugugaguuugaagccagccuggucuacauagugaguuccaagagagccagaacuacaaagugggacccugccucaaaauaaauaaacaaacaaacacaauggugagaaagaaaaagaaaaaagaagacaugaaggugggugaggaacauguugagaaggggccaugugggagcugaaggagaaauuuggggucaaugcgaucaagguacaugguagauguaugacauuuuugaagaauaauuuuucuuuaaagaaaaaaguaaagggaagauuacuguugguauuuuaauauauucagaagacaccugagccugagauuuucuuuguuuguguuugcuuugggguuuuuugguuuuguuuuuauuuuucuauaaucugaauauuaaacaacggaggcaauugguaaaacccagaguagaggauggguaguccaacugguccagagcaaggauaucugucugaagggggcgaugagaagcagguggacucagcuggagaggcagaaggcugccaagacccagcuaaugacuggauaaggugaggugcugucccaugccggggucaaagcaaggcuuggaugugcuuucagucaacagaaugagagaaccagcaaggguuccuccucagguaaauggaccaagcucacagacuugugguuuaauaaaaauuacauuuauaccugagaaucaugcucgaggaccuccauugguugaaucaggaaguaggaccugugguacucuuaucauucagcugcuagggaggcugaggcagaacaccugugaggucaagaccaugugggcaacuuggugaaccuugucucaaaaaucaaagguuuaaaaggcuggggauguagcucaguaguaaaauacuuguccagcauagggcacuaggucuaaucccagacugcucuagaaaacagauaagcuggugucuagauguuggguagcaccuuuggagaugaaacguccucacacaagguccuaggcacuaucacagcagcuaucacagugagauggcugcauuccuucacuuaguauagcuuucuaaagcaacaagaugaugugguuuuguguauuuguacagguuggguuuugucaacuugacacauccuagacauaucugagaagagagaaucuuacuauaacaaagccucuuuaaaauggaccuuuagggcuagugagaugacucagcaaguaagaacacugacugcucuuccgaagguccugaauucaaaucccagcaaccacaugguggcucacaaccaccaguaaugagaucugacgcccucgucugguuugucugaagccagcuauaguguaccagagcacaaauacacauaccauaauaaaauuacauuuuaauaaaaaaauaaggugagauuagaaauacugacauccaugcaaaccuggacgggugauauuaaacugugucuaaaucaguggaacacuguaauggauaacaaaguucagcaggcugagaaagaaugggaaaugaagaucuuuuaugguccaggcacaacucugaaaauagcagagggaagagaaaacgcuaagugaagggacuaagcauaaaaggaaagucacugcuguuuaauuuauaugggaagaugcaaucacagugugugugcauuccugagcaugcagaagccagccgacacagagaaucuuccuccacuguucucuacuguauuuuuugagauacugucucuugagucugagucuuauuuuugggagcauggggcugggaggaagaagcaggccaaacaucaaccucuuagagaaccuggaaguugcccuuuuugcuggacuggcaggccuuggcauccuccuaucucugauuccuccacacccccucuuuugacccccaagggcuagcugggauuauaucugagaaugacacccaacuuuucugugggauaggagcugugagcuagcacaguacuuuacccgauguaccaccuccccagcccacacucuguucagcauguuaguacauuuaguaggacuggagaccacugcauuuagcaucauagaacagcuugguuucucucaucaacauggcuaacgugacacacaucuggauaccaagcacaaucuaugucuacgaugaacuuuagaaaagugcuuuguguaacuaguucuuuuucacaugaauacucaaauuagcagauaaauuucuaauuuucaagguggacaccuaguaaacuuuauucauauaguuugcuuugaaaaaaaaauguggccugcaagagagcucagcagauacaagcacuugccaacaagucugauaaccugaguuugaccacauagacauacauaaagguaaacaaauuuccuguuacuuuccuuucaaagccacucuuccucugguuguuuaugcugaugagauccuauuauacuucuuuaugccaggcucgcacuacauaaucuaaggauggagauaaauuuuaauaaaaugaagacucauuucuccuccaagauuuugaauuuaaguuauaaacaaagccauaguuuuaaaccugaaaaauuagguagacucauuaaaaacuaaaugacucggcugaggcugcuucacagcuaaaugacugggcuaaaaagcauggggcacaaaccaucugcgauggccaccaauggcugaggaagacagaccccagcgaggaacaucaagaagucagaagaaacggaggugagugaggccgaggggagugguuaaggagcagacucuacuguauccugaguacuggaacgugauauagucagacuccaguuaacaauggcugcuuacgacacugagcaauaugaaacuccgcagucaacaacaggagcucacuaaagagggucagguaauacagagggugaacugugauccacacagggccuguccacuuccaagcacgugacugagauaagggauguuuguccgugaucucacccugcaauaacaauugcaaagcagguuuugcaucuugcaacaaagcuuuacauguagcccccuuuccucacaaaccauuggcuuuaccacucugcacucacugccuuggcaugucccuagugcuagcgaguccuggcucccugugucacccuggcccuaacagcuuucuuuuauuagcacucaguuaggccuacucacucaggcaucuuucagucugucauuuuucugauugaugugaacaggaucucaaauaccccaggauguucaggaguuccuagauacaauguagugaggaugccuugaaucguacacucuacugccuccaccucccaaguacuaaaaucgcaggggucaccauuccuggcucugggcuaacauugcuacaguuuucuuccaugaugggucaccuguucuucuuggcuccacaugaucaugcccugauuauucuuccauacacucucaugcugacgaugucuuauagagauccaaaucucagacacuggagagaugguucccucaguaaagcaucuggcacaugagcagggggaccugagugcagagcccuaggguacacaguuucucucuccuggcuuuugagaugagaucucacaaaguagcacuugcuggucuagaacucccuguauagaccagguuaacacugaggaggcagagauagacagaccccuggagcucucacuggcccaccagccuagcuaaaucagugggcucugaguguggcacaagacccuauagcugucuccugcaaggcucggccagaacaugacaaauacagagguagaugguuccacuggagugagcacaggguccccaguggaggaguuagagagaggacugaaggagcugaagggguuuccaaucccauaggaagaacaacaaaaucaaccaaccagaccccccaaagcucccagagacuaagccaccaaccaaaaaguacacauggggggaacccauggcuccagccgaauauguacagaggacggcauugucuggcaucaauaggaggcccuugguccugugaaggcucaauuccccaguauaggcgaaugccagggcagggagguaggagugagugaguaggagagggaacaccucuucuaagaagcaggggaagggagaaugagagaaggggguuccagaagggaaaccaggaaaggggauaacauuugaaauguaaauacauaaaauauccaauuaaaaaaaaaaaaaggaagaaaguaugguaaagaaugguugaagaagacauccaacaccgaccucuauccuccaaauauagucacacacacacgugcacccguacacaggaauguguacaaauacauacaccaugcacacacaauccaaaguucacuucuuagaucuguucucuuccacacuacuccaacaaagacacacaaacuccucugccuugcuuuaaaggcagaaagaaggggggcggggagaaauggaccucagugauuaccaguaccacuggccuuauucaaaccuuugcuucuaagcuaaguuagaagugugcacugucacauccgauccuacauugguuuuuaauugggcucugcuuucuuuuggggggcgggguguauacaggaucucauguaguccacgcugaccucaaccuccaucagcagcaggaguuuuccacggccucccacuccccugcucuccaacccccaagugccgggcagggucugcauccuucauacccagcugacucucaucgccuccauuuuuuauacuuaugcuuagcuauuugacuucuguucugcaaccaaaaguccuucuccccucaauuuucccauuuaaaauuuuuguuacuggggaauuuuucucauuuuuuauuucuguuuucuguuuuauuuacccacugcaucaugaaggaaacaggaauaauuuacagauuuacaaaucuuguuaacuaaaaaguuuagagcaaacacauaaaaauauacaauuuuuuaaaagguugacuucauuaguaguuuaagccuaaauccaaugauuuucccaucaaacuaauugucugugcagagcccaaaguuucuaucaauauguagacacaauaucaauaugagucacaaaacuguauugggggaaagcaacccaagguacaauauaacccacacaaacacauuaaaaucaggcauugcuccugcgaggugauggaaacagaggcaggaggaucucuguuaacacaaggccagccuggucuacggagaaaguuucagaacagccagggcuacacaaagaaacccugucucaaaaaagaaaaaaaaaaggaaaaauuuucaaaaaauaaauaaaauaaaaacacacauuaccugauuuucccuaaaaguaguaacuaugcaaaaggcaaaaagcaggcuuuugcccaagaaugaucgaagaggacuucaaagagcuaaagaucugagcuauccaacucauccuugauuuuugcaaagugagucuugcgcaaagaauaauaaauacaaaagcaagcuacauucaugucuaagaugggucauccuaacagaugccaccggaacaggaagaagggagccagugucuggccuaugucaugggggggggggggggagcacucaggggagaaauccacggaaaccuuauaugaacccaggcugugcuuagagcugcugcaaugaacuccacucugcugacggguacaaacaaaccugagcaaggcagagccacagaccuuccuucccaaggaaauacuucuaaugcaggacaaaccauucaaucauccaucuuuaggaucaaagacaaaacuaaguaaacaaaaacuuuaaaaaggagaaaaguaugaggagcuggcaaaguccugagugaaugugcauuucugacaugagcauggggcugcgucagggacccagagcccagggacucaugggaauggcauggccuuccuaguccccugaacuugagcacuacucuuaacaggguguacagaaagaaccaagaaaugaugccugcagccuaaaacugcuccccuguggagucccccuccaaaaguagcuaaccugccuccucuugcuccucuacagugcagaguucccuagccacugcauucuaaugcauuuccagcggagaucccugccuaccagguccccacuuuccuaaaugcugucugucuuuucuuccuuuucugucaccucagucagaucaaucugaaacuaguaaagguuauaacagaaaaguauaguuccaggcaagaagaaaugcuuuauaacuaacagcuuacucaaauugccacagucuacucccuggcccccauaggcuuauucaaacaugugagucuaugggggccauaccuagcuauaauacaaaauauaauuaguccaacuucaaaagucccagaguccuucacagucucagcaaugucauaagucccaaguucaaaucucuucugagauucaugcaaauuuuuaauuguaauaccuuuuauaaaaucaaaaucaaaaaacagaucacauacuuccaucaugguuugaauaugcuuggcccaugggaaguggcacuauuaggagcgauggccuuguuauaggaagugugccacuguggaggcggggcuuugaggccuccuauaugcucaagucuggccacuaugacacagucucccccuggcugccuuuagaccaagaauuuggaauagaauucucaucuccuccagcauuauguuuuucuggaugcugccaugcuucccgcaauuacaauaauggucuaaaccucugaaacuguaagucaauuacauguuguuuccucagucauggugucucuccacagcaauggaaacccuaacuaagacaggauccagcauucucuucuggcuucugugucugcccacgugcacaugugcauacacacguguguacacacaaaaacccauaacuaaaaauaagauaaaaauuuuaaaacagacccuuuccuaguuccccauuuauucuuaggcaauaauauccuuuccaaugaucuuuaccaugaucuauucuauauagagauaaaaggcuuuaaaucuuaguauucaguaacaguucacuccgaauacuaaaagaaacuaagguauguuuaugaugaagguaggacucaguaauucaauaccauauuauucucuuuauaaaacgucaccuguauuugccucagcuguaagagggcacuuaggaaaagucuuaaguaaaauaaaguguaagacucaugugguagguagcauugaacugacgcaagcuguacaaacuuuagaacaauuuuacacugaauuaauguagcacauuacacauucuccucagaaguacaagcagaacccacugugugaaacacggugcucauucucuagcucgucugaguuuccagccacagcuggccauaacuugugaccagaugguacccaaagugcucaccccgcugacaccaucuaaccaaccagcacccaaaugcucaccccgcugacaccauccaaccaaccagcacccaaaugcucacccugcugacaccauccaaccaaccagcacccaaaugcucacccagcugacaccauccaaccaaccggcacccaaaaugcuuaaccugcugacaccggcacccaaaaugcucaccccgcugacaccugcuguccuuuccaucucuuaccugauagugugccugggcuugcugagcggaguucaaggugacauugcagaguuugcagaagaggggcuuacacagcuccuccagggcagagucuggcuccccucucuuagcuaaauccucuuccccugccagaggcaaggaugcuuccugcccaaaagccuucuguggcgggagcugcaagguccuuguggaccuggcagccacugacauaggaggagagguugaaggccgauuagguaaaggaagccagaccugcugcaaaagaaucaucaggcaggaaagccacaagcauaaucccgugggugacaagggauggagucuucaaaccuaaagcagccagggaagaaaauuaaaaugagagcucagcaacacggaaaugacaccaaagccacuuuucucuccaaacccuccuuuggggcgucucuccuuacucauagcccagcagacguccccugccugguuauccccacuaacauaaggcuuugcccugagaacagcuucgagauuugccuuuauuuugcuuggcucaguuccaaacgucaucccucuggccaugggcauuaauuagcagcacugcauccaugagcaauuaaguugaaaagucacauggcuggaacuggacauuuaaggucauccagaccccuuccucuggagugcugaaacacucuuaacggcaauauucauaacccaaacaacaaacaagcaagcaaacaaggggaaagccaccagguaagaaacucuuccacccaaaggaugucaacgaguagaagauuaucaccucuaagaauuuccuuuccucuuuucuuuauuuuuuuuccuuuuagguauuuuguuuauuuuuauuguguuuguguguguguguaugugugugugugugugugugugugugugugugugugugugaaugcacaugcucgcacgccacagcucuucccaccuuuacacacauguguguaccuaagaggcaaagcaguauuuuacccaccagcaaccuuuucucucgguuuuuguuuguuuguuuguuuguuucguuuugguuugguucggcuuuugguuuuucaagccaggguuucucuguguagcccuggcuauccuggaacucacucuguaaaccaggcuggccucagacuccgaaaucugccugccucugccucccaagugcugagauuaaaggcaugcgccaccacugcccggcagguguguguuuguuuguuuguuuguuuguuugcuuguuuuuaaagacagggucucacauagccaggauggccucaaaucugcuauguugcugaaaaaggcuuuaacuuuuuuuuuuaaauguaccaaaauacaaacuauuuucuuauaccuuaaauucuguaaaauugcuaaauaaauaauaagcauaggaccugugagacuuauaacaugaaaaauauguuugacaacacaugaauuacccacuuuuccucuuuaucuuccugccucaaccuacuagcugcuacaaucacagugcugcacagccacacccagccacuagucagguauuuaagcauuucuaccacuuguugaaaggugggugaaaucuagaaacagggcauuaaaauguagcagauguaaaucaauugauacuuccaagcaagcaacaguagcuaaguaacugagccagugguucuggaaggcagagaagacagcaacagccugugggccucagauggcauaaaugugcuguuuggaagacauaguuuuguuuuacuuuuguuuuuaaguugaguuaguuaucaauauuuagaaaucaaaaguuucacagaaucuaguaaugaaaggacaaucugacaacaccauacccaccuccuccaccacacacaaccagcuauuuggugucaagcauacuccauacccaggccagccuccucuuggcccccucaacccuacucagggcauugacuuagugugaugucucuaugucauccagucuuagacuacagcccuugcaaaaucaaaauguaaucucuauuaggagguaaacuaccuauucaauaaagcauccagauugaaaaauguccaaccaaguaauggaccacacuauccuaagcccuaccuucagugucauuucaguugucaacuugacaggagcuagaaguaccuagaaaaggagucucaaugaggagugaugcagguuagguugggugucggcaugccuaugagggauuuucuuaaguagguugagguggaaagacccacccuaaauguggcuagcaccccuguguggguucuggacugcaucaaaaggagacagaacugaacaccagcacuguucucuucugauuguggaccugauaugaccaguugcuucaggcucauguugccuaggcugccccaccaugacagggguaccuugaacucuaagacaaacccuuucucccuuaaguugcuuuugccaggauauuuuaucauacuaacaaaaaagaagccaagacucucucuauucuguuuuccucagaauagauccacuauguuccacucccucuauaucuuuaucccugauuccuucugcuccccaaacagcaucuuuuaguucucacuacuuaaaaaacaccccacaguaaauaccauucaaguuucucagauucuaauuauccaaauuaaaauccuauuucaaagucuauacuuccagucagaugguaguggcacacaccuuuaaucccagcacuugggagacagaggcaggcugaacucuggcuucaaggcuagccuggucuacacagugaguucuaggacagccagggcuauguagagagaauaugccucgaaaaaaaaaaaaaaaaaacaaaaacaacaacaacaacaacgaagucuaacguccauccuauuaggaguaucguuuaagcucuuuuuuuuuuuuggucaacagaauucggugucuucggcuacugagcuucccugucugugaugaagauguguaggcuaggacacuaacagucuuacuaaaaugacucaaggacgcuuuaagagggaaaaaaacauuuguagacacacaguggagaggagccacugacugggaagucauucaguuaagagugguuagucuuaauauuuagcaacacuuuucauuaaucauaauggcuagaaaaggauaauaaucaacuacccguaucucuggaaacacaaaggaaagugauacagaucugauacauuuaaacaguaaguuucucugaaacaauauuaugucucccaacuaagacauucaaagagcaaagaugauuagggauauuggaggcaggguaaugaaaucaucuuuuuaaauagauuaacuacuuagauagaacggaccaugucauucugacccuaacuugucauccagauucucuguuagaucauagagaaaggacagggcaggauaucaaaacaucuggauauagaaaaucagcaauauacauagagaaccgaaucagcaugcucccaagacaugccugggcuuguuucucacaugcuuacucccaccugaugaaaccccagcaugcguggccccagaaucaugcagcaguccugcagaaacaaggcccuccucccagcagaggcacaaaaaggccuuauuucaaagcaaaacacuggccggccgggugggguggggguguuuacagugcagguuuaccuauuauuacauuuuauguucauaauguucaaagaaagaauagagaccucaaaaauacuguuagauuuaauaaucaacauaagguuaaaaaaaaaagcccucccccaaaagucuauaggugacaaucacaacagguauuacauuuggguaaaaauaaauaaauaaauaacucuaaaaauaaauaaaaccaaagcuaagcuucagugaauacacaagcugaaauacagacucaaaaacaugcucggauccguucaaacugcugcauuaauuuaagagacuaauuuagaagcuguuauaaaaauacuucucagaucucaaaauccauccgauuggacgugugcgauggcagacacgaaggaugcacagcgcuugauguccuaauuuggaagggagcucagagacacuaaagaaaaucacagcuccaccauguaccggucugagggaaaugaaugaccacagcacacguuuccacgguugggcuggggccuacuccucaccggcuguacugcaaacaacagccuccccugagcagaaacagacccagggcaaagaagagaauccaggaacagguuccuggcguccggguaaaguaaggaaggcuaccccuggguauuccggagaagagaagacaagagaaaaccuuacucagaggucaccaaaacguggcaggcagaaaaacagcccuggcaggcuguuuuacaucacagaagaaagcuuagaaggggaggaggccuuggcgacccaggcucagcaucuaggacucaaaacugcgccccugcagcaucgcccccgcgugugccauucccgggcugggcaagcucacacgcauucggguccugcgaggaugccggccgggagcaccgagucgccgaggcggcugugcgaauggcugcgggaucgggaucgguggcccgcuggacgccgcgggcgaggcugacacgcgcacacggacgcaaccgagcggacucgaggaccgcacucaccggaaccggcaggccgcagccgccccgccaccccgcgcgccgcugcccgcuccaagaccacuuucugcgcucgccgccgccgaccggccgcuccgcugcuggaggcugauugucaaaagucggucggagcggagccaccgggaaacagcugcaggaagugacugcggaaccgggaggcggcggcggcggcggcggcggaggaggaggaggaggaggaggaggaggcagggcucccggcagcgcuacugcgcaugugcacggacaagcggcugcucccgcagacccgggacgccgagcaggugcggaacagcgacucgaaaggguacccuacccuggcccugauggcuccucggagcugccccagccuacccugaaagcgaugagggcagaagcuuggcagagccugguaggagggcggagguucuccucugagaccuggaaacugcacuccuugcgccuccgcccaaagacauuggaaaggagcccgcucaccggcaggacccgaaggacug

SEQ ID NO: 1386 - RNA, 2471 nt, Mus musculus
aaugaccacagcacacguuuccacgguugggcuggggccuacuccucaccggcuguacugcaaacaacagccuccccugagcagaaacagacccagggcaaagaagagaauccaggaacagguuccuggcguccggguaaaguaaggaaggcuaccccuggguauuccggagaagagaagacaagagaaaaccuuacucagaggucaccaaaacguggcaggcagaaaaacagcccuggcaggcuguuuuacaucacagaagaaagcuuagaaggggaggaggccuuggcgacccaggcucagcaucuaggacucaaaacugcgccccugcagcaucgcccccgcgugugccauucccgggcugggcaagcucacacgcauucggguccugcgaggaugccggccgggagcaccgagucgccgaggcggcugugcgaauggcugcgggaucgggaucgguggcccgcuggacgccgcgggcgaggcugacacgcgcacacggacgcaaccgagcggacucgaggaccgcacucaccggaaccggcaggccgcagccgccccgccaccccgcgcgccgcugcccgcuccaagaccacuuucugcgcucgccgccgccgaccggccgcuccgcugcuggaggcugauugucaaaagucggucggagcggagccaccgggaaacagcugcaggaagugacugcggaaccgggaggcggcggcggcggcggcggcggaggaggaggaggaggaggaggaggaggcagggcucccggcagcgcuacugcgcaugugcacggacaagcggcugcucccgcagacccgggacgccgagcaggugcggaacagcgacucgaaaggguacccuacccuggcccugauggcuccucggagcugccccagccuacccugaaagcgaugagggcagaagcuuggcagagccugguaggagggcggagguucuccucugagaccuggaaacugcacuccuugcgccuccgcccaaagacauuggaaaggagcccgcucaccggcaggacccgaaggacugcagaaguccccgggauaccuucaagagaggcgcugggauggauugcagcccuagcuuguucugccggcuuguaccuucugcaugugaauacuuguauaguggcuagggguuucuccuuggauaacaugacacgaauuuuccauauuaccggcagaguaugguuucgcagcaucaaguacuuucacauugugugugguuauuguguaaaccauaaacuaaaaugccaagaucuaaauauggugagccucaacucagccuaauagacugccuauuuacacgggaaugcaaggcuaugacuggagcaugcgccaacaaccagguacgggcgggcuucgcgaauucgaggacuguucagcagacuagaccagugugcacccgccaucgggaagaguaauccaccgcacagaugaguucagugcacgugcuguauaugugaaaauaccaaauggcuucauuguuuuaaaagcagcgggguagaaacgcauuucucagcccuuugucagaacuuugccauucacucuuguuagcugggaccaugcugggcccuggcuggccuuucccaucugacaacccucauccucguuuucacccacaugucccgucuuauaaaauggcuggcaaaggcaacggaagaaaauuaauuuuggcucgcaguuugaggguacaguccaucacagcagggaagccaugagagcaaaaguggggcagcuggucacaaauguccauagucaggaaaccgggaggagcugcucgauugcuuuccauccacgaagccgcccacacucagggugagucuucccuccucgguuucuaauccagaaacacuccuauugacagucuguacuauccaucacaggcccauagucuagcguuaccucugugaucuuacacagccuguccuugguguuaaaugccuuucucccuguccauccuugcccccugcagccucuccuacaagcaacuuccauggccucucgggccacugcaugauaacaaucuccauuccucacaugggacuuuauuacauauacuacuaccuuaaacucccugagugcagaaagagacaggucuuggagucuuccguuuauauuuuauaguuuuauguguauuugcauguuggaauaaaaucuaaaagcugaaaguaggggccuuacccgcuagcucauacacauacauacacucgauguuccaaauuugcugccccugauccuacaacuuacuucaaacagcucaggcauuuccuucucuggcccaggaaaaagcaaguaaucccaagauacuuguuucauagaaauguaaaucucaugacagagaaaauggccccacaaauuagagcuuuuuuugugaaucacugggucuuaugagauucaguagccccccucaaauaaauaaauaaauaaauuuuuaaaauaaaauaaaugaaa

SEQ ID NO: 1387 - RNA, 14579 nt, Mus musculus
cuacagguaaacucuaaggcuuuauuuauucugguccugauaauuuuauaugguugguucaguauuucuuuugaacuuaaaauuccaaguagucccaaauaagccccaucugcaaugacagaugacuacaguuccugaauauucacaggaccgcugcaccuuccaccugccagacaacggcaucagcagcuuaucaacagugucacuuuaggaauucacaacuucccagaccuccagguuucauuacuacccuguaaaucccaacagaugaagcugaaaggcccacagagaacacaucaccugaaccucaugaagaaccagccacagaaucuuguguacaucagagcaaaaauacagaguauuuauucauuucuucccacuagagggacacacuguucuuggacagacaaaugaaucaucaguugucaggaguugccuuuggagaaugaucaaugaacuccuuuucagggguuggaaauugauaccaggguccaucaccucgggcacgcaucagccuucgaacuuccugcuccuuuaaccuguaacaaagggaauaguaacugugaggauacggacacgugagcagaugcagccacuacagcagucagcagagcuucuucaaaauaacaaagcagaaccaccauaggacagaggccuucaccacuccauagccgcacugcucaggggucuaaguuggcucauuagacacauagcugaguauccauguucuugugcauaauacccaagauauggaagcacucuagcuguccaucaacagaugaauaauaaagaaaauguggcacauuuacacaauggcacaccauucagucauaugcagacaacugcaugaagcuggagggcaucauguccucugcuauguggaauccauacugauguauacagguauacacaggacacaaaacagauggggaacuacugggggcagaaagggaccaggaggagggaagaggacaggaagagaucagcaggcaggggagaagggaagagaagguaaaggagguaaggaugagcaacguacaucuuuaugaagaugccaucaggaaagccuuuauuccauacaccaaaaaaguuaaugaaggggaaaacagucccacgaucccaacaacagagguagucacuguaugcaugauagucuggcauaaacaggcacauggaagcagacaucugcuauacauacaagccaacuuggggcuggugaauuuuaucaucacuuacauugaacaauugucuccacaggcccugcuccauggcuuugugacaagcuugcucugucauccaccuuucugauguuaauacaguuggcuacagaacacccacuaaugagcccaugcgagggucccaugcugggaggugauaugcugccaucugccuauacugcugcuaucauuguuugaagagggaagagggaauuucuccacagcaaguggaguccccucacuagcaccacacugaauggccuacauuagauauuccauuguuaaaaacagaagagaaaaaucagagccaaaagccccaucaacccagagccucacgcagcugacaucauacucugggugaucugcaugguacagagaucccuucacaacuccacagccaaggccaagccuucuccaugaaacccuggccuuccaaaguacauguauuaagcuuuuuaugaccagaaauguacaacuacauaauucacuucccaagcauuagccagcucucuaaccuuacuuaugagauuagauaccuuuguaacugugacuuagagaauaucuauucaacuuuucagaaaggacuaaacacuuuuucccucuuuuaaauauaacuacacaaaauguguaacuaucauaauuaaagagaaagaguucauaaaucuaagagagaguagggggacagggaggaacuggagucgggagaggaaaggagguagaaaugguguaaguaaaaguacucacgcagaaaguucuuacagcaaucaaucaaucaaucaauaaaaacaacaauagcaacaacaacaaacaaggcacagccaaagcccaaaacccaaggcugaggaaauggcgcagucagugaagagcuggccuugcaaggacaguucuguccccaagcccaugucaaaucaucccuucccagugcugcggagguggagacggauccuggagccugccagccaguggcaagccuacuuccuccacaagcuccaggucagugagagaccccgucucaaaauuuaaaacacaaaacagguggauagagccugaggagcaaugccugagauuauucucugccuuccauaggcacacgccuguacauguauacacacacacacaucugcacacagauacacaccaaaaaaccaaccaaccaaaccaaaacuaaugagcacaccgcggacugagagaaacacaguagucaaggcaugcucuucucgggaagagcauuaacugaaggcacagggcuaagcaagguccggaagagggcuguaucugcacccaccugacuuaaugcuaaugacauucucucuagaaacagguacacaggggcacauauggcuucuggcuguuauacagggcagucucuagugaugugggauggaaagaaacaggcagguuguggagugggcugcuguaugcagaguagcuucuuuaggaauuucuuuccagggcgggagagaugguucagcaguuaagcguacuugcuguauucaugucugguggcucacaggccugcaacucuagcuucaggacaucggaugcccuuuuggccuccaugggccuacauccaggcagacacauacacagagacauacacuauaaccauuuaaaaaggggagagagacagagacuaagagggagggggagggcauuccucucaguaugagcuaucaucccccagucagcaacagagucgcccuucucccagaagagcccucucaagcuucacacagacauccaacuucugaagcugcgcuauucuucccgcccacucuccuaccguaacucagccuuuucagauucaaucuggaggauagccaggguuuucucguaguucuuuucagggccaucauagaaauuccgggcgauccaucuugauaucggaugcugagagaaaagguguuuccaaucagucaccuucugaaggauucuucacguuuuggcugacuacuguuucagauaacugaagcacugccaugacaacaacucagaugugcuuuaagucacucugagcacugggcucacgcuaguguuacccacuuuugagauaagcaccugaauggcagcaucuccgcagcuuaagggcgagggaggagaggaaccaaauucuacugaccagacuccaaaaaucaucauauucuaugcuuauguaauuuaaccuauaaagcuuaacuuuuuuaacgaaaaagguagcaugaauuguuauuugcugcaaagauggcucagcaguuuagaucccucauugcucuugcaucugcauacauucucagcacccaaguggcucaucaucauuggugauuccagucccgggggaucugacacccuuuucuggucuccacauauguggaguaccgagcacacacggagcacauucauacauuuagggaaaacaccaaaucauguaaaauaaagaaaucuaaaggaaauuaaguuuuaaaaauguauuaucuacuugaugugaaaaacuggauauaaaaguauaucauaauugccuaauuaagacauuuaccacuacauuaacaagauauccaauaaaaguuugaaugagcugugcaaaccuuguaauacucccaguguucagggauguagccuucugggauuucugcaagcucggcuucaccuagagagaaaauguugacgaugcugggucagcacugacagcccguguccccagaagccagcuucucccagacuccucuagugcuaaacuccccggggcagaucagucccucaugagggguccuagucauccuguagguguaacacaggaccuccagcaucucagcaguuucucauuuuguucuuagguaacagacauaaugaaggacacacuggucucuauuuuauuuucugcugugaaucuaccagacaaaauauucuaagauucaaaacuucagcauuuuagaauucuguucagaaggccuugugugcauuugaugcuuccagacccuaagaugaauuuuaauccugucagugccugccuuucuguguaucucucugucuucugcaugugugucugucucucucauucucucuucccaacucgacuguuacucuauuuuccucaucuaguuuguuaaagcugauuuuggaaaaggagauauggugguuugaauaagaauagccccaaaggcucauauauuugaaugcuuagucaccacagagcagaacuguuugaaaggauuagaaggauuuauugcuucauuggaguagguggagccuuccuuguuggaggaagugugucaauuagggugaacuuugagauuucugaagccccaccaggccuagcuucucucucugcucuugccuacggccccagcaccauccacauuggcaugcucccauugugauaauggcuaauucucugaaacaagcccccaauuaaaugcuuucuuuuauaagcguugccuugcuuauggugucuccucacaaugacagaacaggcacuaagccagaggaaagggagcugagcuucuggaagccaccuccucuguagacauguccuccauaggcucacaugcuacuuuaaaggucccagagcuuuaggaggugggaccuggauggagaaaaaaagcagugaacagaagcagccuuuaaaaucgucaagcccgccacccuguuuccagcaagcuucuuuugcucccacuucucacgguaggccaaugucucucuaaaaccaugacaaaacaaaccuuucuuccaaagaaggucugugucaguguguggucgcagcaaugcaaaaguaaauaauauaaauguuccuuuuaaaaaucuuguauauuuguuuacaaaugcuaucaucucauggagugagggcuggaugagugacuuaccaauaaauauguucaccaguguuaugccaauuauaacugggaucccagucaacauaagguagaauuucugugaggaaaaacauaaaaacauaaagguuucucucauggccuuuccuuuuuaauuuccaccaaaauuauccucauuugauguccuuuuauccuuauugaacaaacaugacaauuuuggaaucagaauugaaucacugauuucugucacauuucucugauuuaguuuuuagacacaacuauuuaguagaguacaauauaugugcaaugacuuuugacuucuugguuaaagcaaugagauaaaaaaaauucuguauuaagaacaaaugugaaaacaguagcauuucagccacugaaugugacuggaguugguccugguaugaaaagaggacacuugcuaugugugauagcacacacuggggaauccagcacuccauagguggaggcaggaggaucaggaguuugaagucagccuuggcuacauagcaagucugagacuagccugggauaacagaagauccuccauuaaauuaaaaaacaaaaacaaaaacaaaaacaaaaaacagggcuaaggaaaggcaguguacacaauggggaggagggggagggcuaaggagaggcagugugcacagugaggaggagggggagggcuaaggagaggcaguguguacaauggggaggagggggagggcuaaggagaggcagugugcacagugaggaggagggggagggcuaaggagaggcagugugcacaauggggaggagggggagggcuaaggagaggcagugugcacaauggggaggagggggagggcuaaggagaggcagugugcacaguggggaggagagggagggcugagacugaacacaguggggaggagagggagggcugagacugcacacaguggggaggagggagagcauuucaggggaacagcaagccuccauuuuuaagcuccugguugguacuuuuuggaucaugauacagacaagcagcauucuaaacaaguaguauuauuuacaauccugcugaauuaagaauguugacuuaaaaucaacauucccagauugcauuuaaaaaacaaauuacaucccaaaauagagcugcuucuguagaagccuuccagugagucuuuugcuaaaacgaucuuaguuuuuuccaaaccuaucucagugacaccagugagcagcucagcaccucagccuuuaaggucuguaaacccacugaugucuauggugcagggagaggaccacagggccugacgcgcgugaacacgcacugaacagacucugcccacccaguccugcagauucauuucuacacuugaagaggaagcacaaacugaacuucaaacugcaugacccugagcagaaggaacggcuggcacuugaccugcagucccagugaauccagcugaaacuuaaaaaguucaguagcaagucagaucuuacuacucacucucagcauccucugggggaagaaacaguaauuuuaaaaugaaagacaucuccuaaaugggaauuuucccuccuggacacagcauaguuaagaacauuucaacucaccauuaaccucaagaagcgagcgucauaguauaaagaaggcuugacgacaaacagucucuugccaugguccccacugugccgcacaggagcugaaaaugugaaacuguuuaacagggcucaugcggggugggcagagaagaccaccagauagauauacacgggugaauguucuuugcuugugcaucggagugggcaggacgcgucagagacugagagacuguucucagguauagcugcugcugccgcuuuuauuucauuuuuaucaguaagcacacugaagcccagcccuuacacaugcugguaagcacagccgcagagcuccuugcuuuaacccaauguaaagacacugagcaagcgaucauuucaguguaccucagaggcaggcagggagggcagacgcucuugacagcugcuaacccuugcuuccccuacagaaaacaaacaugcuaaagcccccuaaaaaacaaaggugaaggcugccuccuaacagaaggggaaggcagggagcugcggaaaccuggagggacaggaccagcaguaucuaugccaaucucuagcaggaauuugacuguuacagacuacacugaguuaaacucaaugccuuguguaugcuagccaggcauucaucaggcuauacaccauccuucuaauggugacaaaauccauuuguaauucauuucugacuaggaagacccuccuccuccuccgccuucuccucuucuccccccccccccccagaucaaagcuuuggaaugacuucagccuuguuggagauaagcagagguggacugugacuccuagaccccuccucugcuccacugcccuggaagcugcgagacuugccaucagcacucuacacccaggaccgugcugcuacucagaagcuucauggcuccacuucugcucagauucccacugaaggaaacauaacagcaaagaaaucgaaccuggccgagaccccuagguggcaacgcuaacauaagaaagaauguuccauuuguugaguuuaacggcuacaagucgccacucccuucaggcagaagcugacgcugucccaacagaugccacguucccccuaacaugccacacacccaugggucugcacaacuauccuugggugucaguauccaugaggaacgaguucuggguuccuggacaccaaaacuuucagaugaucagagaccuucagugaaacacacccuuacaauagcccacaaguucuccuauguacuaugucugguaauacuggugacaaugaauaccauguaaaccacuacuauauugcauuguuaggggaauaauaccaagaacaaagguuacaggagcaauuuacuucccaaauauuuucaaaccacaguuaucuggauucgaggaugcuacugcauggauguagaggccagcuccaccugcacuaauccugccacguucaacgauccacagcugaagaugggagcugucuggauuuuggaaucaccuguagcagcuaacaggguuuaggaagugaauucacuagaggaucagauaugggcauuaauuuacuaaguacagauuauacuacuaacacuacagacgugacaagauaagagauuuuuagaacccgacauuuucagaaaccccuuuaaaaguuaccguuauggaagaaagucaggaugauacuacaaaccauucaugaacucacuaaagacugaaaugcccacugugugcagguccucugcgaggccaaaggucaagauggauacagacccugcugggagggaaagaguagacaagcccucgaggcaaaggcagcaaagaaacagacaaaccagcagaagaaaacaggcccagagggaaagggcacauucagacagcacaauggagggagcggaggacacgcacuguucccuuagggaagaagcugguuggcuuguccuaccugugccggacaguuuuauaagcuagcgucacuggagaaggagggaauuucaguugaggaaaugccuccauaagaucugguugaagagcauuuucuuaauuagugauugaugggggagggcccagcccauggugagugaggccaccccuggauucuguaagaagcaggcagaguaaaccucagaaagcaagccaguaagcagcagcccuccauggccuuugcaucagcucuggcccccagguuccucccuugucugaguuucuguccugacuuccuucaaugacgaaugacaaaguggaaguguaagccaaauaaacccuuuccuccgacccacuugcuuuuggucauggugcuucaaugcagcaauagaaauccuaaguaagacauuaccuagacagugcaguccaccacagagccccagaaucuagaugccuguaaauguccugaguggguagagacaugggugggccaauaagaauggccccuggagacucaucucagggagugacauuaggagguguggccuugggaaggaaauguaucacuaaguguggaccuuggcauuucagaagcccaagccaggcccaaugcuuuguucugcugccugccaaucuagauguagaacucucagcucccucuccagcaccaugucugccugcaugcugccaugcuacccaccaugacaauaauggacuaaaccucugaaccuguaagccagucccaauuaaauauuuuucuuuauaagacuugccauggucauggugucucuucauagcaauagaaaccaaagcagacagcuuaccugagccauggaaauacaaagcaacuuuuagaaaaauggugaauucaaccauaaugaaaucaaauucuaaauaagucuucaugcacacuuacaaaaggcagaaucugaaaggcucaacacaaaguaaguagcaaguccuacuggguccacagagccuucagcugccaacuggaagguggagguauaaggaucaggggcucaaagucagacuccguagaguuugaagguagcuucggcuccacgagacuacaggacuucaccugguuuucauuuucugaccauuacagacguguauccauuccagagcucgguuguuuuguuuugagacaguauccuuguauacccuagacuaaccuugagcucucuaagcacugcagguguaucuugacccuccuuacagggcacauacuuuaauagaggacuuaagcagcuagguuguuuacaaaccuggcaagugaccuggggacugacagcacugaagucgggauggagacaaggugcugguuucuuuguaugaauguuuugcuugcauguuugucuguguacauguaggcccaguguccaugaaguacagaagagggugucagauccccugguccuagagcugcagauggcugugagccaccaugcugggagcucaacugacuacccauuuuuaaauagcuaaagaaccauugaggaaagagggcucuacuguuuccaccugaagggaagaucaauggucaacguauaaagggaacaguucucugcuucacggauucagaaguuccuagaacuguggggguugaagauagaacuggacugcuucaccguuuuucacggccguuguccaagaauccacaaugcaaucuggaaauccugugugauacagguuagccuagaggaucaagccgccucuuucagaaaaccugaucacaaccccuaucuucaaauaaagaaguuuccuucucaacucaucucuggcuucucaagacaaauauccccaaggcagguggggaugacagcacacaacuugaaguuccagcagucaggaggcagagccagguugaaucuagccuggucuacauacggacaaccuccaagccagccaggguacauaaugagaugauaucuaauagaacaggacaaagauucccuaagaaaucucgccuguuuccugggcuuucuuucugccuaaaucaaccccuaugcccuggguucuuugccucugucucacaucucacccuuuggagcuaugcaucaucuccagcauagcucuuuucugauuuccccagauaguguuggucucugcuuuucccuugagcaagauuugauaacuuccuuuaacaugaagcacacuaacacuaagaguguguuaaagcucaugaggucagaggagaauauaugaagcucggucagucucuccaguaagugucagugucugacagguggcaggucuugugggaacauuguugaauuuacauuucuuaacugaacguuuacagggaucacuuaaguaaauccuuacaguuuacuacacuuacucagaggaccuuguacacaccuuccuccuucaaucagagaacaguggaaggauuaauuuauauguggcuuuagugaacaaucauuacaacuguagagcaaacauaaaaaacaaaaaacaaacaaacaaaaaaagcagccagcacuuggggagcagagacuagaggaaaguuguagguucgaggccaguuagggcucccagcgagaccugcauuaacaccucaugcuacaaaaacugaacaacagaagaaagguagggcuggcugcauuacauuaacgagguuaacaaagagaaaugcuuccucuuucucaacuguuuaacaauuacucuuuauuaacuaugccugaugacugcuaucgcaccaacuauccuggaauguacuucagagcaguuaacuucccacagccccgaagucucccugcugaaguggagagucaucugcucacauucugaaaacauuaggaugaacagagcuuacaagaccaauucuccaaaaaaugauuuuuaaguuuuuuauuauuuuuuagguguguguguguauauauacaggugaauggaguugccuguggaggucagggacaugggcuucugaagcuggaguuauaggcuguggcccugggaaucaacccaggucuucugaggaccaggaagcacgauuagccacugagccaucucuccagcccccuccaauaaaugauuuuaaauaugcaagucacucaggaaagcuauuuaguuuccugacugucauugaugccaggauugagcaagacaaugguagcagcuuucuguugguauuucaaacaaucaaaagcuggccauucacucauuaucuuccucuaaauuuucaguuaaaaguaucauuugaauuccuugggccaaaaaguuaaguccacuuccuugcaucuguccgucuuucaucacuuaucaaugacaaacugcaaaugauucuaaaaagggcuagugagguggccugggaaggaagugcauuuguuucaaggcuugauaaccugaauuugauccccagaucccacaguggaagaagagcugauucccacaagaugucuucugaccucuacaugcacaggcacuuuaguugugucaaggccccuucuccaccccaacuaagccaugaucaccaucuucuccuucucucaacaccuaguucucccaaaagcccuauauccagggagaccuggaagcccacacacuacugccauuuucccauguuaagaugauugccauauucauuuuauauuuauacuccucgucugaguucacaguacugugaucacagaucuguugauccacucuccucuacccugagaaauaucuguggauauuagcuuuagaauggaaagagauucaguguuuucugccacggcaaguuggaggauuugcugcuuugggccuguggcaaagcaugauggaaguauguguuagaacaaacugccaccuucuagugacugggaagcagagaagagaggcugaugcccugcaagggccucuucaaugacaagaucuuggaccggaauuccaccucucagacgcucagcaacaaccuaccagcuucuuggaagacuguggcaggagcauugaagguuagaaccagcccgcaaugcagagucuauucaagaucagcuugggcaacucaaugacacucugacucaaaauuuuaaagaguaaagacaaaaagaaggguuagggauguagcccagaggaaagaccucaccuggcuagaauaagcaagcacuuguauuucaucagcaguaccaaagaaauaagcaaauaaaauaaaggguaaauuuaaugcuguguguauuuucuaauuuaggugcauggugcuaaaaaugucuccuacucaaagggcuucacaacuacucuguaagguaucuccgucaaucagauggucaucuuccggaaaaggaaaugaagaucaugaccaagugccuuccacuuuagcucccaguaggcguugacucaaggucauagagcucuuaaauucugcagccaagauuugaaucucggcagcccagcuccagaaaaagaagaugggagaggggccuagccaucuuguugggcugcccaaggaacugguggaagagaggaaaaccuucagggagcaauggcagacucauaagccagugaaagcugcgacagucaaacagucgcucuuggaacagccucgaguaggcccucccuguucucucuggacaggacaucggcuccccgugguucucucggaacugcaggagugagaaauaguccaggaagagagggaccacggagucucagcucagcucagcuagacuacagucagcacuucuggggaaggguucaagggaucucuacuuguguaucugaggauauuuacaauaaaaaagugaugucaaaaggauaugaccaagaagugucagcacauggagucugccuucaguguaaauuccugcuggguauuuuaaaugcacugauccuuuccagcauguuccagaaggucccuaugcauacugccucaauauaauaggcuuuagggcaauuugugugugugucuuucucuauauuagacaaggcaaauuguauaucucuaaccaaggcccucucuaugacuguccugagaccugagcucuuuaccccucuuaggcuccuuucuaagagaacagugguucucaaccuuccuaaugcugcaacccuuuaaugcaguucuuuguguugugaccuccaacuauaaaauuauuuucacugcuacuccauaacuguaaucuugcuacuguuaugggucacaaugugaacaucuguguuuuccuacggucuuaggugaccccuaugaaggggucgcgacccgcaggucauaugaaaagcaugacugcauuaacauacagcagauacaaucugggcugaacccaacuuuacacauucacucgcacuagucuuuuaaaaaaaaaaacaaacauaaaauauuuucguggccuucuaugauguugugagguccacggacacaguuauuaccgugccuaacgggccugucaccuggagccuuuuuacacucgugccuaggaacaccaugacagccuucacuucagugcgcuucucagcaacuuccuaucugcggguuggaaccagcugcaggugccacgcacccugauucugcccugagcccagcgacgcagugcaagccugcaaucccagcccucgggagccgggacaagugcagccucggauccccgagacccugucucaacaacgaagugugugcaguugcccuuggagacgcgggcagcagcuccaugccugccuagccuggcagcgagggagcagcgcccagcauggcguggcaaggcgcuucgcaaacgcugagcuuaaacaaggccauccgaucugcagcagcucuucacacgagagccccaggccgacuuuguccccgcucucucccucggagguccccaaggucaccuggaaacagcccucccaccucucacccgcgucuccgaggccgccacccaccgacagucuucggaaagcuccgcgugagaaaacuuccgacuccgagucuaggaccagcgcggcggcaagacagcgcugucagcgcggagaccgaagcccgcugcagcaggcucauggccgccauggcuacaccggccacggaaggaaguggggagggcuaagggagccgggagggacaauccaccagugagggcgaacgcuagaggaggccauauug

SEQ ID NO: 1388 - RNA, 1120 nt, Mus musculus
auccuguguauagaucucagcguuuacccugcuuaaacaagcuagcuugucauaguugacagauucuaacagaagacaugagagacuguuauaacagagaugaaggauguuuccauuugugacacagaagaagauacaagcuuccugucugcauggcuugcuccacaucgcagcaaggggcucagguagauaauucaccaacaguagguuuauguuacaauuaacucuaaauauuuucaagugggaaauaagcagacacaccuaacuuucgcucuagagggaacuaugaccucugccuugcuauugaaacaguacagugggaguuaguacaucucuuuacaaggcauuaaacaaauucaugggggauuuaccagcauuuggugucagguucuuaaauguuacuuucuccuuuuguuucaguaaacuuucaugagcuauuuucaggaguuauaauaguagugaugguaacgucugcaugccagaacagaaauggacucacuucuugcuaaaaccuuaugaaaguaaaccacuugaucauaucaaaaagaagucuucaaccuacugucuuucuucuagaaaacgcugguaguaaaagacauuuagaacuggaaguuggcauuuuagaauuuuuuacuguauuugaucagaauguauucagucuuaagugaucauaacuuacauguucagcagcuaaagguggaagacuaagcagaagaaauucaucuuuucaccuuucuaaacaagagaagaagccaggugugguggcagacaccuuuaauccugguucuugggaagcugauggaggacuuuugaggccaaggacaguccgagcuaccuaucaauacccagucucaaaaacaaauaauaaaauacaauuucuaaaaggaagaagugggaaagacaggaaauaugcuuugggaacaagaaaaaaauuuuuucaugaguucaugaaaaaguggaaggcaggguucaacaacaaaaauagauuuacucguggaacauuacugcagcaccaaaugcugcuuucugauaagaagauagacauuuuugaaacaagucaauugaacauucccuaucaaaaaaauaaccccccagugguuucaucaaugaggucuuugaa

SEQ ID NO: 1389 - RNA, 25337 nt, Mus musculus
ucucucuuuucuuuuuauuaauauuuuaaaagcugugucuaccaggaucauuuuucuagucugaaagaccauggucaguuugaguauuuuguuuuaagagugguuuguauucuuuaaacguuacauugacuaaaacccagaaaaccuagcacaaacugauaauuuuuuuuuuuuuuagcaaacugaaauguaaauuuuagcagaaaugaggcauugaaaaaucucuacauuuuagauuaauuacuguguguuggaaaaaaacuuaauuauauauuaguguguuauauugaggacauuguguuuucuuacagggaaugguuccauuuguauuuguuggcacuaaagaaagcauugggaaugugcaaguucuucuagaguaucacaucgcuuacuuaaagguacggaugcagcucacuguguggucagucaugugucaucccugcugcacguucugggugaauguuguauacuuaacacaaacaagggcaagguagccacauguugaauauucuuguuuauugugguaauguuguuggguauuaaauauuuuuaguuguuuugccccguuauuaagaccuuaagaauaaaauguucuuugcccuuacacuuuugcagggguggggagagucuuuagguuccccccuaaaaagcccauucgucacguuugaagaguucagcauuuacaguaacuguuuuacuagggccaguuuguucugcuuucaaguuuuagccaucugcacacaaggugaaauugagccucuuugauaacccugguauuauuugagucagcuaccuugcccccaauacacuguguuccaucaauuuugagggaggggugaguugcuagagaugcaaaccagagccaagugcaugguaaacaaaacaggcaucagcuucugggcuuuauccacccucagcccccauuuuuaauuucaggauuacagaaaaugaguggcuaccaguaagcaucaugguuuccuuguucuuuuccuccuucuccuccucuuucuucuucuucucuuucuucuuuuuuuuuuuuuuuuuuuuuguuguuguucaugguaauaacccuaaacugcucucuacuucuaguauauuuuccuucuacucucugaucucauuguuguacauguauuuugaaagcacaauugauaaugccacuuaauuuacguuuuaaccauucuggccuuguaagcaaaugcuuuuuuaucuucuguagucuuccucccagccauuagcucuguuuagauugcuuaccuucacagguugcaggacuucaguuucuaaaugaucaggacggcuuguccaucucaguagugaaugaagauguuaaucuuacauaaaguagcuugcuaauaguaccguuaauagaauauuuaacuucuuguuuaaagagacaguaucuggcuagucagcuggcuccuugcauaaagucuuuugcaggcaagcuugcuuacauacacacacacacacacacacacacacacauacauacaucucacauuguagggcagaaucaacuacuugaaguuauauaguuagaucuccacagacacauguuggcauauauagacuuauacacacauguacacacaagcauacaaaauuaaaaaacaguauuugguaauauuagauaacgauaaaagauaaguuauuauaauagaaaacagcuacuugaaagagaauuguauauacuguuuguauauacugaaaagugugccuugaguugaccagcaaaugaccuugugaauacgauucugcuuuaugagaagaugauuucaaagaucauaguuuguuuccuuuuguguagauuguacaguuccagcucuaggccaaaacacacaaaucaaaccuguauaggaugugggcuagggaagaugggucaaguggguaaaggugaucucacaugguggucucacaugguuugacagguguaugaaugccugugugugcgcgcgagugcacacacacacacacaguaaaaggguuuuuguuuugaucguaggaaguggaacaacuaagaauggaacgucugcagauugaugagcagcugcgacagauugguauggguuucagaccuucuuccaccagagggccugaaagagagaaaggauaugccacugaugaaaguaccgucucuucuguacaagguucuaggucuuauaguggaagaggcagaggucgucggggcccuaauuacaccuccgguuaugguaaaaagaacauugauuuauuucuguauagugugugugggagugguucuaguuuagaugcugcauacauuuuggcugaaagguaguucuaagguguaugucccauugaugugacaaacuagugacagugaaagguguauagcuugcaaauaguuaccuaaugcauaauuuuuaauuaugguuacgguagguuacaaguauguguaaagaguaaaugggaauauggcuuauguuccaacuaaugugguuucauacauuuucuguagacuccuagugugcuacugcuaucuauaagaugagcacaaaugaaaaguaauagacugaucacuagaucaguguugcauauaauaaaccuucagcagcuuugcugauguugcugguuugaguguuuuaguaccuuguauguaacuguuuaguaacauuucuucaagaugaaggcuuagagauauaguuaaccugucaugaacauuuuauaagcuauauuuucauuuggaagcuggggccuaggguaggaacagaucaguggauccuaugguaguuaacaauucucuaaucauaaauucucauuuauucuuguuuagcuuuggaguuguuccaucuuucuccauuuggacuuggauauuagcugugaccugaucuccugcccaucccucuucauuugcuuuuucuguucuuuucuucucuucucccuguguucaucuuguuuugagaaaauacuuaugaaccuaggccaaaguaggaagcauuuacagaaaguagaggugaauucagguuugcacggugcagguucagauccauacuucucauuuaacaaaggaaucugaugauguacaccuguacuuucuuacauucauuguacagguggaaggcuaaaguaucccuucccuuuagugcugcaacuuuauguucaaguauuucauuuucucgguguauuuuuguuuucauaaacacuguauuaaaguuugcaaauaaaauuccaauauaguguugaguguguaaaagaugaagaauugcaagcuagugguguauuuccaaaaguguaucuaauacuaguaguuaaugcuggguggugguggcgcacgccuuuaaucccagcacuugggaggcagaggcgggcggauuucugaguucgaggccagccuggucuacaaagugaguuaguuccaggacagccagggcuacacagagaaccccugucucgacccaccccccaccccccaaaaaaauuauaaauugacaaucagauauggcuuuuguauagcaggagugaaaagccauugaacagauugauuagugucugaugccucugcuuauugaugagggaggcacucugguaagguggcugaagaauagauaauaaauagauggaaaaauggcaaagguucugaaaucugguucagaaaaugcuuuacagguggcaggcuuagguuuguggaacaagaaacauuguaguuuugaaguaacuugagagaaaggaucauuugaauuuaauuacagcuguuuuugagcacuuuucaaaaggacugggcaguauuaacauuuuuuaagaaauggauacuaguacaacauuucuaaaauugugcuaaauuuaguugaaucuuagaaguuuaucaggucuugguuauaauaaagcauuuuuaauguacauuuuaaucaaaugaccauuuaaaauggucagaagcaucuugauaagagugauagauagaaguuguagagaaaagccugauuauguaauuuagauaacagcaagcugugauugugagugucauggcucauuuuuaaaagcuuuucugugauuucuuuccuuauauccugcuuguaugauaagauugagauguugaaguggcuauauuguuuucagugcaguaaucacuaauguauagcaaccuagaggcaugaccagcacagccuuuuuacuguaaaacugaccauugucgcacugggcuaaccucacacccaucacuuagacugcaggugcuguauuguuuuuguuuuuggaaguuugauagaaccugcuugcuugacauuuccaggcuuaugacugccugccucuggucuaaauugccacugauguaacagucuucauucugccaucuuuauggcaugggucuuauagacccaugagcccguuggggcccaccuaaguauuuuagggcaaucgucucaucucaugguuagccuuauauacuugacuuuuugugaucaugaaauaugaauauuagccaguccaucaacaauguugugugugugagauauuagucucauaaaauacugaauuuagccaggcaugguggcgaacgucuuuaaucccagcacuugggaggcagagacaggcggauaucugaguucaaggccagccuggucuacagagugaguuccaggacagccacggcuacacagagaaacccugucucggggaaaacaaacaaacaaacaaaaaaaaccccacugaauuuagguuaaguuuaaagaguaauuuccuugcuuuuuaucccuggguaagauaaaauaguuuaagacugauuuaccuuuacauuuuagcccaaauuuucacuauuucuuagauaauugucuacuucaacagugacaguauuaaguguuuuugucauucaaacaaaucauuguuaaauguguauuuuauucucuucuaugagaucucauuccaacaaacaguugaaugaaaaacuggauuuuuucccccccaaacugucuuguuuuccaucuuccgcgcugucauuuguauugguagaauccuuacuuuuccugcaccuuauaacuucugugucaggguuuuacuacuacugucaaaugcucguguaguuuaaauacauugauuucaugaaaucauauguggaagucuagccacuuaaacuucaaaauaauguaucauaaaaaggaauuuucugcacauuaugagacauuugggaccuuuucacuauagaucuauagaggaaaauguugagaaaaguaaccacauggcaauaagaaggggagggauucuguuuucaguuaaauuggugugaauuuagaagucaguuucugcaggagauaauuauguaaauuucauuucaguagucagugucuucuguucuauuagguaguagcuauuuucucagaaacaucauuaugcuaaucugaggcaauaggaaaacauauaacugacaaguacguuccuaacuuuuucuuaagauuaucaguuacaagaaguguucugauuugagagaaauuaaaaugugugagaaaaaaaaauacucaagucagaaauaauggaaauaacuauugauuaaaacuuaguuuuuucuaaauguuaauuuuuagguauuggcuaacauacugauaauuuaagcuagcaauuuuaaaauuggcagaaaacuuuauuaacugcauuuucauguauacauuuucucuuauugcuuagcugaaucugauaauuacauuuaaaauaaauuuaaaguuuacuuuuaauuuugcucucuuuggagcaguuacuauacuuaauuauguaaaugaugcuuagcagauacuguuuuaaaaacuuuuuagcauuucuguuuaugugcuucuaauuggcuuauauuuauugucuuuccccaaagguacaaauucugagcugucuaaccccuccgaaacagaaucugagcguaaagaugagcugagugauuggucauuggcaggagaagaugaucgagagacucgacaucagcgagacagcaggagacgcccaggaggaagaggcagaaguguuucugggggacgaggucgugguggaccacgugguggcaaauccuccaucaguucugguagucuuuuauauacuacaucagcauucaugcuuuguaaacaguauaauccgacaaagguuauuccuucuuucagggccauauauauuuggaaguuugugauuccgcuuacugucuuagaguaaauaguagacuguauagcaauuaacuugguaaguguuguguagaguaauucccagugaagguuuccuuaagaggucaggcuuugagagucauguuuauccuuuccccuuuugagaucuuugacaauuaggcaauacuuuccuuguuuucccaaaaauuuuugcuacacuuugaagaaagaaacagauguggacucaguuccuaagaaaaauuuauugaguaauugaaccauaaagagucauauagaggaacuagagaguugacucagcaauuaagaacuguuaaugcuguuguagagaauucagcuccuagcacccaccacgggcuacucacaacacuaacuccagcucuggaggaccugguacccucuuguggaucugugagcaucugcacaugugcguguguguggguacaucauauguucauagauacaguguagagaugacuaaagacuucauaugcucaagcauauguuggcugugaucacuugacuauuuuuuuuuuuaucauggaauaguaauuguugacagaguucucuuucugaguagacuaggcaaaaggagaggguuuccaggaauacauggccuagauuauuuuaaaacauuguguguuagcauuauuaauuguccuuuaagaaggucacauucaauauuuauaaugauuaaaugucucaucuaaaauucuaucuuuaaucuuagcauagucugugcauauuaaaaauacauguaaauguacagaaacuagaacaaaucagcauaaaaugaagggaagacuuuggcucuaauuggauuacaauuuucauugggcccuaggaaauuuuaacuuaguuuuuucagaaaaguaauuuuuguauuaaaaugcacucuauacuguaauauuaaacaauuauuuuguggaauugcaaaguaaauauauuuuuuaguguucaugauuaauagauaaacgcaguauuuuuugcuaagacacagcuugcuaacuuagcaaggaaaacuuaggaguaaucgugauuaggugaauucuucuguaguuugaauguuggaagcaguagaugcacauagguaagaugggcacuuuucuuugcauuugcaucuugacacuguucuguucuaacuucaccccaugguuuguuuuucaaguuggauuacaaguuagguguuucaguguuguccuuucuauagccaguacaauuucagccugauuuagaugccuguauagacuuguuuugguugcuucaguucauacuucggucuugggugcagaugguuuauuuucuuuuauuugggauaaucuaauagcacaaaauaucagcaauguaaggaacaaugguuuucuuagaaucaugacauucuuucucuugguuuuuauuuuuucuacucugaguaggauuaauuuaugagugccauaauuaguagguagugugauuucugauauagucauccuucacuagccaugggggacugagcucaagaaugcucaagguuuugcuuuuuuuaauucuuuaugaaaaauauauuagugaucuuugcacaugcuuuuauaucauucuauauuaccucuagauuaucuauagcuaauacugugaaaaugccauguaaacaguuuacauuuauuugaggcagagcaauagggaaaaaauagaaccauacauguuuaauauacaucccuuccuuuguaauuuugaucucaucugaagauguagagagacuauuuuuguaaacaauucaaaggaaacauuaggaaacuuaugaaguaagcauaauuuuuguuuuacaaauuuucguucucauuaaaguuuuauuuaaucauuacuacuuuccagauaaauuaguguuaagagaauuuuuuuauaauuucagaccuauauuuuauuggggguauuaguacauguaguucauucaguagaugaagcauucuuaacugauguccucuuaaaugaauauuucuugccucugacaugaauauagugcucaaagauccagacagcaauccauacagcuuacuugauaauacagaauccgaucagacugcagacacugacgccagcgaaucucaccacaguacuaaccgucguaggcggucucguagacggaggacugaugaagaugcuguucugauggauggacugacugaaucugauacagccucaguuaaugagaaugggcuagguauguaagcacuuagggaagaguugugagugugugugguugcauuguauugauaauggaggaagccuuuccuuuuuuuguauagaauucacaaaugguuuuuuuuuuuccuuucuuuucuuuuuaguguuuacuuuaaaugagggauauggcugcuaucuugggcacucauuuucauaucugucagacuaucugaacugggaggauuccuuaaggugcccuuucauaccauuaaaucaaccuaaauacucaguugaucugucuacaaacaaaacuuaacuguuuuagucccucccccuuuaaaaauuauaguacauauuuaugggggcugcaaaaaccuagcauuuauuaauaaggggcuuugagauccaggguaauguuggagagauaucuuauauuucugaaugauggugguuguuucaauuacauggcaguuugcuuuauuaugaguuauuaaagcccucuuaauuuccagagggcagugcuuuaugcugcaaaaaauguguauaauucuuugucaguauuguauaugcuuuaucuuugauguuuaauuaaaaguuucucuuucccuuccuuaaauaaggaaagaaauuuuuuguuuguuuuuuguuuauuuuuugucagaauaguugaugguaaacuuugcaauuacagaugauagugaaaaaaaaccccagcgacgcaaucguagccgcaggcgucguuucaggggucaggcagaagauagacagccagguaacuugagugggccuguuggugucaggucacaagcaugaaaaaaaugucaugugucugcauucuaaauacaguuauauguucacauguguguauacauucagaauuugcauugcauaauuuauucaacuaauaaugcugcucaagaaaaugcauucuuccuucccaguguaaauguuuaguaucuagucuuaagugaacuaauguugugucuuaauuucuuacauggacagaauuucaguaccuuuacuuuuuauucagcuggcagauucuucagcuuucagaugggaacugccauugcagggacuauggugugaauuguguugagguugauuggcaaaacuaggcaauuuuuuacauggugccugcuuacuauagauugagcucuucauuuggugggaauuacaauacucaaaauuuuaaaauaaaauguagaagugucuuuuucuuuaaaagaggaugcauguuaauguuuuuguguuaauguaguguggugcuuuuucuuugacacauacuaaccauucaaauaguacuuacuuaguuucauucaguauuuuauguugucacaaguuuugguaacuggaaagaaacuuguuugcuaugucuauuacuuugaacacaauucauuuccuauguacagagaaucacuguauauucaccuugaagaaauuguauauaguagaaauaaaccccuuucaaaccaaccaauuuuugcauucuuuccaaaacauacucuuucauguguguucucuaucccccuccccccucuccaaauaauguacauuguaaauguugcacugcagagguuguagagaccugggaaucuaguaaaggguauucuuucccaucaugaagaguuuguguuuaaaagauagaaggaaauguaaaaacuguacacuaucaaagcuaguguccagaaaauuuguuuucccuuuauauuccuuuuccuucuuaauguuagagauguauuuuaguugaagaggucauaaauuucagcuuugaaaguagcacagcagugaagauuuuugacccuacuuuuuuugcaagauagaaaauucaggcuauuaguaugggcucacuaacuuggaaugacuuucaaucuaacuuaagccagugaucaugguuaaauguacagacacaaaaauaucaaaacaggauuucuuccaaaagagaugauuuugaauggaauuaacuaaaaugaauaauuuggaguuuugguaauuuuaacagugaugugcuguugcauacuauaucugauuuguuuuuacuguucuuaggaaccauuguguuuucucuuuucaaauuccuuuauuucaaccccuucuucuccagaguuucuuguuucccagcagcaauccagggagacagcuguuuuuccuuuggcucaaauuucucguucuuaugucuauguacauuaaccauugaguggucuuucuucuacuuagacaaugugacacucugguggucucaacugauucuuaagcccagggucccgauuauaccauaaaauugcuuggauuuuuuuucuugaaauuuaaauuucuauuaaauuuuaagggucuguauuacauaagaacuauaaaacaaguuucuuaacuggcucucuuuuauuugggggcaaggaacagaacuaagugucacuugcuaaacuuuggacuaauaacuacaaaguguuuuuuucuguauagggauagaugagcgagagccuaagaacuguuuguugcacacauuuaaauugagcacuaugccuguuugugcagcagcguccugaaguagaugccguucucaggugucaacugagaucugcaccaugaaaaccauauucauuggcauguuauucccaccugugguuacagucauucucaggacagugcugucacccuguagaguagacuaauaccccagcagagugcuaaacauguuuguacauuuuuuggcagugauuuuaaaaugagaagcuauuuaaaggcuucauuaugaacauuuccuuauaacuuugaaggaaagcagcuuuagauuucaaauaucuauaguuuucucauaaaguuuugauucaagaugcuuaauaaauuuuaaaguucacuaaguaaugaguuaguagaaaauucuccaguuuuuauguuaggacaugcauuauuaagaugaaugaauuguaaaauacaauucagcccuuuacuguauuuauuuuguuaguugcaugugguauaaaucuaguggaccaauucuacacacacacaguggcuuaaaauaauguaaaauugacuuguuuuuuacuuuuaauuuagggcuuucuuaaaucuaguuugcgauagaaaauaauaaaaaguuaggauuuugaguuucaaaaccugaggccaguguuguacuaauacaacagaggccguuuauuagaaugauagauagggucaucacuuuauuugauuaaucucauguuacagaccuagcaagauagcagaguugaugggacagcaucucuaguaacagugcuccuuucccacccuguguccaccacaugcugaggauugugcuuuauugucuuaaugugccuguacuuccuucaagucagaacaucagaugguuuaaauacugucuaccaugaaauguuaggaaggaaacagaaaauaacacacuugaacaccuugauugugcuguuuuuuucuggggcagagauauaaccaaaacacaaagcuuucaaacuuuuacuccccgcacugugaucugagucaccguugccccaucccccauugcugcagaugcacucugcacuuagagcacugcacucgaagugcauguuggugguggugguugcuacaccacauucgucccaccaccuuagauaaaccaggagauagcuggauuccugggaaaaaggacguuagucuagauuuccucagguuccagcugaaaaggauuuuucuauugccaguacuaaaaucagauacauuuuuuucaagcuuugcuuuuguucggagguggguacccagcguaaaauuuugaaauugggugacccaccacuaguuuacuuuaauagugaaauuauucuuuauccauaauagaacuuagaaauauuuuucaacaccuguaauuuuuuucucaucuuuaacagucacaguugcagauuauauuucuagagcugagucucagagcagacaaagaaaccucccaagggaaacuuuggcuaaaaacaagaaagaaaugguaaggagaauuuaaccuguaggguuuuuguuucuuuuucuaugauuuucguaauguuuagauuuauuuauuuuuuacuuaauugcuguauggucaguuguuucccuuaagagaugauauuuaaagaagauccuuguuucuaucccaggccccugauaaaugaagauaugcaugcuugagccuaagacauuggccagauagauagcacuuuaguauuuacuugauugauaauuagaaggcuguguguacuucuugucaguagugggaauagaccuuuuaaguuucauuuguauuaaauguuuucagugauuuauacgugaguuucaaaaaggugaguaaaauggcugauuguuguucugcuugcuguauugacucuuuuacaccauuuauauggugaacuucccaauggucauaauacuagguacagguuuuauuggacagugcaggugcuuucugugaugugggcacucauaggcacuagaaauaauacguaguuuuaaaacccugauacuggagugcauugguauuuguuuuaaguauuaaauacuuucuuuaaggcauaugaaaguuauccuauuuuuaaaagcuaauguuuauaguuauuuuccuccucagcugcagauuucuuuauaaagauguugaaaaaguugucucccuuugacaggcaaaagaugugauugaagagcaugguccuucagaaaaggcaauaaaugguccaacuagcgcuucuggcgaugaaauuccuaagcuaccgcguacucugggagaagaaaagacuaagaccuuaaaagaagacagcacucaagaagcagcaguccugaaugguguuucauaacugaaggaaguuccuaguuuacaguucuuuuacauuacaguuacaauagugcuuguacaagcuugccaaagauagaauacggaucgccagucuuacaucgcacuuucaguuccuccauuuggaauucagaaaggggagggauccugaagaaaucauauguuaaacauacuuugacaccuacuguguuaaaaauauaucaucagaugugccuugagaauaguauauguaacauuaaaaaaaguugcuggcuauaggaaauguuauuuuguuuucaaaauauggcagagauggggggaggugggugggguggggucccuaacguaauauucuuuaugaaagcauuagcugcuuuuguuacauuuuuaauaauaugcaaccacuucuucacccgaggaaaacuagaaugaagcagucuaaaauauuuugcacugaauuguaauuucuucauuaguuuagucuggaaacuggucuguuuaauguguuuuuuaaaugcuguuuguagaggcaauucugcagaccacuggaaauacauguuaacucaucugcagggauacugggugauauuggcagugacuguucuacauugaggcuuuguuugguuuauuuauuaaaguguacaguauuuaaaaaucaaacauagcuuuaguugaaacacuaagcugauuagucauguccauucagacauaaccugaacuacugaaaagaucaauuuccagaagguuuauucuguauaaacuacauguuuagucuucaguagaguacuuuucacauuuucuuucuaccuuuuuuuucuuuuuuuuuuucuuccccccuuuuuuugauuuugguuguuugaugugcaauauguuuuuguaugcagguaguaaaauaaacuuugaucuuccauuugcugauuuuuaacuuucuacuuguuaugccaauuguuucaaagcgguaggaguacuuacaggccgagaauagauagcauucuuugauugcuuuucagaagcauuuauuuuguuucucagaucuaguguuaaaaucuaaccauuuaaucauuuguaaugaacccuccagaaucuuaacacuuaagguuuuggcuaguaaaugauuuaggaaauguauaaugucuuugccauuagagaaacaucuuuguauuaaauucuaaucaaaggcaauuuguggaagauaugggaggcagaagauaagcuuuucacuuuugccuuuaguucuuuauuaaaaacuauuuuuaaauuaugguaagcaguuuuuaauaggccgauaaugugcuuuuugagugauaaaugacuuugaagguuuucguaccagugauugaaaaucaguaauuaaaaguuuaaagagcuuucauucggaagacuuaauuuuauuaagcauuuucagguggaaguauaaguuacguauacuuccgugauuguaaauuguguauuuauggacuuagggcucugcucccacuggacauguacuuugugucauuugaagguuuuuuuaugugcauaauuuguuaauuauguccauaaaaauguugagcuuguuuuauaaaugaaggauaauucacauauaguuuacaaacgggccauuagauguguguagcuugucacguacauucuaauugauauuaacaugcacggauacgagauuuuuuuuaaaaaagucuagauaguagaacuuugaagugagugauguacagugaaauucuugcacucuguauagaacagguauagcagauuaaauaucaaaaccucacuuucaaaguauugaaaacaauuuaaauaauuggcuuuuuaauuacuugguucuguguacauggguuacaaauuuaaccaugaguuguuguaacaaagagaauuuugugucuguugggacuugaaguguuuuaccauuaagcuacaucccuagcccacaaagaguuuuaauuuccaggcugggaaacaugacacuaagaaaguauaauucuuuuuauuuucauccauaaucagaauuccccaagaucuucuugucauaaagauuaaacuaucuuaaagaucaaguacagcugagacacuuggauaggacuuaguaaggauucuuuuuuuuguuguuguuguuguuuuuuucgagacaggguuuuucuguguagcccuggcuguccuggaacucacucuguagaccaggcuggccucgaacucagaaauccaccugcuucugccucccaggugcugggauuaaaggcgugcacaaccacgcccagcuauuuuuguuuuguuuugguaaggauuuuuuaagagcugagauuucauuaccugaaaauaaccccucagugacuuaacccaaagaggcacuaaagaauuguaagguuuugggcuuuuguuuuucuuacagauggauuagucaguuuuauuuagugucaguaaaaagccaccuccccagggcuaacaugucgauuuagguuggcuucugguguuuuggcugccagccugguuaaauuuuccaugcacauacuacacaaaaugugaaaucagaaaaguguauucugaaaaggaugugugcagcucaaagcacugauguagacaccaugggauuccauauaaaccugaacugagugaagugggaaugcaaauaaguuucuaauguggaauucagcagcaugucacuccaguggguucuuagugauuuacuuuaggugcuguggagucaaagcaagggagcuugcugaaaugaguuacuuuuaagaagugcagaugaugacacugggcuuuuaaagcagaagaacucaagcuuaucaggcacugagugagaggggagaagcacuaggugguuuacucuucugcauccuuccaucacccauaagccaaaacagcagcuacagcugacugccacuugacuuggccauuauauagccugaggaaagucuggaaaaguugguauguccucugcagacauuccaauuuuguuguggcucagaaauccuaauuagcauuccuaaagacuuggugugugugcuaaggaaaaguaaauaggagacuggcuaugugggaaggcacaagugaugucuuuaaaggaggauuacauuuuuuuauuacuuggagcuuuguagaauuugaaaaggauaggaugcuuauuuuaaaaucucauccagucuuaaugugcuuuuuuuuuuuuuuuuuuuuuauggcuuggagucccccacaccaauuucauuaccugcuaacagguuuguuuaaucaggguguugcuccuaaccuguuuaauacauggcaagaguuugcauuaaucuguugaaaucaauuccaguuugauauaggcagucuuugaguaagugguguuaacuugaaaguauguacuuacuauugguugaaacaugccuguuaaacuuaauuguuauuuauucuaaauuauuacucuucggguucaacaauggucaacuacugacaguuucugucaaauuaauuauacauuuuaaauaaaaacacuaggaauucgggaaggaguugguguuagccgucaaagcuggaugauggagguacaugugaauuguaacaaaaugccauuuuaaaauacuacucauuuuuggugauguuagggguugaggccagggcccugugcaugaaaggcuuugacauagcuuuaaacucccaguaaccuuccugccucaggucuucgugcaucgagcuaccaugcccaccuggcugcaccgaucgacuuagaugcucacuggcuuugacuuuuuuuuuuuuuaagauuuauuuauuuauuauauguaaguacacuguagcuguuuucagacaccggaaaaggucaucauuucccauuacagaugguugugagccaccaugugguugcaggaauuugaacuuuggaccuucggaagagcagucagugcucuuaacugcugugccaucucuguagcucccuggcuuugacuuuuuaaggauucuguccuacccuuccguguaccugaaaguacagacaaaccugacuaugguuucccaaaguccauugucuuaauucuucauuuugaaaauuugagauguuauaggugaaaagcacauaauuuugucaauuauucucuauaaucaggaggucuguacuagcuaaccuccugcuguucagauguuaauguaaggaaucuagagaugcauuuuaaccuuauguacccauaacauaaccuugugagugugaaaggauucacagugguguguuggguauguucaucccugauaguuccuguuaggcucaacacaaaaacuggcucccuucuuucucagccuggcagccuuccuacaccuguaucaguuggcuuuagccccacugccgcuaugucacuuaguggauuauuuuuaacuauuuugguaguuguaccauaaugauuacuaaaauuguucuguuuacuaaucuuguaguucuaaacaaacaaaaacuaguuacaagcuaauuaguauuuguuaccccaaaccuacauuccuuuggacuuguauguagguucugagguaacuucagguucucaggcuuggcaaucaguacuucacccagugagccaucuugccuugauuugguacuuuuuaagaaacguuauuuuaauuccaccaucaaggauacuucuaugguggcagcacuuacuaauagguuccagacuacaccauaccauagcucagccuaucauugggguagaggaauuaagagaagcacuagcaucccaucuuuagggccaacagucugcucuaagcagauaggcaaggaaaguaagggcauugauaucuccugcgcucaggguugcuugcucuagugucuuagcuacuugagcauauuaaauaucuuuaaaaccuagccugugauuugcuuuauaugcuguuguuuauacgcuacuugaacuugagugaaguuguaaauaucccauaacuucuaugaauaugaugacauuuaauguugggucucugaacuggaaaacaaucuuuauagugaucaucaccagaagauguguuauaaguucucuuuuguaucugagacugcacuauggucuggccccaaaucacuaucaguuauuugaagugaaacauuuucucauuuuauuuuuguuugcuauguaagauaugagguagggcauauuuaaaggauggcaguucgcggguuuaggguuuuuccuggauuuauuuuuuuaaauacauuuuuugaugagugugggacauuugugccagaggacauuuugggagauuucacuccauccucuccguuaguaacuugaguuugccaggcuugcgaguugucuuuacccacugagcuguucauuggcuguaguuucuuaccuuguugagcagcagcucauuguauuuuccccuuguacuugucagugguuuagaaucuacagauauaaaaggucucagauacaaccaugggccuucuggaauaguuuacaaaaugggguaguuuguguuccagcuuccuuaaguauuccuucucauuugcagaauggucaaaggcuggggaauuugcuaaaaaucaauaguagucaaagauaauugucuuucagcacuacuuggucuaguuggcauuaccaaaguaguaaaauuuuuagagaguaagcuacggcuucuauccuaguaaugucaacuucaaagguaagcuguggccaggaaccaaacuauaaaugagcaugaugaaauggaaaauccaggcccagaguuaauuguuccaccaugguaacccuuuugcucuucaaaauuugcucagcuaccuagggauugggaacaagcucugccaagaguauguauguaagcaugagcuaguucagucucuacauuguagucagauguuggacugcugccuuguaauccccagcacuggagacaggcaguguguugggaguucacugguuugucccccucccagccuaagacuuuaggucccaaugaaaccaagcuugaggacuuauguggagagcuuuccagguuagcuucuggccugcuguucucugaagcccauggccccagaugugcugggguguugugccacugaucuacaacuaucucuuugucgccauuuacaauucucuccaauuauaauuucugguagaaacuguagcaagugcuugccuaguuuauccuccgcauguuaaauauguucgugcaaaaaccaacuggaugcuuaacaugcaugaccaagaaacaugcuuaggugaguacaucagaauuuuaaaaaaaaaaaaaagcuacagaaacuaggaauguggaacucugggucugaaaaagaauccgauuuucccacugggccuugucuccuggagaagucacuucacucaacuuugguuugugguaaacaaagcacuuaagaaaauagaauuaagaagggucuuuuacaaaucaucuuaacagcccuuuaauauggagcucuuaaauguuaugccuaguagcuuuuaaucaaauacagucuucaacuugaaaagguuauguaagccuagagaaaauuaaaauuacuaucaaagaaugauuggcugugcuccuuaguaggaaggcuuucaaugauuugacacaccugucuucuaacaggcacacauagcuuuacaugcaguccuuucugcaguuaaugagugacuccuugugggcauuuuauaauauuuuucaaaaacuugcuuuuauauuguaaccaacucugccauaucauucauagaaacauuuaaaaauuuaaucuguguaggaguguuuugccuguguguguuuguaccauguguagacugugccuagggaggccagaagaugguaucagauccccugcaacuagaguuaacagaugauuuugaggugcuauauggguguuagggaucaaacuugggcagggcuuaguggaugagccauauuuguaauucugaauuuuuuuuaaauuuuauuaguucaaaggggcaaauaaaagguuaguaagccauaaugcuuuggauauccuccucaucuguggacuccuaaaguguauuuaccugcuugcuaacauaaaacuucaauacucaacacgcuuugcuggucaucucuaaugccauguguucagauaaggcauuagaauaugugcuguguuccuauuuguaauuucucuaauccuccuaacuauagugguuaaguacuauguuucucaaaacaagaaaggcuguauaugacaaaguugggcuacacugcuuccaaguuuacuauuacaaaacacauaaggcuuguucaaauagaagcaugugacuagagagccucacaaccuguuccccuaggaacaguuuuuuucuuuauuugcugugaauaagaaugagacauaccuuuggaccucccccccacccccccagcaugggggggauuugagagaguuaguuacauaaaauuucuagaaucuguaguuuucuucacacucaaacuuuaaggauuuuacgagagggugcaugauaggaaauaaccuuuagugaccuugagugaaucgaaacaccuugaucucugcaagccgagacauuagcucaaagugcacacaguguaaagugcugacagguuaagugcuacaggggccgcuggcuagggguuuuagcuccugaccugcacaggucagcuuacauacuuuaguauuggccgucuaacuugggugguuuauaguauguaaaauauuaaugguugagguugaaaaucaaaagcauuuaacugcugggauuaaagguguguguuacacuuggcucucaaguuuuaaaauugagggaauuuuacagucacauaagcuuggucauaacugaaaaucaaaacaaaggaacagcuuaucaaguauuuccaagggacuagcuaaauaacaaaauugacaggaucuauacacuggaagguuucuauuacagcuuuaauguagcugggugggcugacagagaucuacugccaaguggaucucuugaguucaaggccagaaugagcuacauagcaaguugcaagacagccagagcuauauaauaauugagacugucucucucucucuuuuuuuuuaaauugucuuaauuuaucaaaaucugaauugcccagugaaaaugccuaaaguacaguguucaaguaccuugggccaguuguaccuugaguuuuaccucccaaaggugagaaucccauuuucaauaguuaaugucugucucaauugacuguagugggguauucucagagcaaggccuuagccuuggaaaaauaacaagugccaaauuucuuugcuaagucagcaaugaacagcauuuauagucuaauguguguaaucauaauucuugaaauccuuaaguuugaacaaaauauaccaagacacugauuuagcuuuugccaagcaauuuucauggguuauagcucugaggcauuuuuauuacaaaacaugcucauaaguagacuaauggacuuaaaauucaucagauuacuuuauuuuuuagcuuguccuucuaguaagucuuuagcuucauugauuuuggcugcuauauaaggagauccuccuauagaagaaaggggaugggggagacacaguuuagagcacagauucuaagucuugucagaagcauuucaaggauuccaggguguaacagaaaugguaucuucauuaagaagcaacuaugauacuauaaauaugucucaaaauuaaaggguaaaauaucagaucgaugggaaaugagauguuuucacacaaaaguuuaccauuuuucagaaaucuuuuuuucagaagucuaaauaggauuuggcuccucccacauacacacuuaacagaacucuaugcuuacucauuacugcauauguggauauaauccacuguucuucccauaggcuucuaagcuaauguugaaagacuuaucuguguaccauucuauaaugcuucaguuuuccucucaauauuagcugacucuuuguaaugucaucuagauuugcugucuacuaaagugauggagcagugugguccuaacccuaucaaagaggggucaucaagaggauucugguagaauguguauauguggacucuacuaccauccagaacagaauacuucgaggucugcaagcuaaauucuuuacauugugaagucacauacuaaacaguucuauuuaaauuucaugugcaugacaacagauuuuuguggucugcuuaaagaaucuguucuuaccaguuaaagcuacuuugaagucuguauuugaauaaaagcaaauacagcucauagguuuccaaauaaguauucugucacaaguguccacacauuaagaggccccuuaaguuuuucuuaauuaaaauuuaaacuugguuauuuaugagucuaaacaaaaauaaugcaaaccuaaaaaguaaaacucaaaacauagccgaguuggggugugcuucuuaagcucugcuuuugggaaugagggaggguggucauaagguuuaggccaaccuuggauggccuaaaaacaaaccaaccaaaauaucuagcagaacuguaacccguuauuggaagacauucuaucauagacacagaaccuaaaaguaguaguaauguuuaccgcuccugccaaaucacaguaguucuuacauuguuguucauuauaucuuuauuuuggugagacauggugucacugcagagaacgucaccauauguacugaauuucacuuaagacacuacaaugugauccacaacugggaaacugcucacacacagacauucauaacaccaagaauuagcuauuccauuaacaguccaguauaguaauaaaaguugcuuacccuugucugggugauuuaauagcauaauccggcgaugagcaucccugaucuucccuuuauuggcaguagggcuaauuugaaaaggaaaacauacuuguugcuuuaguuugcuuuaagaaaacaaaacaccaugaacuauuacagaagugaaguuaaacauugagaacaguaaagcaacacaacugagaagcugugugugagacaguaaaaugugcuucguaagaaccaaaagugcuuuagauguaguuaacaucauaacccucauucaacgcuuaguuugcauuccagaguagacuuuagauuacuccaggcagcagugagcacugucccaguguuacacgugugaguucuauccccagcaacuacuucauucucaauuacuacuaggaauuaccuuacccuacaucucagaacugaguagacaucuuaccuuacaccuaauauuaaugcugcuucccguuuugucauuuuggguucaaauccaccucuguaguacccaccaccgaaugccugaaagaaauugaauuggaagaaaagauuaaugaaguaaauggaaguugguuaaaucuguaaaagaagugguacauuucagggaaguacaaguguacuucccaaggcacuuuagcuugaccagggguagccaacuauuuuaagauguguuaaacacccauuucuugcaacuaaacuggaacagugucuugagaacauaagaugggagggggggaggggagaugagugaauggcagccacucucauccauauuccagacagaaacuugauccccguaaaacaggaguuucaaaaggucucaaaagacgaccuggagaucucgaaaagauucaaggcaacaacuaaaauaagacuuuaugguagggacauuuaugccaucagaaucuuaaccuuaguagagaucauguacaacaaggcccuaugcuccugcccaagcuccaugacauggccucucaaaguccugacuagcagcagcuuugugcuuuacacccaguucagagccguuaucuaacaucgcugcaaagcuauccuaugugacaaaacacgagggaaggcagcuggacagauaaaccugggucaacaguauauguaguaaaauuaauugcuaacuaccugcuaucguucuaaaucugcaaaggccacccacccucaguugucacaugugaaaaccaacucccaguguggcccauugcaagguuuacaacuccacacugagcuccauggaccuguggaauucaccuuacaggcaagcuccaggcuucaaauacaggcaaguuaguuagcaagaagguucacuuacagauuuugguaggcucugaaaaacuuguuuuacuugaggcuccacaugcuucauggcuuguaaaacauaacggccuaaaaccaaaagcaacagaauaagcaaauccaugcauaaccagucugcuccacccccaacccacagacaaaccugcaaauccugcagcagcaauggucaacccgacugcuaccacugugcuggccuguaauggaggagaagagcaagucuuuacuacucuuaauugcuaccuauuccgcagccaaacucauuacgaccuucauuuuggugaaagguggguucuuuuucccuuuuggggcaggauuagggauggaaccuagugugugucucaugcugguaaggugccuacaacuccagccuuucucaaaguuccaacacuuuuauucugagguggagucuugcuaaaauuguccaggcugcccacgaauuugcgacuagcucucuaagcaacugggacuuuacagagugcagcacagggucugcuggaagaaacauuuuuuuuucuaauagaaauaugucuuuaaaacuacugcaguuggacguggugcacauuggcggcuugcauuuaguccccggacuugggaaacauuggcaggugaauuucuguacguucugggacuuccaggacuacaaagugaaacccuguuuaaaaaaaaaaaauuaaacuacugcaauuuuuauccacaauuuauugucagaguaugggauuuucaccaagaagaaaaggguaagucaucuuuacccacaacaguaagauggugauuuuucagccauggaagagaacuuuaacccuugggcauuggaaccccuuucuaguuuagacaagaccggugaaaauaagauuucugcuggauuuggaaacagugcuugcaaaggcucccugaucccauaagguauuuccaccguaaagaggggaggagugcggagaugguagugggguaacagcccgaccuccuaggaggcacaaacgugugccugccugcaagcagauaaggggugucagcuggagccaccggaggccggaguaaaggucagucuccguauccgcccagcgccccuucggagcccgucagcgccgaccacucaccaugacuccacuccgcggcucggcaccgcgcgcucaucccagcgcgagcccaccgccacgguacagcuguggagaacgacagggccgagccagcgaugccgccacuuccacuagcgccgcgcaacacggcagcggcgccguaaagugcgucggaacugucgcacaaagug

SEQ ID NO: 1390 - RNA, 7729 nt, Mus musculus
cuuaaacagauuguuuuuuucuuuaauugaaaggcacaguagucaauacuacauaacccaaguauccaccaacggaugagugaauacacacagugugagaugcaguggaauauuacuuagccauaagaggaguagcauuccgaccccugguacucaaugggugaaucuuuaaaagcacuuugcucaguaaaauaagccaacugcaaaggaagaaacccuguaugacuccacucccaugagguagguaggacagacgagucacagagagugggaggagagucaagguuaucagggaaggggugagaaugaaaaccugcugcugaaugggucagacuugccauuuaggauaaagauggguggagacugucaggcucagugugauuagcacuggucagcucagacacuuagcaauggugccuguggugcuggugggugaggccgguacuggauaugcuaaguaacuugauugaaucugauuugauuuuacgaauuggguuagguuuuuuguuuuuugguuuugguagcccaggcuggccugaagcuugccuugucuucuugccuccauccccuggugcugccauuacagcuuguguuguuacgaagguugagcuuucuuugaaugugagcccgacacccgugagcuggucgaguugcucuccacagacacacgagacaucgcaaccaccugaaacagagaaaaauaacucuaaagugguaaagacggcaguuucauauuacguauaucacauuagauuacaugaugugccaaaaagaaauagaggaacuauuuuuuaacaugugugauagauaaaagacaagaagucccuucugggguggagaaaugacucagcaguuaagaguauuuguagauuuugcagaaggcauggguuuuucuucacaagcaacuacauuggacuccucacaacugccuauaacuucagcuccaguggaucugacaccuuuuucuggccucugugucccccugcaagcacaugaacaugcaugcacacaugugcacauuuauuaaauuaaauuaaggauacuauuaauauuuauaaaauauuuaacagaaaaaaaucauaauauuaaaugagaaguugauaccuagcuaucucaaauaaguguaugugguguuuuuuguuaaaguacuagagggcuggagagagaaaugguucaguaguuaagaucccugacuacucuuccagagcccugagcuuugauugugagcaucuacauggcagcuaacaauuaucuguaacucuaguucuaagggacuuaaaaccaucucuggccucuacagguuccagacacacaugugaugcacggacauauauguaggcaacgcacacauaugcauagaaauuuuaaguauuagauagaaagaacuauaccaaaaagcuaaugacuccccuaaggaacuaauauuauauuguaauauuuuuuugucaugguuugccuaaaugucccuuaaaggcccacuuaguuaagcuuggugcuaucagguacaugggagaaaucuuaauggaaaauccccccaucacaggggacuggcccgugggggauacugcugcucagcccuuccuggcucucaggucuccuggcuguggagaacaaugugugaacaauguucuauuccacaugcuuuccucaagauguguguagacaccaaugagucaugaaucauaagcgcugaagcuaagcuggagucagccuguccucuucauaaaugaucauuaaagguuugcaggucacaugacagaaagcugacugacccaacuguaucuagacuuucuaugguaaaaccaucuagcuacaugcaaauguaagggcaaaauggaaaucaguauacuaggccugguuaaguuuuacacuugcaauccccacagcagggaggcugagcuaggaggguccuggaaaguuuaguucaaggucauccuugucuuucaacaucauccuggucuaccuaucaagacccucuuugaaaaucaaaaguaaaauaaagagaaacauauaguguuacuggagccauauuuaguggccgugguaguccuggagcaucagcagaagagaaggagacaugcugaucuugcacuccccuccccugagagacuggaggcagcauuagccuccgaagcucucagaugaugagaagccugagcccaucccacaccuagaugcuaucagcugggcauuggggcucagggcuagugcagugugcucccagcugcuguguccuuacaaggcuacgugagagugggaacucacacgcuuaccucucagcugugguugaguccccauaugagugaccuagaaaugauucugucuaguuguuggcauuacaauuuaaggaaaaaugaaaaaauaaagaauugucaccaaaaaauccauaauuguauuuaaauuaaacuuauauaaaugugcaaacaguuaaauaacauuuagcuuuacauuuccuagguccugucaucccucgguaccagugaaggacaggucuaggaauuuccccagauuaucaaacccagguguugucaaguucuucuugggguagcauaguauuuccauagaaccuguauaagcacccauaucccuuauaggucuuuaaaugauuuauaauaacuaguacaacauagacaucccacauggaauuuuuauacuguguaguuuggaaauuaaggaccaggacaaagcauugcacaaagauggcagaauguaggcaagagcccugacuuaggagaaggcugagucugcaugcaaugucauucuugaggaauugguguaguacuuaagguguggcuaauccaaggccuauuuuugagauauuucuaaaaauauuuaaaguacuuuaggccugcaguuaacuaaauacaagauacagauauagaugauaaaauguggcuuuuuccauuucaaaaaagaaaaaggagaaggaggaagaggaaaagaagaaggaagaggaggaagaagaggaaggaaaaggaggaagaggaggaagaggaagaaaggaggaggagaagaggaagaagaggaggaagaagaaggaaggcaggaaagaggaggaggaagagaaaguugucaucauguccuacuuucauuucugucacugugauaaaguacccugacaaaaguaauuaaaaccgaaggcuuugucucagcucccaguuucuggugacagccuaucacaucagagauguuaaggcagaaacucgaagcagcuggucacaucgcaagcacagccuuuucccucugaugcuugaucccauaaaaucaucucuuuaggcacuuccuauucuuacccuuuguucugauucccuauguuaguguuuaguagauugagagcauccaaugagagcccauuucucacccucuguaucuguaaaaucuaaggagaaugugaguguaaugauggggcaagcccagccugugaggaaggccagcacauguccucccucguuuaagaccauaugagcuguacuauuucucuugcaguccuucacuucauacaucggaugagauuauuucgguauuugaagagauaaaaacagcccaagcuucacagaagaaaugcaaaggaauuaguccuacucaccauuaacaaaagagcuagguguagacagagcaggaggcaagguggacgaggggaaguuguaguagucacuuguccugccaugacaaagaaccuaaugaaagcaauuaaugcaauuaaagaugauuuggguccccaguucaggcuacggucacagcugcaggagcuugagcagcuggucacauggcauccaaucaggaagcagaggugugguugcuguugcuugguuugcuuauccagaccacggggugguauugcucacauacagguuagguggaagaccuucgcaauuaagaccagcccaguuaaccuaauccagaaaccccaucacauggcucguauuuguuuccauggugacucuaaauccugccagguugacagucaagaucaaccacuauaagaacucacacugagcagugccuucuggaagauuccuucuaaaggugcagaguuaaguagccuccuguucuuccaugacacccuuguuuuccaaaagcaacaaaaguuuuguugcuuuuguuuacucaguguuggugugugugugugugugugugugugugugcuguggugugcaugggggugucagaggacagcuugccagagucaauuuucuccuuuuaccaugaagguccagggaucaagguugggucuucaggcuuggcagcaagcacugcuaaccacugagcccucucaccagccugagauuaauauuuauauuuuuguguugccugugacuggauauguuuugggcccuagggaggaggagugagaguggacucccauacugguccaccugcucacacaaaggcugcauagacugacauacucagucacagaaaugacucugcucaucagagguggcucugucugagguucaugcagagccaccugaaggacccugccaaauauccaacuauguuuucauggagaaaugagauaaugugguauuuuaauucugcauuugcaacacucauguguuaggcauauucguguaaauggguaccaacuuugaauacucagguauaaacauuuuuaacaagcagagaggcuuaaaauccuaaagggccugggcucugaccaaccucuggcaggcauuuaucauggauuaucagauuggaaaugcugaaaaucuccuugugggcuguguugauuugcagguuuuuaaccuggacguguaacagagcgaugcuguuacaggccugccaggugugauuagaggcccacccaggggauuguauuaauaccaaaaugacuuggcuuuucauuaaucaauuaugggcuucuuuauuuaagggacucagggaguggguaacaguggaaaaucuauaaggcuuucagguguuuuucuuaaaucuugcuaaaacgugaaaauaacagcuaccuggcauggagaggaagcgaaaucuacuauuuuaauucuaaaagaaaauuacagguagcuuaccuccuaaagcaguggucauugggucacaagaggcacugggagaguggauuacauccucuggccccuugugacuucagagagacuuagcugcuugcauggcucggaugucgugcugaggguacacaaugaugaagggcccgccacauguauguuuugaugcugagugucagcaggaaggcagcacugcaugggaaauggugccccuuauugacugcugugguuuggaagugaaaugucccccagagacuugcauguuugaacacuucuucuccacuugguggagcuguuugcaagauuguggagccuuuagaggagaaagccuagggaaaaggaaguaagccacuaguguuaggggugaggcuuugaagcucugugucuggccccacauccugaguguagaugcaauaugauuggcuugucucuugcuucugcccccaugucuuccaugcaugauggguuuugucccucugaaacugugcgccaaaauaaaguccccguuaagcugcuucugccaggguuguguuaccauagcaacagcgaaaugauggacagugguggugaugcuuaagacacagagcugaagagugugaacuuguuccucaaagcucaucagcugcugucaaaacaaaacccuuugcaggaggaaauaucacauuugucuuuuacagucuuucucccgguugauaccucuauagcaggagaaaauaaaguguugcucagagauaaacauacuucugugaauuaacaguuuaacuucacacugauuagacuacucaagacacaaaggauaggacuuaggcgugggaagaugacuccaucaauaaagugcuuucugacuugaauuaggccuucuaauguuguguaaaaagccagguuugggggugcaugccagauccuugaauggggggcgggaaucucuggagcugacuggccagcaaauccuugaguuccaauuucagugaauaggccuuaucucaaaaaguaagauagauggcgauugaggaagacauuggacaacaacaaugccuccacacacauguccacaaaacaugcauacauguaugcccacacccauacacagaaaacuuaaaaaaguccagcuuggucauugugaaaauaugcaaacaagcucaaugauauauguaugugcuuugugccaaguaaggaccagguaccuuuagggugucauaagcccugggugacaucagaccugcuccacggauaacaccaggcagugugaaauucauuugcagucuuuaccuagaaaguacaacuuugaaauuguagucaaaguucauugauaaaagagggagccacgugcaugaucaauacacguuuucucguauugcugugacaauacaaggacagggaacccuaacaaaguaaugucaaaugcuguggaguccguaaccacuugcaagcauuugcugcuugcugagcacguguuguuuguggcucauucuugacuccuacagcacugucaaguucuguauucugugggacaaacucugggcuuuggaacuaguagaacuuuggagaguuaaacacuaggaguggacuggccagaguuaccuauucagguggugagaauauaaacacagggcauucagguuagucugucugcaucaccauacgucaugcaccucccacccaucaucugucuacugucuaucaucuguuuguauguaccuaucuaucccauauguguguaaguauauaugcauacguguauguaugcauguacauaugcuauaaacagaccggauggacugggcaucugcauggcccaguuugcuuaccucagcugagcgauauaauucuagcucauggccuccuacagccuuugcucucaaaagaaugaaagagaguuccagaagccuguguacugggcuaaaaaccuguugccuacaguuucaguuuguuguccacuugaggaaauaguggaagcuggcuccuaagaaaacaguagucagaaucacagcaaugcacauagggucauuuuuccaaguagaagauagagaggugacuaaagaagcuaaagagacaaagacagaaguugcugccacuaaagagauggggagaugcauucgcaacaauuuucuaggucaucccugggcaucucuguaguguuuucuuauccugucucugcgggugggaaacagguuucugagguauugaaaaugauggccagagguaagccauuuccaaccaucagacacagagagccuauuaucacaagccuuaggcaaccuccauucagucuugaggcccugagcucaagauccugauccuguacguccugucugucagugaccucaggggggaacaauuuccuuaggcauaucccgcacacacugaugaugccacaucucaaaggagugaugacuuacccagagaaaccguaagugaggcagaacugaaaggcugcuguuaagagacaguuugagacagugaaagguccucccagagcauccaaaccucucuuugugucccaaugcugagggcuuucugcagcaaucugaaagaaacucaacgaaggaaaccccacccacuaaagucuccauacuugcccagucgucaucccggccacaugaucaucagauucccagagacagaguucccacagaccgucuguccgcugaguuaaucaguccagcaacaaaaauuucuucaggaacucuccaucacuggcagguuuuccu

SEQ ID NO: 1391 - RNA, 3725 nt, Mus musculus
cauugggcugagcacggcuugcauuuuauaagacacugcaaaaaugccuucuccauugguuuaccagucuuauuuauuuuugaaguuaagcuuaguugauaaaaacauaaagacuguauguaucagaagguaacagaguguuucaauaccguauacaauguuuaaaccugacuuaaacuuguaacucuccuuaaacauuuguuauuauucauauuguuauuaauugggccuuuuagagccaaguucucauguacuguagcucagguugacuucaaauucacuaugcagcugagaauggccuuugaucauucugcuuccacuuccgggauuaugaguguauaccaccugccuggccuguauuauuuuccuuuuguuuucacagugucucuauacagucuuggcuggaauagaacuugcuaugcaaaccaguuggucuugaacuuucaguaauucuccugccucuauacuuguugguaaaacuuuuuuuguuguuuguuuguuuuucgagacaggguuucucuguauagcccuggcuguccuggaacucacuuuguagaccaggcuggccucgaacucagaaauccgccugccucugccucccaagugcugggauuaaaggcgugcaccaccaagcccggcgguaaaacuuuuaaaaaaccuuuuugucucauugugugaacuguaccacaccuuacuguugccuggaaccacccugcucgauaaaggcauccaggucuucuugcuccaucuaauuuuucauccacagcuguuacguggggaagagcauuuuguuuacuuaaauccccacaguggaggucuugugagaugacccagagguuaagagcccaagcugcucuugcaggggaccuggguuuaguucccagcacggauauggaagcucaaaauaauccauuauuccaguuccaggggaaccacugcccucuucuggccucugugggcacuaccugcacacaauacacagauacucaugcaagcaaaacacccaugcacagaacauaaaauauaccuuaauuauauaaccuuaauuauauaaaaauuugcaguguccccaggcagcuccaugcuaguuuacuucuuuguuuaacuguuauacaauuuaggaaauucacaaucuaaauuggaacaaugucaugcaauagcuuuaaguuuuuaagcuuuaucagagaaauacguuucuuuagucugcuuuaaaaaucuagaaucgacuguuuuguauaaaacuguugcacccccccccuuuuuaagguguuagacuuucagcugcuggagggaacauuuugaauucuguuuaaaaacacagcuauuauaacaggcuaacucaguauccacaagaaucaggccucaacaacuaugcagaguaaugugccguaaguuccaggauuuuguuucuaaguaggaagucagcaugggagagauacacauggacaccugcuuacccaguuccacucacaaagccaagacaggaaaucacaugagaagguaaagaaaacgaugucuauacacauaugcauacacuauacgccauaaaacauaaugucuuauucagccguaaauagugaaauuacucuauugacaggaaaauggaugacagaacaggagcucauccaggugagaagacucagcuggagaaagaaaggauggcaaaccaacucaacauaaagggcagacuuccgugcaagaggccguugaggagugggauggggggagucaggagcaggcaggcuuuaauuaguuacgauucaugaugagcacauagugaauugcaccaacagagaaauagcaugaucacuaacguccuuccuaaagcgaaaacucacuaaaccguguauguauggaaggcgugguaugugugugcuguaugugcaugcauggaauucguguaugcuguaugcguguguaugauguauguguuugugcuguauguguguacuguaugugcaugcauggaauaugugugcuguaugggcaugcauggugugugugugcuguaugugcauguauguaauguauguguaguauguguguauauaguaugugugugcuguauguguaugcaugguauauguaugugcuguguguuuaugugugauauguguauagugaguaugugugguauguguauuuauaugguauguauauauggcauguaugcauguguugguauaguaugcauguguugaguaugugguaugucuauauguaugguguguguguguagcauaugugugacauguaugugguauguguauauguauauauauggugugugugggacauauguauguguauaagcguaguauauaugugguguguuugugugugugguguauauguuuggcacacguguuuguguguguguauauuaugcauaugugcuuuguguguagugcaagugguaggcggugucaagaggaacagccaccucacggguacgugacuccuuacugauccccaaugauggcuucagaugcucuauaaagccagaaucagaacucccagcagccuccacauccuaugcaguaaagcaagacaugcugaacaccaaggguaacugcaagccucugguccuugcuacacuuucugagugcuggcacuggagguuccaagguccugcuugguuuucgcaugucagggaucaaagucagggauccaugcauucuagguaaacauucugcuaacugaacuacacccucaacccaauugucuuugcuuuuugaagcagcaucuugcuaggcagcccaggcuggccucacauuuccaagucucucgaguacuagaauucuaggcacaugccaccacacugagcuugguuuagaauaucuuuuuaaagaugguauauagucagguguuguggcacaccccuuuaaucccagcauccagaaagcagaggcaggcaaaucucugagauucucaacugcccuggccuauauacagaguuucaggcuagccugggcucuguagugagauucugucuccaaagccagccagcaggucagccaguaagcagacaaacaagaaaccaguggaaugaaacaacuccccaaggccucaguaaacagaaaguaaagauguuacauaaacaagagaaacaaaaccauaaagugagaauuggaaauuaaacuugaucucuucucccucuuccuuucccuccuucccucccuucuucccucccuccuuccuuacuucccucccucccucucuuccuuccuuccuucuuuccucucucuuucuccucucuuuucucuccuucugcuuccuaccaugaauucaaauuggggaguguucccuuaauuucacaagucgcucaggugcucgggucuauggaagcagagguacacucacucagguugcuguauuguggacucagugcgaguucuguuaaaucuauggaagccaagaguggacaugaagaauuucuacuuuggaacagcaucucccagcagcuucuacagagcagagagcaggccuaaugggggcagcugaaugcauggaacuccccagcagacccaaaagcccccugcguagauccaucucugaacagaacaguggggaaggcugucgcuuaaggcgcaggacacucaaggucacaaaugguguugaggccuccaguccacgacucucuuuuuguugcuuuucuuaugugcgguuugcggucauuuaaaaaccacuucucuaacauaugacaauggaauaaaacagcuuua

SEQ ID NO: 1392 - RNA, 636 nt, Mus musculus
aaagcagaagcugacuacgcugacuacgcagccccagaucaagcacgcuccagauaauucucugcacucagcgccgaggccaguucugccacacagcacccgccccugccgccaccgggggcugcggcguucccugcgccaucucccgccgcccgggacugcagcggggccgccgucaccuuucgaaggcgcagcacguggucccaacacucggcggggugcacguuuuaaacccuaagacgccagcuucagccacuguggcgcccuuccgagggccucugcugaccucgagguucuucugcaaaggcccugggugcuggugugcucugagggagaaaacaaucgagcuuagaaaagaauguucccgagucucugaccugggcuccccccgcccucugcggugccguacucccagcgcgagauugcaguguaccagggcucgggugagacaaaaauuggcaccaaggcggaagccugcuuagcgucagagcccgagguugagauauuaacaaaagacgaggugccuaggagugaagucugugggguuggaccgccuggggugcaaaauucagugucuaaauaaaaucgugcgugcggggggguggggugacaauuaaaaugaaacaaaaugcgaaa

SEQ ID NO: 1393 - RNA, 1246 nt, Mus musculus
cuucuuccuccuccuuuuuucuucuucauuuuugagacaggguuucucuguguagcccuggcuguccuggaacucacucuguagaccaggcuggccucgaacucauagagauccuccugccucugcguccugagugcuaggauuaaaggcgugcgccaccacugcccaacgccuuuuuuuuuucuuuuuuauuuaaagaaagaauauaaaguugugucagcuguggggaaagguuuuguuuuauguguguguguguauguguucugcuuugauuuuguuuuuuauuucucagagagagaagaacaugaaguugggucucuguugggugggggucucuguacuggcugguuuugugugucaacuugacauaagcuggaguuaucacagagaaaggagccucccuugaggaaaugccuccaugagauccagcuguaaggcauucuuuuaauuagugaccaaguggggaaaggccccuugugggugguaccaucccugggcugcuagucuuggguucuauaagaaagcaggcugaacaaagcaggggaagcaagccaguaacuaacaucccuccauggccucugcaucagcuccugcuuccugaccugcuugaguuccaauccugacuuccuuuggugaugaacaacaauguggaaauguaagcugaauaaacccuuuccuccccaacuugcuucuugguuaugauguuugugcaggaauagaaacccuaacuaagacagaauggaucugggaggaauugggggaaagaacagagucuaacugagauacacuguaugaaaacauaaaguaaaauagcacaaguguagugcugcaagugcuguggaggcagaggccguccaagaauucaaguucccgccagccagagcuacacagugacaccccaucucaaaaaauaagauuauccaccuuaaaaaaauaugggccaggugguagugguacacacuguuaauccaagcagucgggaaaggugggugaaucucugugaguuugaggccagccuggucuacagaacaaguuuugggucagccagggcuacacaaauaaaccaaaacauauauauauauauauauacucuagagagauggcucagagguucagaaguccugaauucaauuccuagcaaccacaugucaacuaacaacugucugaaauaggaucugaugcccucuucuggugugcaaacaucaaugcagacaaaauaccuauauacauaaauaaauaaguugua

SEQ ID NO: 1394 - RNA, 824 nt, Mus musculus
ugaucaaggcccacaauuuuacuaagagaccguguuauaagggggaagcccccccccccccccgccacccgccaguccauccuuggugcuugucgccaugcugcaugcugucaacacuuggucaccaggcugguugcuuauucaggaaugucucaggaagacagguucagccuccuggcagguagcagaagagcaggacaguugucacuucaaaaaggagccaaccaagucggaaagcugcaccgcagguggccccaccccaguggggacaaggucugcaccagccagcuucaggcugggggaggcuauaccucaggaagcauuugucacacaacagguuuacacagugaguucuaagccagcuagugcuacacagcaaggcccuuuuccagagagagagagagaagagagagagagagagagagagagagagagagaguuaguuugucuucccuacuuagcucccaaccugaggccccacacuuggucuccucuggagacucacauucuucacccuacacccuccaagguauacucaagguugugcacauuauacagcuugcaaaaauguaagcuguuaggaagccuucagcagcucucaggcuccagguacagacugaagcacaaaggguccuugccauugugggcagcugcuuccuguguaugcgaagccuguuguccaguccaggucagagcacucugccccaauacaccgugacuuuccugccuuauuagccucgguuagucccucugccugaaguguccugauaguaccuucucuguucuccacacggcagacagcuguccuguaguuaaacugucac

SEQ ID NO: 1395 - RNA, 824 nt, Mus musculus
gugacaguuuaacuacaggacagcugucugccguguggagaacagagaagguacuaucaggacacuucaggcagagggacuaaccgaggcuaauaaggcaggaaagucacgguguauuggggcagagugcucugaccuggacuggacaacaggcuucgcauacacaggaagcagcugcccacaauggcaaggacccuuugugcuucagucuguaccuggagccugagagcugcugaaggcuuccuaacagcuuacauuuuugcaagcuguauaaugugcacaaccuugaguauaccuuggaggguguagggugaagaaugugagucuccagaggagaccaaguguggggccucagguugggagcuaaguagggaagacaaacuaacucucucucucucucucucucucucucucucucuucucucucucucucuggaaaagggccuugcuguguagcacuagcuggcuuagaacucacuguguaaaccuguugugugacaaaugcuuccugagguauagccucccccagccugaagcuggcuggugcagaccuuguccccacugggguggggccaccugcggugcagcuuuccgacuugguuggcuccuuuuugaagugacaacuguccugcucuucugcuaccugccaggaggcugaaccugucuuccugagacauuccugaauaagcaaccagccuggugaccaaguguugacagcaugcagcauggcgacaagcaccaaggauggacuggcggguggcgggggggggggggggcuucccccuuauaacacggucucuuaguaaaauugugggccuugauca
